United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 14

SEQ ID NO: 210211 - DNA, 20 bp, Artificial Sequence
  Description of Artificial Sequence: Synthetic oligonucleotide
  Target: ATXN1; (-) strand; PAM type: YTN; PAM sequence: TTT
actgtctgtaatactcatac

SEQ ID NO: 210212 - DNA, 20 bp, Artificial Sequence
  Description of Artificial Sequence: Synthetic oligonucleotide
  Target: ATXN1; (-) strand; PAM type: YTN; PAM sequence: TTG
tgtgatatgatttactgtct

SEQ ID NO: 210213 - DNA, 20 bp, Artificial Sequence
  Description of Artificial Sequence: Synthetic oligonucleotide
  Target: ATXN1; (-) strand; PAM type: YTN; PAM sequence: TTT
gtgtgatatgatttactgtc

SEQ ID NO: 210214 - DNA, 20 bp, Artificial Sequence
  Description of Artificial Sequence: Synthetic oligonucleotide
  Target: ATXN1; (-) strand; PAM type: YTN; PAM sequence: TTT
tgtgtgatatgatttactgt

SEQ ID NO: 210215 - DNA, 20 bp, Artificial Sequence
  Description of Artificial Sequence: Synthetic oligonucleotide
  Target: ATXN1; (-) strand; PAM type: YTN; PAM sequence: TTC
cattttgtgtgatatgattt

SEQ ID NO: 210216 - DNA, 20 bp, Artificial Sequence
  Description of Artificial Sequence: Synthetic oligonucleotide
  Target: ATXN1; (-) strand; PAM type: YTN; PAM sequence: TTT
ccattttgtgtgatatgatt

SEQ ID NO: 210217 - DNA, 20 bp, Artificial Sequence
  Description of Artificial Sequence: Synthetic oligonucleotide
  Target: ATXN1; (-) strand; PAM type: YTN; PAM sequence: TTT
tccattttgtgtgatatgat

SEQ ID NO: 210218 - DNA, 20 bp, Artificial Sequence
  Description of Artificial Sequence: Synthetic oligonucleotide
  Target: ATXN1; (-) strand; PAM type: YTN; PAM sequence: CTC
attttccattttgtgtgata

SEQ ID NO: 210219 - DNA, 20 bp, Artificial Sequence
  Description of Artificial Sequence: Synthetic oligonucleotide
  Target: ATXN1; (-) strand; PAM type: YTN; PAM sequence: TTC
cctcattttccattttgtgt

SEQ ID NO: 210220 - DNA, 20 bp, Artificial Sequence
  Description of Artificial Sequence: Synthetic oligonucleotide
  Target: ATXN1; (-) strand; PAM type: YTN; PAM sequence: TTT
ccctcattttccattttgtg

SEQ ID NO: 210221 - DNA, 20 bp, Artificial Sequence
  Description of Artificial Sequence: Synthetic oligonucleotide
  Target: ATXN1; (-) strand; PAM type: YTN; PAM sequence: TTG
atatttccctcattttccat

SEQ ID NO: 210222 - DNA, 20 bp, Artificial Sequence
  Description of Artificial Sequence: Synthetic oligonucleotide
  Target: ATXN1; (-) strand; PAM type: YTN; PAM sequence: CTT
gatatttccctcattttcca

SEQ ID NO: 210223 - DNA, 20 bp, Artificial Sequence
  Description of Artificial Sequence: Synthetic oligonucleotide
  Target: ATXN1; (-) strand; PAM type: YTN; PAM sequence: TTC
cttgatatttccctcatttt

SEQ ID NO: 210224 - DNA, 20 bp, Artificial Sequence
  Description of Artificial Sequence: Synthetic oligonucleotide
  Target: ATXN1; (-) strand; PAM type: YTN; PAM sequence: TTA
tgattccttgatatttccct

SEQ ID NO: 210225 - DNA, 20 bp, Artificial Sequence
  Description of Artificial Sequence: Synthetic oligonucleotide
  Target: ATXN1; (-) strand; PAM type: YTN; PAM sequence: TTT
atgattccttgatatttccc

SEQ ID NO: 210226 - DNA, 20 bp, Artificial Sequence
  Description of Artificial Sequence: Synthetic oligonucleotide
  Target: ATXN1; (-) strand; PAM type: YTN; PAM sequence: TTT
tatgattccttgatatttcc

SEQ ID NO: 210227 - DNA, 20 bp, Artificial Sequence
  Description of Artificial Sequence: Synthetic oligonucleotide
  Target: ATXN1; (-) strand; PAM type: YTN; PAM sequence: TTG
gttttatgattccttgatat

SEQ ID NO: 210228 - DNA, 20 bp, Artificial Sequence
  Description of Artificial Sequence: Synthetic oligonucleotide
  Target: ATXN1; (-) strand; PAM type: YTN; PAM sequence: TTT
ggttttatgattccttgata

SEQ ID NO: 210229 - DNA, 20 bp, Artificial Sequence
  Description of Artificial Sequence: Synthetic oligonucleotide
  Target: ATXN1; (-) strand; PAM type: YTN; PAM sequence: TTT
tggttttatgattccttgat

SEQ ID NO: 210230 - DNA, 20 bp, Artificial Sequence
  Description of Artificial Sequence: Synthetic oligonucleotide
  Target: ATXN1; (-) strand; PAM type: YTN; PAM sequence: CTT
ttggttttatgattccttga

SEQ ID NO: 210231 - DNA, 20 bp, Artificial Sequence
  Description of Artificial Sequence: Synthetic oligonucleotide
  Target: ATXN1; (-) strand; PAM type: YTN; PAM sequence: TTC
ttttggttttatgattcctt

SEQ ID NO: 210232 - DNA, 20 bp, Artificial Sequence
  Description of Artificial Sequence: Synthetic oligonucleotide
  Target: ATXN1; (-) strand; PAM type: YTN; PAM sequence: TTA
ttcttttggttttatgattc

SEQ ID NO: 210233 - DNA, 20 bp, Artificial Sequence
  Description of Artificial Sequence: Synthetic oligonucleotide
  Target: ATXN1; (-) strand; PAM type: YTN; PAM sequence: TTT
attcttttggttttatgatt

SEQ ID NO: 210234 - DNA, 20 bp, Artificial Sequence
  Description of Artificial Sequence: Synthetic oligonucleotide
  Target: ATXN1; (-) strand; PAM type: YTN; PAM sequence: TTT
tattcttttggttttatgat

SEQ ID NO: 210235 - DNA, 20 bp, Artificial Sequence
  Description of Artificial Sequence: Synthetic oligonucleotide
  Target: ATXN1; (-) strand; PAM type: YTN; PAM sequence: TTT
ttattcttttggttttatga

SEQ ID NO: 210236 - DNA, 20 bp, Artificial Sequence
  Description of Artificial Sequence: Synthetic oligonucleotide
  Target: ATXN1; (-) strand; PAM type: YTN; PAM sequence: CTT
tttattcttttggttttatg

SEQ ID NO: 210237 - DNA, 20 bp, Artificial Sequence
  Description of Artificial Sequence: Synthetic oligonucleotide
  Target: ATXN1; (-) strand; PAM type: YTN; PAM sequence: TTG
tcatctttttattcttttgg

SEQ ID NO: 210238 - DNA, 20 bp, Artificial Sequence
  Description of Artificial Sequence: Synthetic oligonucleotide
  Target: ATXN1; (-) strand; PAM type: YTN; PAM sequence: TTT
gtcatctttttattcttttg

SEQ ID NO: 210239 - DNA, 20 bp, Artificial Sequence
  Description of Artificial Sequence: Synthetic oligonucleotide
  Target: ATXN1; (-) strand; PAM type: YTN; PAM sequence: TTT
tgtcatctttttattctttt

SEQ ID NO: 210240 - DNA, 20 bp, Artificial Sequence
  Description of Artificial Sequence: Synthetic oligonucleotide
  Target: ATXN1; (-) strand; PAM type: YTN; PAM sequence: TTT
ttgtcatctttttattcttt

SEQ ID NO: 210241 - DNA, 20 bp, Artificial Sequence
  Description of Artificial Sequence: Synthetic oligonucleotide
  Target: ATXN1; (-) strand; PAM type: YTN; PAM sequence: CTA
atttttgtcatctttttatt

SEQ ID NO: 210242 - DNA, 20 bp, Artificial Sequence
  Description of Artificial Sequence: Synthetic oligonucleotide
  Target: ATXN1; (-) strand; PAM type: YTN; PAM sequence: TTC
taatttttgtcatcttttta

SEQ ID NO: 210243 - DNA, 20 bp, Artificial Sequence
  Description of Artificial Sequence: Synthetic oligonucleotide
  Target: ATXN1; (-) strand; PAM type: YTN; PAM sequence: TTA
ttctaatttttgtcatcttt

SEQ ID NO: 210244 - DNA, 20 bp, Artificial Sequence
  Description of Artificial Sequence: Synthetic oligonucleotide
  Target: ATXN1; (-) strand; PAM type: YTN; PAM sequence: CTT
attctaatttttgtcatctt

SEQ ID NO: 210245 - DNA, 20 bp, Artificial Sequence
  Description of Artificial Sequence: Synthetic oligonucleotide
  Target: ATXN1; (-) strand; PAM type: YTN; PAM sequence: TTG
atacgcttattctaattttt

SEQ ID NO: 210246 - DNA, 20 bp, Artificial Sequence
  Description of Artificial Sequence: Synthetic oligonucleotide
  Target: ATXN1; (-) strand; PAM type: YTN; PAM sequence: TTC
aatgttgatacgcttattct

SEQ ID NO: 210247 - DNA, 20 bp, Artificial Sequence
  Description of Artificial Sequence: Synthetic oligonucleotide
  Target: ATXN1; (-) strand; PAM type: YTN; PAM sequence: CTT
caatgttgatacgcttattc

SEQ ID NO: 210248 - DNA, 20 bp, Artificial Sequence
  Description of Artificial Sequence: Synthetic oligonucleotide
  Target: ATXN1; (-) strand; PAM type: YTN; PAM sequence: CTG
tcttcaatgttgatacgctt

SEQ ID NO: 210249 - DNA, 20 bp, Artificial Sequence
  Description of Artificial Sequence: Synthetic oligonucleotide
  Target: ATXN1; (-) strand; PAM type: YTN; PAM sequence: TTA
atacctgtcttcaatgttga

SEQ ID NO: 210250 - DNA, 20 bp, Artificial Sequence
  Description of Artificial Sequence: Synthetic oligonucleotide
  Target: ATXN1; (-) strand; PAM type: YTN; PAM sequence: TTC
aaaacgaattaatacctgtc

SEQ ID NO: 210251 - DNA, 20 bp, Artificial Sequence
  Description of Artificial Sequence: Synthetic oligonucleotide
  Target: ATXN1; (-) strand; PAM type: YTN; PAM sequence: TTT
caaaacgaattaatacctgt

SEQ ID NO: 210252 - DNA, 20 bp, Artificial Sequence
  Description of Artificial Sequence: Synthetic oligonucleotide
  Target: ATXN1; (-) strand; PAM type: YTN; PAM sequence: TTT
tcaaaacgaattaatacctg

SEQ ID NO: 210253 - DNA, 20 bp, Artificial Sequence
  Description of Artificial Sequence: Synthetic oligonucleotide
  Target: ATXN1; (-) strand; PAM type: YTN; PAM sequence: CTT
ttcaaaacgaattaatacct

SEQ ID NO: 210254 - DNA, 20 bp, Artificial Sequence
  Description of Artificial Sequence: Synthetic oligonucleotide
  Target: ATXN1; (-) strand; PAM type: YTN; PAM sequence: TTG
cttttcaaaacgaattaata

SEQ ID NO: 210255 - DNA, 20 bp, Artificial Sequence
  Description of Artificial Sequence: Synthetic oligonucleotide
  Target: ATXN1; (-) strand; PAM type: YTN; PAM sequence: TTT
gcttttcaaaacgaattaat

SEQ ID NO: 210256 - DNA, 20 bp, Artificial Sequence
  Description of Artificial Sequence: Synthetic oligonucleotide
  Target: ATXN1; (-) strand; PAM type: YTN; PAM sequence: TTT
tgcttttcaaaacgaattaa

SEQ ID NO: 210257 - DNA, 20 bp, Artificial Sequence
  Description of Artificial Sequence: Synthetic oligonucleotide
  Target: ATXN1; (-) strand; PAM type: YTN; PAM sequence: CTT
ttgcttttcaaaacgaatta

SEQ ID NO: 210258 - DNA, 20 bp, Artificial Sequence
  Description of Artificial Sequence: Synthetic oligonucleotide
  Target: ATXN1; (-) strand; PAM type: YTN; PAM sequence: TTC
ttttgcttttcaaaacgaat

SEQ ID NO: 210259 - DNA, 20 bp, Artificial Sequence
  Description of Artificial Sequence: Synthetic oligonucleotide
  Target: ATXN1; (-) strand; PAM type: YTN; PAM sequence: CTG
agattcttttgcttttcaaa

SEQ ID NO: 210260 - DNA, 20 bp, Artificial Sequence
  Description of Artificial Sequence: Synthetic oligonucleotide
  Target: ATXN1; (-) strand; PAM type: YTN; PAM sequence: TTA
tgacaccatctgagattctt

SEQ ID NO: 210261 - DNA, 20 bp, Artificial Sequence
  Description of Artificial Sequence: Synthetic oligonucleotide
  Target: ATXN1; (-) strand; PAM type: YTN; PAM sequence: TTT
atgacaccatctgagattct

SEQ ID NO: 210262 - DNA, 20 bp, Artificial Sequence
  Description of Artificial Sequence: Synthetic oligonucleotide
  Target: ATXN1; (-) strand; PAM type: YTN; PAM sequence: TTA
atttatgacaccatctgaga

SEQ ID NO: 210263 - DNA, 20 bp, Artificial Sequence
  Description of Artificial Sequence: Synthetic oligonucleotide
  Target: ATXN1; (-) strand; PAM type: YTN; PAM sequence: CTT
aatttatgacaccatctgag

SEQ ID NO: 210264 - DNA, 20 bp, Artificial Sequence
  Description of Artificial Sequence: Synthetic oligonucleotide
  Target: ATXN1; (-) strand; PAM type: YTN; PAM sequence: TTC
ttaatttatgacaccatctg

SEQ ID NO: 210265 - DNA, 20 bp, Artificial Sequence
  Description of Artificial Sequence: Synthetic oligonucleotide
  Target: ATXN1; (-) strand; PAM type: YTN; PAM sequence: CTA
agggcattcttaatttatga

SEQ ID NO: 210266 - DNA, 20 bp, Artificial Sequence
  Description of Artificial Sequence: Synthetic oligonucleotide
  Target: ATXN1; (-) strand; PAM type: YTN; PAM sequence: TTG
cagatagtctaagggcattc

SEQ ID NO: 210267 - DNA, 20 bp, Artificial Sequence
  Description of Artificial Sequence: Synthetic oligonucleotide
  Target: ATXN1; (-) strand; PAM type: YTN; PAM sequence: CTT
gcagatagtctaagggcatt

SEQ ID NO: 210268 - DNA, 20 bp, Artificial Sequence
  Description of Artificial Sequence: Synthetic oligonucleotide
  Target: ATXN1; (-) strand; PAM type: YTN; PAM sequence: TTC
ttgcagatagtctaagggca

SEQ ID NO: 210269 - DNA, 20 bp, Artificial Sequence
  Description of Artificial Sequence: Synthetic oligonucleotide
  Target: ATXN1; (-) strand; PAM type: YTN; PAM sequence: TTT
cttgcagatagtctaagggc

SEQ ID NO: 210270 - DNA, 20 bp, Artificial Sequence
  Description of Artificial Sequence: Synthetic oligonucleotide
  Target: ATXN1; (-) strand; PAM type: YTN; PAM sequence: TTA
tgggtttcttgcagatagtc

SEQ ID NO: 210271 - DNA, 20 bp, Artificial Sequence
  Description of Artificial Sequence: Synthetic oligonucleotide
  Target: ATXN1; (-) strand; PAM type: YTN; PAM sequence: TTT
atgggtttcttgcagatagt

SEQ ID NO: 210272 - DNA, 20 bp, Artificial Sequence
  Description of Artificial Sequence: Synthetic oligonucleotide
  Target: ATXN1; (-) strand; PAM type: YTN; PAM sequence: TTT
tatgggtttcttgcagatag

SEQ ID NO: 210273 - DNA, 20 bp, Artificial Sequence
  Description of Artificial Sequence: Synthetic oligonucleotide
  Target: ATXN1; (-) strand; PAM type: YTN; PAM sequence: CTT
ttatgggtttcttgcagata

SEQ ID NO: 210274 - DNA, 20 bp, Artificial Sequence
  Description of Artificial Sequence: Synthetic oligonucleotide
  Target: ATXN1; (-) strand; PAM type: YTN; PAM sequence: TTG
taacttttatgggtttcttg

SEQ ID NO: 210275 - DNA, 20 bp, Artificial Sequence
  Description of Artificial Sequence: Synthetic oligonucleotide
  Target: ATXN1; (-) strand; PAM type: YTN; PAM sequence: CTT
gtaacttttatgggtttctt

SEQ ID NO: 210276 - DNA, 20 bp, Artificial Sequence
  Description of Artificial Sequence: Synthetic oligonucleotide
  Target: ATXN1; (-) strand; PAM type: YTN; PAM sequence: TTC
ttgtaacttttatgggtttc

SEQ ID NO: 210277 - DNA, 20 bp, Artificial Sequence
  Description of Artificial Sequence: Synthetic oligonucleotide
  Target: ATXN1; (-) strand; PAM type: YTN; PAM sequence: CTT
cttgtaacttttatgggttt

SEQ ID NO: 210278 - DNA, 20 bp, Artificial Sequence
  Description of Artificial Sequence: Synthetic oligonucleotide
  Target: ATXN1; (-) strand; PAM type: YTN; PAM sequence: TTG
ccccaatcttcttgtaactt

SEQ ID NO: 210279 - DNA, 20 bp, Artificial Sequence
  Description of Artificial Sequence: Synthetic oligonucleotide
  Target: ATXN1; (-) strand; PAM type: YTN; PAM sequence: TTT
gccccaatcttcttgtaact

SEQ ID NO: 210280 - DNA, 20 bp, Artificial Sequence
  Description of Artificial Sequence: Synthetic oligonucleotide
  Target: ATXN1; (-) strand; PAM type: YTN; PAM sequence: CTT
tgccccaatcttcttgtaac

SEQ ID NO: 210281 - DNA, 20 bp, Artificial Sequence
  Description of Artificial Sequence: Synthetic oligonucleotide
  Target: ATXN1; (-) strand; PAM type: YTN; PAM sequence: TTC
ctttgccccaatcttcttgt

SEQ ID NO: 210282 - DNA, 20 bp, Artificial Sequence
  Description of Artificial Sequence: Synthetic oligonucleotide
  Target: ATXN1; (-) strand; PAM type: YTN; PAM sequence: CTG
gtattcctttgccccaatct

SEQ ID NO: 210283 - DNA, 20 bp, Artificial Sequence
  Description of Artificial Sequence: Synthetic oligonucleotide
  Target: ATXN1; (-) strand; PAM type: YTN; PAM sequence: TTC
ctggtattcctttgccccaa

SEQ ID NO: 210284 - DNA, 20 bp, Artificial Sequence
  Description of Artificial Sequence: Synthetic oligonucleotide
  Target: ATXN1; (-) strand; PAM type: YTN; PAM sequence: TTT
cctggtattcctttgcccca

SEQ ID NO: 210285 - DNA, 20 bp, Artificial Sequence
  Description of Artificial Sequence: Synthetic oligonucleotide
  Target: ATXN1; (-) strand; PAM type: YTN; PAM sequence: CTA
aatgtgcagtttcctggtat

SEQ ID NO: 210286 - DNA, 20 bp, Artificial Sequence
  Description of Artificial Sequence: Synthetic oligonucleotide
  Target: ATXN1; (-) strand; PAM type: YTN; PAM sequence: TTC
taaatgtgcagtttcctggt

SEQ ID NO: 210287 - DNA, 20 bp, Artificial Sequence
  Description of Artificial Sequence: Synthetic oligonucleotide
  Target: ATXN1; (-) strand; PAM type: YTN; PAM sequence: CTT
ctaaatgtgcagtttcctgg

SEQ ID NO: 210288 - DNA, 20 bp, Artificial Sequence
  Description of Artificial Sequence: Synthetic oligonucleotide
  Target: ATXN1; (-) strand; PAM type: YTN; PAM sequence: CTG
tcacttctaaatgtgcagtt

SEQ ID NO: 210289 - DNA, 20 bp, Artificial Sequence
  Description of Artificial Sequence: Synthetic oligonucleotide
  Target: ATXN1; (-) strand; PAM type: YTN; PAM sequence: TTG
taaaactgtcacttctaaat

SEQ ID NO: 210290 - DNA, 20 bp, Artificial Sequence
  Description of Artificial Sequence: Synthetic oligonucleotide
  Target: ATXN1; (-) strand; PAM type: YTN; PAM sequence: TTA
acagttgtaaaactgtcact

SEQ ID NO: 210291 - DNA, 20 bp, Artificial Sequence
  Description of Artificial Sequence: Synthetic oligonucleotide
  Target: ATXN1; (-) strand; PAM type: YTN; PAM sequence: TTG
tattaacagttgtaaaactg

SEQ ID NO: 210292 - DNA, 20 bp, Artificial Sequence
  Description of Artificial Sequence: Synthetic oligonucleotide
  Target: ATXN1; (-) strand; PAM type: YTN; PAM sequence: TTT
gtattaacagttgtaaaact

SEQ ID NO: 210293 - DNA, 20 bp, Artificial Sequence
  Description of Artificial Sequence: Synthetic oligonucleotide
  Target: ATXN1; (-) strand; PAM type: YTN; PAM sequence: TTT
tgtattaacagttgtaaaac

SEQ ID NO: 210294 - DNA, 20 bp, Artificial Sequence
  Description of Artificial Sequence: Synthetic oligonucleotide
  Target: ATXN1; (-) strand; PAM type: YTN; PAM sequence: CTG
attttgtattaacagttgta

SEQ ID NO: 210295 - DNA, 20 bp, Artificial Sequence
  Description of Artificial Sequence: Synthetic oligonucleotide
  Target: ATXN1; (-) strand; PAM type: YTN; PAM sequence: TTA
gatatgtaatactgattttg

SEQ ID NO: 210296 - DNA, 20 bp, Artificial Sequence
  Description of Artificial Sequence: Synthetic oligonucleotide
  Target: ATXN1; (-) strand; PAM type: YTN; PAM sequence: TTT
agatatgtaatactgatttt

SEQ ID NO: 210297 - DNA, 20 bp, Artificial Sequence
  Description of Artificial Sequence: Synthetic oligonucleotide
  Target: ATXN1; (-) strand; PAM type: YTN; PAM sequence: CTT
tagatatgtaatactgattt

SEQ ID NO: 210298 - DNA, 20 bp, Artificial Sequence
  Description of Artificial Sequence: Synthetic oligonucleotide
  Target: ATXN1; (-) strand; PAM type: YTN; PAM sequence: TTG
aatgctttagatatgtaata

SEQ ID NO: 210299 - DNA, 20 bp, Artificial Sequence
  Description of Artificial Sequence: Synthetic oligonucleotide
  Target: ATXN1; (-) strand; PAM type: YTN; PAM sequence: CTG
ttgaatgctttagatatgta

SEQ ID NO: 210300 - DNA, 20 bp, Artificial Sequence
  Description of Artificial Sequence: Synthetic oligonucleotide
  Target: ATXN1; (-) strand; PAM type: YTN; PAM sequence: TTC
acccctgttgaatgctttag

SEQ ID NO: 210301 - DNA, 20 bp, Artificial Sequence
  Description of Artificial Sequence: Synthetic oligonucleotide
  Target: ATXN1; (-) strand; PAM type: YTN; PAM sequence: TTT
cacccctgttgaatgcttta

SEQ ID NO: 210302 - DNA, 20 bp, Artificial Sequence
  Description of Artificial Sequence: Synthetic oligonucleotide
  Target: ATXN1; (-) strand; PAM type: YTN; PAM sequence: TTG
tcagtaaaaatttcacccct

SEQ ID NO: 210303 - DNA, 20 bp, Artificial Sequence
  Description of Artificial Sequence: Synthetic oligonucleotide
  Target: ATXN1; (-) strand; PAM type: YTN; PAM sequence: CTT
gtcagtaaaaatttcacccc

SEQ ID NO: 210304 - DNA, 20 bp, Artificial Sequence
  Description of Artificial Sequence: Synthetic oligonucleotide
  Target: ATXN1; (-) strand; PAM type: YTN; PAM sequence: CTC
ttgtcagtaaaaatttcacc

SEQ ID NO: 210305 - DNA, 20 bp, Artificial Sequence
  Description of Artificial Sequence: Synthetic oligonucleotide
  Target: ATXN1; (-) strand; PAM type: YTN; PAM sequence: TTG
gaatgtatctcttgtcagta

SEQ ID NO: 210306 - DNA, 20 bp, Artificial Sequence
  Description of Artificial Sequence: Synthetic oligonucleotide
  Target: ATXN1; (-) strand; PAM type: YTN; PAM sequence: TTT
ggaatgtatctcttgtcagt

SEQ ID NO: 210307 - DNA, 20 bp, Artificial Sequence
  Description of Artificial Sequence: Synthetic oligonucleotide
  Target: ATXN1; (-) strand; PAM type: YTN; PAM sequence: CTT
tggaatgtatctcttgtcag

SEQ ID NO: 210308 - DNA, 20 bp, Artificial Sequence
  Description of Artificial Sequence: Synthetic oligonucleotide
  Target: ATXN1; (-) strand; PAM type: YTN; PAM sequence: TTC
tttggaatgtatctcttgtc

SEQ ID NO: 210309 - DNA, 20 bp, Artificial Sequence
  Description of Artificial Sequence: Synthetic oligonucleotide
  Target: ATXN1; (-) strand; PAM type: YTN; PAM sequence: TTA
attctttggaatgtatctct

SEQ ID NO: 210310 - DNA, 20 bp, Artificial Sequence
  Description of Artificial Sequence: Synthetic oligonucleotide
  Target: ATXN1; (-) strand; PAM type: YTN; PAM sequence: CTT
aattctttggaatgtatctc

SEQ ID NO: 210311 - DNA, 20 bp, Artificial Sequence
  Description of Artificial Sequence: Synthetic oligonucleotide
  Target: ATXN1; (-) strand; PAM type: YTN; PAM sequence: TTG
acttaattctttggaatgta

SEQ ID NO: 210312 - DNA, 20 bp, Artificial Sequence
  Description of Artificial Sequence: Synthetic oligonucleotide
  Target: ATXN1; (-) strand; PAM type: YTN; PAM sequence: TTT
gacttaattctttggaatgt

SEQ ID NO: 210313 - DNA, 20 bp, Artificial Sequence
  Description of Artificial Sequence: Synthetic oligonucleotide
  Target: ATXN1; (-) strand; PAM type: YTN; PAM sequence: TTT
tgacttaattctttggaatg

SEQ ID NO: 210314 - DNA, 20 bp, Artificial Sequence
  Description of Artificial Sequence: Synthetic oligonucleotide
  Target: ATXN1; (-) strand; PAM type: YTN; PAM sequence: TTG
acacatacaattttgactta

SEQ ID NO: 210315 - DNA, 20 bp, Artificial Sequence
  Description of Artificial Sequence: Synthetic oligonucleotide
  Target: ATXN1; (-) strand; PAM type: YTN; PAM sequence: CTT
gacacatacaattttgactt

SEQ ID NO: 210316 - DNA, 20 bp, Artificial Sequence
  Description of Artificial Sequence: Synthetic oligonucleotide
  Target: ATXN1; (-) strand; PAM type: YTN; PAM sequence: CTA
tcttgacacatacaattttg

SEQ ID NO: 210317 - DNA, 20 bp, Artificial Sequence
  Description of Artificial Sequence: Synthetic oligonucleotide
  Target: ATXN1; (-) strand; PAM type: YTN; PAM sequence: CTA
ctatcttgacacatacaatt

SEQ ID NO: 210318 - DNA, 20 bp, Artificial Sequence
  Description of Artificial Sequence: Synthetic oligonucleotide
  Target: ATXN1; (-) strand; PAM type: YTN; PAM sequence: CTC
tactatcttgacacatacaa

SEQ ID NO: 210319 - DNA, 20 bp, Artificial Sequence
  Description of Artificial Sequence: Synthetic oligonucleotide
  Target: ATXN1; (-) strand; PAM type: YTN; PAM sequence: TTC
catgctctactatcttgaca

SEQ ID NO: 210320 - DNA, 20 bp, Artificial Sequence
  Description of Artificial Sequence: Synthetic oligonucleotide
  Target: ATXN1; (-) strand; PAM type: YTN; PAM sequence: TTT
ccatgctctactatcttgac

SEQ ID NO: 210321 - DNA, 20 bp, Artificial Sequence
  Description of Artificial Sequence: Synthetic oligonucleotide
  Target: ATXN1; (-) strand; PAM type: YTN; PAM sequence: TTA
tatatttccatgctctacta

SEQ ID NO: 210322 - DNA, 20 bp, Artificial Sequence
  Description of Artificial Sequence: Synthetic oligonucleotide
  Target: ATXN1; (-) strand; PAM type: YTN; PAM sequence: TTT
atatatttccatgctctact

SEQ ID NO: 210323 - DNA, 20 bp, Artificial Sequence
  Description of Artificial Sequence: Synthetic oligonucleotide
  Target: ATXN1; (-) strand; PAM type: YTN; PAM sequence: CTT
tatatatttccatgctctac

SEQ ID NO: 210324 - DNA, 20 bp, Artificial Sequence
  Description of Artificial Sequence: Synthetic oligonucleotide
  Target: ATXN1; (-) strand; PAM type: YTN; PAM sequence: TTC
tttatatatttccatgctct

SEQ ID NO: 210325 - DNA, 20 bp, Artificial Sequence
  Description of Artificial Sequence: Synthetic oligonucleotide
  Target: ATXN1; (-) strand; PAM type: YTN; PAM sequence: TTT
ctttatatatttccatgctc

SEQ ID NO: 210326 - DNA, 20 bp, Artificial Sequence
  Description of Artificial Sequence: Synthetic oligonucleotide
  Target: ATXN1; (-) strand; PAM type: YTN; PAM sequence: TTT
tctttatatatttccatgct

SEQ ID NO: 210327 - DNA, 20 bp, Artificial Sequence
  Description of Artificial Sequence: Synthetic oligonucleotide
  Target: ATXN1; (-) strand; PAM type: YTN; PAM sequence: TTA
ttttctttatatatttccat

SEQ ID NO: 210328 - DNA, 20 bp, Artificial Sequence
  Description of Artificial Sequence: Synthetic oligonucleotide
  Target: ATXN1; (-) strand; PAM type: YTN; PAM sequence: TTT
attttctttatatatttcca

SEQ ID NO: 210329 - DNA, 20 bp, Artificial Sequence
  Description of Artificial Sequence: Synthetic oligonucleotide
  Target: ATXN1; (-) strand; PAM type: YTN; PAM sequence: TTT
tattttctttatatatttcc

SEQ ID NO: 210330 - DNA, 20 bp, Artificial Sequence
  Description of Artificial Sequence: Synthetic oligonucleotide
  Target: ATXN1; (-) strand; PAM type: YTN; PAM sequence: CTG
ttttattttctttatatatt

SEQ ID NO: 210331 - DNA, 20 bp, Artificial Sequence
  Description of Artificial Sequence: Synthetic oligonucleotide
  Target: ATXN1; (-) strand; PAM type: YTN; PAM sequence: CTC
tgttttattttctttatata

SEQ ID NO: 210332 - DNA, 20 bp, Artificial Sequence
  Description of Artificial Sequence: Synthetic oligonucleotide
  Target: ATXN1; (-) strand; PAM type: YTN; PAM sequence: CTC
aatctctgttttattttctt

SEQ ID NO: 210333 - DNA, 20 bp, Artificial Sequence
  Description of Artificial Sequence: Synthetic oligonucleotide
  Target: ATXN1; (-) strand; PAM type: YTN; PAM sequence: CTC
tcaatctctgttttattttc

SEQ ID NO: 210334 - DNA, 20 bp, Artificial Sequence
  Description of Artificial Sequence: Synthetic oligonucleotide
  Target: ATXN1; (-) strand; PAM type: YTN; PAM sequence: TTG
catgtctctcaatctctgtt

SEQ ID NO: 210335 - DNA, 20 bp, Artificial Sequence
  Description of Artificial Sequence: Synthetic oligonucleotide
  Target: ATXN1; (-) strand; PAM type: YTN; PAM sequence: TTA
ttgcatgtctctcaatctct

SEQ ID NO: 210336 - DNA, 20 bp, Artificial Sequence
  Description of Artificial Sequence: Synthetic oligonucleotide
  Target: ATXN1; (-) strand; PAM type: YTN; PAM sequence: TTA
acattattgcatgtctctca

SEQ ID NO: 210337 - DNA, 20 bp, Artificial Sequence
  Description of Artificial Sequence: Synthetic oligonucleotide
  Target: ATXN1; (-) strand; PAM type: YTN; PAM sequence: TTT
aacattattgcatgtctctc

SEQ ID NO: 210338 - DNA, 20 bp, Artificial Sequence
  Description of Artificial Sequence: Synthetic oligonucleotide
  Target: ATXN1; (-) strand; PAM type: YTN; PAM sequence: CTT
taacattattgcatgtctct

SEQ ID NO: 210339 - DNA, 20 bp, Artificial Sequence
  Description of Artificial Sequence: Synthetic oligonucleotide
  Target: ATXN1; (-) strand; PAM type: YTN; PAM sequence: CTG
aatgcagtggggtagacttt

SEQ ID NO: 210340 - DNA, 20 bp, Artificial Sequence
  Description of Artificial Sequence: Synthetic oligonucleotide
  Target: ATXN1; (-) strand; PAM type: YTN; PAM sequence: TTC
caaggactgaatgcagtggg

SEQ ID NO: 210341 - DNA, 20 bp, Artificial Sequence
  Description of Artificial Sequence: Synthetic oligonucleotide
  Target: ATXN1; (-) strand; PAM type: YTN; PAM sequence: TTT
ccaaggactgaatgcagtgg

SEQ ID NO: 210342 - DNA, 20 bp, Artificial Sequence
  Description of Artificial Sequence: Synthetic oligonucleotide
  Target: ATXN1; (-) strand; PAM type: YTN; PAM sequence: TTT
tccaaggactgaatgcagtg

SEQ ID NO: 210343 - DNA, 20 bp, Artificial Sequence
  Description of Artificial Sequence: Synthetic oligonucleotide
  Target: ATXN1; (-) strand; PAM type: YTN; PAM sequence: TTT
ttccaaggactgaatgcagt

SEQ ID NO: 210344 - DNA, 20 bp, Artificial Sequence
  Description of Artificial Sequence: Synthetic oligonucleotide
  Target: ATXN1; (-) strand; PAM type: YTN; PAM sequence: TTA
tttttccaaggactgaatgc

SEQ ID NO: 210345 - DNA, 20 bp, Artificial Sequence
  Description of Artificial Sequence: Synthetic oligonucleotide
  Target: ATXN1; (-) strand; PAM type: YTN; PAM sequence: CTT
atttttccaaggactgaatg

SEQ ID NO: 210346 - DNA, 20 bp, Artificial Sequence
  Description of Artificial Sequence: Synthetic oligonucleotide
  Target: ATXN1; (-) strand; PAM type: YTN; PAM sequence: CTG
cttatttttccaaggactga

SEQ ID NO: 210347 - DNA, 20 bp, Artificial Sequence
  Description of Artificial Sequence: Synthetic oligonucleotide
  Target: ATXN1; (-) strand; PAM type: YTN; PAM sequence: TTC
atctgcttatttttccaagg

SEQ ID NO: 210348 - DNA, 20 bp, Artificial Sequence
  Description of Artificial Sequence: Synthetic oligonucleotide
  Target: ATXN1; (-) strand; PAM type: YTN; PAM sequence: TTT
catctgcttatttttccaag

SEQ ID NO: 210349 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaaaaaa

SEQ ID NO: 210350 - DNA, 20 bp, Artificial Sequence
  Description of Artificial Sequence: Synthetic oligonucleotide
  Target: ATXN1; (-) strand; PAM type: YTN; PAM sequence: CTG
tctcaaaaaaaaaaaaaaaa

SEQ ID NO: 210351 - DNA, 20 bp, Artificial Sequence
  Description of Artificial Sequence: Synthetic oligonucleotide
  Target: ATXN1; (-) strand; PAM type: YTN; PAM sequence: CTC
tgtctcaaaaaaaaaaaaaa

SEQ ID NO: 210352 - DNA, 20 bp, Artificial Sequence
  Description of Artificial Sequence: Synthetic oligonucleotide
  Target: ATXN1; (-) strand; PAM type: YTN; PAM sequence: CTC
cagaatgggcaacagagtga

SEQ ID NO: 210353 - DNA, 20 bp, Artificial Sequence
  Description of Artificial Sequence: Synthetic oligonucleotide
  Target: ATXN1; (-) strand; PAM type: YTN; PAM sequence: CTG
cactccagaatgggcaacag

SEQ ID NO: 210354 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatggagcc

SEQ ID NO: 210355 - DNA, 20 bp, Artificial Sequence
  Description of Artificial Sequence: Synthetic oligonucleotide
  Target: ATXN1; (-) strand; PAM type: YTN; PAM sequence: CTT
gcagtgagccgagatggagc

SEQ ID NO: 210356 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatggcatgaa

SEQ ID NO: 210357 - DNA, 20 bp, Artificial Sequence
  Description of Artificial Sequence: Synthetic oligonucleotide
  Target: ATXN1; (-) strand; PAM type: YTN; PAM sequence: CTC
gaaaggctgaggcaggagaa

SEQ ID NO: 210358 - DNA, 20 bp, Artificial Sequence
  Description of Artificial Sequence: Synthetic oligonucleotide
  Target: ATXN1; (-) strand; PAM type: YTN; PAM sequence: CTA
ctcgaaaggctgaggcagga

SEQ ID NO: 210359 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctactcgaaag

SEQ ID NO: 210360 - DNA, 20 bp, Artificial Sequence
  Description of Artificial Sequence: Synthetic oligonucleotide
  Target: ATXN1; (-) strand; PAM type: YTN; PAM sequence: TTA
gccgggtgtggtggcgggca

SEQ ID NO: 210361 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaattagccg

SEQ ID NO: 210362 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaattag

SEQ ID NO: 210363 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaaatt

SEQ ID NO: 210364 - DNA, 20 bp, Artificial Sequence
  Description of Artificial Sequence: Synthetic oligonucleotide
  Target: ATXN1; (-) strand; PAM type: YTN; PAM sequence: CTA
acatggtgaaaccccgtctc

SEQ ID NO: 210365 - DNA, 20 bp, Artificial Sequence
  Description of Artificial Sequence: Synthetic oligonucleotide
  Target: ATXN1; (-) strand; PAM type: YTN; PAM sequence: CTG
actaacatggtgaaaccccg

SEQ ID NO: 210366 - DNA, 20 bp, Artificial Sequence
  Description of Artificial Sequence: Synthetic oligonucleotide
  Target: ATXN1; (-) strand; PAM type: YTN; PAM sequence: CTG
aggcaggcgcatcatgaggt

SEQ ID NO: 210367 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggcgcat

SEQ ID NO: 210368 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggcaggcgca

SEQ ID NO: 210369 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggcaggcgc

SEQ ID NO: 210370 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 210371 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccagcact

SEQ ID NO: 210372 - DNA, 20 bp, Artificial Sequence
  Description of Artificial Sequence: Synthetic oligonucleotide
  Target: ATXN1; (-) strand; PAM type: YTN; PAM sequence: CTG
gccgggcgcggtggctcaca

SEQ ID NO: 210373 - DNA, 20 bp, Artificial Sequence
  Description of Artificial Sequence: Synthetic oligonucleotide
  Target: ATXN1; (-) strand; PAM type: YTN; PAM sequence: CTG
ctggccgggcgcggtggctc

SEQ ID NO: 210374 - DNA, 20 bp, Artificial Sequence
  Description of Artificial Sequence: Synthetic oligonucleotide
  Target: ATXN1; (-) strand; PAM type: YTN; PAM sequence: TTC
atctgctggccgggcgcggt

SEQ ID NO: 210375 - DNA, 20 bp, Artificial Sequence
  Description of Artificial Sequence: Synthetic oligonucleotide
  Target: ATXN1; (-) strand; PAM type: YTN; PAM sequence: TTT
catctgctggccgggcgcgg

SEQ ID NO: 210376 - DNA, 20 bp, Artificial Sequence
  Description of Artificial Sequence: Synthetic oligonucleotide
  Target: ATXN1; (-) strand; PAM type: YTN; PAM sequence: TTT
tcatctgctggccgggcgcg

SEQ ID NO: 210377 - DNA, 20 bp, Artificial Sequence
  Description of Artificial Sequence: Synthetic oligonucleotide
  Target: ATXN1; (-) strand; PAM type: YTN; PAM sequence: TTA
aattttcatctgctggccgg

SEQ ID NO: 210378 - DNA, 20 bp, Artificial Sequence
  Description of Artificial Sequence: Synthetic oligonucleotide
  Target: ATXN1; (-) strand; PAM type: YTN; PAM sequence: TTA
ttaaattttcatctgctggc

SEQ ID NO: 210379 - DNA, 20 bp, Artificial Sequence
  Description of Artificial Sequence: Synthetic oligonucleotide
  Target: ATXN1; (-) strand; PAM type: YTN; PAM sequence: TTT
attaaattttcatctgctgg

SEQ ID NO: 210380 - DNA, 20 bp, Artificial Sequence
  Description of Artificial Sequence: Synthetic oligonucleotide
  Target: ATXN1; (-) strand; PAM type: YTN; PAM sequence: CTT
tattaaattttcatctgctg

SEQ ID NO: 210381 - DNA, 20 bp, Artificial Sequence
  Description of Artificial Sequence: Synthetic oligonucleotide
  Target: ATXN1; (-) strand; PAM type: YTN; PAM sequence: CTA
tatctttattaaattttcat

SEQ ID NO: 210382 - DNA, 20 bp, Artificial Sequence
  Description of Artificial Sequence: Synthetic oligonucleotide
  Target: ATXN1; (-) strand; PAM type: YTN; PAM sequence: CTC
tatatctttattaaattttc

SEQ ID NO: 210383 - DNA, 20 bp, Artificial Sequence
  Description of Artificial Sequence: Synthetic oligonucleotide
  Target: ATXN1; (-) strand; PAM type: YTN; PAM sequence: TTC
tctatatctttattaaattt

SEQ ID NO: 210384 - DNA, 20 bp, Artificial Sequence
  Description of Artificial Sequence: Synthetic oligonucleotide
  Target: ATXN1; (-) strand; PAM type: YTN; PAM sequence: CTT
ctctatatctttattaaatt

SEQ ID NO: 210385 - DNA, 20 bp, Artificial Sequence
  Description of Artificial Sequence: Synthetic oligonucleotide
  Target: ATXN1; (-) strand; PAM type: YTN; PAM sequence: CTA
cttctctatatctttattaa

SEQ ID NO: 210386 - DNA, 20 bp, Artificial Sequence
  Description of Artificial Sequence: Synthetic oligonucleotide
  Target: ATXN1; (-) strand; PAM type: YTN; PAM sequence: TTA
tcctacttctctatatcttt

SEQ ID NO: 210387 - DNA, 20 bp, Artificial Sequence
  Description of Artificial Sequence: Synthetic oligonucleotide
  Target: ATXN1; (-) strand; PAM type: YTN; PAM sequence: TTT
atcctacttctctatatctt

SEQ ID NO: 210388 - DNA, 20 bp, Artificial Sequence
  Description of Artificial Sequence: Synthetic oligonucleotide
  Target: ATXN1; (-) strand; PAM type: YTN; PAM sequence: TTT
tatcctacttctctatatct

SEQ ID NO: 210389 - DNA, 20 bp, Artificial Sequence
  Description of Artificial Sequence: Synthetic oligonucleotide
  Target: ATXN1; (-) strand; PAM type: YTN; PAM sequence: TTA
tgattttatcctacttctct

SEQ ID NO: 210390 - DNA, 20 bp, Artificial Sequence
  Description of Artificial Sequence: Synthetic oligonucleotide
  Target: ATXN1; (-) strand; PAM type: YTN; PAM sequence: TTT
atgattttatcctacttctc

SEQ ID NO: 210391 - DNA, 20 bp, Artificial Sequence
  Description of Artificial Sequence: Synthetic oligonucleotide
  Target: ATXN1; (-) strand; PAM type: YTN; PAM sequence: CTG
ccatatttatgattttatcc

SEQ ID NO: 210392 - DNA, 20 bp, Artificial Sequence
  Description of Artificial Sequence: Synthetic oligonucleotide
  Target: ATXN1; (-) strand; PAM type: YTN; PAM sequence: TTG
tcatcagatctgccatattt

SEQ ID NO: 210393 - DNA, 20 bp, Artificial Sequence
  Description of Artificial Sequence: Synthetic oligonucleotide
  Target: ATXN1; (-) strand; PAM type: YTN; PAM sequence: CTT
gtcatcagatctgccatatt

SEQ ID NO: 210394 - DNA, 20 bp, Artificial Sequence
  Description of Artificial Sequence: Synthetic oligonucleotide
  Target: ATXN1; (-) strand; PAM type: YTN; PAM sequence: TTA
tcttgtcatcagatctgcca

SEQ ID NO: 210395 - DNA, 20 bp, Artificial Sequence
  Description of Artificial Sequence: Synthetic oligonucleotide
  Target: ATXN1; (-) strand; PAM type: YTN; PAM sequence: CTT
atcttgtcatcagatctgcc

SEQ ID NO: 210396 - DNA, 20 bp, Artificial Sequence
  Description of Artificial Sequence: Synthetic oligonucleotide
  Target: ATXN1; (-) strand; PAM type: YTN; PAM sequence: CTA
atcaggcttatcttgtcatc

SEQ ID NO: 210397 - DNA, 20 bp, Artificial Sequence
  Description of Artificial Sequence: Synthetic oligonucleotide
  Target: ATXN1; (-) strand; PAM type: YTN; PAM sequence: TTA
aatctaatcaggcttatctt

SEQ ID NO: 210398 - DNA, 20 bp, Artificial Sequence
  Description of Artificial Sequence: Synthetic oligonucleotide
  Target: ATXN1; (-) strand; PAM type: YTN; PAM sequence: CTA
attaaatctaatcaggctta

SEQ ID NO: 210399 - DNA, 20 bp, Artificial Sequence
  Description of Artificial Sequence: Synthetic oligonucleotide
  Target: ATXN1; (-) strand; PAM type: YTN; PAM sequence: CTC
taattaaatctaatcaggct

SEQ ID NO: 210400 - DNA, 20 bp, Artificial Sequence
  Description of Artificial Sequence: Synthetic oligonucleotide
  Target: ATXN1; (-) strand; PAM type: YTN; PAM sequence: CTG
tatagaagatgcatgctcta

SEQ ID NO: 210401 - DNA, 20 bp, Artificial Sequence
  Description of Artificial Sequence: Synthetic oligonucleotide
  Target: ATXN1; (-) strand; PAM type: YTN; PAM sequence: TTC
catgagcccctgtatagaag

SEQ ID NO: 210402 - DNA, 20 bp, Artificial Sequence
  Description of Artificial Sequence: Synthetic oligonucleotide
  Target: ATXN1; (-) strand; PAM type: YTN; PAM sequence: TTA
atgttccatgagcccctgta

SEQ ID NO: 210403 - DNA, 20 bp, Artificial Sequence
  Description of Artificial Sequence: Synthetic oligonucleotide
  Target: ATXN1; (-) strand; PAM type: YTN; PAM sequence: TTG
ttaatgttccatgagcccct

SEQ ID NO: 210404 - DNA, 20 bp, Artificial Sequence
  Description of Artificial Sequence: Synthetic oligonucleotide
  Target: ATXN1; (-) strand; PAM type: YTN; PAM sequence: TTT
gttaatgttccatgagcccc

SEQ ID NO: 210405 - DNA, 20 bp, Artificial Sequence
  Description of Artificial Sequence: Synthetic oligonucleotide
  Target: ATXN1; (-) strand; PAM type: YTN; PAM sequence: TTT
tgttaatgttccatgagccc

SEQ ID NO: 210406 - DNA, 20 bp, Artificial Sequence
  Description of Artificial Sequence: Synthetic oligonucleotide
  Target: ATXN1; (-) strand; PAM type: YTN; PAM sequence: TTT
ttgttaatgttccatgagcc

SEQ ID NO: 210407 - DNA, 20 bp, Artificial Sequence
  Description of Artificial Sequence: Synthetic oligonucleotide
  Target: ATXN1; (-) strand; PAM type: YTN; PAM sequence: TTC
atttttgttaatgttccatg

SEQ ID NO: 210408 - DNA, 20 bp, Artificial Sequence
  Description of Artificial Sequence: Synthetic oligonucleotide
  Target: ATXN1; (-) strand; PAM type: YTN; PAM sequence: TTC
caatacaggattcatttttg

SEQ ID NO: 210409 - DNA, 20 bp, Artificial Sequence
  Description of Artificial Sequence: Synthetic oligonucleotide
  Target: ATXN1; (-) strand; PAM type: YTN; PAM sequence: TTA
tgttccaatacaggattcat

SEQ ID NO: 210410 - DNA, 20 bp, Artificial Sequence
  Description of Artificial Sequence: Synthetic oligonucleotide
  Target: ATXN1; (-) strand; PAM type: YTN; PAM sequence: TTT
atgttccaatacaggattca

SEQ ID NO: 210411 - DNA, 20 bp, Artificial Sequence
  Description of Artificial Sequence: Synthetic oligonucleotide
  Target: ATXN1; (-) strand; PAM type: YTN; PAM sequence: TTT
tatgttccaatacaggattc

SEQ ID NO: 210412 - DNA, 20 bp, Artificial Sequence
  Description of Artificial Sequence: Synthetic oligonucleotide
  Target: ATXN1; (-) strand; PAM type: YTN; PAM sequence: TTA
ttttatgttccaatacagga

SEQ ID NO: 210413 - DNA, 20 bp, Artificial Sequence
  Description of Artificial Sequence: Synthetic oligonucleotide
  Target: ATXN1; (-) strand; PAM type: YTN; PAM sequence: TTT
attttatgttccaatacagg

SEQ ID NO: 210414 - DNA, 20 bp, Artificial Sequence
  Description of Artificial Sequence: Synthetic oligonucleotide
  Target: ATXN1; (-) strand; PAM type: YTN; PAM sequence: TTG
aaaggtagtaaaatttattt

SEQ ID NO: 210415 - DNA, 20 bp, Artificial Sequence
  Description of Artificial Sequence: Synthetic oligonucleotide
  Target: ATXN1; (-) strand; PAM type: YTN; PAM sequence: TTG
tggtcacagaatattgaaag

SEQ ID NO: 210416 - DNA, 20 bp, Artificial Sequence
  Description of Artificial Sequence: Synthetic oligonucleotide
  Target: ATXN1; (-) strand; PAM type: YTN; PAM sequence: TTG
cattgtggtcacagaatatt

SEQ ID NO: 210417 - DNA, 20 bp, Artificial Sequence
  Description of Artificial Sequence: Synthetic oligonucleotide
  Target: ATXN1; (-) strand; PAM type: YTN; PAM sequence: TTG
ttgcattgtggtcacagaat

SEQ ID NO: 210418 - DNA, 20 bp, Artificial Sequence
  Description of Artificial Sequence: Synthetic oligonucleotide
  Target: ATXN1; (-) strand; PAM type: YTN; PAM sequence: TTT
gttgcattgtggtcacagaa

SEQ ID NO: 210419 - DNA, 20 bp, Artificial Sequence
  Description of Artificial Sequence: Synthetic oligonucleotide
  Target: ATXN1; (-) strand; PAM type: YTN; PAM sequence: TTT
tgttgcattgtggtcacaga

SEQ ID NO: 210420 - DNA, 20 bp, Artificial Sequence
  Description of Artificial Sequence: Synthetic oligonucleotide
  Target: ATXN1; (-) strand; PAM type: YTN; PAM sequence: TTA
atgagttttgttgcattgtg

SEQ ID NO: 210421 - DNA, 20 bp, Artificial Sequence
  Description of Artificial Sequence: Synthetic oligonucleotide
  Target: ATXN1; (-) strand; PAM type: YTN; PAM sequence: CTA
ttaatgagttttgttgcatt

SEQ ID NO: 210422 - DNA, 20 bp, Artificial Sequence
  Description of Artificial Sequence: Synthetic oligonucleotide
  Target: ATXN1; (-) strand; PAM type: YTN; PAM sequence: CTG
tctattaatgagttttgttg

SEQ ID NO: 210423 - DNA, 20 bp, Artificial Sequence
  Description of Artificial Sequence: Synthetic oligonucleotide
  Target: ATXN1; (-) strand; PAM type: YTN; PAM sequence: TTC
tgtctattaatgagttttgt

SEQ ID NO: 210424 - DNA, 20 bp, Artificial Sequence
  Description of Artificial Sequence: Synthetic oligonucleotide
  Target: ATXN1; (-) strand; PAM type: YTN; PAM sequence: CTT
ctgtctattaatgagttttg

SEQ ID NO: 210425 - DNA, 20 bp, Artificial Sequence
  Description of Artificial Sequence: Synthetic oligonucleotide
  Target: ATXN1; (-) strand; PAM type: YTN; PAM sequence: TTA
cacttctgtctattaatgag

SEQ ID NO: 210426 - DNA, 20 bp, Artificial Sequence
  Description of Artificial Sequence: Synthetic oligonucleotide
  Target: ATXN1; (-) strand; PAM type: YTN; PAM sequence: TTT
acacttctgtctattaatga

SEQ ID NO: 210427 - DNA, 20 bp, Artificial Sequence
  Description of Artificial Sequence: Synthetic oligonucleotide
  Target: ATXN1; (-) strand; PAM type: YTN; PAM sequence: TTG
tttacacttctgtctattaa

SEQ ID NO: 210428 - DNA, 20 bp, Artificial Sequence
  Description of Artificial Sequence: Synthetic oligonucleotide
  Target: ATXN1; (-) strand; PAM type: YTN; PAM sequence: TTG
aattgtttacacttctgtct

SEQ ID NO: 210429 - DNA, 20 bp, Artificial Sequence
  Description of Artificial Sequence: Synthetic oligonucleotide
  Target: ATXN1; (-) strand; PAM type: YTN; PAM sequence: TTT
gaattgtttacacttctgtc

SEQ ID NO: 210430 - DNA, 20 bp, Artificial Sequence
  Description of Artificial Sequence: Synthetic oligonucleotide
  Target: ATXN1; (-) strand; PAM type: YTN; PAM sequence: TTA
atttgaattgtttacacttc

SEQ ID NO: 210431 - DNA, 20 bp, Artificial Sequence
  Description of Artificial Sequence: Synthetic oligonucleotide
  Target: ATXN1; (-) strand; PAM type: YTN; PAM sequence: TTG
aatgtacaagttaatttgaa

SEQ ID NO: 210432 - DNA, 20 bp, Artificial Sequence
  Description of Artificial Sequence: Synthetic oligonucleotide
  Target: ATXN1; (-) strand; PAM type: YTN; PAM sequence: TTT
gaatgtacaagttaatttga

SEQ ID NO: 210433 - DNA, 20 bp, Artificial Sequence
  Description of Artificial Sequence: Synthetic oligonucleotide
  Target: ATXN1; (-) strand; PAM type: YTN; PAM sequence: TTT
tgaatgtacaagttaatttg

SEQ ID NO: 210434 - DNA, 20 bp, Artificial Sequence
  Description of Artificial Sequence: Synthetic oligonucleotide
  Target: ATXN1; (-) strand; PAM type: YTN; PAM sequence: TTT
ttgaatgtacaagttaattt

SEQ ID NO: 210435 - DNA, 20 bp, Artificial Sequence
  Description of Artificial Sequence: Synthetic oligonucleotide
  Target: ATXN1; (-) strand; PAM type: YTN; PAM sequence: CTT
tttgaatgtacaagttaatt

SEQ ID NO: 210436 - DNA, 20 bp, Artificial Sequence
  Description of Artificial Sequence: Synthetic oligonucleotide
  Target: ATXN1; (-) strand; PAM type: YTN; PAM sequence: TTC
tttttgaatgtacaagttaa

SEQ ID NO: 210437 - DNA, 20 bp, Artificial Sequence
  Description of Artificial Sequence: Synthetic oligonucleotide
  Target: ATXN1; (-) strand; PAM type: YTN; PAM sequence: TTA
gaagaattctttttgaatgt

SEQ ID NO: 210438 - DNA, 20 bp, Artificial Sequence
  Description of Artificial Sequence: Synthetic oligonucleotide
  Target: ATXN1; (-) strand; PAM type: YTN; PAM sequence: TTT
agaagaattctttttgaatg

SEQ ID NO: 210439 - DNA, 20 bp, Artificial Sequence
  Description of Artificial Sequence: Synthetic oligonucleotide
  Target: ATXN1; (-) strand; PAM type: YTN; PAM sequence: CTA
tttagaagaattctttttga

SEQ ID NO: 210440 - DNA, 20 bp, Artificial Sequence
  Description of Artificial Sequence: Synthetic oligonucleotide
  Target: ATXN1; (-) strand; PAM type: YTN; PAM sequence: CTA
cacctatttagaagaattct

SEQ ID NO: 210441 - DNA, 20 bp, Artificial Sequence
  Description of Artificial Sequence: Synthetic oligonucleotide
  Target: ATXN1; (-) strand; PAM type: YTN; PAM sequence: CTC
tacacctatttagaagaatt

SEQ ID NO: 210442 - DNA, 20 bp, Artificial Sequence
  Description of Artificial Sequence: Synthetic oligonucleotide
  Target: ATXN1; (-) strand; PAM type: YTN; PAM sequence: TTA
tactctacacctatttagaa

SEQ ID NO: 210443 - DNA, 20 bp, Artificial Sequence
  Description of Artificial Sequence: Synthetic oligonucleotide
  Target: ATXN1; (-) strand; PAM type: YTN; PAM sequence: TTT
atactctacacctatttaga

SEQ ID NO: 210444 - DNA, 20 bp, Artificial Sequence
  Description of Artificial Sequence: Synthetic oligonucleotide
  Target: ATXN1; (-) strand; PAM type: YTN; PAM sequence: TTT
tatactctacacctatttag

SEQ ID NO: 210445 - DNA, 20 bp, Artificial Sequence
  Description of Artificial Sequence: Synthetic oligonucleotide
  Target: ATXN1; (-) strand; PAM type: YTN; PAM sequence: CTT
ttatactctacacctattta

SEQ ID NO: 210446 - DNA, 20 bp, Artificial Sequence
  Description of Artificial Sequence: Synthetic oligonucleotide
  Target: ATXN1; (-) strand; PAM type: YTN; PAM sequence: TTA
tcttttatactctacaccta

SEQ ID NO: 210447 - DNA, 20 bp, Artificial Sequence
  Description of Artificial Sequence: Synthetic oligonucleotide
  Target: ATXN1; (-) strand; PAM type: YTN; PAM sequence: TTA
ttatcttttatactctacac

SEQ ID NO: 210448 - DNA, 20 bp, Artificial Sequence
  Description of Artificial Sequence: Synthetic oligonucleotide
  Target: ATXN1; (-) strand; PAM type: YTN; PAM sequence: TTT
attatcttttatactctaca

SEQ ID NO: 210449 - DNA, 20 bp, Artificial Sequence
  Description of Artificial Sequence: Synthetic oligonucleotide
  Target: ATXN1; (-) strand; PAM type: YTN; PAM sequence: TTC
cataatttattatcttttat

SEQ ID NO: 210450 - DNA, 20 bp, Artificial Sequence
  Description of Artificial Sequence: Synthetic oligonucleotide
  Target: ATXN1; (-) strand; PAM type: YTN; PAM sequence: CTG
tgattccataatttattatc

SEQ ID NO: 210451 - DNA, 20 bp, Artificial Sequence
  Description of Artificial Sequence: Synthetic oligonucleotide
  Target: ATXN1; (-) strand; PAM type: YTN; PAM sequence: CTC
agtctgtgattccataattt

SEQ ID NO: 210452 - DNA, 20 bp, Artificial Sequence
  Description of Artificial Sequence: Synthetic oligonucleotide
  Target: ATXN1; (-) strand; PAM type: YTN; PAM sequence: TTG
tctcagtctgtgattccata

SEQ ID NO: 210453 - DNA, 20 bp, Artificial Sequence
  Description of Artificial Sequence: Synthetic oligonucleotide
  Target: ATXN1; (-) strand; PAM type: YTN; PAM sequence: TTA
ttgtctcagtctgtgattcc

SEQ ID NO: 210454 - DNA, 20 bp, Artificial Sequence
  Description of Artificial Sequence: Synthetic oligonucleotide
  Target: ATXN1; (-) strand; PAM type: YTN; PAM sequence: TTT
attgtctcagtctgtgattc

SEQ ID NO: 210455 - DNA, 20 bp, Artificial Sequence
  Description of Artificial Sequence: Synthetic oligonucleotide
  Target: ATXN1; (-) strand; PAM type: YTN; PAM sequence: CTT
tattgtctcagtctgtgatt

SEQ ID NO: 210456 - DNA, 20 bp, Artificial Sequence
  Description of Artificial Sequence: Synthetic oligonucleotide
  Target: ATXN1; (-) strand; PAM type: YTN; PAM sequence: TTA
tctttattgtctcagtctgt

SEQ ID NO: 210457 - DNA, 20 bp, Artificial Sequence
  Description of Artificial Sequence: Synthetic oligonucleotide
  Target: ATXN1; (-) strand; PAM type: YTN; PAM sequence: CTC
attatctttattgtctcagt

SEQ ID NO: 210458 - DNA, 20 bp, Artificial Sequence
  Description of Artificial Sequence: Synthetic oligonucleotide
  Target: ATXN1; (-) strand; PAM type: YTN; PAM sequence: TTC
tcattatctttattgtctca

SEQ ID NO: 210459 - DNA, 20 bp, Artificial Sequence
  Description of Artificial Sequence: Synthetic oligonucleotide
  Target: ATXN1; (-) strand; PAM type: YTN; PAM sequence: TTT
ctcattatctttattgtctc

SEQ ID NO: 210460 - DNA, 20 bp, Artificial Sequence
  Description of Artificial Sequence: Synthetic oligonucleotide
  Target: ATXN1; (-) strand; PAM type: YTN; PAM sequence: TTT
tctcattatctttattgtct

SEQ ID NO: 210461 - DNA, 20 bp, Artificial Sequence
  Description of Artificial Sequence: Synthetic oligonucleotide
  Target: ATXN1; (-) strand; PAM type: YTN; PAM sequence: TTG
atacataattttctcattat

SEQ ID NO: 210462 - DNA, 20 bp, Artificial Sequence
  Description of Artificial Sequence: Synthetic oligonucleotide
  Target: ATXN1; (-) strand; PAM type: YTN; PAM sequence: TTT
gatacataattttctcatta

SEQ ID NO: 210463 - DNA, 20 bp, Artificial Sequence
  Description of Artificial Sequence: Synthetic oligonucleotide
  Target: ATXN1; (-) strand; PAM type: YTN; PAM sequence: CTT
tgatacataattttctcatt

SEQ ID NO: 210464 - DNA, 20 bp, Artificial Sequence
  Description of Artificial Sequence: Synthetic oligonucleotide
  Target: ATXN1; (-) strand; PAM type: YTN; PAM sequence: CTA
cactttgatacataattttc

SEQ ID NO: 210465 - DNA, 20 bp, Artificial Sequence
  Description of Artificial Sequence: Synthetic oligonucleotide
  Target: ATXN1; (-) strand; PAM type: YTN; PAM sequence: CTG
cctacactttgatacataat

SEQ ID NO: 210466 - DNA, 20 bp, Artificial Sequence
  Description of Artificial Sequence: Synthetic oligonucleotide
  Target: ATXN1; (-) strand; PAM type: YTN; PAM sequence: CTG
taagctgcctacactttgat

SEQ ID NO: 210467 - DNA, 20 bp, Artificial Sequence
  Description of Artificial Sequence: Synthetic oligonucleotide
  Target: ATXN1; (-) strand; PAM type: YTN; PAM sequence: CTG
actgtaagctgcctacactt

SEQ ID NO: 210468 - DNA, 20 bp, Artificial Sequence
  Description of Artificial Sequence: Synthetic oligonucleotide
  Target: ATXN1; (-) strand; PAM type: YTN; PAM sequence: CTC
tgactgtaagctgcctacac

SEQ ID NO: 210469 - DNA, 20 bp, Artificial Sequence
  Description of Artificial Sequence: Synthetic oligonucleotide
  Target: ATXN1; (-) strand; PAM type: YTN; PAM sequence: TTG
cctctgactgtaagctgcct

SEQ ID NO: 210470 - DNA, 20 bp, Artificial Sequence
  Description of Artificial Sequence: Synthetic oligonucleotide
  Target: ATXN1; (-) strand; PAM type: YTN; PAM sequence: TTT
gcctctgactgtaagctgcc

SEQ ID NO: 210471 - DNA, 20 bp, Artificial Sequence
  Description of Artificial Sequence: Synthetic oligonucleotide
  Target: ATXN1; (-) strand; PAM type: YTN; PAM sequence: CTA
aagatatttgcctctgactg

SEQ ID NO: 210472 - DNA, 20 bp, Artificial Sequence
  Description of Artificial Sequence: Synthetic oligonucleotide
  Target: ATXN1; (-) strand; PAM type: YTN; PAM sequence: TTA
atgataaaaatactaaagat

SEQ ID NO: 210473 - DNA, 20 bp, Artificial Sequence
  Description of Artificial Sequence: Synthetic oligonucleotide
  Target: ATXN1; (-) strand; PAM type: YTN; PAM sequence: CTT
aatgataaaaatactaaaga

SEQ ID NO: 210474 - DNA, 20 bp, Artificial Sequence
  Description of Artificial Sequence: Synthetic oligonucleotide
  Target: ATXN1; (-) strand; PAM type: YTN; PAM sequence: TTC
ttaatgataaaaatactaaa

SEQ ID NO: 210475 - DNA, 20 bp, Artificial Sequence
  Description of Artificial Sequence: Synthetic oligonucleotide
  Target: ATXN1; (-) strand; PAM type: YTN; PAM sequence: TTT
cttaatgataaaaatactaa

SEQ ID NO: 210476 - DNA, 20 bp, Artificial Sequence
  Description of Artificial Sequence: Synthetic oligonucleotide
  Target: ATXN1; (-) strand; PAM type: YTN; PAM sequence: TTT
tcttaatgataaaaatacta

SEQ ID NO: 210477 - DNA, 20 bp, Artificial Sequence
  Description of Artificial Sequence: Synthetic oligonucleotide
  Target: ATXN1; (-) strand; PAM type: YTN; PAM sequence: TTT
ttcttaatgataaaaatact

SEQ ID NO: 210478 - DNA, 20 bp, Artificial Sequence
  Description of Artificial Sequence: Synthetic oligonucleotide
  Target: ATXN1; (-) strand; PAM type: YTN; PAM sequence: TTA
atttttcttaatgataaaaa

SEQ ID NO: 210479 - DNA, 20 bp, Artificial Sequence
  Description of Artificial Sequence: Synthetic oligonucleotide
  Target: ATXN1; (-) strand; PAM type: YTN; PAM sequence: TTT
aatttttcttaatgataaaa

SEQ ID NO: 210480 - DNA, 20 bp, Artificial Sequence
  Description of Artificial Sequence: Synthetic oligonucleotide
  Target: ATXN1; (-) strand; PAM type: YTN; PAM sequence: TTT
taatttttcttaatgataaa

SEQ ID NO: 210481 - DNA, 20 bp, Artificial Sequence
  Description of Artificial Sequence: Synthetic oligonucleotide
  Target: ATXN1; (-) strand; PAM type: YTN; PAM sequence: TTT
ttaatttttcttaatgataa

SEQ ID NO: 210482 - DNA, 20 bp, Artificial Sequence
  Description of Artificial Sequence: Synthetic oligonucleotide
  Target: ATXN1; (-) strand; PAM type: YTN; PAM sequence: TTA
tttttaatttttcttaatga

SEQ ID NO: 210483 - DNA, 20 bp, Artificial Sequence
  Description of Artificial Sequence: Synthetic oligonucleotide
  Target: ATXN1; (-) strand; PAM type: YTN; PAM sequence: TTT
atttttaatttttcttaatg

SEQ ID NO: 210484 - DNA, 20 bp, Artificial Sequence
  Description of Artificial Sequence: Synthetic oligonucleotide
  Target: ATXN1; (-) strand; PAM type: YTN; PAM sequence: TTT
tatttttaatttttcttaat

SEQ ID NO: 210485 - DNA, 20 bp, Artificial Sequence
  Description of Artificial Sequence: Synthetic oligonucleotide
  Target: ATXN1; (-) strand; PAM type: YTN; PAM sequence: CTT
ttatttttaatttttcttaa

SEQ ID NO: 210486 - DNA, 20 bp, Artificial Sequence
  Description of Artificial Sequence: Synthetic oligonucleotide
  Target: ATXN1; (-) strand; PAM type: YTN; PAM sequence: TTG
atcttttatttttaattttt

SEQ ID NO: 210487 - DNA, 20 bp, Artificial Sequence
  Description of Artificial Sequence: Synthetic oligonucleotide
  Target: ATXN1; (-) strand; PAM type: YTN; PAM sequence: TTG
agttgatcttttatttttaa

SEQ ID NO: 210488 - DNA, 20 bp, Artificial Sequence
  Description of Artificial Sequence: Synthetic oligonucleotide
  Target: ATXN1; (-) strand; PAM type: YTN; PAM sequence: TTA
ttgagttgatcttttatttt

SEQ ID NO: 210489 - DNA, 20 bp, Artificial Sequence
  Description of Artificial Sequence: Synthetic oligonucleotide
  Target: ATXN1; (-) strand; PAM type: YTN; PAM sequence: TTT
attgagttgatcttttattt

SEQ ID NO: 210490 - DNA, 20 bp, Artificial Sequence
  Description of Artificial Sequence: Synthetic oligonucleotide
  Target: ATXN1; (-) strand; PAM type: YTN; PAM sequence: CTA
atttattgagttgatctttt

SEQ ID NO: 210491 - DNA, 20 bp, Artificial Sequence
  Description of Artificial Sequence: Synthetic oligonucleotide
  Target: ATXN1; (-) strand; PAM type: YTN; PAM sequence: TTC
taatttattgagttgatctt

SEQ ID NO: 210492 - DNA, 20 bp, Artificial Sequence
  Description of Artificial Sequence: Synthetic oligonucleotide
  Target: ATXN1; (-) strand; PAM type: YTN; PAM sequence: TTT
ctaatttattgagttgatct

SEQ ID NO: 210493 - DNA, 20 bp, Artificial Sequence
  Description of Artificial Sequence: Synthetic oligonucleotide
  Target: ATXN1; (-) strand; PAM type: YTN; PAM sequence: TTT
tctaatttattgagttgatc

SEQ ID NO: 210494 - DNA, 20 bp, Artificial Sequence
  Description of Artificial Sequence: Synthetic oligonucleotide
  Target: ATXN1; (-) strand; PAM type: YTN; PAM sequence: CTT
ttctaatttattgagttgat

SEQ ID NO: 210495 - DNA, 20 bp, Artificial Sequence
  Description of Artificial Sequence: Synthetic oligonucleotide
  Target: ATXN1; (-) strand; PAM type: YTN; PAM sequence: TTA
caaaggtgtgagccaccgtg

SEQ ID NO: 210496 - DNA, 20 bp, Artificial Sequence
  Description of Artificial Sequence: Synthetic oligonucleotide
  Target: ATXN1; (-) strand; PAM type: YTN; PAM sequence: CTG
ggattacaaaggtgtgagcc

SEQ ID NO: 210497 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacaa

SEQ ID NO: 210498 - DNA, 20 bp, Artificial Sequence
  Description of Artificial Sequence: Synthetic oligonucleotide
  Target: ATXN1; (-) strand; PAM type: YTN; PAM sequence: CTG
cccgacctcccaaagtgctg

SEQ ID NO: 210499 - DNA, 20 bp, Artificial Sequence
  Description of Artificial Sequence: Synthetic oligonucleotide
  Target: ATXN1; (-) strand; PAM type: YTN; PAM sequence: CTG
cctgcccgacctcccaaagt

SEQ ID NO: 210500 - DNA, 20 bp, Artificial Sequence
  Description of Artificial Sequence: Synthetic oligonucleotide
  Target: ATXN1; (-) strand; PAM type: YTN; PAM sequence: CTC
gtgatctgcctgcccgacct

SEQ ID NO: 210501 - DNA, 20 bp, Artificial Sequence
  Description of Artificial Sequence: Synthetic oligonucleotide
  Target: ATXN1; (-) strand; PAM type: YTN; PAM sequence: TTG
acctcgtgatctgcctgccc

SEQ ID NO: 210502 - DNA, 20 bp, Artificial Sequence
  Description of Artificial Sequence: Synthetic oligonucleotide
  Target: ATXN1; (-) strand; PAM type: YTN; PAM sequence: CTT
gacctcgtgatctgcctgcc

SEQ ID NO: 210503 - DNA, 20 bp, Artificial Sequence
  Description of Artificial Sequence: Synthetic oligonucleotide
  Target: ATXN1; (-) strand; PAM type: YTN; PAM sequence: CTC
ttgacctcgtgatctgcctg

SEQ ID NO: 210504 - DNA, 20 bp, Artificial Sequence
  Description of Artificial Sequence: Synthetic oligonucleotide
  Target: ATXN1; (-) strand; PAM type: YTN; PAM sequence: CTC
aatctcttgacctcgtgatc

SEQ ID NO: 210505 - DNA, 20 bp, Artificial Sequence
  Description of Artificial Sequence: Synthetic oligonucleotide
  Target: ATXN1; (-) strand; PAM type: YTN; PAM sequence: TTG
gccaggatggtctcaatctc

SEQ ID NO: 210506 - DNA, 20 bp, Artificial Sequence
  Description of Artificial Sequence: Synthetic oligonucleotide
  Target: ATXN1; (-) strand; PAM type: YTN; PAM sequence: TTG
ccatgttggccaggatggtc

SEQ ID NO: 210507 - DNA, 20 bp, Artificial Sequence
  Description of Artificial Sequence: Synthetic oligonucleotide
  Target: ATXN1; (-) strand; PAM type: YTN; PAM sequence: TTT
gccatgttggccaggatggt

SEQ ID NO: 210508 - DNA, 20 bp, Artificial Sequence
  Description of Artificial Sequence: Synthetic oligonucleotide
  Target: ATXN1; (-) strand; PAM type: YTN; PAM sequence: TTT
tgccatgttggccaggatgg

SEQ ID NO: 210509 - DNA, 20 bp, Artificial Sequence
  Description of Artificial Sequence: Synthetic oligonucleotide
  Target: ATXN1; (-) strand; PAM type: YTN; PAM sequence: TTA
gtacagatggagttttgcca

SEQ ID NO: 210510 - DNA, 20 bp, Artificial Sequence
  Description of Artificial Sequence: Synthetic oligonucleotide
  Target: ATXN1; (-) strand; PAM type: YTN; PAM sequence: TTT
agtacagatggagttttgcc

SEQ ID NO: 210511 - DNA, 20 bp, Artificial Sequence
  Description of Artificial Sequence: Synthetic oligonucleotide
  Target: ATXN1; (-) strand; PAM type: YTN; PAM sequence: TTT
tagtacagatggagttttgc

SEQ ID NO: 210512 - DNA, 20 bp, Artificial Sequence
  Description of Artificial Sequence: Synthetic oligonucleotide
  Target: ATXN1; (-) strand; PAM type: YTN; PAM sequence: TTT
ttagtacagatggagttttg

SEQ ID NO: 210513 - DNA, 20 bp, Artificial Sequence
  Description of Artificial Sequence: Synthetic oligonucleotide
  Target: ATXN1; (-) strand; PAM type: YTN; PAM sequence: TTG
tatttttagtacagatggag

SEQ ID NO: 210514 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtacagatgga

SEQ ID NO: 210515 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtacagatgg

SEQ ID NO: 210516 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtacagatg

SEQ ID NO: 210517 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaca

SEQ ID NO: 210518 - DNA, 20 bp, Artificial Sequence
  Description of Artificial Sequence: Synthetic oligonucleotide
  Target: ATXN1; (-) strand; PAM type: YTN; PAM sequence: CTA
caggtgcgtgccaccatgcc

SEQ ID NO: 210519 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgcgtgccac

SEQ ID NO: 210520 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggactacag

SEQ ID NO: 210521 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 210522 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 210523 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccaagta

SEQ ID NO: 210524 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccaag

SEQ ID NO: 210525 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcctgcctcag

SEQ ID NO: 210526 - DNA, 20 bp, Artificial Sequence
  Description of Artificial Sequence: Synthetic oligonucleotide
  Target: ATXN1; (-) strand; PAM type: YTN; PAM sequence: TTA
cgggttcaagtgattctcct

SEQ ID NO: 210527 - DNA, 20 bp, Artificial Sequence
  Description of Artificial Sequence: Synthetic oligonucleotide
  Target: ATXN1; (-) strand; PAM type: YTN; PAM sequence: CTT
acgggttcaagtgattctcc

SEQ ID NO: 210528 - DNA, 20 bp, Artificial Sequence
  Description of Artificial Sequence: Synthetic oligonucleotide
  Target: ATXN1; (-) strand; PAM type: YTN; PAM sequence: CTC
caccttacgggttcaagtga

SEQ ID NO: 210529 - DNA, 20 bp, Artificial Sequence
  Description of Artificial Sequence: Synthetic oligonucleotide
  Target: ATXN1; (-) strand; PAM type: YTN; PAM sequence: CTG
caacctccaccttacgggtt

SEQ ID NO: 210530 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccaccttacg

SEQ ID NO: 210531 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctccacc

SEQ ID NO: 210532 - DNA, 20 bp, Artificial Sequence
  Description of Artificial Sequence: Synthetic oligonucleotide
  Target: ATXN1; (-) strand; PAM type: YTN; PAM sequence: CTC
tcggctcactgcaacctcca

SEQ ID NO: 210533 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcactctc

SEQ ID NO: 210534 - DNA, 20 bp, Artificial Sequence
  Description of Artificial Sequence: Synthetic oligonucleotide
  Target: ATXN1; (-) strand; PAM type: YTN; PAM sequence: CTG
tcaccaggctggagtgcagt

SEQ ID NO: 210535 - DNA, 20 bp, Artificial Sequence
  Description of Artificial Sequence: Synthetic oligonucleotide
  Target: ATXN1; (-) strand; PAM type: YTN; PAM sequence: CTC
tgtcaccaggctggagtgca

SEQ ID NO: 210536 - DNA, 20 bp, Artificial Sequence
  Description of Artificial Sequence: Synthetic oligonucleotide
  Target: ATXN1; (-) strand; PAM type: YTN; PAM sequence: CTC
tctgtcaccaggctggagtg

SEQ ID NO: 210537 - DNA, 20 bp, Artificial Sequence
  Description of Artificial Sequence: Synthetic oligonucleotide
  Target: ATXN1; (-) strand; PAM type: YTN; PAM sequence: CTC
tctctgtcaccaggctggag

SEQ ID NO: 210538 - DNA, 20 bp, Artificial Sequence
  Description of Artificial Sequence: Synthetic oligonucleotide
  Target: ATXN1; (-) strand; PAM type: YTN; PAM sequence: TTA
agacagagtctctctctgtc

SEQ ID NO: 210539 - DNA, 20 bp, Artificial Sequence
  Description of Artificial Sequence: Synthetic oligonucleotide
  Target: ATXN1; (-) strand; PAM type: YTN; PAM sequence: TTT
aagacagagtctctctctgt

SEQ ID NO: 210540 - DNA, 20 bp, Artificial Sequence
  Description of Artificial Sequence: Synthetic oligonucleotide
  Target: ATXN1; (-) strand; PAM type: YTN; PAM sequence: TTT
taagacagagtctctctctg

SEQ ID NO: 210541 - DNA, 20 bp, Artificial Sequence
  Description of Artificial Sequence: Synthetic oligonucleotide
  Target: ATXN1; (-) strand; PAM type: YTN; PAM sequence: TTT
ttaagacagagtctctctct

SEQ ID NO: 210542 - DNA, 20 bp, Artificial Sequence
  Description of Artificial Sequence: Synthetic oligonucleotide
  Target: ATXN1; (-) strand; PAM type: YTN; PAM sequence: TTT
tttaagacagagtctctctc

SEQ ID NO: 210543 - DNA, 20 bp, Artificial Sequence
  Description of Artificial Sequence: Synthetic oligonucleotide
  Target: ATXN1; (-) strand; PAM type: YTN; PAM sequence: TTT
ttttaagacagagtctctct

SEQ ID NO: 210544 - DNA, 20 bp, Artificial Sequence
  Description of Artificial Sequence: Synthetic oligonucleotide
  Target: ATXN1; (-) strand; PAM type: YTN; PAM sequence: TTT
tttttaagacagagtctctc

SEQ ID NO: 210545 - DNA, 20 bp, Artificial Sequence
  Description of Artificial Sequence: Synthetic oligonucleotide
  Target: ATXN1; (-) strand; PAM type: YTN; PAM sequence: TTT
ttttttaagacagagtctct

SEQ ID NO: 210546 - DNA, 20 bp, Artificial Sequence
  Description of Artificial Sequence: Synthetic oligonucleotide
  Target: ATXN1; (-) strand; PAM type: YTN; PAM sequence: TTT
tttttttaagacagagtctc

SEQ ID NO: 210547 - DNA, 20 bp, Artificial Sequence
  Description of Artificial Sequence: Synthetic oligonucleotide
  Target: ATXN1; (-) strand; PAM type: YTN; PAM sequence: TTT
ttttttttaagacagagtct

SEQ ID NO: 210548 - DNA, 20 bp, Artificial Sequence
  Description of Artificial Sequence: Synthetic oligonucleotide
  Target: ATXN1; (-) strand; PAM type: YTN; PAM sequence: TTT
tttttttttaagacagagtc

SEQ ID NO: 210549 - DNA, 20 bp, Artificial Sequence
  Description of Artificial Sequence: Synthetic oligonucleotide
  Target: ATXN1; (-) strand; PAM type: YTN; PAM sequence: TTT
ttttttttttaagacagagt

SEQ ID NO: 210550 - DNA, 20 bp, Artificial Sequence
  Description of Artificial Sequence: Synthetic oligonucleotide
  Target: ATXN1; (-) strand; PAM type: YTN; PAM sequence: TTT
tttttttttttaagacagag

SEQ ID NO: 210551 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttaagacaga

SEQ ID NO: 210552 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttaagacag

SEQ ID NO: 210553 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttttaagac

SEQ ID NO: 210554 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttttttaaga

SEQ ID NO: 210555 - DNA, 20 bp, Artificial Sequence
  Description of Artificial Sequence: Synthetic oligonucleotide
  Target: ATXN1; (-) strand; PAM type: YTN; PAM sequence: CTT
tctttttttttttttttaag

SEQ ID NO: 210556 - DNA, 20 bp, Artificial Sequence
  Description of Artificial Sequence: Synthetic oligonucleotide
  Target: ATXN1; (-) strand; PAM type: YTN; PAM sequence: TTC
cctttctttttttttttttt

SEQ ID NO: 210557 - DNA, 20 bp, Artificial Sequence
  Description of Artificial Sequence: Synthetic oligonucleotide
  Target: ATXN1; (-) strand; PAM type: YTN; PAM sequence: TTT
ccctttcttttttttttttt

SEQ ID NO: 210558 - DNA, 20 bp, Artificial Sequence
  Description of Artificial Sequence: Synthetic oligonucleotide
  Target: ATXN1; (-) strand; PAM type: YTN; PAM sequence: TTA
tttccctttctttttttttt

SEQ ID NO: 210559 - DNA, 20 bp, Artificial Sequence
  Description of Artificial Sequence: Synthetic oligonucleotide
  Target: ATXN1; (-) strand; PAM type: YTN; PAM sequence: TTT
atttccctttcttttttttt

SEQ ID NO: 210560 - DNA, 20 bp, Artificial Sequence
  Description of Artificial Sequence: Synthetic oligonucleotide
  Target: ATXN1; (-) strand; PAM type: YTN; PAM sequence: TTA
ggtttatttccctttctttt

SEQ ID NO: 210561 - DNA, 20 bp, Artificial Sequence
  Description of Artificial Sequence: Synthetic oligonucleotide
  Target: ATXN1; (-) strand; PAM type: YTN; PAM sequence: CTT
aggtttatttccctttcttt

SEQ ID NO: 210562 - DNA, 20 bp, Artificial Sequence
  Description of Artificial Sequence: Synthetic oligonucleotide
  Target: ATXN1; (-) strand; PAM type: YTN; PAM sequence: TTC
ttaggtttatttccctttct

SEQ ID NO: 210563 - DNA, 20 bp, Artificial Sequence
  Description of Artificial Sequence: Synthetic oligonucleotide
  Target: ATXN1; (-) strand; PAM type: YTN; PAM sequence: TTT
cttaggtttatttccctttc

SEQ ID NO: 210564 - DNA, 20 bp, Artificial Sequence
  Description of Artificial Sequence: Synthetic oligonucleotide
  Target: ATXN1; (-) strand; PAM type: YTN; PAM sequence: TTT
tcttaggtttatttcccttt

SEQ ID NO: 210565 - DNA, 20 bp, Artificial Sequence
  Description of Artificial Sequence: Synthetic oligonucleotide
  Target: ATXN1; (-) strand; PAM type: YTN; PAM sequence: CTT
ttcttaggtttatttccctt

SEQ ID NO: 210566 - DNA, 20 bp, Artificial Sequence
  Description of Artificial Sequence: Synthetic oligonucleotide
  Target: ATXN1; (-) strand; PAM type: YTN; PAM sequence: TTG
cttttcttaggtttatttcc

SEQ ID NO: 210567 - DNA, 20 bp, Artificial Sequence
  Description of Artificial Sequence: Synthetic oligonucleotide
  Target: ATXN1; (-) strand; PAM type: YTN; PAM sequence: TTA
tattgcttttcttaggttta

SEQ ID NO: 210568 - DNA, 20 bp, Artificial Sequence
  Description of Artificial Sequence: Synthetic oligonucleotide
  Target: ATXN1; (-) strand; PAM type: YTN; PAM sequence: TTT
atattgcttttcttaggttt

SEQ ID NO: 210569 - DNA, 20 bp, Artificial Sequence
  Description of Artificial Sequence: Synthetic oligonucleotide
  Target: ATXN1; (-) strand; PAM type: YTN; PAM sequence: CTT
tatattgcttttcttaggtt

SEQ ID NO: 210570 - DNA, 20 bp, Artificial Sequence
  Description of Artificial Sequence: Synthetic oligonucleotide
  Target: ATXN1; (-) strand; PAM type: YTN; PAM sequence: TTC
ctttatattgcttttcttag

SEQ ID NO: 210571 - DNA, 20 bp, Artificial Sequence
  Description of Artificial Sequence: Synthetic oligonucleotide
  Target: ATXN1; (-) strand; PAM type: YTN; PAM sequence: TTT
cctttatattgcttttctta

SEQ ID NO: 210572 - DNA, 20 bp, Artificial Sequence
  Description of Artificial Sequence: Synthetic oligonucleotide
  Target: ATXN1; (-) strand; PAM type: YTN; PAM sequence: TTT
tcctttatattgcttttctt

SEQ ID NO: 210573 - DNA, 20 bp, Artificial Sequence
  Description of Artificial Sequence: Synthetic oligonucleotide
  Target: ATXN1; (-) strand; PAM type: YTN; PAM sequence: CTT
ttcctttatattgcttttct

SEQ ID NO: 210574 - DNA, 20 bp, Artificial Sequence
  Description of Artificial Sequence: Synthetic oligonucleotide
  Target: ATXN1; (-) strand; PAM type: YTN; PAM sequence: TTA
tgtgcttttcctttatattg

SEQ ID NO: 210575 - DNA, 20 bp, Artificial Sequence
  Description of Artificial Sequence: Synthetic oligonucleotide
  Target: ATXN1; (-) strand; PAM type: YTN; PAM sequence: TTT
atgtgcttttcctttatatt

SEQ ID NO: 210576 - DNA, 20 bp, Artificial Sequence
  Description of Artificial Sequence: Synthetic oligonucleotide
  Target: ATXN1; (-) strand; PAM type: YTN; PAM sequence: TTT
tatgtgcttttcctttatat

SEQ ID NO: 210577 - DNA, 20 bp, Artificial Sequence
  Description of Artificial Sequence: Synthetic oligonucleotide
  Target: ATXN1; (-) strand; PAM type: YTN; PAM sequence: TTG
gatagttttatgtgcttttc

SEQ ID NO: 210578 - DNA, 20 bp, Artificial Sequence
  Description of Artificial Sequence: Synthetic oligonucleotide
  Target: ATXN1; (-) strand; PAM type: YTN; PAM sequence: TTT
ggatagttttatgtgctttt

SEQ ID NO: 210579 - DNA, 20 bp, Artificial Sequence
  Description of Artificial Sequence: Synthetic oligonucleotide
  Target: ATXN1; (-) strand; PAM type: YTN; PAM sequence: CTC
acatttggatagttttatgt

SEQ ID NO: 210580 - DNA, 20 bp, Artificial Sequence
  Description of Artificial Sequence: Synthetic oligonucleotide
  Target: ATXN1; (-) strand; PAM type: YTN; PAM sequence: TTA
tctcacatttggatagtttt

SEQ ID NO: 210581 - DNA, 20 bp, Artificial Sequence
  Description of Artificial Sequence: Synthetic oligonucleotide
  Target: ATXN1; (-) strand; PAM type: YTN; PAM sequence: TTT
atctcacatttggatagttt

SEQ ID NO: 210582 - DNA, 20 bp, Artificial Sequence
  Description of Artificial Sequence: Synthetic oligonucleotide
  Target: ATXN1; (-) strand; PAM type: YTN; PAM sequence: TTT
tatctcacatttggatagtt

SEQ ID NO: 210583 - DNA, 20 bp, Artificial Sequence
  Description of Artificial Sequence: Synthetic oligonucleotide
  Target: ATXN1; (-) strand; PAM type: YTN; PAM sequence: TTT
ttatctcacatttggatagt

SEQ ID NO: 210584 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccgcgcc

SEQ ID NO: 210585 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 210586 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 210587 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 210588 - DNA, 20 bp, Artificial Sequence
  Description of Artificial Sequence: Synthetic oligonucleotide
  Target: ATXN1; (-) strand; PAM type: YTN; PAM sequence: CTC
atgatccacccgcctcggcc

SEQ ID NO: 210589 - DNA, 20 bp, Artificial Sequence
  Description of Artificial Sequence: Synthetic oligonucleotide
  Target: ATXN1; (-) strand; PAM type: YTN; PAM sequence: CTG
acctcatgatccacccgcct

SEQ ID NO: 210590 - DNA, 20 bp, Artificial Sequence
  Description of Artificial Sequence: Synthetic oligonucleotide
  Target: ATXN1; (-) strand; PAM type: YTN; PAM sequence: CTC
ctgacctcatgatccacccg

SEQ ID NO: 210591 - DNA, 20 bp, Artificial Sequence
  Description of Artificial Sequence: Synthetic oligonucleotide
  Target: ATXN1; (-) strand; PAM type: YTN; PAM sequence: CTC
gatctcctgacctcatgatc

SEQ ID NO: 210592 - DNA, 20 bp, Artificial Sequence
  Description of Artificial Sequence: Synthetic oligonucleotide
  Target: ATXN1; (-) strand; PAM type: YTN; PAM sequence: TTA
gccaggatggtctcgatctc

SEQ ID NO: 210593 - DNA, 20 bp, Artificial Sequence
  Description of Artificial Sequence: Synthetic oligonucleotide
  Target: ATXN1; (-) strand; PAM type: YTN; PAM sequence: TTG
ttagccaggatggtctcgat

SEQ ID NO: 210594 - DNA, 20 bp, Artificial Sequence
  Description of Artificial Sequence: Synthetic oligonucleotide
  Target: ATXN1; (-) strand; PAM type: YTN; PAM sequence: CTT
gttagccaggatggtctcga

SEQ ID NO: 210595 - DNA, 20 bp, Artificial Sequence
  Description of Artificial Sequence: Synthetic oligonucleotide
  Target: ATXN1; (-) strand; PAM type: YTN; PAM sequence: TTC
accttgttagccaggatggt

SEQ ID NO: 210596 - DNA, 20 bp, Artificial Sequence
  Description of Artificial Sequence: Synthetic oligonucleotide
  Target: ATXN1; (-) strand; PAM type: YTN; PAM sequence: TTT
caccttgttagccaggatgg

SEQ ID NO: 210597 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggtttcacct

SEQ ID NO: 210598 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggtttcacc

SEQ ID NO: 210599 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggtttcac

SEQ ID NO: 210600 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggtttca

SEQ ID NO: 210601 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacgggg

SEQ ID NO: 210602 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggg

SEQ ID NO: 210603 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 210604 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 210605 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagac

SEQ ID NO: 210606 - DNA, 20 bp, Artificial Sequence
  Description of Artificial Sequence: Synthetic oligonucleotide
  Target: ATXN1; (-) strand; PAM type: YTN; PAM sequence: CTA
attttttgtatttttagtag

SEQ ID NO: 210607 - DNA, 20 bp, Artificial Sequence
  Description of Artificial Sequence: Synthetic oligonucleotide
  Target: ATXN1; (-) strand; PAM type: YTN; PAM sequence: CTA
caggcgcccgccaccgcgcc

SEQ ID NO: 210608 - DNA, 20 bp, Artificial Sequence
  Description of Artificial Sequence: Synthetic oligonucleotide
  Target: ATXN1; (-) strand; PAM type: YTN; PAM sequence: CTG
ggactacaggcgcccgccac

SEQ ID NO: 210609 - DNA, 20 bp, Artificial Sequence
  Description of Artificial Sequence: Synthetic oligonucleotide
  Target: ATXN1; (-) strand; PAM type: YTN; PAM sequence: CTC
ccgagtggctgggactacag

SEQ ID NO: 210610 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtggctggga

SEQ ID NO: 210611 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtggct

SEQ ID NO: 210612 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagtg

SEQ ID NO: 210613 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgag

SEQ ID NO: 210614 - DNA, 20 bp, Artificial Sequence
  Description of Artificial Sequence: Synthetic oligonucleotide
  Target: ATXN1; (-) strand; PAM type: YTN; PAM sequence: TTC
acgccattctcctgcctcag

SEQ ID NO: 210615 - DNA, 20 bp, Artificial Sequence
  Description of Artificial Sequence: Synthetic oligonucleotide
  Target: ATXN1; (-) strand; PAM type: YTN; PAM sequence: TTC
ccgggttcacgccattctcc

SEQ ID NO: 210616 - DNA, 20 bp, Artificial Sequence
  Description of Artificial Sequence: Synthetic oligonucleotide
  Target: ATXN1; (-) strand; PAM type: YTN; PAM sequence: CTT
cccgggttcacgccattctc

SEQ ID NO: 210617 - DNA, 20 bp, Artificial Sequence
  Description of Artificial Sequence: Synthetic oligonucleotide
  Target: ATXN1; (-) strand; PAM type: YTN; PAM sequence: CTC
cgcttcccgggttcacgcca

SEQ ID NO: 210618 - DNA, 20 bp, Artificial Sequence
  Description of Artificial Sequence: Synthetic oligonucleotide
  Target: ATXN1; (-) strand; PAM type: YTN; PAM sequence: CTG
caagctccgcttcccgggtt

SEQ ID NO: 210619 - DNA, 20 bp, Artificial Sequence
  Description of Artificial Sequence: Synthetic oligonucleotide
  Target: ATXN1; (-) strand; PAM type: YTN; PAM sequence: CTC
actgcaagctccgcttcccg

SEQ ID NO: 210620 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaagctccgct

SEQ ID NO: 210621 - DNA, 20 bp, Artificial Sequence
  Description of Artificial Sequence: Synthetic oligonucleotide
  Target: ATXN1; (-) strand; PAM type: YTN; PAM sequence: CTG
cagtggcacaatctcggctc

SEQ ID NO: 210622 - DNA, 20 bp, Artificial Sequence
  Description of Artificial Sequence: Synthetic oligonucleotide
  Target: ATXN1; (-) strand; PAM type: YTN; PAM sequence: CTG
cggactgcagtggcacaatc

SEQ ID NO: 210623 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggccggactgcgg

SEQ ID NO: 210624 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggccggactgc

SEQ ID NO: 210625 - DNA, 20 bp, Artificial Sequence
  Description of Artificial Sequence: Synthetic oligonucleotide
  Target: ATXN1; (-) strand; PAM type: YTN; PAM sequence: CTC
gctctgtcgcccaggccgga

SEQ ID NO: 210626 - DNA, 20 bp, Artificial Sequence
  Description of Artificial Sequence: Synthetic oligonucleotide
  Target: ATXN1; (-) strand; PAM type: YTN; PAM sequence: TTG
agacggagtctcgctctgtc

SEQ ID NO: 210627 - DNA, 20 bp, Artificial Sequence
  Description of Artificial Sequence: Synthetic oligonucleotide
  Target: ATXN1; (-) strand; PAM type: YTN; PAM sequence: TTT
gagacggagtctcgctctgt

SEQ ID NO: 210628 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtctcgctctg

SEQ ID NO: 210629 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagtctcgctct

SEQ ID NO: 210630 - DNA, 20 bp, Artificial Sequence
  Description of Artificial Sequence: Synthetic oligonucleotide
  Target: ATXN1; (-) strand; PAM type: YTN; PAM sequence: TTT
tttgagacggagtctcgctc

SEQ ID NO: 210631 - DNA, 20 bp, Artificial Sequence
  Description of Artificial Sequence: Synthetic oligonucleotide
  Target: ATXN1; (-) strand; PAM type: YTN; PAM sequence: TTT
ttttgagacggagtctcgct

SEQ ID NO: 210632 - DNA, 20 bp, Artificial Sequence
  Description of Artificial Sequence: Synthetic oligonucleotide
  Target: ATXN1; (-) strand; PAM type: YTN; PAM sequence: TTT
tttttgagacggagtctcgc

SEQ ID NO: 210633 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacggagtctcg

SEQ ID NO: 210634 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacggagtctc

SEQ ID NO: 210635 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacggagtct

SEQ ID NO: 210636 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacggagtc

SEQ ID NO: 210637 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacggagt

SEQ ID NO: 210638 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacggag

SEQ ID NO: 210639 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacgga

SEQ ID NO: 210640 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacgg

SEQ ID NO: 210641 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagacg

SEQ ID NO: 210642 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagac

SEQ ID NO: 210643 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaga

SEQ ID NO: 210644 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgag

SEQ ID NO: 210645 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttga

SEQ ID NO: 210646 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttg

SEQ ID NO: 210647 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 210648 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 210649 - DNA, 20 bp, Artificial Sequence
  Description of Artificial Sequence: Synthetic oligonucleotide
  Target: ATXN1; (-) strand; PAM type: YTN; PAM sequence: TTA
aaataatttttttttttttt

SEQ ID NO: 210650 - DNA, 20 bp, Artificial Sequence
  Description of Artificial Sequence: Synthetic oligonucleotide
  Target: ATXN1; (-) strand; PAM type: YTN; PAM sequence: TTT
aaaataattttttttttttt

SEQ ID NO: 210651 - DNA, 20 bp, Artificial Sequence
  Description of Artificial Sequence: Synthetic oligonucleotide
  Target: ATXN1; (-) strand; PAM type: YTN; PAM sequence: TTT
taaaataatttttttttttt

SEQ ID NO: 210652 - DNA, 20 bp, Artificial Sequence
  Description of Artificial Sequence: Synthetic oligonucleotide
  Target: ATXN1; (-) strand; PAM type: YTN; PAM sequence: CTT
ttaaaataattttttttttt

SEQ ID NO: 210653 - DNA, 20 bp, Artificial Sequence
  Description of Artificial Sequence: Synthetic oligonucleotide
  Target: ATXN1; (-) strand; PAM type: YTN; PAM sequence: TTA
atagccttttaaaataattt

SEQ ID NO: 210654 - DNA, 20 bp, Artificial Sequence
  Description of Artificial Sequence: Synthetic oligonucleotide
  Target: ATXN1; (-) strand; PAM type: YTN; PAM sequence: CTA
attaatagccttttaaaata

SEQ ID NO: 210655 - DNA, 20 bp, Artificial Sequence
  Description of Artificial Sequence: Synthetic oligonucleotide
  Target: ATXN1; (-) strand; PAM type: YTN; PAM sequence: CTA
gctaattaatagccttttaa

SEQ ID NO: 210656 - DNA, 20 bp, Artificial Sequence
  Description of Artificial Sequence: Synthetic oligonucleotide
  Target: ATXN1; (-) strand; PAM type: YTN; PAM sequence: CTG
ctagctaattaatagccttt

SEQ ID NO: 210657 - DNA, 20 bp, Artificial Sequence
  Description of Artificial Sequence: Synthetic oligonucleotide
  Target: ATXN1; (-) strand; PAM type: YTN; PAM sequence: TTA
ctgctagctaattaatagcc

SEQ ID NO: 210658 - DNA, 20 bp, Artificial Sequence
  Description of Artificial Sequence: Synthetic oligonucleotide
  Target: ATXN1; (-) strand; PAM type: YTN; PAM sequence: CTT
actgctagctaattaatagc

SEQ ID NO: 210659 - DNA, 20 bp, Artificial Sequence
  Description of Artificial Sequence: Synthetic oligonucleotide
  Target: ATXN1; (-) strand; PAM type: YTN; PAM sequence: TTA
aaatatatgcaaaaataaga

SEQ ID NO: 210660 - DNA, 20 bp, Artificial Sequence
  Description of Artificial Sequence: Synthetic oligonucleotide
  Target: ATXN1; (-) strand; PAM type: YTN; PAM sequence: TTT
aaaatatatgcaaaaataag

SEQ ID NO: 210661 - DNA, 20 bp, Artificial Sequence
  Description of Artificial Sequence: Synthetic oligonucleotide
  Target: ATXN1; (-) strand; PAM type: YTN; PAM sequence: TTT
taaaatatatgcaaaaataa

SEQ ID NO: 210662 - DNA, 20 bp, Artificial Sequence
  Description of Artificial Sequence: Synthetic oligonucleotide
  Target: ATXN1; (-) strand; PAM type: YTN; PAM sequence: TTG
tatatattttaaaatatatg

SEQ ID NO: 210663 - DNA, 20 bp, Artificial Sequence
  Description of Artificial Sequence: Synthetic oligonucleotide
  Target: ATXN1; (-) strand; PAM type: YTN; PAM sequence: TTT
gtatatattttaaaatatat

SEQ ID NO: 210664 - DNA, 20 bp, Artificial Sequence
  Description of Artificial Sequence: Synthetic oligonucleotide
  Target: ATXN1; (-) strand; PAM type: YTN; PAM sequence: TTT
tgtatatattttaaaatata

SEQ ID NO: 210665 - DNA, 20 bp, Artificial Sequence
  Description of Artificial Sequence: Synthetic oligonucleotide
  Target: ATXN1; (-) strand; PAM type: YTN; PAM sequence: TTA
aaacattttgtatatatttt

SEQ ID NO: 210666 - DNA, 20 bp, Artificial Sequence
  Description of Artificial Sequence: Synthetic oligonucleotide
  Target: ATXN1; (-) strand; PAM type: YTN; PAM sequence: TTT
aaaacattttgtatatattt

SEQ ID NO: 210667 - DNA, 20 bp, Artificial Sequence
  Description of Artificial Sequence: Synthetic oligonucleotide
  Target: ATXN1; (-) strand; PAM type: YTN; PAM sequence: TTT
taaaacattttgtatatatt

SEQ ID NO: 210668 - DNA, 20 bp, Artificial Sequence
  Description of Artificial Sequence: Synthetic oligonucleotide
  Target: ATXN1; (-) strand; PAM type: YTN; PAM sequence: TTG
tatatattttaaaacatttt

SEQ ID NO: 210669 - DNA, 20 bp, Artificial Sequence
  Description of Artificial Sequence: Synthetic oligonucleotide
  Target: ATXN1; (-) strand; PAM type: YTN; PAM sequence: TTT
gtatatattttaaaacattt

SEQ ID NO: 210670 - DNA, 20 bp, Artificial Sequence
  Description of Artificial Sequence: Synthetic oligonucleotide
  Target: ATXN1; (-) strand; PAM type: YTN; PAM sequence: TTT
tgtatatattttaaaacatt

SEQ ID NO: 210671 - DNA, 20 bp, Artificial Sequence
  Description of Artificial Sequence: Synthetic oligonucleotide
  Target: ATXN1; (-) strand; PAM type: YTN; PAM sequence: TTT
ttgtatatattttaaaacat

SEQ ID NO: 210672 - DNA, 20 bp, Artificial Sequence
  Description of Artificial Sequence: Synthetic oligonucleotide
  Target: ATXN1; (-) strand; PAM type: YTN; PAM sequence: TTA
tttttgtatatattttaaaa

SEQ ID NO: 210673 - DNA, 20 bp, Artificial Sequence
  Description of Artificial Sequence: Synthetic oligonucleotide
  Target: ATXN1; (-) strand; PAM type: YTN; PAM sequence: CTT
atttttgtatatattttaaa

SEQ ID NO: 210674 - DNA, 20 bp, Artificial Sequence
  Description of Artificial Sequence: Synthetic oligonucleotide
  Target: ATXN1; (-) strand; PAM type: YTN; PAM sequence: CTA
gcagtaagtcaatcttattt

SEQ ID NO: 210675 - DNA, 20 bp, Artificial Sequence
  Description of Artificial Sequence: Synthetic oligonucleotide
  Target: ATXN1; (-) strand; PAM type: YTN; PAM sequence: TTA
gctagcagtaagtcaatctt

SEQ ID NO: 210676 - DNA, 20 bp, Artificial Sequence
  Description of Artificial Sequence: Synthetic oligonucleotide
  Target: ATXN1; (-) strand; PAM type: YTN; PAM sequence: TTA
agattagctagcagtaagtc

SEQ ID NO: 210677 - DNA, 20 bp, Artificial Sequence
  Description of Artificial Sequence: Synthetic oligonucleotide
  Target: ATXN1; (-) strand; PAM type: YTN; PAM sequence: CTT
aagattagctagcagtaagt

SEQ ID NO: 210678 - DNA, 20 bp, Artificial Sequence
  Description of Artificial Sequence: Synthetic oligonucleotide
  Target: ATXN1; (-) strand; PAM type: YTN; PAM sequence: CTG
aaacttaagattagctagca

SEQ ID NO: 210679 - DNA, 20 bp, Artificial Sequence
  Description of Artificial Sequence: Synthetic oligonucleotide
  Target: ATXN1; (-) strand; PAM type: YTN; PAM sequence: CTC
tgaaacttaagattagctag

SEQ ID NO: 210680 - DNA, 20 bp, Artificial Sequence
  Description of Artificial Sequence: Synthetic oligonucleotide
  Target: ATXN1; (-) strand; PAM type: YTN; PAM sequence: TTC
tctgaaacttaagattagct

SEQ ID NO: 210681 - DNA, 20 bp, Artificial Sequence
  Description of Artificial Sequence: Synthetic oligonucleotide
  Target: ATXN1; (-) strand; PAM type: YTN; PAM sequence: TTG
ttctctgaaacttaagatta

SEQ ID NO: 210682 - DNA, 20 bp, Artificial Sequence
  Description of Artificial Sequence: Synthetic oligonucleotide
  Target: ATXN1; (-) strand; PAM type: YTN; PAM sequence: TTT
gttctctgaaacttaagatt

SEQ ID NO: 210683 - DNA, 20 bp, Artificial Sequence
  Description of Artificial Sequence: Synthetic oligonucleotide
  Target: ATXN1; (-) strand; PAM type: YTN; PAM sequence: TTG
gtttgttctctgaaacttaa

SEQ ID NO: 210684 - DNA, 20 bp, Artificial Sequence
  Description of Artificial Sequence: Synthetic oligonucleotide
  Target: ATXN1; (-) strand; PAM type: YTN; PAM sequence: TTT
ggtttgttctctgaaactta

SEQ ID NO: 210685 - DNA, 20 bp, Artificial Sequence
  Description of Artificial Sequence: Synthetic oligonucleotide
  Target: ATXN1; (-) strand; PAM type: YTN; PAM sequence: TTA
atttggtttgttctctgaaa

SEQ ID NO: 210686 - DNA, 20 bp, Artificial Sequence
  Description of Artificial Sequence: Synthetic oligonucleotide
  Target: ATXN1; (-) strand; PAM type: YTN; PAM sequence: TTT
aatttggtttgttctctgaa

SEQ ID NO: 210687 - DNA, 20 bp, Artificial Sequence
  Description of Artificial Sequence: Synthetic oligonucleotide
  Target: ATXN1; (-) strand; PAM type: YTN; PAM sequence: TTT
taatttggtttgttctctga

SEQ ID NO: 210688 - DNA, 20 bp, Artificial Sequence
  Description of Artificial Sequence: Synthetic oligonucleotide
  Target: ATXN1; (-) strand; PAM type: YTN; PAM sequence: TTT
ttaatttggtttgttctctg

SEQ ID NO: 210689 - DNA, 20 bp, Artificial Sequence
  Description of Artificial Sequence: Synthetic oligonucleotide
  Target: ATXN1; (-) strand; PAM type: YTN; PAM sequence: TTA
tttttaatttggtttgttct

SEQ ID NO: 210690 - DNA, 20 bp, Artificial Sequence
  Description of Artificial Sequence: Synthetic oligonucleotide
  Target: ATXN1; (-) strand; PAM type: YTN; PAM sequence: CTT
atttttaatttggtttgttc

SEQ ID NO: 210691 - DNA, 20 bp, Artificial Sequence
  Description of Artificial Sequence: Synthetic oligonucleotide
  Target: ATXN1; (-) strand; PAM type: YTN; PAM sequence: TTC
ttatttttaatttggtttgt

SEQ ID NO: 210692 - DNA, 20 bp, Artificial Sequence
  Description of Artificial Sequence: Synthetic oligonucleotide
  Target: ATXN1; (-) strand; PAM type: YTN; PAM sequence: CTT
cttatttttaatttggtttg

SEQ ID NO: 210693 - DNA, 20 bp, Artificial Sequence
  Description of Artificial Sequence: Synthetic oligonucleotide
  Target: ATXN1; (-) strand; PAM type: YTN; PAM sequence: TTC
cacttcttatttttaatttg

SEQ ID NO: 210694 - DNA, 20 bp, Artificial Sequence
  Description of Artificial Sequence: Synthetic oligonucleotide
  Target: ATXN1; (-) strand; PAM type: YTN; PAM sequence: TTA
ttccacttcttatttttaat

SEQ ID NO: 210695 - DNA, 20 bp, Artificial Sequence
  Description of Artificial Sequence: Synthetic oligonucleotide
  Target: ATXN1; (-) strand; PAM type: YTN; PAM sequence: TTT
attccacttcttatttttaa

SEQ ID NO: 210696 - DNA, 20 bp, Artificial Sequence
  Description of Artificial Sequence: Synthetic oligonucleotide
  Target: ATXN1; (-) strand; PAM type: YTN; PAM sequence: TTG
tgaatttattccacttctta

SEQ ID NO: 210697 - DNA, 20 bp, Artificial Sequence
  Description of Artificial Sequence: Synthetic oligonucleotide
  Target: ATXN1; (-) strand; PAM type: YTN; PAM sequence: TTT
gtgaatttattccacttctt

SEQ ID NO: 210698 - DNA, 20 bp, Artificial Sequence
  Description of Artificial Sequence: Synthetic oligonucleotide
  Target: ATXN1; (-) strand; PAM type: YTN; PAM sequence: CTC
aatatttgtgaatttattcc

SEQ ID NO: 210699 - DNA, 20 bp, Artificial Sequence
  Description of Artificial Sequence: Synthetic oligonucleotide
  Target: ATXN1; (-) strand; PAM type: YTN; PAM sequence: TTC
tcaatatttgtgaatttatt

SEQ ID NO: 210700 - DNA, 20 bp, Artificial Sequence
  Description of Artificial Sequence: Synthetic oligonucleotide
  Target: ATXN1; (-) strand; PAM type: YTN; PAM sequence: TTA
aaacattctcaatatttgtg

SEQ ID NO: 210701 - DNA, 20 bp, Artificial Sequence
  Description of Artificial Sequence: Synthetic oligonucleotide
  Target: ATXN1; (-) strand; PAM type: YTN; PAM sequence: TTT
aaaacattctcaatatttgt

SEQ ID NO: 210702 - DNA, 20 bp, Artificial Sequence
  Description of Artificial Sequence: Synthetic oligonucleotide
  Target: ATXN1; (-) strand; PAM type: YTN; PAM sequence: TTA
aaaatttaaaacattctcaa

SEQ ID NO: 210703 - DNA, 20 bp, Artificial Sequence
  Description of Artificial Sequence: Synthetic oligonucleotide
  Target: ATXN1; (-) strand; PAM type: YTN; PAM sequence: TTT
aaaaatttaaaacattctca

SEQ ID NO: 210704 - DNA, 20 bp, Artificial Sequence
  Description of Artificial Sequence: Synthetic oligonucleotide
  Target: ATXN1; (-) strand; PAM type: YTN; PAM sequence: TTT
taaaaatttaaaacattctc

SEQ ID NO: 210705 - DNA, 20 bp, Artificial Sequence
  Description of Artificial Sequence: Synthetic oligonucleotide
  Target: ATXN1; (-) strand; PAM type: YTN; PAM sequence: TTA
catattttaaaaatttaaaa

SEQ ID NO: 210706 - DNA, 20 bp, Artificial Sequence
  Description of Artificial Sequence: Synthetic oligonucleotide
  Target: ATXN1; (-) strand; PAM type: YTN; PAM sequence: TTA
acacagtcaaatattacata

SEQ ID NO: 210707 - DNA, 20 bp, Artificial Sequence
  Description of Artificial Sequence: Synthetic oligonucleotide
  Target: ATXN1; (-) strand; PAM type: YTN; PAM sequence: TTG
ttaacacagtcaaatattac

SEQ ID NO: 210708 - DNA, 20 bp, Artificial Sequence
  Description of Artificial Sequence: Synthetic oligonucleotide
  Target: ATXN1; (-) strand; PAM type: YTN; PAM sequence: TTT
gttaacacagtcaaatatta

SEQ ID NO: 210709 - DNA, 20 bp, Artificial Sequence
  Description of Artificial Sequence: Synthetic oligonucleotide
  Target: ATXN1; (-) strand; PAM type: YTN; PAM sequence: TTT
tgttaacacagtcaaatatt

SEQ ID NO: 210710 - DNA, 20 bp, Artificial Sequence
  Description of Artificial Sequence: Synthetic oligonucleotide
  Target: ATXN1; (-) strand; PAM type: YTN; PAM sequence: TTC
aaaattttgttaacacagtc

SEQ ID NO: 210711 - DNA, 20 bp, Artificial Sequence
  Description of Artificial Sequence: Synthetic oligonucleotide
  Target: ATXN1; (-) strand; PAM type: YTN; PAM sequence: CTA
tattcaaaattttgttaaca

SEQ ID NO: 210712 - DNA, 20 bp, Artificial Sequence
  Description of Artificial Sequence: Synthetic oligonucleotide
  Target: ATXN1; (-) strand; PAM type: YTN; PAM sequence: TTC
tatattcaaaattttgttaa

SEQ ID NO: 210713 - DNA, 20 bp, Artificial Sequence
  Description of Artificial Sequence: Synthetic oligonucleotide
  Target: ATXN1; (-) strand; PAM type: YTN; PAM sequence: TTT
ctatattcaaaattttgtta

SEQ ID NO: 210714 - DNA, 20 bp, Artificial Sequence
  Description of Artificial Sequence: Synthetic oligonucleotide
  Target: ATXN1; (-) strand; PAM type: YTN; PAM sequence: CTG
accatttctatattcaaaat

SEQ ID NO: 210715 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccaccggacc

SEQ ID NO: 210716 - DNA, 20 bp, Artificial Sequence
  Description of Artificial Sequence: Synthetic oligonucleotide
  Target: ATXN1; (-) strand; PAM type: YTN; PAM sequence: CTC
ccaaagcatggggattacag

SEQ ID NO: 210717 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagcatgggga

SEQ ID NO: 210718 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaaagcatg

SEQ ID NO: 210719 - DNA, 20 bp, Artificial Sequence
  Description of Artificial Sequence: Synthetic oligonucleotide
  Target: ATXN1; (-) strand; PAM type: YTN; PAM sequence: TTG
agcaatcctgcctcagcctc

SEQ ID NO: 210720 - DNA, 20 bp, Artificial Sequence
  Description of Artificial Sequence: Synthetic oligonucleotide
  Target: ATXN1; (-) strand; PAM type: YTN; PAM sequence: CTT
gagcaatcctgcctcagcct

SEQ ID NO: 210721 - DNA, 20 bp, Artificial Sequence
  Description of Artificial Sequence: Synthetic oligonucleotide
  Target: ATXN1; (-) strand; PAM type: YTN; PAM sequence: CTG
ccttgagcaatcctgcctca

SEQ ID NO: 210722 - DNA, 20 bp, Artificial Sequence
  Description of Artificial Sequence: Synthetic oligonucleotide
  Target: ATXN1; (-) strand; PAM type: YTN; PAM sequence: CTC
ctgccttgagcaatcctgcc

SEQ ID NO: 210723 - DNA, 20 bp, Artificial Sequence
  Description of Artificial Sequence: Synthetic oligonucleotide
  Target: ATXN1; (-) strand; PAM type: YTN; PAM sequence: CTC
aaactcctgccttgagcaat

SEQ ID NO: 210724 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcctgccttga

SEQ ID NO: 210725 - DNA, 20 bp, Artificial Sequence
  Description of Artificial Sequence: Synthetic oligonucleotide
  Target: ATXN1; (-) strand; PAM type: YTN; PAM sequence: CTC
aggctggtctcaaactcctg

SEQ ID NO: 210726 - DNA, 20 bp, Artificial Sequence
  Description of Artificial Sequence: Synthetic oligonucleotide
  Target: ATXN1; (-) strand; PAM type: YTN; PAM sequence: TTG
ctcaggctggtctcaaactc

SEQ ID NO: 210727 - DNA, 20 bp, Artificial Sequence
  Description of Artificial Sequence: Synthetic oligonucleotide
  Target: ATXN1; (-) strand; PAM type: YTN; PAM sequence: CTA
tattgctcaggctggtctca

SEQ ID NO: 210728 - DNA, 20 bp, Artificial Sequence
  Description of Artificial Sequence: Synthetic oligonucleotide
  Target: ATXN1; (-) strand; PAM type: YTN; PAM sequence: CTC
actatattgctcaggctggt

SEQ ID NO: 210729 - DNA, 20 bp, Artificial Sequence
  Description of Artificial Sequence: Synthetic oligonucleotide
  Target: ATXN1; (-) strand; PAM type: YTN; PAM sequence: TTG
tagagatggggtctcactat

SEQ ID NO: 210730 - DNA, 20 bp, Artificial Sequence
  Description of Artificial Sequence: Synthetic oligonucleotide
  Target: ATXN1; (-) strand; PAM type: YTN; PAM sequence: TTT
gtagagatggggtctcacta

SEQ ID NO: 210731 - DNA, 20 bp, Artificial Sequence
  Description of Artificial Sequence: Synthetic oligonucleotide
  Target: ATXN1; (-) strand; PAM type: YTN; PAM sequence: TTT
tgtagagatggggtctcact

SEQ ID NO: 210732 - DNA, 20 bp, Artificial Sequence
  Description of Artificial Sequence: Synthetic oligonucleotide
  Target: ATXN1; (-) strand; PAM type: YTN; PAM sequence: TTT
ttgtagagatggggtctcac

SEQ ID NO: 210733 - DNA, 20 bp, Artificial Sequence
  Description of Artificial Sequence: Synthetic oligonucleotide
  Target: ATXN1; (-) strand; PAM type: YTN; PAM sequence: TTT
tttgtagagatggggtctca

SEQ ID NO: 210734 - DNA, 20 bp, Artificial Sequence
  Description of Artificial Sequence: Synthetic oligonucleotide
  Target: ATXN1; (-) strand; PAM type: YTN; PAM sequence: CTT
ttttgtagagatggggtctc

SEQ ID NO: 210735 - DNA, 20 bp, Artificial Sequence
  Description of Artificial Sequence: Synthetic oligonucleotide
  Target: ATXN1; (-) strand; PAM type: YTN; PAM sequence: TTA
acttttttgtagagatgggg

SEQ ID NO: 210736 - DNA, 20 bp, Artificial Sequence
  Description of Artificial Sequence: Synthetic oligonucleotide
  Target: ATXN1; (-) strand; PAM type: YTN; PAM sequence: TTT
aacttttttgtagagatggg

SEQ ID NO: 210737 - DNA, 20 bp, Artificial Sequence
  Description of Artificial Sequence: Synthetic oligonucleotide
  Target: ATXN1; (-) strand; PAM type: YTN; PAM sequence: TTT
taacttttttgtagagatgg

SEQ ID NO: 210738 - DNA, 20 bp, Artificial Sequence
  Description of Artificial Sequence: Synthetic oligonucleotide
  Target: ATXN1; (-) strand; PAM type: YTN; PAM sequence: TTT
ttaacttttttgtagagatg

SEQ ID NO: 210739 - DNA, 20 bp, Artificial Sequence
  Description of Artificial Sequence: Synthetic oligonucleotide
  Target: ATXN1; (-) strand; PAM type: YTN; PAM sequence: TTT
tttaacttttttgtagagat

SEQ ID NO: 210740 - DNA, 20 bp, Artificial Sequence
  Description of Artificial Sequence: Synthetic oligonucleotide
  Target: ATXN1; (-) strand; PAM type: YTN; PAM sequence: CTT
ttttaacttttttgtagaga

SEQ ID NO: 210741 - DNA, 20 bp, Artificial Sequence
  Description of Artificial Sequence: Synthetic oligonucleotide
  Target: ATXN1; (-) strand; PAM type: YTN; PAM sequence: TTC
ttttttaacttttttgtaga

SEQ ID NO: 210742 - DNA, 20 bp, Artificial Sequence
  Description of Artificial Sequence: Synthetic oligonucleotide
  Target: ATXN1; (-) strand; PAM type: YTN; PAM sequence: TTT
cttttttaacttttttgtag

SEQ ID NO: 210743 - DNA, 20 bp, Artificial Sequence
  Description of Artificial Sequence: Synthetic oligonucleotide
  Target: ATXN1; (-) strand; PAM type: YTN; PAM sequence: TTT
tcttttttaacttttttgta

SEQ ID NO: 210744 - DNA, 20 bp, Artificial Sequence
  Description of Artificial Sequence: Synthetic oligonucleotide
  Target: ATXN1; (-) strand; PAM type: YTN; PAM sequence: TTT
ttcttttttaacttttttgt

SEQ ID NO: 210745 - DNA, 20 bp, Artificial Sequence
  Description of Artificial Sequence: Synthetic oligonucleotide
  Target: ATXN1; (-) strand; PAM type: YTN; PAM sequence: CTT
tttcttttttaacttttttg

SEQ ID NO: 210746 - DNA, 20 bp, Artificial Sequence
  Description of Artificial Sequence: Synthetic oligonucleotide
  Target: ATXN1; (-) strand; PAM type: YTN; PAM sequence: CTC
tttttcttttttaacttttt

SEQ ID NO: 210747 - DNA, 20 bp, Artificial Sequence
  Description of Artificial Sequence: Synthetic oligonucleotide
  Target: ATXN1; (-) strand; PAM type: YTN; PAM sequence: CTG
gctctttttcttttttaact

SEQ ID NO: 210748 - DNA, 20 bp, Artificial Sequence
  Description of Artificial Sequence: Synthetic oligonucleotide
  Target: ATXN1; (-) strand; PAM type: YTN; PAM sequence: CTA
tgcctggctctttttctttt

SEQ ID NO: 210749 - DNA, 20 bp, Artificial Sequence
  Description of Artificial Sequence: Synthetic oligonucleotide
  Target: ATXN1; (-) strand; PAM type: YTN; PAM sequence: CTG
caggtgcatgccactatgcc

SEQ ID NO: 210750 - DNA, 20 bp, Artificial Sequence
  Description of Artificial Sequence: Synthetic oligonucleotide
  Target: ATXN1; (-) strand; PAM type: YTN; PAM sequence: CTG
ggactgcaggtgcatgccac

SEQ ID NO: 210751 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggactgcag

SEQ ID NO: 210752 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 210753 - DNA, 20 bp, Artificial Sequence
  Description of Artificial Sequence: Synthetic oligonucleotide
  Target: ATXN1; (-) strand; PAM type: YTN; PAM sequence: CTC
ccgcctcagcctcccaagta

SEQ ID NO: 210754 - DNA, 20 bp, Artificial Sequence
  Description of Artificial Sequence: Synthetic oligonucleotide
  Target: ATXN1; (-) strand; PAM type: YTN; PAM sequence: CTC
aagcaatcctcccgcctcag

SEQ ID NO: 210755 - DNA, 20 bp, Artificial Sequence
  Description of Artificial Sequence: Synthetic oligonucleotide
  Target: ATXN1; (-) strand; PAM type: YTN; PAM sequence: CTG
ggctcaagcaatcctcccgc

SEQ ID NO: 210756 - DNA, 20 bp, Artificial Sequence
  Description of Artificial Sequence: Synthetic oligonucleotide
  Target: ATXN1; (-) strand; PAM type: YTN; PAM sequence: TTG
aacccctgggctcaagcaat

SEQ ID NO: 210757 - DNA, 20 bp, Artificial Sequence
  Description of Artificial Sequence: Synthetic oligonucleotide
  Target: ATXN1; (-) strand; PAM type: YTN; PAM sequence: CTT
gaacccctgggctcaagcaa

SEQ ID NO: 210758 - DNA, 20 bp, Artificial Sequence
  Description of Artificial Sequence: Synthetic oligonucleotide
  Target: ATXN1; (-) strand; PAM type: YTN; PAM sequence: CTG
caaccttgaacccctgggct

SEQ ID NO: 210759 - DNA, 20 bp, Artificial Sequence
  Description of Artificial Sequence: Synthetic oligonucleotide
  Target: ATXN1; (-) strand; PAM type: YTN; PAM sequence: CTC
actgcaaccttgaacccctg

SEQ ID NO: 210760 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcagtcat

SEQ ID NO: 210761 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcagtgg

SEQ ID NO: 210762 - DNA, 20 bp, Artificial Sequence
  Description of Artificial Sequence: Synthetic oligonucleotide
  Target: ATXN1; (-) strand; PAM type: YTN; PAM sequence: CTG
ttgcccaggctggagtgcag

SEQ ID NO: 210763 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaggctggagtgc

SEQ ID NO: 210764 - DNA, 20 bp, Artificial Sequence
  Description of Artificial Sequence: Synthetic oligonucleotide
  Target: ATXN1; (-) strand; PAM type: YTN; PAM sequence: TTG
ctctgttgcccaggctggag

SEQ ID NO: 210765 - DNA, 20 bp, Artificial Sequence
  Description of Artificial Sequence: Synthetic oligonucleotide
  Target: ATXN1; (-) strand; PAM type: YTN; PAM sequence: CTT
gctctgttgcccaggctgga

SEQ ID NO: 210766 - DNA, 20 bp, Artificial Sequence
  Description of Artificial Sequence: Synthetic oligonucleotide
  Target: ATXN1; (-) strand; PAM type: YTN; PAM sequence: TTA
tcaagacagggtcttgctct

SEQ ID NO: 210767 - DNA, 20 bp, Artificial Sequence
  Description of Artificial Sequence: Synthetic oligonucleotide
  Target: ATXN1; (-) strand; PAM type: YTN; PAM sequence: TTT
atcaagacagggtcttgctc

SEQ ID NO: 210768 - DNA, 20 bp, Artificial Sequence
  Description of Artificial Sequence: Synthetic oligonucleotide
  Target: ATXN1; (-) strand; PAM type: YTN; PAM sequence: TTT
tatcaagacagggtcttgct

SEQ ID NO: 210769 - DNA, 20 bp, Artificial Sequence
  Description of Artificial Sequence: Synthetic oligonucleotide
  Target: ATXN1; (-) strand; PAM type: YTN; PAM sequence: TTA
ttttatcaagacagggtctt

SEQ ID NO: 210770 - DNA, 20 bp, Artificial Sequence
  Description of Artificial Sequence: Synthetic oligonucleotide
  Target: ATXN1; (-) strand; PAM type: YTN; PAM sequence: TTT
attttatcaagacagggtct

SEQ ID NO: 210771 - DNA, 20 bp, Artificial Sequence
  Description of Artificial Sequence: Synthetic oligonucleotide
  Target: ATXN1; (-) strand; PAM type: YTN; PAM sequence: TTT
tattttatcaagacagggtc

SEQ ID NO: 210772 - DNA, 20 bp, Artificial Sequence
  Description of Artificial Sequence: Synthetic oligonucleotide
  Target: ATXN1; (-) strand; PAM type: YTN; PAM sequence: TTA
ttttattttatcaagacagg

SEQ ID NO: 210773 - DNA, 20 bp, Artificial Sequence
  Description of Artificial Sequence: Synthetic oligonucleotide
  Target: ATXN1; (-) strand; PAM type: YTN; PAM sequence: TTA
tattattttattttatcaag

SEQ ID NO: 210774 - DNA, 20 bp, Artificial Sequence
  Description of Artificial Sequence: Synthetic oligonucleotide
  Target: ATXN1; (-) strand; PAM type: YTN; PAM sequence: TTT
atattattttattttatcaa

SEQ ID NO: 210775 - DNA, 20 bp, Artificial Sequence
  Description of Artificial Sequence: Synthetic oligonucleotide
  Target: ATXN1; (-) strand; PAM type: YTN; PAM sequence: CTA
tttatattattttattttat

SEQ ID NO: 210776 - DNA, 20 bp, Artificial Sequence
  Description of Artificial Sequence: Synthetic oligonucleotide
  Target: ATXN1; (-) strand; PAM type: YTN; PAM sequence: TTC
tatttatattattttatttt

SEQ ID NO: 210777 - DNA, 20 bp, Artificial Sequence
  Description of Artificial Sequence: Synthetic oligonucleotide
  Target: ATXN1; (-) strand; PAM type: YTN; PAM sequence: TTT
ctatttatattattttattt

SEQ ID NO: 210778 - DNA, 20 bp, Artificial Sequence
  Description of Artificial Sequence: Synthetic oligonucleotide
  Target: ATXN1; (-) strand; PAM type: YTN; PAM sequence: TTG
tcatttctatttatattatt

SEQ ID NO: 210779 - DNA, 20 bp, Artificial Sequence
  Description of Artificial Sequence: Synthetic oligonucleotide
  Target: ATXN1; (-) strand; PAM type: YTN; PAM sequence: TTT
gtcatttctatttatattat

SEQ ID NO: 210780 - DNA, 20 bp, Artificial Sequence
  Description of Artificial Sequence: Synthetic oligonucleotide
  Target: ATXN1; (-) strand; PAM type: YTN; PAM sequence: CTA
gaaaatttgtcatttctatt

SEQ ID NO: 210781 - DNA, 20 bp, Artificial Sequence
  Description of Artificial Sequence: Synthetic oligonucleotide
  Target: ATXN1; (-) strand; PAM type: YTN; PAM sequence: TTC
tagaaaatttgtcatttcta

SEQ ID NO: 210782 - DNA, 20 bp, Artificial Sequence
  Description of Artificial Sequence: Synthetic oligonucleotide
  Target: ATXN1; (-) strand; PAM type: YTN; PAM sequence: TTT
ctagaaaatttgtcatttct

SEQ ID NO: 210783 - DNA, 20 bp, Artificial Sequence
  Description of Artificial Sequence: Synthetic oligonucleotide
  Target: ATXN1; (-) strand; PAM type: YTN; PAM sequence: TTA
atgtttctagaaaatttgtc

SEQ ID NO: 210784 - DNA, 20 bp, Artificial Sequence
  Description of Artificial Sequence: Synthetic oligonucleotide
  Target: ATXN1; (-) strand; PAM type: YTN; PAM sequence: TTT
aatgtttctagaaaatttgt

SEQ ID NO: 210785 - DNA, 20 bp, Artificial Sequence
  Description of Artificial Sequence: Synthetic oligonucleotide
  Target: ATXN1; (-) strand; PAM type: YTN; PAM sequence: TTT
taatgtttctagaaaatttg

SEQ ID NO: 210786 - DNA, 20 bp, Artificial Sequence
  Description of Artificial Sequence: Synthetic oligonucleotide
  Target: ATXN1; (-) strand; PAM type: YTN; PAM sequence: TTA
aagcattttaatgtttctag

SEQ ID NO: 210787 - DNA, 20 bp, Artificial Sequence
  Description of Artificial Sequence: Synthetic oligonucleotide
  Target: ATXN1; (-) strand; PAM type: YTN; PAM sequence: TTA
atattaaagcattttaatgt

SEQ ID NO: 210788 - DNA, 20 bp, Artificial Sequence
  Description of Artificial Sequence: Synthetic oligonucleotide
  Target: ATXN1; (-) strand; PAM type: YTN; PAM sequence: TTA
aattaatattaaagcatttt

SEQ ID NO: 210789 - DNA, 20 bp, Artificial Sequence
  Description of Artificial Sequence: Synthetic oligonucleotide
  Target: ATXN1; (-) strand; PAM type: YTN; PAM sequence: CTT
aaattaatattaaagcattt

SEQ ID NO: 210790 - DNA, 20 bp, Artificial Sequence
  Description of Artificial Sequence: Synthetic oligonucleotide
  Target: ATXN1; (-) strand; PAM type: YTN; PAM sequence: TTC
ttaaattaatattaaagcat

SEQ ID NO: 210791 - DNA, 20 bp, Artificial Sequence
  Description of Artificial Sequence: Synthetic oligonucleotide
  Target: ATXN1; (-) strand; PAM type: YTN; PAM sequence: CTT
cttaaattaatattaaagca

SEQ ID NO: 210792 - DNA, 20 bp, Artificial Sequence
  Description of Artificial Sequence: Synthetic oligonucleotide
  Target: ATXN1; (-) strand; PAM type: YTN; PAM sequence: TTA
cttcttaaattaatattaaa

SEQ ID NO: 210793 - DNA, 20 bp, Artificial Sequence
  Description of Artificial Sequence: Synthetic oligonucleotide
  Target: ATXN1; (-) strand; PAM type: YTN; PAM sequence: TTT
acttcttaaattaatattaa

SEQ ID NO: 210794 - DNA, 20 bp, Artificial Sequence
  Description of Artificial Sequence: Synthetic oligonucleotide
  Target: ATXN1; (-) strand; PAM type: YTN; PAM sequence: TTT
tacttcttaaattaatatta

SEQ ID NO: 210795 - DNA, 20 bp, Artificial Sequence
  Description of Artificial Sequence: Synthetic oligonucleotide
  Target: ATXN1; (-) strand; PAM type: YTN; PAM sequence: TTT
ttacttcttaaattaatatt

SEQ ID NO: 210796 - DNA, 20 bp, Artificial Sequence
  Description of Artificial Sequence: Synthetic oligonucleotide
  Target: ATXN1; (-) strand; PAM type: YTN; PAM sequence: TTG
atcaggatttttacttctta

SEQ ID NO: 210797 - DNA, 20 bp, Artificial Sequence
  Description of Artificial Sequence: Synthetic oligonucleotide
  Target: ATXN1; (-) strand; PAM type: YTN; PAM sequence: TTT
gatcaggatttttacttctt

SEQ ID NO: 210798 - DNA, 20 bp, Artificial Sequence
  Description of Artificial Sequence: Synthetic oligonucleotide
  Target: ATXN1; (-) strand; PAM type: YTN; PAM sequence: TTT
tgatcaggatttttacttct

SEQ ID NO: 210799 - DNA, 20 bp, Artificial Sequence
  Description of Artificial Sequence: Synthetic oligonucleotide
  Target: ATXN1; (-) strand; PAM type: YTN; PAM sequence: TTT
ttgatcaggatttttacttc

SEQ ID NO: 210800 - DNA, 20 bp, Artificial Sequence
  Description of Artificial Sequence: Synthetic oligonucleotide
  Target: ATXN1; (-) strand; PAM type: YTN; PAM sequence: TTT
tttgatcaggatttttactt

SEQ ID NO: 210801 - DNA, 20 bp, Artificial Sequence
  Description of Artificial Sequence: Synthetic oligonucleotide
  Target: ATXN1; (-) strand; PAM type: YTN; PAM sequence: TTT
ttttgatcaggatttttact

SEQ ID NO: 210802 - DNA, 20 bp, Artificial Sequence
  Description of Artificial Sequence: Synthetic oligonucleotide
  Target: ATXN1; (-) strand; PAM type: YTN; PAM sequence: CTA
taataatttttttgatcagg

SEQ ID NO: 210803 - DNA, 20 bp, Artificial Sequence
  Description of Artificial Sequence: Synthetic oligonucleotide
  Target: ATXN1; (-) strand; PAM type: YTN; PAM sequence: TTG
tctataataatttttttgat

SEQ ID NO: 210804 - DNA, 20 bp, Artificial Sequence
  Description of Artificial Sequence: Synthetic oligonucleotide
  Target: ATXN1; (-) strand; PAM type: YTN; PAM sequence: TTT
gtctataataatttttttga

SEQ ID NO: 210805 - DNA, 20 bp, Artificial Sequence
  Description of Artificial Sequence: Synthetic oligonucleotide
  Target: ATXN1; (-) strand; PAM type: YTN; PAM sequence: CTA
aaagtttgtctataataatt

SEQ ID NO: 210806 - DNA, 20 bp, Artificial Sequence
  Description of Artificial Sequence: Synthetic oligonucleotide
  Target: ATXN1; (-) strand; PAM type: YTN; PAM sequence: CTC
cccacccctaaaagtttgtc

SEQ ID NO: 210807 - DNA, 20 bp, Artificial Sequence
  Description of Artificial Sequence: Synthetic oligonucleotide
  Target: ATXN1; (-) strand; PAM type: YTN; PAM sequence: TTA
tgaaagcctccccaccccta

SEQ ID NO: 210808 - DNA, 20 bp, Artificial Sequence
  Description of Artificial Sequence: Synthetic oligonucleotide
  Target: ATXN1; (-) strand; PAM type: YTN; PAM sequence: TTA
tattatgaaagcctccccac

SEQ ID NO: 210809 - DNA, 20 bp, Artificial Sequence
  Description of Artificial Sequence: Synthetic oligonucleotide
  Target: ATXN1; (-) strand; PAM type: YTN; PAM sequence: TTG
ttatattatgaaagcctccc

SEQ ID NO: 210810 - DNA, 20 bp, Artificial Sequence
  Description of Artificial Sequence: Synthetic oligonucleotide
  Target: ATXN1; (-) strand; PAM type: YTN; PAM sequence: TTG
gttgttatattatgaaagcc

SEQ ID NO: 210811 - DNA, 20 bp, Artificial Sequence
  Description of Artificial Sequence: Synthetic oligonucleotide
  Target: ATXN1; (-) strand; PAM type: YTN; PAM sequence: TTT
ggttgttatattatgaaagc

SEQ ID NO: 210812 - DNA, 20 bp, Artificial Sequence
  Description of Artificial Sequence: Synthetic oligonucleotide
  Target: ATXN1; (-) strand; PAM type: YTN; PAM sequence: TTT
tggttgttatattatgaaag

SEQ ID NO: 210813 - DNA, 20 bp, Artificial Sequence
  Description of Artificial Sequence: Synthetic oligonucleotide
  Target: ATXN1; (-) strand; PAM type: YTN; PAM sequence: TTT
ttggttgttatattatgaaa

SEQ ID NO: 210814 - DNA, 20 bp, Artificial Sequence
  Description of Artificial Sequence: Synthetic oligonucleotide
  Target: ATXN1; (-) strand; PAM type: YTN; PAM sequence: TTT
tttggttgttatattatgaa

SEQ ID NO: 210815 - DNA, 20 bp, Artificial Sequence
  Description of Artificial Sequence: Synthetic oligonucleotide
  Target: ATXN1; (-) strand; PAM type: YTN; PAM sequence: TTA
tgtcattttttggttgttat

SEQ ID NO: 210816 - DNA, 20 bp, Artificial Sequence
  Description of Artificial Sequence: Synthetic oligonucleotide
  Target: ATXN1; (-) strand; PAM type: YTN; PAM sequence: TTA
gaattatgtcattttttggt

SEQ ID NO: 210817 - DNA, 20 bp, Artificial Sequence
  Description of Artificial Sequence: Synthetic oligonucleotide
  Target: ATXN1; (-) strand; PAM type: YTN; PAM sequence: TTA
ttagaattatgtcatttttt

SEQ ID NO: 210818 - DNA, 20 bp, Artificial Sequence
  Description of Artificial Sequence: Synthetic oligonucleotide
  Target: ATXN1; (-) strand; PAM type: YTN; PAM sequence: CTG
tccccaaagttattagaatt

SEQ ID NO: 210819 - DNA, 20 bp, Artificial Sequence
  Description of Artificial Sequence: Synthetic oligonucleotide
  Target: ATXN1; (-) strand; PAM type: YTN; PAM sequence: TTA
cctgtccccaaagttattag

SEQ ID NO: 210820 - DNA, 20 bp, Artificial Sequence
  Description of Artificial Sequence: Synthetic oligonucleotide
  Target: ATXN1; (-) strand; PAM type: YTN; PAM sequence: TTG
aaattacctgtccccaaagt

SEQ ID NO: 210821 - DNA, 20 bp, Artificial Sequence
  Description of Artificial Sequence: Synthetic oligonucleotide
  Target: ATXN1; (-) strand; PAM type: YTN; PAM sequence: TTT
gaaattacctgtccccaaag

SEQ ID NO: 210822 - DNA, 20 bp, Artificial Sequence
  Description of Artificial Sequence: Synthetic oligonucleotide
  Target: ATXN1; (-) strand; PAM type: YTN; PAM sequence: CTT
tgaaattacctgtccccaaa

SEQ ID NO: 210823 - DNA, 20 bp, Artificial Sequence
  Description of Artificial Sequence: Synthetic oligonucleotide
  Target: ATXN1; (-) strand; PAM type: YTN; PAM sequence: CTG
gaagctttgaaattacctgt

SEQ ID NO: 210824 - DNA, 20 bp, Artificial Sequence
  Description of Artificial Sequence: Synthetic oligonucleotide
  Target: ATXN1; (-) strand; PAM type: YTN; PAM sequence: TTA
aggcacatgtagcatcctgg

SEQ ID NO: 210825 - DNA, 20 bp, Artificial Sequence
  Description of Artificial Sequence: Synthetic oligonucleotide
  Target: ATXN1; (-) strand; PAM type: YTN; PAM sequence: TTG
cccccattaaggcacatgta

SEQ ID NO: 210826 - DNA, 20 bp, Artificial Sequence
  Description of Artificial Sequence: Synthetic oligonucleotide
  Target: ATXN1; (-) strand; PAM type: YTN; PAM sequence: TTT
gcccccattaaggcacatgt

SEQ ID NO: 210827 - DNA, 20 bp, Artificial Sequence
  Description of Artificial Sequence: Synthetic oligonucleotide
  Target: ATXN1; (-) strand; PAM type: YTN; PAM sequence: CTT
tgcccccattaaggcacatg

SEQ ID NO: 210828 - DNA, 20 bp, Artificial Sequence
  Description of Artificial Sequence: Synthetic oligonucleotide
  Target: ATXN1; (-) strand; PAM type: YTN; PAM sequence: CTC
aaggagaagaaaagtgagag

SEQ ID NO: 210829 - DNA, 20 bp, Artificial Sequence
  Description of Artificial Sequence: Synthetic oligonucleotide
  Target: ATXN1; (-) strand; PAM type: YTN; PAM sequence: TTG
cctcaaggagaagaaaagtg

SEQ ID NO: 210830 - DNA, 20 bp, Artificial Sequence
  Description of Artificial Sequence: Synthetic oligonucleotide
  Target: ATXN1; (-) strand; PAM type: YTN; PAM sequence: CTG
agttgcctcaaggagaagaa

SEQ ID NO: 210831 - DNA, 20 bp, Artificial Sequence
  Description of Artificial Sequence: Synthetic oligonucleotide
  Target: ATXN1; (-) strand; PAM type: YTN; PAM sequence: CTC
tgagttgcctcaaggagaag

SEQ ID NO: 210832 - DNA, 20 bp, Artificial Sequence
  Description of Artificial Sequence: Synthetic oligonucleotide
  Target: ATXN1; (-) strand; PAM type: YTN; PAM sequence: CTC
ctctgagttgcctcaaggag

SEQ ID NO: 210833 - DNA, 20 bp, Artificial Sequence
  Description of Artificial Sequence: Synthetic oligonucleotide
  Target: ATXN1; (-) strand; PAM type: YTN; PAM sequence: TTC
cacaatcgctcctctgagtt

SEQ ID NO: 210834 - DNA, 20 bp, Artificial Sequence
  Description of Artificial Sequence: Synthetic oligonucleotide
  Target: ATXN1; (-) strand; PAM type: YTN; PAM sequence: TTT
ccacaatcgctcctctgagt

SEQ ID NO: 210835 - DNA, 20 bp, Artificial Sequence
  Description of Artificial Sequence: Synthetic oligonucleotide
  Target: ATXN1; (-) strand; PAM type: YTN; PAM sequence: TTC
ggaaatttccacaatcgctc

SEQ ID NO: 210836 - DNA, 20 bp, Artificial Sequence
  Description of Artificial Sequence: Synthetic oligonucleotide
  Target: ATXN1; (-) strand; PAM type: YTN; PAM sequence: CTT
cggaaatttccacaatcgct

SEQ ID NO: 210837 - DNA, 20 bp, Artificial Sequence
  Description of Artificial Sequence: Synthetic oligonucleotide
  Target: ATXN1; (-) strand; PAM type: YTN; PAM sequence: CTG
acatatagcagcttcggaaa

SEQ ID NO: 210838 - DNA, 20 bp, Artificial Sequence
  Description of Artificial Sequence: Synthetic oligonucleotide
  Target: ATXN1; (-) strand; PAM type: YTN; PAM sequence: TTC
catacaaatgggcaagctga

SEQ ID NO: 210839 - DNA, 20 bp, Artificial Sequence
  Description of Artificial Sequence: Synthetic oligonucleotide
  Target: ATXN1; (-) strand; PAM type: YTN; PAM sequence: TTG
tcaaaaaaaccatgaaattc

SEQ ID NO: 210840 - DNA, 20 bp, Artificial Sequence
  Description of Artificial Sequence: Synthetic oligonucleotide
  Target: ATXN1; (-) strand; PAM type: YTN; PAM sequence: CTT
gtcaaaaaaaccatgaaatt

SEQ ID NO: 210841 - DNA, 20 bp, Artificial Sequence
  Description of Artificial Sequence: Synthetic oligonucleotide
  Target: ATXN1; (-) strand; PAM type: YTN; PAM sequence: CTG
acttgtcaaaaaaaccatga

SEQ ID NO: 210842 - DNA, 20 bp, Artificial Sequence
  Description of Artificial Sequence: Synthetic oligonucleotide
  Target: ATXN1; (-) strand; PAM type: YTN; PAM sequence: CTC
aagatgcgatgatgacaaaa

SEQ ID NO: 210843 - DNA, 20 bp, Artificial Sequence
  Description of Artificial Sequence: Synthetic oligonucleotide
  Target: ATXN1; (-) strand; PAM type: YTN; PAM sequence: CTC
tcaagatgcgatgatgacaa

SEQ ID NO: 210844 - DNA, 20 bp, Artificial Sequence
  Description of Artificial Sequence: Synthetic oligonucleotide
  Target: ATXN1; (-) strand; PAM type: YTN; PAM sequence: CTA
ctctcaagatgcgatgatga

SEQ ID NO: 210845 - DNA, 20 bp, Artificial Sequence
  Description of Artificial Sequence: Synthetic oligonucleotide
  Target: ATXN1; (-) strand; PAM type: YTN; PAM sequence: CTC
tactctcaagatgcgatgat

SEQ ID NO: 210846 - DNA, 20 bp, Artificial Sequence
  Description of Artificial Sequence: Synthetic oligonucleotide
  Target: ATXN1; (-) strand; PAM type: YTN; PAM sequence: CTC
tctactctcaagatgcgatg

SEQ ID NO: 210847 - DNA, 20 bp, Artificial Sequence
  Description of Artificial Sequence: Synthetic oligonucleotide
  Target: ATXN1; (-) strand; PAM type: YTN; PAM sequence: TTC
ctctctactctcaagatgcg

SEQ ID NO: 210848 - DNA, 20 bp, Artificial Sequence
  Description of Artificial Sequence: Synthetic oligonucleotide
  Target: ATXN1; (-) strand; PAM type: YTN; PAM sequence: CTT
cctctctactctcaagatgc

SEQ ID NO: 210849 - DNA, 20 bp, Artificial Sequence
  Description of Artificial Sequence: Synthetic oligonucleotide
  Target: ATXN1; (-) strand; PAM type: YTN; PAM sequence: TTC
ccttcctctctactctcaag

SEQ ID NO: 210850 - DNA, 20 bp, Artificial Sequence
  Description of Artificial Sequence: Synthetic oligonucleotide
  Target: ATXN1; (-) strand; PAM type: YTN; PAM sequence: TTC
cattcccttcctctctactc

SEQ ID NO: 210851 - DNA, 20 bp, Artificial Sequence
  Description of Artificial Sequence: Synthetic oligonucleotide
  Target: ATXN1; (-) strand; PAM type: YTN; PAM sequence: CTT
ccattcccttcctctctact

SEQ ID NO: 210852 - DNA, 20 bp, Artificial Sequence
  Description of Artificial Sequence: Synthetic oligonucleotide
  Target: ATXN1; (-) strand; PAM type: YTN; PAM sequence: CTC
ccttccattcccttcctctc

SEQ ID NO: 210853 - DNA, 20 bp, Artificial Sequence
  Description of Artificial Sequence: Synthetic oligonucleotide
  Target: ATXN1; (-) strand; PAM type: YTN; PAM sequence: TTC
tcccttccattcccttcctc

SEQ ID NO: 210854 - DNA, 20 bp, Artificial Sequence
  Description of Artificial Sequence: Synthetic oligonucleotide
  Target: ATXN1; (-) strand; PAM type: YTN; PAM sequence: CTG
atagtaacagttctcccttc

SEQ ID NO: 210855 - DNA, 20 bp, Artificial Sequence
  Description of Artificial Sequence: Synthetic oligonucleotide
  Target: ATXN1; (-) strand; PAM type: YTN; PAM sequence: CTC
tgatagtaacagttctccct

SEQ ID NO: 210856 - DNA, 20 bp, Artificial Sequence
  Description of Artificial Sequence: Synthetic oligonucleotide
  Target: ATXN1; (-) strand; PAM type: YTN; PAM sequence: TTC
cagaagcctctgatagtaac

SEQ ID NO: 210857 - DNA, 20 bp, Artificial Sequence
  Description of Artificial Sequence: Synthetic oligonucleotide
  Target: ATXN1; (-) strand; PAM type: YTN; PAM sequence: TTT
ccagaagcctctgatagtaa

SEQ ID NO: 210858 - DNA, 20 bp, Artificial Sequence
  Description of Artificial Sequence: Synthetic oligonucleotide
  Target: ATXN1; (-) strand; PAM type: YTN; PAM sequence: TTA
agaaagagtcatgtaccatc

SEQ ID NO: 210859 - DNA, 20 bp, Artificial Sequence
  Description of Artificial Sequence: Synthetic oligonucleotide
  Target: ATXN1; (-) strand; PAM type: YTN; PAM sequence: CTT
aagaaagagtcatgtaccat

SEQ ID NO: 210860 - DNA, 20 bp, Artificial Sequence
  Description of Artificial Sequence: Synthetic oligonucleotide
  Target: ATXN1; (-) strand; PAM type: YTN; PAM sequence: TTC
ttaagaaagagtcatgtacc

SEQ ID NO: 210861 - DNA, 20 bp, Artificial Sequence
  Description of Artificial Sequence: Synthetic oligonucleotide
  Target: ATXN1; (-) strand; PAM type: YTN; PAM sequence: TTG
tcaccaaaatggcaacccat

SEQ ID NO: 210862 - DNA, 20 bp, Artificial Sequence
  Description of Artificial Sequence: Synthetic oligonucleotide
  Target: ATXN1; (-) strand; PAM type: YTN; PAM sequence: CTG
agtgcaccaattgtcaccaa

SEQ ID NO: 210863 - DNA, 20 bp, Artificial Sequence
  Description of Artificial Sequence: Synthetic oligonucleotide
  Target: ATXN1; (-) strand; PAM type: YTN; PAM sequence: CTG
gggcccaccaagaggtagag

SEQ ID NO: 210864 - DNA, 20 bp, Artificial Sequence
  Description of Artificial Sequence: Synthetic oligonucleotide
  Target: ATXN1; (-) strand; PAM type: YTN; PAM sequence: CTG
aagtacactggggcccacca

SEQ ID NO: 210865 - DNA, 20 bp, Artificial Sequence
  Description of Artificial Sequence: Synthetic oligonucleotide
  Target: ATXN1; (-) strand; PAM type: YTN; PAM sequence: CTG
agatcatgctgaagtacact

SEQ ID NO: 210866 - DNA, 20 bp, Artificial Sequence
  Description of Artificial Sequence: Synthetic oligonucleotide
  Target: ATXN1; (-) strand; PAM type: YTN; PAM sequence: CTG
gtagagaaagaaagaactga

SEQ ID NO: 210867 - DNA, 20 bp, Artificial Sequence
  Description of Artificial Sequence: Synthetic oligonucleotide
  Target: ATXN1; (-) strand; PAM type: YTN; PAM sequence: TTC
aggatgtatgtatcatggaa

SEQ ID NO: 210868 - DNA, 20 bp, Artificial Sequence
  Description of Artificial Sequence: Synthetic oligonucleotide
  Target: ATXN1; (-) strand; PAM type: YTN; PAM sequence: TTT
caggatgtatgtatcatgga

SEQ ID NO: 210869 - DNA, 20 bp, Artificial Sequence
  Description of Artificial Sequence: Synthetic oligonucleotide
  Target: ATXN1; (-) strand; PAM type: YTN; PAM sequence: TTT
tcaggatgtatgtatcatgg

SEQ ID NO: 210870 - DNA, 20 bp, Artificial Sequence
  Description of Artificial Sequence: Synthetic oligonucleotide
  Target: ATXN1; (-) strand; PAM type: YTN; PAM sequence: CTG
tgattttcaggatgtatgta

SEQ ID NO: 210871 - DNA, 20 bp, Artificial Sequence
  Description of Artificial Sequence: Synthetic oligonucleotide
  Target: ATXN1; (-) strand; PAM type: YTN; PAM sequence: TTG
aatggtgatgctgtgatttt

SEQ ID NO: 210872 - DNA, 20 bp, Artificial Sequence
  Description of Artificial Sequence: Synthetic oligonucleotide
  Target: ATXN1; (-) strand; PAM type: YTN; PAM sequence: CTA
ttgaatggtgatgctgtgat

SEQ ID NO: 210873 - DNA, 20 bp, Artificial Sequence
  Description of Artificial Sequence: Synthetic oligonucleotide
  Target: ATXN1; (-) strand; PAM type: YTN; PAM sequence: TTG
tctattgaatggtgatgctg

SEQ ID NO: 210874 - DNA, 20 bp, Artificial Sequence
  Description of Artificial Sequence: Synthetic oligonucleotide
  Target: ATXN1; (-) strand; PAM type: YTN; PAM sequence: TTT
gtctattgaatggtgatgct

SEQ ID NO: 210875 - DNA, 20 bp, Artificial Sequence
  Description of Artificial Sequence: Synthetic oligonucleotide
  Target: ATXN1; (-) strand; PAM type: YTN; PAM sequence: TTT
tgtctattgaatggtgatgc

SEQ ID NO: 210876 - DNA, 20 bp, Artificial Sequence
  Description of Artificial Sequence: Synthetic oligonucleotide
  Target: ATXN1; (-) strand; PAM type: YTN; PAM sequence: TTT
ttgtctattgaatggtgatg

SEQ ID NO: 210877 - DNA, 20 bp, Artificial Sequence
  Description of Artificial Sequence: Synthetic oligonucleotide
  Target: ATXN1; (-) strand; PAM type: YTN; PAM sequence: TTG
ataatgataatttttgtcta

SEQ ID NO: 210878 - DNA, 20 bp, Artificial Sequence
  Description of Artificial Sequence: Synthetic oligonucleotide
  Target: ATXN1; (-) strand; PAM type: YTN; PAM sequence: TTT
gataatgataatttttgtct

SEQ ID NO: 210879 - DNA, 20 bp, Artificial Sequence
  Description of Artificial Sequence: Synthetic oligonucleotide
  Target: ATXN1; (-) strand; PAM type: YTN; PAM sequence: CTT
tgataatgataatttttgtc

SEQ ID NO: 210880 - DNA, 20 bp, Artificial Sequence
  Description of Artificial Sequence: Synthetic oligonucleotide
  Target: ATXN1; (-) strand; PAM type: YTN; PAM sequence: TTG
gccgctttgataatgataat

SEQ ID NO: 210881 - DNA, 20 bp, Artificial Sequence
  Description of Artificial Sequence: Synthetic oligonucleotide
  Target: ATXN1; (-) strand; PAM type: YTN; PAM sequence: TTT
ggccgctttgataatgataa

SEQ ID NO: 210882 - DNA, 20 bp, Artificial Sequence
  Description of Artificial Sequence: Synthetic oligonucleotide
  Target: ATXN1; (-) strand; PAM type: YTN; PAM sequence: TTT
tggccgctttgataatgata

SEQ ID NO: 210883 - DNA, 20 bp, Artificial Sequence
  Description of Artificial Sequence: Synthetic oligonucleotide
  Target: ATXN1; (-) strand; PAM type: YTN; PAM sequence: TTT
ttggccgctttgataatgat

SEQ ID NO: 210884 - DNA, 20 bp, Artificial Sequence
  Description of Artificial Sequence: Synthetic oligonucleotide
  Target: ATXN1; (-) strand; PAM type: YTN; PAM sequence: CTT
tttggccgctttgataatga

SEQ ID NO: 210885 - DNA, 20 bp, Artificial Sequence
  Description of Artificial Sequence: Synthetic oligonucleotide
  Target: ATXN1; (-) strand; PAM type: YTN; PAM sequence: TTA
agagaaaacctttttggccg

SEQ ID NO: 210886 - DNA, 20 bp, Artificial Sequence
  Description of Artificial Sequence: Synthetic oligonucleotide
  Target: ATXN1; (-) strand; PAM type: YTN; PAM sequence: TTT
aagagaaaacctttttggcc

SEQ ID NO: 210887 - DNA, 20 bp, Artificial Sequence
  Description of Artificial Sequence: Synthetic oligonucleotide
  Target: ATXN1; (-) strand; PAM type: YTN; PAM sequence: TTC
ccacagaatatttaagagaa

SEQ ID NO: 210888 - DNA, 20 bp, Artificial Sequence
  Description of Artificial Sequence: Synthetic oligonucleotide
  Target: ATXN1; (-) strand; PAM type: YTN; PAM sequence: TTT
cccacagaatatttaagaga

SEQ ID NO: 210889 - DNA, 20 bp, Artificial Sequence
  Description of Artificial Sequence: Synthetic oligonucleotide
  Target: ATXN1; (-) strand; PAM type: YTN; PAM sequence: CTT
tcccacagaatatttaagag

SEQ ID NO: 210890 - DNA, 20 bp, Artificial Sequence
  Description of Artificial Sequence: Synthetic oligonucleotide
  Target: ATXN1; (-) strand; PAM type: YTN; PAM sequence: CTC
tttcccacagaatatttaag

SEQ ID NO: 210891 - DNA, 20 bp, Artificial Sequence
  Description of Artificial Sequence: Synthetic oligonucleotide
  Target: ATXN1; (-) strand; PAM type: YTN; PAM sequence: TTC
aaccctctttcccacagaat

SEQ ID NO: 210892 - DNA, 20 bp, Artificial Sequence
  Description of Artificial Sequence: Synthetic oligonucleotide
  Target: ATXN1; (-) strand; PAM type: YTN; PAM sequence: TTT
caaccctctttcccacagaa

SEQ ID NO: 210893 - DNA, 20 bp, Artificial Sequence
  Description of Artificial Sequence: Synthetic oligonucleotide
  Target: ATXN1; (-) strand; PAM type: YTN; PAM sequence: TTT
tcaaccctctttcccacaga

SEQ ID NO: 210894 - DNA, 20 bp, Artificial Sequence
  Description of Artificial Sequence: Synthetic oligonucleotide
  Target: ATXN1; (-) strand; PAM type: YTN; PAM sequence: CTA
attttcaaccctctttccca

SEQ ID NO: 210895 - DNA, 20 bp, Artificial Sequence
  Description of Artificial Sequence: Synthetic oligonucleotide
  Target: ATXN1; (-) strand; PAM type: YTN; PAM sequence: TTC
taattttcaaccctctttcc

SEQ ID NO: 210896 - DNA, 20 bp, Artificial Sequence
  Description of Artificial Sequence: Synthetic oligonucleotide
  Target: ATXN1; (-) strand; PAM type: YTN; PAM sequence: CTA
ttctaattttcaaccctctt

SEQ ID NO: 210897 - DNA, 20 bp, Artificial Sequence
  Description of Artificial Sequence: Synthetic oligonucleotide
  Target: ATXN1; (-) strand; PAM type: YTN; PAM sequence: TTC
tattctaattttcaaccctc

SEQ ID NO: 210898 - DNA, 20 bp, Artificial Sequence
  Description of Artificial Sequence: Synthetic oligonucleotide
  Target: ATXN1; (-) strand; PAM type: YTN; PAM sequence: CTG
tggcaaatacatagtattct

SEQ ID NO: 210899 - DNA, 20 bp, Artificial Sequence
  Description of Artificial Sequence: Synthetic oligonucleotide
  Target: ATXN1; (-) strand; PAM type: YTN; PAM sequence: TTA
ctgtggcaaatacatagtat

SEQ ID NO: 210900 - DNA, 20 bp, Artificial Sequence
  Description of Artificial Sequence: Synthetic oligonucleotide
  Target: ATXN1; (-) strand; PAM type: YTN; PAM sequence: TTT
actgtggcaaatacatagta

SEQ ID NO: 210901 - DNA, 20 bp, Artificial Sequence
  Description of Artificial Sequence: Synthetic oligonucleotide
  Target: ATXN1; (-) strand; PAM type: YTN; PAM sequence: TTT
tactgtggcaaatacatagt

SEQ ID NO: 210902 - DNA, 20 bp, Artificial Sequence
  Description of Artificial Sequence: Synthetic oligonucleotide
  Target: ATXN1; (-) strand; PAM type: YTN; PAM sequence: CTT
ttactgtggcaaatacatag

SEQ ID NO: 210903 - DNA, 20 bp, Artificial Sequence
  Description of Artificial Sequence: Synthetic oligonucleotide
  Target: ATXN1; (-) strand; PAM type: YTN; PAM sequence: TTG
tggtagatatcttttactgt

SEQ ID NO: 210904 - DNA, 20 bp, Artificial Sequence
  Description of Artificial Sequence: Synthetic oligonucleotide
  Target: ATXN1; (-) strand; PAM type: YTN; PAM sequence: TTT
gtggtagatatcttttactg

SEQ ID NO: 210905 - DNA, 20 bp, Artificial Sequence
  Description of Artificial Sequence: Synthetic oligonucleotide
  Target: ATXN1; (-) strand; PAM type: YTN; PAM sequence: CTG
gtttgtggtagatatctttt

SEQ ID NO: 210906 - DNA, 20 bp, Artificial Sequence
  Description of Artificial Sequence: Synthetic oligonucleotide
  Target: ATXN1; (-) strand; PAM type: YTN; PAM sequence: CTA
ctggtttgtggtagatatct

SEQ ID NO: 210907 - DNA, 20 bp, Artificial Sequence
  Description of Artificial Sequence: Synthetic oligonucleotide
  Target: ATXN1; (-) strand; PAM type: YTN; PAM sequence: TTG
gctactggtttgtggtagat

SEQ ID NO: 210908 - DNA, 20 bp, Artificial Sequence
  Description of Artificial Sequence: Synthetic oligonucleotide
  Target: ATXN1; (-) strand; PAM type: YTN; PAM sequence: TTA
atataatattggctactggt

SEQ ID NO: 210909 - DNA, 20 bp, Artificial Sequence
  Description of Artificial Sequence: Synthetic oligonucleotide
  Target: ATXN1; (-) strand; PAM type: YTN; PAM sequence: TTT
aatataatattggctactgg

SEQ ID NO: 210910 - DNA, 20 bp, Artificial Sequence
  Description of Artificial Sequence: Synthetic oligonucleotide
  Target: ATXN1; (-) strand; PAM type: YTN; PAM sequence: TTT
taatataatattggctactg

SEQ ID NO: 210911 - DNA, 20 bp, Artificial Sequence
  Description of Artificial Sequence: Synthetic oligonucleotide
  Target: ATXN1; (-) strand; PAM type: YTN; PAM sequence: CTT
ttaatataatattggctact

SEQ ID NO: 210912 - DNA, 20 bp, Artificial Sequence
  Description of Artificial Sequence: Synthetic oligonucleotide
  Target: ATXN1; (-) strand; PAM type: YTN; PAM sequence: TTA
acttttaatataatattggc

SEQ ID NO: 210913 - DNA, 20 bp, Artificial Sequence
  Description of Artificial Sequence: Synthetic oligonucleotide
  Target: ATXN1; (-) strand; PAM type: YTN; PAM sequence: TTT
aacttttaatataatattgg

SEQ ID NO: 210914 - DNA, 20 bp, Artificial Sequence
  Description of Artificial Sequence: Synthetic oligonucleotide
  Target: ATXN1; (-) strand; PAM type: YTN; PAM sequence: TTT
taacttttaatataatattg

SEQ ID NO: 210915 - DNA, 20 bp, Artificial Sequence
  Description of Artificial Sequence: Synthetic oligonucleotide
  Target: ATXN1; (-) strand; PAM type: YTN; PAM sequence: TTT
ttaacttttaatataatatt

SEQ ID NO: 210916 - DNA, 20 bp, Artificial Sequence
  Description of Artificial Sequence: Synthetic oligonucleotide
  Target: ATXN1; (-) strand; PAM type: YTN; PAM sequence: TTG
tttttaacttttaatataat

SEQ ID NO: 210917 - DNA, 20 bp, Artificial Sequence
  Description of Artificial Sequence: Synthetic oligonucleotide
  Target: ATXN1; (-) strand; PAM type: YTN; PAM sequence: CTT
gtttttaacttttaatataa

SEQ ID NO: 210918 - DNA, 20 bp, Artificial Sequence
  Description of Artificial Sequence: Synthetic oligonucleotide
  Target: ATXN1; (-) strand; PAM type: YTN; PAM sequence: CTC
ttgtttttaacttttaatat

SEQ ID NO: 210919 - DNA, 20 bp, Artificial Sequence
  Description of Artificial Sequence: Synthetic oligonucleotide
  Target: ATXN1; (-) strand; PAM type: YTN; PAM sequence: TTG
actcttgtttttaactttta

SEQ ID NO: 210920 - DNA, 20 bp, Artificial Sequence
  Description of Artificial Sequence: Synthetic oligonucleotide
  Target: ATXN1; (-) strand; PAM type: YTN; PAM sequence: TTA
atcattgactcttgttttta

SEQ ID NO: 210921 - DNA, 20 bp, Artificial Sequence
  Description of Artificial Sequence: Synthetic oligonucleotide
  Target: ATXN1; (-) strand; PAM type: YTN; PAM sequence: TTT
aatcattgactcttgttttt

SEQ ID NO: 210922 - DNA, 20 bp, Artificial Sequence
  Description of Artificial Sequence: Synthetic oligonucleotide
  Target: ATXN1; (-) strand; PAM type: YTN; PAM sequence: CTG
aatttaatcattgactcttg

SEQ ID NO: 210923 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccgcatg

SEQ ID NO: 210924 - DNA, 20 bp, Artificial Sequence
  Description of Artificial Sequence: Synthetic oligonucleotide
  Target: ATXN1; (-) strand; PAM type: YTN; PAM sequence: CTG
gggttacaggcatgagccac

SEQ ID NO: 210925 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctggggttacag

SEQ ID NO: 210926 - DNA, 20 bp, Artificial Sequence
  Description of Artificial Sequence: Synthetic oligonucleotide
  Target: ATXN1; (-) strand; PAM type: YTN; PAM sequence: TTC
agcctcccaaagtgctgggg

SEQ ID NO: 210927 - DNA, 20 bp, Artificial Sequence
  Description of Artificial Sequence: Synthetic oligonucleotide
  Target: ATXN1; (-) strand; PAM type: YTN; PAM sequence: CTT
cagcctcccaaagtgctggg

SEQ ID NO: 210928 - DNA, 20 bp, Artificial Sequence
  Description of Artificial Sequence: Synthetic oligonucleotide
  Target: ATXN1; (-) strand; PAM type: YTN; PAM sequence: CTC
aagtgatccacccgcttcag

SEQ ID NO: 210929 - DNA, 20 bp, Artificial Sequence
  Description of Artificial Sequence: Synthetic oligonucleotide
  Target: ATXN1; (-) strand; PAM type: YTN; PAM sequence: CTG
acctcaagtgatccacccgc

SEQ ID NO: 210930 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaagtgatccacc

SEQ ID NO: 210931 - DNA, 20 bp, Artificial Sequence
  Description of Artificial Sequence: Synthetic oligonucleotide
  Target: ATXN1; (-) strand; PAM type: YTN; PAM sequence: CTC
aaactcctgacctcaagtga

SEQ ID NO: 210932 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcctgacctca

SEQ ID NO: 210933 - DNA, 20 bp, Artificial Sequence
  Description of Artificial Sequence: Synthetic oligonucleotide
  Target: ATXN1; (-) strand; PAM type: YTN; PAM sequence: TTC
gccaggctggtctcaaactc

SEQ ID NO: 210934 - DNA, 20 bp, Artificial Sequence
  Description of Artificial Sequence: Synthetic oligonucleotide
  Target: ATXN1; (-) strand; PAM type: YTN; PAM sequence: TTC
accatgttcgccaggctggt

SEQ ID NO: 210935 - DNA, 20 bp, Artificial Sequence
  Description of Artificial Sequence: Synthetic oligonucleotide
  Target: ATXN1; (-) strand; PAM type: YTN; PAM sequence: TTT
caccatgttcgccaggctgg

SEQ ID NO: 210936 - DNA, 20 bp, Artificial Sequence
  Description of Artificial Sequence: Synthetic oligonucleotide
  Target: ATXN1; (-) strand; PAM type: YTN; PAM sequence: TTA
gtagagacggagtttcacca

SEQ ID NO: 210937 - DNA, 20 bp, Artificial Sequence
  Description of Artificial Sequence: Synthetic oligonucleotide
  Target: ATXN1; (-) strand; PAM type: YTN; PAM sequence: TTT
agtagagacggagtttcacc

SEQ ID NO: 210938 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggagtttcac

SEQ ID NO: 210939 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggagtttca

SEQ ID NO: 210940 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacggag

SEQ ID NO: 210941 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacgga

SEQ ID NO: 210942 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 210943 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 210944 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 210945 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtatttttag

SEQ ID NO: 210946 - DNA, 20 bp, Artificial Sequence
  Description of Artificial Sequence: Synthetic oligonucleotide
  Target: ATXN1; (-) strand; PAM type: YTN; PAM sequence: TTA
caggcatgcaacaccacgcc

SEQ ID NO: 210947 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgcaacac

SEQ ID NO: 210948 - DNA, 20 bp, Artificial Sequence
  Description of Artificial Sequence: Synthetic oligonucleotide
  Target: ATXN1; (-) strand; PAM type: YTN; PAM sequence: CTC
ccaagtatctgggattacag

SEQ ID NO: 210949 - DNA, 20 bp, Artificial Sequence
  Description of Artificial Sequence: Synthetic oligonucleotide
  Target: ATXN1; (-) strand; PAM type: YTN; PAM sequence: CTC
agactcccaagtatctggga

SEQ ID NO: 210950 - DNA, 20 bp, Artificial Sequence
  Description of Artificial Sequence: Synthetic oligonucleotide
  Target: ATXN1; (-) strand; PAM type: YTN; PAM sequence: CTC
cggcctcagactcccaagta

SEQ ID NO: 210951 - DNA, 20 bp, Artificial Sequence
  Description of Artificial Sequence: Synthetic oligonucleotide
  Target: ATXN1; (-) strand; PAM type: YTN; PAM sequence: TTC
tccggcctcagactcccaag

SEQ ID NO: 210952 - DNA, 20 bp, Artificial Sequence
  Description of Artificial Sequence: Synthetic oligonucleotide
  Target: ATXN1; (-) strand; PAM type: YTN; PAM sequence: CTC
aagtgattctccggcctcag

SEQ ID NO: 210953 - DNA, 20 bp, Artificial Sequence
  Description of Artificial Sequence: Synthetic oligonucleotide
  Target: ATXN1; (-) strand; PAM type: YTN; PAM sequence: CTC
ccaggctcaagtgattctcc

SEQ ID NO: 210954 - DNA, 20 bp, Artificial Sequence
  Description of Artificial Sequence: Synthetic oligonucleotide
  Target: ATXN1; (-) strand; PAM type: YTN; PAM sequence: CTG
cctcccaggctcaagtgatt

SEQ ID NO: 210955 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaggctcaagtga

SEQ ID NO: 210956 - DNA, 20 bp, Artificial Sequence
  Description of Artificial Sequence: Synthetic oligonucleotide
  Target: ATXN1; (-) strand; PAM type: YTN; PAM sequence: TTG
caacctctgcctcccaggct

SEQ ID NO: 210957 - DNA, 20 bp, Artificial Sequence
  Description of Artificial Sequence: Synthetic oligonucleotide
  Target: ATXN1; (-) strand; PAM type: YTN; PAM sequence: CTC
attgcaacctctgcctccca

SEQ ID NO: 210958 - DNA, 20 bp, Artificial Sequence
  Description of Artificial Sequence: Synthetic oligonucleotide
  Target: ATXN1; (-) strand; PAM type: YTN; PAM sequence: TTG
gctcattgcaacctctgcct

SEQ ID NO: 210959 - DNA, 20 bp, Artificial Sequence
  Description of Artificial Sequence: Synthetic oligonucleotide
  Target: ATXN1; (-) strand; PAM type: YTN; PAM sequence: CTT
ggctcattgcaacctctgcc

SEQ ID NO: 210960 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcacacgatc

SEQ ID NO: 210961 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcagtgg

SEQ ID NO: 210962 - DNA, 20 bp, Artificial Sequence
  Description of Artificial Sequence: Synthetic oligonucleotide
  Target: ATXN1; (-) strand; PAM type: YTN; PAM sequence: CTG
ttgcccaggctggagtgcag

SEQ ID NO: 210963 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaggctggagtgc

SEQ ID NO: 210964 - DNA, 20 bp, Artificial Sequence
  Description of Artificial Sequence: Synthetic oligonucleotide
  Target: ATXN1; (-) strand; PAM type: YTN; PAM sequence: TTG
ctctgttgcccaggctggag

SEQ ID NO: 210965 - DNA, 20 bp, Artificial Sequence
  Description of Artificial Sequence: Synthetic oligonucleotide
  Target: ATXN1; (-) strand; PAM type: YTN; PAM sequence: CTT
gctctgttgcccaggctgga

SEQ ID NO: 210966 - DNA, 20 bp, Artificial Sequence
  Description of Artificial Sequence: Synthetic oligonucleotide
  Target: ATXN1; (-) strand; PAM type: YTN; PAM sequence: TTA
tcaagacagggtcttgctct

SEQ ID NO: 210967 - DNA, 20 bp, Artificial Sequence
  Description of Artificial Sequence: Synthetic oligonucleotide
  Target: ATXN1; (-) strand; PAM type: YTN; PAM sequence: TTT
atcaagacagggtcttgctc

SEQ ID NO: 210968 - DNA, 20 bp, Artificial Sequence
  Description of Artificial Sequence: Synthetic oligonucleotide
  Target: ATXN1; (-) strand; PAM type: YTN; PAM sequence: TTT
tatcaagacagggtcttgct

SEQ ID NO: 210969 - DNA, 20 bp, Artificial Sequence
  Description of Artificial Sequence: Synthetic oligonucleotide
  Target: ATXN1; (-) strand; PAM type: YTN; PAM sequence: TTA
ttttatcaagacagggtctt

SEQ ID NO: 210970 - DNA, 20 bp, Artificial Sequence
  Description of Artificial Sequence: Synthetic oligonucleotide
  Target: ATXN1; (-) strand; PAM type: YTN; PAM sequence: TTT
attttatcaagacagggtct

SEQ ID NO: 210971 - DNA, 20 bp, Artificial Sequence
  Description of Artificial Sequence: Synthetic oligonucleotide
  Target: ATXN1; (-) strand; PAM type: YTN; PAM sequence: TTT
tattttatcaagacagggtc

SEQ ID NO: 210972 - DNA, 20 bp, Artificial Sequence
  Description of Artificial Sequence: Synthetic oligonucleotide
  Target: ATXN1; (-) strand; PAM type: YTN; PAM sequence: TTC
attttattttatcaagacag

SEQ ID NO: 210973 - DNA, 20 bp, Artificial Sequence
  Description of Artificial Sequence: Synthetic oligonucleotide
  Target: ATXN1; (-) strand; PAM type: YTN; PAM sequence: TTT
cattttattttatcaagaca

SEQ ID NO: 210974 - DNA, 20 bp, Artificial Sequence
  Description of Artificial Sequence: Synthetic oligonucleotide
  Target: ATXN1; (-) strand; PAM type: YTN; PAM sequence: TTA
tttcattttattttatcaag

SEQ ID NO: 210975 - DNA, 20 bp, Artificial Sequence
  Description of Artificial Sequence: Synthetic oligonucleotide
  Target: ATXN1; (-) strand; PAM type: YTN; PAM sequence: TTT
atttcattttattttatcaa

SEQ ID NO: 210976 - DNA, 20 bp, Artificial Sequence
  Description of Artificial Sequence: Synthetic oligonucleotide
  Target: ATXN1; (-) strand; PAM type: YTN; PAM sequence: TTT
tatttcattttattttatca

SEQ ID NO: 210977 - DNA, 20 bp, Artificial Sequence
  Description of Artificial Sequence: Synthetic oligonucleotide
  Target: ATXN1; (-) strand; PAM type: YTN; PAM sequence: TTA
ttttatttcattttatttta

SEQ ID NO: 210978 - DNA, 20 bp, Artificial Sequence
  Description of Artificial Sequence: Synthetic oligonucleotide
  Target: ATXN1; (-) strand; PAM type: YTN; PAM sequence: TTT
attttatttcattttatttt

SEQ ID NO: 210979 - DNA, 20 bp, Artificial Sequence
  Description of Artificial Sequence: Synthetic oligonucleotide
  Target: ATXN1; (-) strand; PAM type: YTN; PAM sequence: TTT
tattttatttcattttattt

SEQ ID NO: 210980 - DNA, 20 bp, Artificial Sequence
  Description of Artificial Sequence: Synthetic oligonucleotide
  Target: ATXN1; (-) strand; PAM type: YTN; PAM sequence: TTA
ttttattttatttcatttta

SEQ ID NO: 210981 - DNA, 20 bp, Artificial Sequence
  Description of Artificial Sequence: Synthetic oligonucleotide
  Target: ATXN1; (-) strand; PAM type: YTN; PAM sequence: TTA
tattattttattttatttca

SEQ ID NO: 210982 - DNA, 20 bp, Artificial Sequence
  Description of Artificial Sequence: Synthetic oligonucleotide
  Target: ATXN1; (-) strand; PAM type: YTN; PAM sequence: TTT
atattattttattttatttc

SEQ ID NO: 210983 - DNA, 20 bp, Artificial Sequence
  Description of Artificial Sequence: Synthetic oligonucleotide
  Target: ATXN1; (-) strand; PAM type: YTN; PAM sequence: TTG
tatttatattattttatttt

SEQ ID NO: 210984 - DNA, 20 bp, Artificial Sequence
  Description of Artificial Sequence: Synthetic oligonucleotide
  Target: ATXN1; (-) strand; PAM type: YTN; PAM sequence: TTT
gtatttatattattttattt

SEQ ID NO: 210985 - DNA, 20 bp, Artificial Sequence
  Description of Artificial Sequence: Synthetic oligonucleotide
  Target: ATXN1; (-) strand; PAM type: YTN; PAM sequence: TTG
tcatttgtatttatattatt

SEQ ID NO: 210986 - DNA, 20 bp, Artificial Sequence
  Description of Artificial Sequence: Synthetic oligonucleotide
  Target: ATXN1; (-) strand; PAM type: YTN; PAM sequence: TTT
gtcatttgtatttatattat

SEQ ID NO: 210987 - DNA, 20 bp, Artificial Sequence
  Description of Artificial Sequence: Synthetic oligonucleotide
  Target: ATXN1; (-) strand; PAM type: YTN; PAM sequence: CTA
gaaaatttgtcatttgtatt

SEQ ID NO: 210988 - DNA, 20 bp, Artificial Sequence
  Description of Artificial Sequence: Synthetic oligonucleotide
  Target: ATXN1; (-) strand; PAM type: YTN; PAM sequence: TTC
tagaaaatttgtcatttgta

SEQ ID NO: 210989 - DNA, 20 bp, Artificial Sequence
  Description of Artificial Sequence: Synthetic oligonucleotide
  Target: ATXN1; (-) strand; PAM type: YTN; PAM sequence: TTT
ctagaaaatttgtcatttgt

SEQ ID NO: 210990 - DNA, 20 bp, Artificial Sequence
  Description of Artificial Sequence: Synthetic oligonucleotide
  Target: ATXN1; (-) strand; PAM type: YTN; PAM sequence: TTA
atgtttctagaaaatttgtc

SEQ ID NO: 210991 - DNA, 20 bp, Artificial Sequence
  Description of Artificial Sequence: Synthetic oligonucleotide
  Target: ATXN1; (-) strand; PAM type: YTN; PAM sequence: TTT
aatgtttctagaaaatttgt

SEQ ID NO: 210992 - DNA, 20 bp, Artificial Sequence
  Description of Artificial Sequence: Synthetic oligonucleotide
  Target: ATXN1; (-) strand; PAM type: YTN; PAM sequence: TTT
taatgtttctagaaaatttg

SEQ ID NO: 210993 - DNA, 20 bp, Artificial Sequence
  Description of Artificial Sequence: Synthetic oligonucleotide
  Target: ATXN1; (-) strand; PAM type: YTN; PAM sequence: TTA
aagcattttaatgtttctag

SEQ ID NO: 210994 - DNA, 20 bp, Artificial Sequence
  Description of Artificial Sequence: Synthetic oligonucleotide
  Target: ATXN1; (-) strand; PAM type: YTN; PAM sequence: TTA
atattaaagcattttaatgt

SEQ ID NO: 210995 - DNA, 20 bp, Artificial Sequence
  Description of Artificial Sequence: Synthetic oligonucleotide
  Target: ATXN1; (-) strand; PAM type: YTN; PAM sequence: TTA
aattaatattaaagcatttt

SEQ ID NO: 210996 - DNA, 20 bp, Artificial Sequence
  Description of Artificial Sequence: Synthetic oligonucleotide
  Target: ATXN1; (-) strand; PAM type: YTN; PAM sequence: CTT
aaattaatattaaagcattt

SEQ ID NO: 210997 - DNA, 20 bp, Artificial Sequence
  Description of Artificial Sequence: Synthetic oligonucleotide
  Target: ATXN1; (-) strand; PAM type: YTN; PAM sequence: TTC
ttaaattaatattaaagcat

SEQ ID NO: 210998 - DNA, 20 bp, Artificial Sequence
  Description of Artificial Sequence: Synthetic oligonucleotide
  Target: ATXN1; (-) strand; PAM type: YTN; PAM sequence: CTT
cttaaattaatattaaagca

SEQ ID NO: 210999 - DNA, 20 bp, Artificial Sequence
  Description of Artificial Sequence: Synthetic oligonucleotide
  Target: ATXN1; (-) strand; PAM type: YTN; PAM sequence: TTA
cttcttaaattaatattaaa

SEQ ID NO: 211000 - DNA, 20 bp, Artificial Sequence
  Description of Artificial Sequence: Synthetic oligonucleotide
  Target: ATXN1; (-) strand; PAM type: YTN; PAM sequence: TTT
acttcttaaattaatattaa

SEQ ID NO: 211001 - DNA, 20 bp, Artificial Sequence
  Description of Artificial Sequence: Synthetic oligonucleotide
  Target: ATXN1; (-) strand; PAM type: YTN; PAM sequence: TTT
tacttcttaaattaatatta

SEQ ID NO: 211002 - DNA, 20 bp, Artificial Sequence
  Description of Artificial Sequence: Synthetic oligonucleotide
  Target: ATXN1; (-) strand; PAM type: YTN; PAM sequence: TTT
ttacttcttaaattaatatt

SEQ ID NO: 211003 - DNA, 20 bp, Artificial Sequence
  Description of Artificial Sequence: Synthetic oligonucleotide
  Target: ATXN1; (-) strand; PAM type: YTN; PAM sequence: TTG
atcaggatttttacttctta

SEQ ID NO: 211004 - DNA, 20 bp, Artificial Sequence
  Description of Artificial Sequence: Synthetic oligonucleotide
  Target: ATXN1; (-) strand; PAM type: YTN; PAM sequence: TTT
gatcaggatttttacttctt

SEQ ID NO: 211005 - DNA, 20 bp, Artificial Sequence
  Description of Artificial Sequence: Synthetic oligonucleotide
  Target: ATXN1; (-) strand; PAM type: YTN; PAM sequence: TTT
tgatcaggatttttacttct

SEQ ID NO: 211006 - DNA, 20 bp, Artificial Sequence
  Description of Artificial Sequence: Synthetic oligonucleotide
  Target: ATXN1; (-) strand; PAM type: YTN; PAM sequence: TTT
ttgatcaggatttttacttc

SEQ ID NO: 211007 - DNA, 20 bp, Artificial Sequence
  Description of Artificial Sequence: Synthetic oligonucleotide
  Target: ATXN1; (-) strand; PAM type: YTN; PAM sequence: TTT
tttgatcaggatttttactt

SEQ ID NO: 211008 - DNA, 20 bp, Artificial Sequence
  Description of Artificial Sequence: Synthetic oligonucleotide
  Target: ATXN1; (-) strand; PAM type: YTN; PAM sequence: TTT
ttttgatcaggatttttact

SEQ ID NO: 211009 - DNA, 20 bp, Artificial Sequence
  Description of Artificial Sequence: Synthetic oligonucleotide
  Target: ATXN1; (-) strand; PAM type: YTN; PAM sequence: CTA
taataatttttttgatcagg

SEQ ID NO: 211010 - DNA, 20 bp, Artificial Sequence
  Description of Artificial Sequence: Synthetic oligonucleotide
  Target: ATXN1; (-) strand; PAM type: YTN; PAM sequence: TTG
tctataataatttttttgat

SEQ ID NO: 211011 - DNA, 20 bp, Artificial Sequence
  Description of Artificial Sequence: Synthetic oligonucleotide
  Target: ATXN1; (-) strand; PAM type: YTN; PAM sequence: TTT
gtctataataatttttttga

SEQ ID NO: 211012 - DNA, 20 bp, Artificial Sequence
  Description of Artificial Sequence: Synthetic oligonucleotide
  Target: ATXN1; (-) strand; PAM type: YTN; PAM sequence: CTA
aaagtttgtctataataatt

SEQ ID NO: 211013 - DNA, 20 bp, Artificial Sequence
  Description of Artificial Sequence: Synthetic oligonucleotide
  Target: ATXN1; (-) strand; PAM type: YTN; PAM sequence: CTC
cccacccctaaaagtttgtc

SEQ ID NO: 211014 - DNA, 20 bp, Artificial Sequence
  Description of Artificial Sequence: Synthetic oligonucleotide
  Target: ATXN1; (-) strand; PAM type: YTN; PAM sequence: TTA
tgaaagcctccccaccccta

SEQ ID NO: 211015 - DNA, 20 bp, Artificial Sequence
  Description of Artificial Sequence: Synthetic oligonucleotide
  Target: ATXN1; (-) strand; PAM type: YTN; PAM sequence: TTA
tattatgaaagcctccccac

SEQ ID NO: 211016 - DNA, 20 bp, Artificial Sequence
  Description of Artificial Sequence: Synthetic oligonucleotide
  Target: ATXN1; (-) strand; PAM type: YTN; PAM sequence: TTG
ttatattatgaaagcctccc

SEQ ID NO: 211017 - DNA, 20 bp, Artificial Sequence
  Description of Artificial Sequence: Synthetic oligonucleotide
  Target: ATXN1; (-) strand; PAM type: YTN; PAM sequence: TTG
gttgttatattatgaaagcc

SEQ ID NO: 211018 - DNA, 20 bp, Artificial Sequence
  Description of Artificial Sequence: Synthetic oligonucleotide
  Target: ATXN1; (-) strand; PAM type: YTN; PAM sequence: TTT
ggttgttatattatgaaagc

SEQ ID NO: 211019 - DNA, 20 bp, Artificial Sequence
  Description of Artificial Sequence: Synthetic oligonucleotide
  Target: ATXN1; (-) strand; PAM type: YTN; PAM sequence: TTT
tggttgttatattatgaaag

SEQ ID NO: 211020 - DNA, 20 bp, Artificial Sequence
  Description of Artificial Sequence: Synthetic oligonucleotide
  Target: ATXN1; (-) strand; PAM type: YTN; PAM sequence: TTT
ttggttgttatattatgaaa

SEQ ID NO: 211021 - DNA, 20 bp, Artificial Sequence
  Description of Artificial Sequence: Synthetic oligonucleotide
  Target: ATXN1; (-) strand; PAM type: YTN; PAM sequence: TTT
tttggttgttatattatgaa

SEQ ID NO: 211022 - DNA, 20 bp, Artificial Sequence
  Description of Artificial Sequence: Synthetic oligonucleotide
  Target: ATXN1; (-) strand; PAM type: YTN; PAM sequence: TTA
tgtcattttttggttgttat

SEQ ID NO: 211023 - DNA, 20 bp, Artificial Sequence
  Description of Artificial Sequence: Synthetic oligonucleotide
  Target: ATXN1; (-) strand; PAM type: YTN; PAM sequence: TTA
gaattatgtcattttttggt

SEQ ID NO: 211024 - DNA, 20 bp, Artificial Sequence
  Description of Artificial Sequence: Synthetic oligonucleotide
  Target: ATXN1; (-) strand; PAM type: YTN; PAM sequence: TTA
ttagaattatgtcatttttt

SEQ ID NO: 211025 - DNA, 20 bp, Artificial Sequence
  Description of Artificial Sequence: Synthetic oligonucleotide
  Target: ATXN1; (-) strand; PAM type: YTN; PAM sequence: CTG
tccccaaagttattagaatt

SEQ ID NO: 211026 - DNA, 20 bp, Artificial Sequence
  Description of Artificial Sequence: Synthetic oligonucleotide
  Target: ATXN1; (-) strand; PAM type: YTN; PAM sequence: TTA
cctgtccccaaagttattag

SEQ ID NO: 211027 - DNA, 20 bp, Artificial Sequence
  Description of Artificial Sequence: Synthetic oligonucleotide
  Target: ATXN1; (-) strand; PAM type: YTN; PAM sequence: TTG
aaattacctgtccccaaagt

SEQ ID NO: 211028 - DNA, 20 bp, Artificial Sequence
  Description of Artificial Sequence: Synthetic oligonucleotide
  Target: ATXN1; (-) strand; PAM type: YTN; PAM sequence: TTT
gaaattacctgtccccaaag

SEQ ID NO: 211029 - DNA, 20 bp, Artificial Sequence
  Description of Artificial Sequence: Synthetic oligonucleotide
  Target: ATXN1; (-) strand; PAM type: YTN; PAM sequence: CTT
tgaaattacctgtccccaaa

SEQ ID NO: 211030 - DNA, 20 bp, Artificial Sequence
  Description of Artificial Sequence: Synthetic oligonucleotide
  Target: ATXN1; (-) strand; PAM type: YTN; PAM sequence: CTG
gaagctttgaaattacctgt

SEQ ID NO: 211031 - DNA, 20 bp, Artificial Sequence
  Description of Artificial Sequence: Synthetic oligonucleotide
  Target: ATXN1; (-) strand; PAM type: YTN; PAM sequence: TTA
aggcacatgtagcatcctgg

SEQ ID NO: 211032 - DNA, 20 bp, Artificial Sequence
  Description of Artificial Sequence: Synthetic oligonucleotide
  Target: ATXN1; (-) strand; PAM type: YTN; PAM sequence: TTG
cccccattaaggcacatgta

SEQ ID NO: 211033 - DNA, 20 bp, Artificial Sequence
  Description of Artificial Sequence: Synthetic oligonucleotide
  Target: ATXN1; (-) strand; PAM type: YTN; PAM sequence: TTT
gcccccattaaggcacatgt

SEQ ID NO: 211034 - DNA, 20 bp, Artificial Sequence
  Description of Artificial Sequence: Synthetic oligonucleotide
  Target: ATXN1; (-) strand; PAM type: YTN; PAM sequence: CTT
tgcccccattaaggcacatg

SEQ ID NO: 211035 - DNA, 20 bp, Artificial Sequence
  Description of Artificial Sequence: Synthetic oligonucleotide
  Target: ATXN1; (-) strand; PAM type: YTN; PAM sequence: CTC
aaggagaagaaaagtgagag

SEQ ID NO: 211036 - DNA, 20 bp, Artificial Sequence
  Description of Artificial Sequence: Synthetic oligonucleotide
  Target: ATXN1; (-) strand; PAM type: YTN; PAM sequence: TTG
cctcaaggagaagaaaagtg

SEQ ID NO: 211037 - DNA, 20 bp, Artificial Sequence
  Description of Artificial Sequence: Synthetic oligonucleotide
  Target: ATXN1; (-) strand; PAM type: YTN; PAM sequence: CTG
agttgcctcaaggagaagaa

SEQ ID NO: 211038 - DNA, 20 bp, Artificial Sequence
  Description of Artificial Sequence: Synthetic oligonucleotide
  Target: ATXN1; (-) strand; PAM type: YTN; PAM sequence: CTC
tgagttgcctcaaggagaag

SEQ ID NO: 211039 - DNA, 20 bp, Artificial Sequence
  Description of Artificial Sequence: Synthetic oligonucleotide
  Target: ATXN1; (-) strand; PAM type: YTN; PAM sequence: CTC
ctctgagttgcctcaaggag

SEQ ID NO: 211040 - DNA, 20 bp, Artificial Sequence
  Description of Artificial Sequence: Synthetic oligonucleotide
  Target: ATXN1; (-) strand; PAM type: YTN; PAM sequence: TTC
cacaatcgctcctctgagtt

SEQ ID NO: 211041 - DNA, 20 bp, Artificial Sequence
  Description of Artificial Sequence: Synthetic oligonucleotide
  Target: ATXN1; (-) strand; PAM type: YTN; PAM sequence: TTT
ccacaatcgctcctctgagt

SEQ ID NO: 211042 - DNA, 20 bp, Artificial Sequence
  Description of Artificial Sequence: Synthetic oligonucleotide
  Target: ATXN1; (-) strand; PAM type: YTN; PAM sequence: TTC
ggaaatttccacaatcgctc

SEQ ID NO: 211043 - DNA, 20 bp, Artificial Sequence
  Description of Artificial Sequence: Synthetic oligonucleotide
  Target: ATXN1; (-) strand; PAM type: YTN; PAM sequence: CTT
cggaaatttccacaatcgct

SEQ ID NO: 211044 - DNA, 20 bp, Artificial Sequence
  Description of Artificial Sequence: Synthetic oligonucleotide
  Target: ATXN1; (-) strand; PAM type: YTN; PAM sequence: CTG
acatatagcagcttcggaaa

SEQ ID NO: 211045 - DNA, 20 bp, Artificial Sequence
  Description of Artificial Sequence: Synthetic oligonucleotide
  Target: ATXN1; (-) strand; PAM type: YTN; PAM sequence: TTC
catacaaatgggcaagctga

SEQ ID NO: 211046 - DNA, 20 bp, Artificial Sequence
  Description of Artificial Sequence: Synthetic oligonucleotide
  Target: ATXN1; (-) strand; PAM type: YTN; PAM sequence: TTG
tcaaaaaaaccatgaaattc

SEQ ID NO: 211047 - DNA, 20 bp, Artificial Sequence
  Description of Artificial Sequence: Synthetic oligonucleotide
  Target: ATXN1; (-) strand; PAM type: YTN; PAM sequence: CTT
gtcaaaaaaaccatgaaatt

SEQ ID NO: 211048 - DNA, 20 bp, Artificial Sequence
  Description of Artificial Sequence: Synthetic oligonucleotide
  Target: ATXN1; (-) strand; PAM type: YTN; PAM sequence: CTG
acttgtcaaaaaaaccatga

SEQ ID NO: 211049 - DNA, 20 bp, Artificial Sequence
  Description of Artificial Sequence: Synthetic oligonucleotide
  Target: ATXN1; (-) strand; PAM type: YTN; PAM sequence: TTC
aagatgcgatgatgacaaaa

SEQ ID NO: 211050 - DNA, 20 bp, Artificial Sequence
  Description of Artificial Sequence: Synthetic oligonucleotide
  Target: ATXN1; (-) strand; PAM type: YTN; PAM sequence: TTT
caagatgcgatgatgacaaa

SEQ ID NO: 211051 - DNA, 20 bp, Artificial Sequence
  Description of Artificial Sequence: Synthetic oligonucleotide
  Target: ATXN1; (-) strand; PAM type: YTN; PAM sequence: CTT
tcaagatgcgatgatgacaa

SEQ ID NO: 211052 - DNA, 20 bp, Artificial Sequence
  Description of Artificial Sequence: Synthetic oligonucleotide
  Target: ATXN1; (-) strand; PAM type: YTN; PAM sequence: CTA
ctttcaagatgcgatgatga

SEQ ID NO: 211053 - DNA, 20 bp, Artificial Sequence
  Description of Artificial Sequence: Synthetic oligonucleotide
  Target: ATXN1; (-) strand; PAM type: YTN; PAM sequence: CTC
tactttcaagatgcgatgat

SEQ ID NO: 211054 - DNA, 20 bp, Artificial Sequence
  Description of Artificial Sequence: Synthetic oligonucleotide
  Target: ATXN1; (-) strand; PAM type: YTN; PAM sequence: CTC
tctactttcaagatgcgatg

SEQ ID NO: 211055 - DNA, 20 bp, Artificial Sequence
  Description of Artificial Sequence: Synthetic oligonucleotide
  Target: ATXN1; (-) strand; PAM type: YTN; PAM sequence: TTC
ctctctactttcaagatgcg

SEQ ID NO: 211056 - DNA, 20 bp, Artificial Sequence
  Description of Artificial Sequence: Synthetic oligonucleotide
  Target: ATXN1; (-) strand; PAM type: YTN; PAM sequence: TTT
cctctctactttcaagatgc

SEQ ID NO: 211057 - DNA, 20 bp, Artificial Sequence
  Description of Artificial Sequence: Synthetic oligonucleotide
  Target: ATXN1; (-) strand; PAM type: YTN; PAM sequence: CTT
tcctctctactttcaagatg

SEQ ID NO: 211058 - DNA, 20 bp, Artificial Sequence
  Description of Artificial Sequence: Synthetic oligonucleotide
  Target: ATXN1; (-) strand; PAM type: YTN; PAM sequence: TTC
ctttcctctctactttcaag

SEQ ID NO: 211059 - DNA, 20 bp, Artificial Sequence
  Description of Artificial Sequence: Synthetic oligonucleotide
  Target: ATXN1; (-) strand; PAM type: YTN; PAM sequence: TTC
cattcctttcctctctactt

SEQ ID NO: 211060 - DNA, 20 bp, Artificial Sequence
  Description of Artificial Sequence: Synthetic oligonucleotide
  Target: ATXN1; (-) strand; PAM type: YTN; PAM sequence: CTT
ccattcctttcctctctact

SEQ ID NO: 211061 - DNA, 20 bp, Artificial Sequence
  Description of Artificial Sequence: Synthetic oligonucleotide
  Target: ATXN1; (-) strand; PAM type: YTN; PAM sequence: CTC
ccttccattcctttcctctc

SEQ ID NO: 211062 - DNA, 20 bp, Artificial Sequence
  Description of Artificial Sequence: Synthetic oligonucleotide
  Target: ATXN1; (-) strand; PAM type: YTN; PAM sequence: TTC
tcccttccattcctttcctc

SEQ ID NO: 211063 - DNA, 20 bp, Artificial Sequence
  Description of Artificial Sequence: Synthetic oligonucleotide
  Target: ATXN1; (-) strand; PAM type: YTN; PAM sequence: CTG
atagtaacagttctcccttc

SEQ ID NO: 211064 - DNA, 20 bp, Artificial Sequence
  Description of Artificial Sequence: Synthetic oligonucleotide
  Target: ATXN1; (-) strand; PAM type: YTN; PAM sequence: CTC
tgatagtaacagttctccct

SEQ ID NO: 211065 - DNA, 20 bp, Artificial Sequence
  Description of Artificial Sequence: Synthetic oligonucleotide
  Target: ATXN1; (-) strand; PAM type: YTN; PAM sequence: TTC
cagaagcctctgatagtaac

SEQ ID NO: 211066 - DNA, 20 bp, Artificial Sequence
  Description of Artificial Sequence: Synthetic oligonucleotide
  Target: ATXN1; (-) strand; PAM type: YTN; PAM sequence: TTT
ccagaagcctctgatagtaa

SEQ ID NO: 211067 - DNA, 20 bp, Artificial Sequence
  Description of Artificial Sequence: Synthetic oligonucleotide
  Target: ATXN1; (-) strand; PAM type: YTN; PAM sequence: TTA
agaaagagtcatgtaccatc

SEQ ID NO: 211068 - DNA, 20 bp, Artificial Sequence
  Description of Artificial Sequence: Synthetic oligonucleotide
  Target: ATXN1; (-) strand; PAM type: YTN; PAM sequence: CTT
aagaaagagtcatgtaccat

SEQ ID NO: 211069 - DNA, 20 bp, Artificial Sequence
  Description of Artificial Sequence: Synthetic oligonucleotide
  Target: ATXN1; (-) strand; PAM type: YTN; PAM sequence: TTC
ttaagaaagagtcatgtacc

SEQ ID NO: 211070 - DNA, 20 bp, Artificial Sequence
  Description of Artificial Sequence: Synthetic oligonucleotide
  Target: ATXN1; (-) strand; PAM type: YTN; PAM sequence: TTG
tcaccaaaatggcaacccgt

SEQ ID NO: 211071 - DNA, 20 bp, Artificial Sequence
  Description of Artificial Sequence: Synthetic oligonucleotide
  Target: ATXN1; (-) strand; PAM type: YTN; PAM sequence: CTG
agtgcaccaattgtcaccaa

SEQ ID NO: 211072 - DNA, 20 bp, Artificial Sequence
  Description of Artificial Sequence: Synthetic oligonucleotide
  Target: ATXN1; (-) strand; PAM type: YTN; PAM sequence: CTG
gggcccaccaagaggtagag

SEQ ID NO: 211073 - DNA, 20 bp, Artificial Sequence
  Description of Artificial Sequence: Synthetic oligonucleotide
  Target: ATXN1; (-) strand; PAM type: YTN; PAM sequence: CTG
aagtatactggggcccacca

SEQ ID NO: 211074 - DNA, 20 bp, Artificial Sequence
  Description of Artificial Sequence: Synthetic oligonucleotide
  Target: ATXN1; (-) strand; PAM type: YTN; PAM sequence: CTG
agatcatgctgaagtatact

SEQ ID NO: 211075 - DNA, 20 bp, Artificial Sequence
  Description of Artificial Sequence: Synthetic oligonucleotide
  Target: ATXN1; (-) strand; PAM type: YTN; PAM sequence: CTG
gtagagaaagaaagaactga

SEQ ID NO: 211076 - DNA, 20 bp, Artificial Sequence
  Description of Artificial Sequence: Synthetic oligonucleotide
  Target: ATXN1; (-) strand; PAM type: YTN; PAM sequence: TTC
aggatgtatgtatcatggaa

SEQ ID NO: 211077 - DNA, 20 bp, Artificial Sequence
  Description of Artificial Sequence: Synthetic oligonucleotide
  Target: ATXN1; (-) strand; PAM type: YTN; PAM sequence: TTT
caggatgtatgtatcatgga

SEQ ID NO: 211078 - DNA, 20 bp, Artificial Sequence
  Description of Artificial Sequence: Synthetic oligonucleotide
  Target: ATXN1; (-) strand; PAM type: YTN; PAM sequence: TTT
tcaggatgtatgtatcatgg

SEQ ID NO: 211079 - DNA, 20 bp, Artificial Sequence
  Description of Artificial Sequence: Synthetic oligonucleotide
  Target: ATXN1; (-) strand; PAM type: YTN; PAM sequence: CTG
tgattttcaggatgtatgta

SEQ ID NO: 211080 - DNA, 20 bp, Artificial Sequence
  Description of Artificial Sequence: Synthetic oligonucleotide
  Target: ATXN1; (-) strand; PAM type: YTN; PAM sequence: TTG
aatggtgatgctgtgatttt

SEQ ID NO: 211081 - DNA, 20 bp, Artificial Sequence
  Description of Artificial Sequence: Synthetic oligonucleotide
  Target: ATXN1; (-) strand; PAM type: YTN; PAM sequence: CTA
ttgaatggtgatgctgtgat

SEQ ID NO: 211082 - DNA, 20 bp, Artificial Sequence
  Description of Artificial Sequence: Synthetic oligonucleotide
  Target: ATXN1; (-) strand; PAM type: YTN; PAM sequence: TTG
tctattgaatggtgatgctg

SEQ ID NO: 211083 - DNA, 20 bp, Artificial Sequence
  Description of Artificial Sequence: Synthetic oligonucleotide
  Target: ATXN1; (-) strand; PAM type: YTN; PAM sequence: TTT
gtctattgaatggtgatgct

SEQ ID NO: 211084 - DNA, 20 bp, Artificial Sequence
  Description of Artificial Sequence: Synthetic oligonucleotide
  Target: ATXN1; (-) strand; PAM type: YTN; PAM sequence: TTT
tgtctattgaatggtgatgc

SEQ ID NO: 211085 - DNA, 20 bp, Artificial Sequence
  Description of Artificial Sequence: Synthetic oligonucleotide
  Target: ATXN1; (-) strand; PAM type: YTN; PAM sequence: TTT
ttgtctattgaatggtgatg

SEQ ID NO: 211086 - DNA, 20 bp, Artificial Sequence
  Description of Artificial Sequence: Synthetic oligonucleotide
  Target: ATXN1; (-) strand; PAM type: YTN; PAM sequence: TTG
ataatgataatttttgtcta

SEQ ID NO: 211087 - DNA, 20 bp, Artificial Sequence
  Description of Artificial Sequence: Synthetic oligonucleotide
  Target: ATXN1; (-) strand; PAM type: YTN; PAM sequence: TTT
gataatgataatttttgtct

SEQ ID NO: 211088 - DNA, 20 bp, Artificial Sequence
  Description of Artificial Sequence: Synthetic oligonucleotide
  Target: ATXN1; (-) strand; PAM type: YTN; PAM sequence: CTT
tgataatgataatttttgtc

SEQ ID NO: 211089 - DNA, 20 bp, Artificial Sequence
  Description of Artificial Sequence: Synthetic oligonucleotide
  Target: ATXN1; (-) strand; PAM type: YTN; PAM sequence: TTG
gccgctttgataatgataat

SEQ ID NO: 211090 - DNA, 20 bp, Artificial Sequence
  Description of Artificial Sequence: Synthetic oligonucleotide
  Target: ATXN1; (-) strand; PAM type: YTN; PAM sequence: TTT
ggccgctttgataatgataa

SEQ ID NO: 211091 - DNA, 20 bp, Artificial Sequence
  Description of Artificial Sequence: Synthetic oligonucleotide
  Target: ATXN1; (-) strand; PAM type: YTN; PAM sequence: TTT
tggccgctttgataatgata

SEQ ID NO: 211092 - DNA, 20 bp, Artificial Sequence
  Description of Artificial Sequence: Synthetic oligonucleotide
  Target: ATXN1; (-) strand; PAM type: YTN; PAM sequence: TTT
ttggccgctttgataatgat

SEQ ID NO: 211093 - DNA, 20 bp, Artificial Sequence
  Description of Artificial Sequence: Synthetic oligonucleotide
  Target: ATXN1; (-) strand; PAM type: YTN; PAM sequence: CTT
tttggccgctttgataatga

SEQ ID NO: 211094 - DNA, 20 bp, Artificial Sequence
  Description of Artificial Sequence: Synthetic oligonucleotide
  Target: ATXN1; (-) strand; PAM type: YTN; PAM sequence: TTA
agagaaaacctttttggccg

SEQ ID NO: 211095 - DNA, 20 bp, Artificial Sequence
  Description of Artificial Sequence: Synthetic oligonucleotide
  Target: ATXN1; (-) strand; PAM type: YTN; PAM sequence: TTT
aagagaaaacctttttggcc

SEQ ID NO: 211096 - DNA, 20 bp, Artificial Sequence
  Description of Artificial Sequence: Synthetic oligonucleotide
  Target: ATXN1; (-) strand; PAM type: YTN; PAM sequence: TTC
ccacagaatatttaagagaa

SEQ ID NO: 211097 - DNA, 20 bp, Artificial Sequence
  Description of Artificial Sequence: Synthetic oligonucleotide
  Target: ATXN1; (-) strand; PAM type: YTN; PAM sequence: TTT
cccacagaatatttaagaga

SEQ ID NO: 211098 - DNA, 20 bp, Artificial Sequence
  Description of Artificial Sequence: Synthetic oligonucleotide
  Target: ATXN1; (-) strand; PAM type: YTN; PAM sequence: CTT
tcccacagaatatttaagag

SEQ ID NO: 211099 - DNA, 20 bp, Artificial Sequence
  Description of Artificial Sequence: Synthetic oligonucleotide
  Target: ATXN1; (-) strand; PAM type: YTN; PAM sequence: CTC
tttcccacagaatatttaag

SEQ ID NO: 211100 - DNA, 20 bp, Artificial Sequence
  Description of Artificial Sequence: Synthetic oligonucleotide
  Target: ATXN1; (-) strand; PAM type: YTN; PAM sequence: TTC
aaccctctttcccacagaat

SEQ ID NO: 211101 - DNA, 20 bp, Artificial Sequence
  Description of Artificial Sequence: Synthetic oligonucleotide
  Target: ATXN1; (-) strand; PAM type: YTN; PAM sequence: TTT
caaccctctttcccacagaa

SEQ ID NO: 211102 - DNA, 20 bp, Artificial Sequence
  Description of Artificial Sequence: Synthetic oligonucleotide
  Target: ATXN1; (-) strand; PAM type: YTN; PAM sequence: TTT
tcaaccctctttcccacaga

SEQ ID NO: 211103 - DNA, 20 bp, Artificial Sequence
  Description of Artificial Sequence: Synthetic oligonucleotide
  Target: ATXN1; (-) strand; PAM type: YTN; PAM sequence: CTA
attttcaaccctctttccca

SEQ ID NO: 211104 - DNA, 20 bp, Artificial Sequence
  Description of Artificial Sequence: Synthetic oligonucleotide
  Target: ATXN1; (-) strand; PAM type: YTN; PAM sequence: TTC
taattttcaaccctctttcc

SEQ ID NO: 211105 - DNA, 20 bp, Artificial Sequence
  Description of Artificial Sequence: Synthetic oligonucleotide
  Target: ATXN1; (-) strand; PAM type: YTN; PAM sequence: CTA
ttctaattttcaaccctctt

SEQ ID NO: 211106 - DNA, 20 bp, Artificial Sequence
  Description of Artificial Sequence: Synthetic oligonucleotide
  Target: ATXN1; (-) strand; PAM type: YTN; PAM sequence: TTC
tattctaattttcaaccctc

SEQ ID NO: 211107 - DNA, 20 bp, Artificial Sequence
  Description of Artificial Sequence: Synthetic oligonucleotide
  Target: ATXN1; (-) strand; PAM type: YTN; PAM sequence: CTG
tggcaaatacatagtattct

SEQ ID NO: 211108 - DNA, 20 bp, Artificial Sequence
  Description of Artificial Sequence: Synthetic oligonucleotide
  Target: ATXN1; (-) strand; PAM type: YTN; PAM sequence: TTA
ctgtggcaaatacatagtat

SEQ ID NO: 211109 - DNA, 20 bp, Artificial Sequence
  Description of Artificial Sequence: Synthetic oligonucleotide
  Target: ATXN1; (-) strand; PAM type: YTN; PAM sequence: TTT
actgtggcaaatacatagta

SEQ ID NO: 211110 - DNA, 20 bp, Artificial Sequence
  Description of Artificial Sequence: Synthetic oligonucleotide
  Target: ATXN1; (-) strand; PAM type: YTN; PAM sequence: TTT
tactgtggcaaatacatagt

SEQ ID NO: 211111 - DNA, 20 bp, Artificial Sequence
  Description of Artificial Sequence: Synthetic oligonucleotide
  Target: ATXN1; (-) strand; PAM type: YTN; PAM sequence: CTT
ttactgtggcaaatacatag

SEQ ID NO: 211112 - DNA, 20 bp, Artificial Sequence
  Description of Artificial Sequence: Synthetic oligonucleotide
  Target: ATXN1; (-) strand; PAM type: YTN; PAM sequence: TTG
tggtaggtatcttttactgt

SEQ ID NO: 211113 - DNA, 20 bp, Artificial Sequence
  Description of Artificial Sequence: Synthetic oligonucleotide
  Target: ATXN1; (-) strand; PAM type: YTN; PAM sequence: TTT
gtggtaggtatcttttactg

SEQ ID NO: 211114 - DNA, 20 bp, Artificial Sequence
  Description of Artificial Sequence: Synthetic oligonucleotide
  Target: ATXN1; (-) strand; PAM type: YTN; PAM sequence: CTG
gtttgtggtaggtatctttt

SEQ ID NO: 211115 - DNA, 20 bp, Artificial Sequence
  Description of Artificial Sequence: Synthetic oligonucleotide
  Target: ATXN1; (-) strand; PAM type: YTN; PAM sequence: CTA
ctggtttgtggtaggtatct

SEQ ID NO: 211116 - DNA, 20 bp, Artificial Sequence
  Description of Artificial Sequence: Synthetic oligonucleotide
  Target: ATXN1; (-) strand; PAM type: YTN; PAM sequence: TTG
gctactggtttgtggtaggt

SEQ ID NO: 211117 - DNA, 20 bp, Artificial Sequence
  Description of Artificial Sequence: Synthetic oligonucleotide
  Target: ATXN1; (-) strand; PAM type: YTN; PAM sequence: TTA
atataatattggctactggt

SEQ ID NO: 211118 - DNA, 20 bp, Artificial Sequence
  Description of Artificial Sequence: Synthetic oligonucleotide
  Target: ATXN1; (-) strand; PAM type: YTN; PAM sequence: TTT
aatataatattggctactgg

SEQ ID NO: 211119 - DNA, 20 bp, Artificial Sequence
  Description of Artificial Sequence: Synthetic oligonucleotide
  Target: ATXN1; (-) strand; PAM type: YTN; PAM sequence: TTT
taatataatattggctactg

SEQ ID NO: 211120 - DNA, 20 bp, Artificial Sequence
  Description of Artificial Sequence: Synthetic oligonucleotide
  Target: ATXN1; (-) strand; PAM type: YTN; PAM sequence: CTT
ttaatataatattggctact

SEQ ID NO: 211121 - DNA, 20 bp, Artificial Sequence
  Description of Artificial Sequence: Synthetic oligonucleotide
  Target: ATXN1; (-) strand; PAM type: YTN; PAM sequence: TTA
acttttaatataatattggc

SEQ ID NO: 211122 - DNA, 20 bp, Artificial Sequence
  Description of Artificial Sequence: Synthetic oligonucleotide
  Target: ATXN1; (-) strand; PAM type: YTN; PAM sequence: TTT
aacttttaatataatattgg

SEQ ID NO: 211123 - DNA, 20 bp, Artificial Sequence
  Description of Artificial Sequence: Synthetic oligonucleotide
  Target: ATXN1; (-) strand; PAM type: YTN; PAM sequence: TTT
taacttttaatataatattg

SEQ ID NO: 211124 - DNA, 20 bp, Artificial Sequence
  Description of Artificial Sequence: Synthetic oligonucleotide
  Target: ATXN1; (-) strand; PAM type: YTN; PAM sequence: TTT
ttaacttttaatataatatt

SEQ ID NO: 211125 - DNA, 20 bp, Artificial Sequence
  Description of Artificial Sequence: Synthetic oligonucleotide
  Target: ATXN1; (-) strand; PAM type: YTN; PAM sequence: TTG
tttttaacttttaatataat

SEQ ID NO: 211126 - DNA, 20 bp, Artificial Sequence
  Description of Artificial Sequence: Synthetic oligonucleotide
  Target: ATXN1; (-) strand; PAM type: YTN; PAM sequence: CTT
gtttttaacttttaatataa

SEQ ID NO: 211127 - DNA, 20 bp, Artificial Sequence
  Description of Artificial Sequence: Synthetic oligonucleotide
  Target: ATXN1; (-) strand; PAM type: YTN; PAM sequence: CTC
ttgtttttaacttttaatat

SEQ ID NO: 211128 - DNA, 20 bp, Artificial Sequence
  Description of Artificial Sequence: Synthetic oligonucleotide
  Target: ATXN1; (-) strand; PAM type: YTN; PAM sequence: TTG
actcttgtttttaactttta

SEQ ID NO: 211129 - DNA, 20 bp, Artificial Sequence
  Description of Artificial Sequence: Synthetic oligonucleotide
  Target: ATXN1; (-) strand; PAM type: YTN; PAM sequence: TTA
atcattgactcttgttttta

SEQ ID NO: 211130 - DNA, 20 bp, Artificial Sequence
  Description of Artificial Sequence: Synthetic oligonucleotide
  Target: ATXN1; (-) strand; PAM type: YTN; PAM sequence: TTT
aatcattgactcttgttttt

SEQ ID NO: 211131 - DNA, 20 bp, Artificial Sequence
  Description of Artificial Sequence: Synthetic oligonucleotide
  Target: ATXN1; (-) strand; PAM type: YTN; PAM sequence: CTG
aatttaatcattgactcttg

SEQ ID NO: 211132 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccgcatg

SEQ ID NO: 211133 - DNA, 20 bp, Artificial Sequence
  Description of Artificial Sequence: Synthetic oligonucleotide
  Target: ATXN1; (-) strand; PAM type: YTN; PAM sequence: CTG
gggttacaggcatgagccac

SEQ ID NO: 211134 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctggggttacag

SEQ ID NO: 211135 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctgggg

SEQ ID NO: 211136 - DNA, 20 bp, Artificial Sequence
  Description of Artificial Sequence: Synthetic oligonucleotide
  Target: ATXN1; (-) strand; PAM type: YTN; PAM sequence: CTC
aagtgatccacccgctcagc

SEQ ID NO: 211137 - DNA, 20 bp, Artificial Sequence
  Description of Artificial Sequence: Synthetic oligonucleotide
  Target: ATXN1; (-) strand; PAM type: YTN; PAM sequence: CTG
acctcaagtgatccacccgc

SEQ ID NO: 211138 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaagtgatccacc

SEQ ID NO: 211139 - DNA, 20 bp, Artificial Sequence
  Description of Artificial Sequence: Synthetic oligonucleotide
  Target: ATXN1; (-) strand; PAM type: YTN; PAM sequence: CTC
aaactcctgacctcaagtga

SEQ ID NO: 211140 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcctgacctca

SEQ ID NO: 211141 - DNA, 20 bp, Artificial Sequence
  Description of Artificial Sequence: Synthetic oligonucleotide
  Target: ATXN1; (-) strand; PAM type: YTN; PAM sequence: TTC
accaggctggtctcaaactc

SEQ ID NO: 211142 - DNA, 20 bp, Artificial Sequence
  Description of Artificial Sequence: Synthetic oligonucleotide
  Target: ATXN1; (-) strand; PAM type: YTN; PAM sequence: TTC
accatgttcaccaggctggt

SEQ ID NO: 211143 - DNA, 20 bp, Artificial Sequence
  Description of Artificial Sequence: Synthetic oligonucleotide
  Target: ATXN1; (-) strand; PAM type: YTN; PAM sequence: TTT
caccatgttcaccaggctgg

SEQ ID NO: 211144 - DNA, 20 bp, Artificial Sequence
  Description of Artificial Sequence: Synthetic oligonucleotide
  Target: ATXN1; (-) strand; PAM type: YTN; PAM sequence: TTA
gtagagacggagtttcacca

SEQ ID NO: 211145 - DNA, 20 bp, Artificial Sequence
  Description of Artificial Sequence: Synthetic oligonucleotide
  Target: ATXN1; (-) strand; PAM type: YTN; PAM sequence: TTT
agtagagacggagtttcacc

SEQ ID NO: 211146 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggagtttcac

SEQ ID NO: 211147 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggagtttca

SEQ ID NO: 211148 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacggag

SEQ ID NO: 211149 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacgga

SEQ ID NO: 211150 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 211151 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 211152 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 211153 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtatttttag

SEQ ID NO: 211154 - DNA, 20 bp, Artificial Sequence
  Description of Artificial Sequence: Synthetic oligonucleotide
  Target: ATXN1; (-) strand; PAM type: YTN; PAM sequence: TTA
caggcatgcaacaccatgcc

SEQ ID NO: 211155 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgcaacac

SEQ ID NO: 211156 - DNA, 20 bp, Artificial Sequence
  Description of Artificial Sequence: Synthetic oligonucleotide
  Target: ATXN1; (-) strand; PAM type: YTN; PAM sequence: CTC
ccaaatatctgggattacag

SEQ ID NO: 211157 - DNA, 20 bp, Artificial Sequence
  Description of Artificial Sequence: Synthetic oligonucleotide
  Target: ATXN1; (-) strand; PAM type: YTN; PAM sequence: CTC
cggccacagactcccaaata

SEQ ID NO: 211158 - DNA, 20 bp, Artificial Sequence
  Description of Artificial Sequence: Synthetic oligonucleotide
  Target: ATXN1; (-) strand; PAM type: YTN; PAM sequence: TTC
tccggccacagactcccaaa

SEQ ID NO: 211159 - DNA, 20 bp, Artificial Sequence
  Description of Artificial Sequence: Synthetic oligonucleotide
  Target: ATXN1; (-) strand; PAM type: YTN; PAM sequence: CTC
aagtgattctccggccacag

SEQ ID NO: 211160 - DNA, 20 bp, Artificial Sequence
  Description of Artificial Sequence: Synthetic oligonucleotide
  Target: ATXN1; (-) strand; PAM type: YTN; PAM sequence: CTC
ccaggctcaagtgattctcc

SEQ ID NO: 211161 - DNA, 20 bp, Artificial Sequence
  Description of Artificial Sequence: Synthetic oligonucleotide
  Target: ATXN1; (-) strand; PAM type: YTN; PAM sequence: CTG
cctcccaggctcaagtgatt

SEQ ID NO: 211162 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaggctcaagtga

SEQ ID NO: 211163 - DNA, 20 bp, Artificial Sequence
  Description of Artificial Sequence: Synthetic oligonucleotide
  Target: ATXN1; (-) strand; PAM type: YTN; PAM sequence: TTG
caacctctgcctcccaggct

SEQ ID NO: 211164 - DNA, 20 bp, Artificial Sequence
  Description of Artificial Sequence: Synthetic oligonucleotide
  Target: ATXN1; (-) strand; PAM type: YTN; PAM sequence: CTC
attgcaacctctgcctccca

SEQ ID NO: 211165 - DNA, 20 bp, Artificial Sequence
  Description of Artificial Sequence: Synthetic oligonucleotide
  Target: ATXN1; (-) strand; PAM type: YTN; PAM sequence: TTG
gctcattgcaacctctgcct

SEQ ID NO: 211166 - DNA, 20 bp, Artificial Sequence
  Description of Artificial Sequence: Synthetic oligonucleotide
  Target: ATXN1; (-) strand; PAM type: YTN; PAM sequence: CTT
ggctcattgcaacctctgcc

SEQ ID NO: 211167 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcgcacgatc

SEQ ID NO: 211168 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgcag

SEQ ID NO: 211169 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggagtgc

SEQ ID NO: 211170 - DNA, 20 bp, Artificial Sequence
  Description of Artificial Sequence: Synthetic oligonucleotide
  Target: ATXN1; (-) strand; PAM type: YTN; PAM sequence: TTG
ctctgtcacccaggctggag

SEQ ID NO: 211171 - DNA, 20 bp, Artificial Sequence
  Description of Artificial Sequence: Synthetic oligonucleotide
  Target: ATXN1; (-) strand; PAM type: YTN; PAM sequence: CTT
gctctgtcacccaggctgga

SEQ ID NO: 211172 - DNA, 20 bp, Artificial Sequence
  Description of Artificial Sequence: Synthetic oligonucleotide
  Target: ATXN1; (-) strand; PAM type: YTN; PAM sequence: TTG
agacagagtcttgctctgtc

SEQ ID NO: 211173 - DNA, 20 bp, Artificial Sequence
  Description of Artificial Sequence: Synthetic oligonucleotide
  Target: ATXN1; (-) strand; PAM type: YTN; PAM sequence: CTT
gagacagagtcttgctctgt

SEQ ID NO: 211174 - DNA, 20 bp, Artificial Sequence
  Description of Artificial Sequence: Synthetic oligonucleotide
  Target: ATXN1; (-) strand; PAM type: YTN; PAM sequence: TTC
ttgagacagagtcttgctct

SEQ ID NO: 211175 - DNA, 20 bp, Artificial Sequence
  Description of Artificial Sequence: Synthetic oligonucleotide
  Target: ATXN1; (-) strand; PAM type: YTN; PAM sequence: TTT
cttgagacagagtcttgctc

SEQ ID NO: 211176 - DNA, 20 bp, Artificial Sequence
  Description of Artificial Sequence: Synthetic oligonucleotide
  Target: ATXN1; (-) strand; PAM type: YTN; PAM sequence: TTT
tcttgagacagagtcttgct

SEQ ID NO: 211177 - DNA, 20 bp, Artificial Sequence
  Description of Artificial Sequence: Synthetic oligonucleotide
  Target: ATXN1; (-) strand; PAM type: YTN; PAM sequence: TTT
ttcttgagacagagtcttgc

SEQ ID NO: 211178 - DNA, 20 bp, Artificial Sequence
  Description of Artificial Sequence: Synthetic oligonucleotide
  Target: ATXN1; (-) strand; PAM type: YTN; PAM sequence: TTT
tttcttgagacagagtcttg

SEQ ID NO: 211179 - DNA, 20 bp, Artificial Sequence
  Description of Artificial Sequence: Synthetic oligonucleotide
  Target: ATXN1; (-) strand; PAM type: YTN; PAM sequence: TTT
ttttcttgagacagagtctt

SEQ ID NO: 211180 - DNA, 20 bp, Artificial Sequence
  Description of Artificial Sequence: Synthetic oligonucleotide
  Target: ATXN1; (-) strand; PAM type: YTN; PAM sequence: TTT
tttttcttgagacagagtct

SEQ ID NO: 211181 - DNA, 20 bp, Artificial Sequence
  Description of Artificial Sequence: Synthetic oligonucleotide
  Target: ATXN1; (-) strand; PAM type: YTN; PAM sequence: TTT
ttttttcttgagacagagtc

SEQ ID NO: 211182 - DNA, 20 bp, Artificial Sequence
  Description of Artificial Sequence: Synthetic oligonucleotide
  Target: ATXN1; (-) strand; PAM type: YTN; PAM sequence: TTT
tttttttcttgagacagagt

SEQ ID NO: 211183 - DNA, 20 bp, Artificial Sequence
  Description of Artificial Sequence: Synthetic oligonucleotide
  Target: ATXN1; (-) strand; PAM type: YTN; PAM sequence: TTT
ttttttttcttgagacagag

SEQ ID NO: 211184 - DNA, 20 bp, Artificial Sequence
  Description of Artificial Sequence: Synthetic oligonucleotide
  Target: ATXN1; (-) strand; PAM type: YTN; PAM sequence: TTA
atttttttttttcttgagac

SEQ ID NO: 211185 - DNA, 20 bp, Artificial Sequence
  Description of Artificial Sequence: Synthetic oligonucleotide
  Target: ATXN1; (-) strand; PAM type: YTN; PAM sequence: TTT
aatttttttttttcttgaga

SEQ ID NO: 211186 - DNA, 20 bp, Artificial Sequence
  Description of Artificial Sequence: Synthetic oligonucleotide
  Target: ATXN1; (-) strand; PAM type: YTN; PAM sequence: CTG
aatttaatttttttttttct

SEQ ID NO: 211187 - DNA, 20 bp, Artificial Sequence
  Description of Artificial Sequence: Synthetic oligonucleotide
  Target: ATXN1; (-) strand; PAM type: YTN; PAM sequence: TTC
ctgaatttaatttttttttt

SEQ ID NO: 211188 - DNA, 20 bp, Artificial Sequence
  Description of Artificial Sequence: Synthetic oligonucleotide
  Target: ATXN1; (-) strand; PAM type: YTN; PAM sequence: TTA
ttcctgaatttaattttttt

SEQ ID NO: 211189 - DNA, 20 bp, Artificial Sequence
  Description of Artificial Sequence: Synthetic oligonucleotide
  Target: ATXN1; (-) strand; PAM type: YTN; PAM sequence: TTT
attcctgaatttaatttttt

SEQ ID NO: 211190 - DNA, 20 bp, Artificial Sequence
  Description of Artificial Sequence: Synthetic oligonucleotide
  Target: ATXN1; (-) strand; PAM type: YTN; PAM sequence: CTT
tattcctgaatttaattttt

SEQ ID NO: 211191 - DNA, 20 bp, Artificial Sequence
  Description of Artificial Sequence: Synthetic oligonucleotide
  Target: ATXN1; (-) strand; PAM type: YTN; PAM sequence: TTG
actttattcctgaatttaat

SEQ ID NO: 211192 - DNA, 20 bp, Artificial Sequence
  Description of Artificial Sequence: Synthetic oligonucleotide
  Target: ATXN1; (-) strand; PAM type: YTN; PAM sequence: CTT
gactttattcctgaatttaa

SEQ ID NO: 211193 - DNA, 20 bp, Artificial Sequence
  Description of Artificial Sequence: Synthetic oligonucleotide
  Target: ATXN1; (-) strand; PAM type: YTN; PAM sequence: CTG
atggtatgccaaataataat

SEQ ID NO: 211194 - DNA, 20 bp, Artificial Sequence
  Description of Artificial Sequence: Synthetic oligonucleotide
  Target: ATXN1; (-) strand; PAM type: YTN; PAM sequence: CTA
cagcatcctgatggtatgcc

SEQ ID NO: 211195 - DNA, 20 bp, Artificial Sequence
  Description of Artificial Sequence: Synthetic oligonucleotide
  Target: ATXN1; (-) strand; PAM type: YTN; PAM sequence: TTC
tacagcatcctgatggtatg

SEQ ID NO: 211196 - DNA, 20 bp, Artificial Sequence
  Description of Artificial Sequence: Synthetic oligonucleotide
  Target: ATXN1; (-) strand; PAM type: YTN; PAM sequence: CTT
ctacagcatcctgatggtat

SEQ ID NO: 211197 - DNA, 20 bp, Artificial Sequence
  Description of Artificial Sequence: Synthetic oligonucleotide
  Target: ATXN1; (-) strand; PAM type: YTN; PAM sequence: TTC
ttctacagcatcctgatggt

SEQ ID NO: 211198 - DNA, 20 bp, Artificial Sequence
  Description of Artificial Sequence: Synthetic oligonucleotide
  Target: ATXN1; (-) strand; PAM type: YTN; PAM sequence: TTT
cttctacagcatcctgatgg

SEQ ID NO: 211199 - DNA, 20 bp, Artificial Sequence
  Description of Artificial Sequence: Synthetic oligonucleotide
  Target: ATXN1; (-) strand; PAM type: YTN; PAM sequence: TTA
tttcttctacagcatcctga

SEQ ID NO: 211200 - DNA, 20 bp, Artificial Sequence
  Description of Artificial Sequence: Synthetic oligonucleotide
  Target: ATXN1; (-) strand; PAM type: YTN; PAM sequence: TTT
atttcttctacagcatcctg

SEQ ID NO: 211201 - DNA, 20 bp, Artificial Sequence
  Description of Artificial Sequence: Synthetic oligonucleotide
  Target: ATXN1; (-) strand; PAM type: YTN; PAM sequence: TTT
tatttcttctacagcatcct

SEQ ID NO: 211202 - DNA, 20 bp, Artificial Sequence
  Description of Artificial Sequence: Synthetic oligonucleotide
  Target: ATXN1; (-) strand; PAM type: YTN; PAM sequence: CTT
ttatttcttctacagcatcc

SEQ ID NO: 211203 - DNA, 20 bp, Artificial Sequence
  Description of Artificial Sequence: Synthetic oligonucleotide
  Target: ATXN1; (-) strand; PAM type: YTN; PAM sequence: TTA
acttttatttcttctacagc

SEQ ID NO: 211204 - DNA, 20 bp, Artificial Sequence
  Description of Artificial Sequence: Synthetic oligonucleotide
  Target: ATXN1; (-) strand; PAM type: YTN; PAM sequence: TTT
aacttttatttcttctacag

SEQ ID NO: 211205 - DNA, 20 bp, Artificial Sequence
  Description of Artificial Sequence: Synthetic oligonucleotide
  Target: ATXN1; (-) strand; PAM type: YTN; PAM sequence: TTT
taacttttatttcttctaca

SEQ ID NO: 211206 - DNA, 20 bp, Artificial Sequence
  Description of Artificial Sequence: Synthetic oligonucleotide
  Target: ATXN1; (-) strand; PAM type: YTN; PAM sequence: TTT
ttaacttttatttcttctac

SEQ ID NO: 211207 - DNA, 20 bp, Artificial Sequence
  Description of Artificial Sequence: Synthetic oligonucleotide
  Target: ATXN1; (-) strand; PAM type: YTN; PAM sequence: TTA
atatttttaacttttatttc

SEQ ID NO: 211208 - DNA, 20 bp, Artificial Sequence
  Description of Artificial Sequence: Synthetic oligonucleotide
  Target: ATXN1; (-) strand; PAM type: YTN; PAM sequence: TTT
aatatttttaacttttattt

SEQ ID NO: 211209 - DNA, 20 bp, Artificial Sequence
  Description of Artificial Sequence: Synthetic oligonucleotide
  Target: ATXN1; (-) strand; PAM type: YTN; PAM sequence: TTT
taatatttttaacttttatt

SEQ ID NO: 211210 - DNA, 20 bp, Artificial Sequence
  Description of Artificial Sequence: Synthetic oligonucleotide
  Target: ATXN1; (-) strand; PAM type: YTN; PAM sequence: CTG
tattttaatatttttaactt

SEQ ID NO: 211211 - DNA, 20 bp, Artificial Sequence
  Description of Artificial Sequence: Synthetic oligonucleotide
  Target: ATXN1; (-) strand; PAM type: YTN; PAM sequence: CTC
ctgtattttaatatttttaa

SEQ ID NO: 211212 - DNA, 20 bp, Artificial Sequence
  Description of Artificial Sequence: Synthetic oligonucleotide
  Target: ATXN1; (-) strand; PAM type: YTN; PAM sequence: TTG
tctcctgtattttaatattt

SEQ ID NO: 211213 - DNA, 20 bp, Artificial Sequence
  Description of Artificial Sequence: Synthetic oligonucleotide
  Target: ATXN1; (-) strand; PAM type: YTN; PAM sequence: TTT
gtctcctgtattttaatatt

SEQ ID NO: 211214 - DNA, 20 bp, Artificial Sequence
  Description of Artificial Sequence: Synthetic oligonucleotide
  Target: ATXN1; (-) strand; PAM type: YTN; PAM sequence: TTT
tgtctcctgtattttaatat

SEQ ID NO: 211215 - DNA, 20 bp, Artificial Sequence
  Description of Artificial Sequence: Synthetic oligonucleotide
  Target: ATXN1; (-) strand; PAM type: YTN; PAM sequence: TTC
caataatgataattttgtct

SEQ ID NO: 211216 - DNA, 20 bp, Artificial Sequence
  Description of Artificial Sequence: Synthetic oligonucleotide
  Target: ATXN1; (-) strand; PAM type: YTN; PAM sequence: TTT
ccaataatgataattttgtc

SEQ ID NO: 211217 - DNA, 20 bp, Artificial Sequence
  Description of Artificial Sequence: Synthetic oligonucleotide
  Target: ATXN1; (-) strand; PAM type: YTN; PAM sequence: CTA
agtagacaataacatttcca

SEQ ID NO: 211218 - DNA, 20 bp, Artificial Sequence
  Description of Artificial Sequence: Synthetic oligonucleotide
  Target: ATXN1; (-) strand; PAM type: YTN; PAM sequence: TTC
taagtagacaataacatttc

SEQ ID NO: 211219 - DNA, 20 bp, Artificial Sequence
  Description of Artificial Sequence: Synthetic oligonucleotide
  Target: ATXN1; (-) strand; PAM type: YTN; PAM sequence: TTA
gatattctaagtagacaata

SEQ ID NO: 211220 - DNA, 20 bp, Artificial Sequence
  Description of Artificial Sequence: Synthetic oligonucleotide
  Target: ATXN1; (-) strand; PAM type: YTN; PAM sequence: CTT
agatattctaagtagacaat

SEQ ID NO: 211221 - DNA, 20 bp, Artificial Sequence
  Description of Artificial Sequence: Synthetic oligonucleotide
  Target: ATXN1; (-) strand; PAM type: YTN; PAM sequence: TTC
ccttagatattctaagtaga

SEQ ID NO: 211222 - DNA, 20 bp, Artificial Sequence
  Description of Artificial Sequence: Synthetic oligonucleotide
  Target: ATXN1; (-) strand; PAM type: YTN; PAM sequence: CTA
attcccttagatattctaag

SEQ ID NO: 211223 - DNA, 20 bp, Artificial Sequence
  Description of Artificial Sequence: Synthetic oligonucleotide
  Target: ATXN1; (-) strand; PAM type: YTN; PAM sequence: TTC
agctaattcccttagatatt

SEQ ID NO: 211224 - DNA, 20 bp, Artificial Sequence
  Description of Artificial Sequence: Synthetic oligonucleotide
  Target: ATXN1; (-) strand; PAM type: YTN; PAM sequence: TTT
cagctaattcccttagatat

SEQ ID NO: 211225 - DNA, 20 bp, Artificial Sequence
  Description of Artificial Sequence: Synthetic oligonucleotide
  Target: ATXN1; (-) strand; PAM type: YTN; PAM sequence: CTT
tcagctaattcccttagata

SEQ ID NO: 211226 - DNA, 20 bp, Artificial Sequence
  Description of Artificial Sequence: Synthetic oligonucleotide
  Target: ATXN1; (-) strand; PAM type: YTN; PAM sequence: CTA
gagtctttcagctaattccc

SEQ ID NO: 211227 - DNA, 20 bp, Artificial Sequence
  Description of Artificial Sequence: Synthetic oligonucleotide
  Target: ATXN1; (-) strand; PAM type: YTN; PAM sequence: TTC
tagagtctttcagctaattc

SEQ ID NO: 211228 - DNA, 20 bp, Artificial Sequence
  Description of Artificial Sequence: Synthetic oligonucleotide
  Target: ATXN1; (-) strand; PAM type: YTN; PAM sequence: CTC
agttctagagtctttcagct

SEQ ID NO: 211229 - DNA, 20 bp, Artificial Sequence
  Description of Artificial Sequence: Synthetic oligonucleotide
  Target: ATXN1; (-) strand; PAM type: YTN; PAM sequence: TTG
atctcagttctagagtcttt

SEQ ID NO: 211230 - DNA, 20 bp, Artificial Sequence
  Description of Artificial Sequence: Synthetic oligonucleotide
  Target: ATXN1; (-) strand; PAM type: YTN; PAM sequence: CTG
accataatattgatctcagt

SEQ ID NO: 211231 - DNA, 20 bp, Artificial Sequence
  Description of Artificial Sequence: Synthetic oligonucleotide
  Target: ATXN1; (-) strand; PAM type: YTN; PAM sequence: CTG
gtcaactgaccataatattg

SEQ ID NO: 211232 - DNA, 20 bp, Artificial Sequence
  Description of Artificial Sequence: Synthetic oligonucleotide
  Target: ATXN1; (-) strand; PAM type: YTN; PAM sequence: CTG
tgcctggtcaactgaccata

SEQ ID NO: 211233 - DNA, 20 bp, Artificial Sequence
  Description of Artificial Sequence: Synthetic oligonucleotide
  Target: ATXN1; (-) strand; PAM type: YTN; PAM sequence: TTA
cagatatgagccactgtgcc

SEQ ID NO: 211234 - DNA, 20 bp, Artificial Sequence
  Description of Artificial Sequence: Synthetic oligonucleotide
  Target: ATXN1; (-) strand; PAM type: YTN; PAM sequence: CTG
ggattacagatatgagccac

SEQ ID NO: 211235 - DNA, 20 bp, Artificial Sequence
  Description of Artificial Sequence: Synthetic oligonucleotide
  Target: ATXN1; (-) strand; PAM type: YTN; PAM sequence: CTC
ccaaaatgctgggattacag

SEQ ID NO: 211236 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaaatgctgggat

SEQ ID NO: 211237 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaaatgctggga

SEQ ID NO: 211238 - DNA, 20 bp, Artificial Sequence
  Description of Artificial Sequence: Synthetic oligonucleotide
  Target: ATXN1; (-) strand; PAM type: YTN; PAM sequence: CTC
aggtgagccacccaccttgg

SEQ ID NO: 211239 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgagccacccac

SEQ ID NO: 211240 - DNA, 20 bp, Artificial Sequence
  Description of Artificial Sequence: Synthetic oligonucleotide
  Target: ATXN1; (-) strand; PAM type: YTN; PAM sequence: CTC
aaacccctgacctcaggtga

SEQ ID NO: 211241 - DNA, 20 bp, Artificial Sequence
  Description of Artificial Sequence: Synthetic oligonucleotide
  Target: ATXN1; (-) strand; PAM type: YTN; PAM sequence: CTG
gtctcaaacccctgacctca

SEQ ID NO: 211242 - DNA, 20 bp, Artificial Sequence
  Description of Artificial Sequence: Synthetic oligonucleotide
  Target: ATXN1; (-) strand; PAM type: YTN; PAM sequence: TTA
gccaggctggtctcaaaccc

SEQ ID NO: 211243 - DNA, 20 bp, Artificial Sequence
  Description of Artificial Sequence: Synthetic oligonucleotide
  Target: ATXN1; (-) strand; PAM type: YTN; PAM sequence: TTC
accatgttagccaggctggt

SEQ ID NO: 211244 - DNA, 20 bp, Artificial Sequence
  Description of Artificial Sequence: Synthetic oligonucleotide
  Target: ATXN1; (-) strand; PAM type: YTN; PAM sequence: TTT
caccatgttagccaggctgg

SEQ ID NO: 211245 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcacca

SEQ ID NO: 211246 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcacc

SEQ ID NO: 211247 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcac

SEQ ID NO: 211248 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 211249 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacaggg

SEQ ID NO: 211250 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagg

SEQ ID NO: 211251 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 211252 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 211253 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 211254 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtatttttag

SEQ ID NO: 211255 - DNA, 20 bp, Artificial Sequence
  Description of Artificial Sequence: Synthetic oligonucleotide
  Target: ATXN1; (-) strand; PAM type: YTN; PAM sequence: TTA
caggtgtgtaccaccacacc

SEQ ID NO: 211256 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgtaccac

SEQ ID NO: 211257 - DNA, 20 bp, Artificial Sequence
  Description of Artificial Sequence: Synthetic oligonucleotide
  Target: ATXN1; (-) strand; PAM type: YTN; PAM sequence: CTC
ccaagtatctgggattacag

SEQ ID NO: 211258 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtatctggga

SEQ ID NO: 211259 - DNA, 20 bp, Artificial Sequence
  Description of Artificial Sequence: Synthetic oligonucleotide
  Target: ATXN1; (-) strand; PAM type: YTN; PAM sequence: CTG
tctcagcctcccaagtatct

SEQ ID NO: 211260 - DNA, 20 bp, Artificial Sequence
  Description of Artificial Sequence: Synthetic oligonucleotide
  Target: ATXN1; (-) strand; PAM type: YTN; PAM sequence: TTC
tgtctcagcctcccaagtat

SEQ ID NO: 211261 - DNA, 20 bp, Artificial Sequence
  Description of Artificial Sequence: Synthetic oligonucleotide
  Target: ATXN1; (-) strand; PAM type: YTN; PAM sequence: CTT
ctgtctcagcctcccaagta

SEQ ID NO: 211262 - DNA, 20 bp, Artificial Sequence
  Description of Artificial Sequence: Synthetic oligonucleotide
  Target: ATXN1; (-) strand; PAM type: YTN; PAM sequence: TTC
ttctgtctcagcctcccaag

SEQ ID NO: 211263 - DNA, 20 bp, Artificial Sequence
  Description of Artificial Sequence: Synthetic oligonucleotide
  Target: ATXN1; (-) strand; PAM type: YTN; PAM sequence: TTC
aagtgattcttctgtctcag

SEQ ID NO: 211264 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagtgattcttc

SEQ ID NO: 211265 - DNA, 20 bp, Artificial Sequence
  Description of Artificial Sequence: Synthetic oligonucleotide
  Target: ATXN1; (-) strand; PAM type: YTN; PAM sequence: CTG
cctcccaggttcaagtgatt

SEQ ID NO: 211266 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaggttcaagtga

SEQ ID NO: 211267 - DNA, 20 bp, Artificial Sequence
  Description of Artificial Sequence: Synthetic oligonucleotide
  Target: ATXN1; (-) strand; PAM type: YTN; PAM sequence: CTG
cagcctctgcctcccaggtt

SEQ ID NO: 211268 - DNA, 20 bp, Artificial Sequence
  Description of Artificial Sequence: Synthetic oligonucleotide
  Target: ATXN1; (-) strand; PAM type: YTN; PAM sequence: CTC
cctgcagcctctgcctccca

SEQ ID NO: 211269 - DNA, 20 bp, Artificial Sequence
  Description of Artificial Sequence: Synthetic oligonucleotide
  Target: ATXN1; (-) strand; PAM type: YTN; PAM sequence: CTC
agctccctgcagcctctgcc

SEQ ID NO: 211270 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcatgatctc

SEQ ID NO: 211271 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgcag

SEQ ID NO: 211272 - DNA, 20 bp, Artificial Sequence
  Description of Artificial Sequence: Synthetic oligonucleotide
  Target: ATXN1; (-) strand; PAM type: YTN; PAM sequence: TTC
tgtcacccaggctggagtgc

SEQ ID NO: 211273 - DNA, 20 bp, Artificial Sequence
  Description of Artificial Sequence: Synthetic oligonucleotide
  Target: ATXN1; (-) strand; PAM type: YTN; PAM sequence: CTT
ctgtcacccaggctggagtg

SEQ ID NO: 211274 - DNA, 20 bp, Artificial Sequence
  Description of Artificial Sequence: Synthetic oligonucleotide
  Target: ATXN1; (-) strand; PAM type: YTN; PAM sequence: CTC
cttctgtcacccaggctgga

SEQ ID NO: 211275 - DNA, 20 bp, Artificial Sequence
  Description of Artificial Sequence: Synthetic oligonucleotide
  Target: ATXN1; (-) strand; PAM type: YTN; PAM sequence: TTG
agacacagtctccttctgtc

SEQ ID NO: 211276 - DNA, 20 bp, Artificial Sequence
  Description of Artificial Sequence: Synthetic oligonucleotide
  Target: ATXN1; (-) strand; PAM type: YTN; PAM sequence: TTT
gagacacagtctccttctgt

SEQ ID NO: 211277 - DNA, 20 bp, Artificial Sequence
  Description of Artificial Sequence: Synthetic oligonucleotide
  Target: ATXN1; (-) strand; PAM type: YTN; PAM sequence: TTT
tgagacacagtctccttctg

SEQ ID NO: 211278 - DNA, 20 bp, Artificial Sequence
  Description of Artificial Sequence: Synthetic oligonucleotide
  Target: ATXN1; (-) strand; PAM type: YTN; PAM sequence: TTT
ttgagacacagtctccttct

SEQ ID NO: 211279 - DNA, 20 bp, Artificial Sequence
  Description of Artificial Sequence: Synthetic oligonucleotide
  Target: ATXN1; (-) strand; PAM type: YTN; PAM sequence: TTT
tttgagacacagtctccttc

SEQ ID NO: 211280 - DNA, 20 bp, Artificial Sequence
  Description of Artificial Sequence: Synthetic oligonucleotide
  Target: ATXN1; (-) strand; PAM type: YTN; PAM sequence: TTA
tatatattttttgagacaca

SEQ ID NO: 211281 - DNA, 20 bp, Artificial Sequence
  Description of Artificial Sequence: Synthetic oligonucleotide
  Target: ATXN1; (-) strand; PAM type: YTN; PAM sequence: CTA
tatataaaatatattatata

SEQ ID NO: 211282 - DNA, 20 bp, Artificial Sequence
  Description of Artificial Sequence: Synthetic oligonucleotide
  Target: ATXN1; (-) strand; PAM type: YTN; PAM sequence: TTA
tatactatatataaaatata

SEQ ID NO: 211283 - DNA, 20 bp, Artificial Sequence
  Description of Artificial Sequence: Synthetic oligonucleotide
  Target: ATXN1; (-) strand; PAM type: YTN; PAM sequence: TTA
taaaatatattatatactat

SEQ ID NO: 211284 - DNA, 20 bp, Artificial Sequence
  Description of Artificial Sequence: Synthetic oligonucleotide
  Target: ATXN1; (-) strand; PAM type: YTN; PAM sequence: TTA
tatatagtatataatatatt

SEQ ID NO: 211285 - DNA, 20 bp, Artificial Sequence
  Description of Artificial Sequence: Synthetic oligonucleotide
  Target: ATXN1; (-) strand; PAM type: YTN; PAM sequence: TTT
atatatagtatataatatat

SEQ ID NO: 211286 - DNA, 20 bp, Artificial Sequence
  Description of Artificial Sequence: Synthetic oligonucleotide
  Target: ATXN1; (-) strand; PAM type: YTN; PAM sequence: TTT
tatatatagtatataatata

SEQ ID NO: 211287 - DNA, 20 bp, Artificial Sequence
  Description of Artificial Sequence: Synthetic oligonucleotide
  Target: ATXN1; (-) strand; PAM type: YTN; PAM sequence: TTA
tataaatatataaaatattt

SEQ ID NO: 211288 - DNA, 20 bp, Artificial Sequence
  Description of Artificial Sequence: Synthetic oligonucleotide
  Target: ATXN1; (-) strand; PAM type: YTN; PAM sequence: TTT
atataaatatataaaatatt

SEQ ID NO: 211289 - DNA, 20 bp, Artificial Sequence
  Description of Artificial Sequence: Synthetic oligonucleotide
  Target: ATXN1; (-) strand; PAM type: YTN; PAM sequence: TTT
tatataaatatataaaatat

SEQ ID NO: 211290 - DNA, 20 bp, Artificial Sequence
  Description of Artificial Sequence: Synthetic oligonucleotide
  Target: ATXN1; (-) strand; PAM type: YTN; PAM sequence: TTA
tataatatattttatataaa

SEQ ID NO: 211291 - DNA, 20 bp, Artificial Sequence
  Description of Artificial Sequence: Synthetic oligonucleotide
  Target: ATXN1; (-) strand; PAM type: YTN; PAM sequence: TTA
tacattatataatatatttt

SEQ ID NO: 211292 - DNA, 20 bp, Artificial Sequence
  Description of Artificial Sequence: Synthetic oligonucleotide
  Target: ATXN1; (-) strand; PAM type: YTN; PAM sequence: TTA
tattatacattatataatat

SEQ ID NO: 211293 - DNA, 20 bp, Artificial Sequence
  Description of Artificial Sequence: Synthetic oligonucleotide
  Target: ATXN1; (-) strand; PAM type: YTN; PAM sequence: TTT
atattatacattatataata

SEQ ID NO: 211294 - DNA, 20 bp, Artificial Sequence
  Description of Artificial Sequence: Synthetic oligonucleotide
  Target: ATXN1; (-) strand; PAM type: YTN; PAM sequence: TTT
tatattatacattatataat

SEQ ID NO: 211295 - DNA, 20 bp, Artificial Sequence
  Description of Artificial Sequence: Synthetic oligonucleotide
  Target: ATXN1; (-) strand; PAM type: YTN; PAM sequence: TTA
atatataatatatataattt

SEQ ID NO: 211296 - DNA, 20 bp, Artificial Sequence
  Description of Artificial Sequence: Synthetic oligonucleotide
  Target: ATXN1; (-) strand; PAM type: YTN; PAM sequence: TTA
ttaatatataatatatataa

SEQ ID NO: 211297 - DNA, 20 bp, Artificial Sequence
  Description of Artificial Sequence: Synthetic oligonucleotide
  Target: ATXN1; (-) strand; PAM type: YTN; PAM sequence: TTA
tatataattattaatatata

SEQ ID NO: 211298 - DNA, 20 bp, Artificial Sequence
  Description of Artificial Sequence: Synthetic oligonucleotide
  Target: ATXN1; (-) strand; PAM type: YTN; PAM sequence: CTG
accattatatataattatta

SEQ ID NO: 211299 - DNA, 20 bp, Artificial Sequence
  Description of Artificial Sequence: Synthetic oligonucleotide
  Target: ATXN1; (-) strand; PAM type: YTN; PAM sequence: CTA
gtaactgaccattatatata

SEQ ID NO: 211300 - DNA, 20 bp, Artificial Sequence
  Description of Artificial Sequence: Synthetic oligonucleotide
  Target: ATXN1; (-) strand; PAM type: YTN; PAM sequence: TTC
tagtaactgaccattatata

SEQ ID NO: 211301 - DNA, 20 bp, Artificial Sequence
  Description of Artificial Sequence: Synthetic oligonucleotide
  Target: ATXN1; (-) strand; PAM type: YTN; PAM sequence: CTT
ctagtaactgaccattatat

SEQ ID NO: 211302 - DNA, 20 bp, Artificial Sequence
  Description of Artificial Sequence: Synthetic oligonucleotide
  Target: ATXN1; (-) strand; PAM type: YTN; PAM sequence: CTA
tgtaagtgtgtgtggagggg

SEQ ID NO: 211303 - DNA, 20 bp, Artificial Sequence
  Description of Artificial Sequence: Synthetic oligonucleotide
  Target: ATXN1; (-) strand; PAM type: YTN; PAM sequence: TTA
gtatgtctatgtaagtgtgt

SEQ ID NO: 211304 - DNA, 20 bp, Artificial Sequence
  Description of Artificial Sequence: Synthetic oligonucleotide
  Target: ATXN1; (-) strand; PAM type: YTN; PAM sequence: CTA
ttagtatgtctatgtaagtg

SEQ ID NO: 211305 - DNA, 20 bp, Artificial Sequence
  Description of Artificial Sequence: Synthetic oligonucleotide
  Target: ATXN1; (-) strand; PAM type: YTN; PAM sequence: TTA
ggaaaactattagtatgtct

SEQ ID NO: 211306 - DNA, 20 bp, Artificial Sequence
  Description of Artificial Sequence: Synthetic oligonucleotide
  Target: ATXN1; (-) strand; PAM type: YTN; PAM sequence: TTT
aggaaaactattagtatgtc

SEQ ID NO: 211307 - DNA, 20 bp, Artificial Sequence
  Description of Artificial Sequence: Synthetic oligonucleotide
  Target: ATXN1; (-) strand; PAM type: YTN; PAM sequence: TTT
taggaaaactattagtatgt

SEQ ID NO: 211308 - DNA, 20 bp, Artificial Sequence
  Description of Artificial Sequence: Synthetic oligonucleotide
  Target: ATXN1; (-) strand; PAM type: YTN; PAM sequence: TTG
cgttttaggaaaactattag

SEQ ID NO: 211309 - DNA, 20 bp, Artificial Sequence
  Description of Artificial Sequence: Synthetic oligonucleotide
  Target: ATXN1; (-) strand; PAM type: YTN; PAM sequence: TTA
tcattgcgttttaggaaaac

SEQ ID NO: 211310 - DNA, 20 bp, Artificial Sequence
  Description of Artificial Sequence: Synthetic oligonucleotide
  Target: ATXN1; (-) strand; PAM type: YTN; PAM sequence: CTG
attatcattgcgttttagga

SEQ ID NO: 211311 - DNA, 20 bp, Artificial Sequence
  Description of Artificial Sequence: Synthetic oligonucleotide
  Target: ATXN1; (-) strand; PAM type: YTN; PAM sequence: TTC
acctgattatcattgcgttt

SEQ ID NO: 211312 - DNA, 20 bp, Artificial Sequence
  Description of Artificial Sequence: Synthetic oligonucleotide
  Target: ATXN1; (-) strand; PAM type: YTN; PAM sequence: TTT
cacctgattatcattgcgtt

SEQ ID NO: 211313 - DNA, 20 bp, Artificial Sequence
  Description of Artificial Sequence: Synthetic oligonucleotide
  Target: ATXN1; (-) strand; PAM type: YTN; PAM sequence: TTT
tcacctgattatcattgcgt

SEQ ID NO: 211314 - DNA, 20 bp, Artificial Sequence
  Description of Artificial Sequence: Synthetic oligonucleotide
  Target: ATXN1; (-) strand; PAM type: YTN; PAM sequence: CTG
tataagggaaattttcacct

SEQ ID NO: 211315 - DNA, 20 bp, Artificial Sequence
  Description of Artificial Sequence: Synthetic oligonucleotide
  Target: ATXN1; (-) strand; PAM type: YTN; PAM sequence: CTA
ctgtataagggaaattttca

SEQ ID NO: 211316 - DNA, 20 bp, Artificial Sequence
  Description of Artificial Sequence: Synthetic oligonucleotide
  Target: ATXN1; (-) strand; PAM type: YTN; PAM sequence: CTA
tggggagactactgtataag

SEQ ID NO: 211317 - DNA, 20 bp, Artificial Sequence
  Description of Artificial Sequence: Synthetic oligonucleotide
  Target: ATXN1; (-) strand; PAM type: YTN; PAM sequence: TTG
accaataaataaaaccatgg

SEQ ID NO: 211318 - DNA, 20 bp, Artificial Sequence
  Description of Artificial Sequence: Synthetic oligonucleotide
  Target: ATXN1; (-) strand; PAM type: YTN; PAM sequence: TTC
agacagcaaattgaccaata

SEQ ID NO: 211319 - DNA, 20 bp, Artificial Sequence
  Description of Artificial Sequence: Synthetic oligonucleotide
  Target: ATXN1; (-) strand; PAM type: YTN; PAM sequence: TTT
cagacagcaaattgaccaat

SEQ ID NO: 211320 - DNA, 20 bp, Artificial Sequence
  Description of Artificial Sequence: Synthetic oligonucleotide
  Target: ATXN1; (-) strand; PAM type: YTN; PAM sequence: TTT
tcagacagcaaattgaccaa

SEQ ID NO: 211321 - DNA, 20 bp, Artificial Sequence
  Description of Artificial Sequence: Synthetic oligonucleotide
  Target: ATXN1; (-) strand; PAM type: YTN; PAM sequence: CTA
ttttcagacagcaaattgac

SEQ ID NO: 211322 - DNA, 20 bp, Artificial Sequence
  Description of Artificial Sequence: Synthetic oligonucleotide
  Target: ATXN1; (-) strand; PAM type: YTN; PAM sequence: CTC
gcctattttcagacagcaaa

SEQ ID NO: 211323 - DNA, 20 bp, Artificial Sequence
  Description of Artificial Sequence: Synthetic oligonucleotide
  Target: ATXN1; (-) strand; PAM type: YTN; PAM sequence: CTG
tactcgcctattttcagaca

SEQ ID NO: 211324 - DNA, 20 bp, Artificial Sequence
  Description of Artificial Sequence: Synthetic oligonucleotide
  Target: ATXN1; (-) strand; PAM type: YTN; PAM sequence: TTG
tactgtactcgcctattttc

SEQ ID NO: 211325 - DNA, 20 bp, Artificial Sequence
  Description of Artificial Sequence: Synthetic oligonucleotide
  Target: ATXN1; (-) strand; PAM type: YTN; PAM sequence: CTT
gtactgtactcgcctatttt

SEQ ID NO: 211326 - DNA, 20 bp, Artificial Sequence
  Description of Artificial Sequence: Synthetic oligonucleotide
  Target: ATXN1; (-) strand; PAM type: YTN; PAM sequence: TTC
ttgtactgtactcgcctatt

SEQ ID NO: 211327 - DNA, 20 bp, Artificial Sequence
  Description of Artificial Sequence: Synthetic oligonucleotide
  Target: ATXN1; (-) strand; PAM type: YTN; PAM sequence: CTT
cttgtactgtactcgcctat

SEQ ID NO: 211328 - DNA, 20 bp, Artificial Sequence
  Description of Artificial Sequence: Synthetic oligonucleotide
  Target: ATXN1; (-) strand; PAM type: YTN; PAM sequence: CTC
caaatatcttcttgtactgt

SEQ ID NO: 211329 - DNA, 20 bp, Artificial Sequence
  Description of Artificial Sequence: Synthetic oligonucleotide
  Target: ATXN1; (-) strand; PAM type: YTN; PAM sequence: CTC
agtctccaaatatcttcttg

SEQ ID NO: 211330 - DNA, 20 bp, Artificial Sequence
  Description of Artificial Sequence: Synthetic oligonucleotide
  Target: ATXN1; (-) strand; PAM type: YTN; PAM sequence: CTC
tcagtctccaaatatcttct

SEQ ID NO: 211331 - DNA, 20 bp, Artificial Sequence
  Description of Artificial Sequence: Synthetic oligonucleotide
  Target: ATXN1; (-) strand; PAM type: YTN; PAM sequence: CTC
tctcagtctccaaatatctt

SEQ ID NO: 211332 - DNA, 20 bp, Artificial Sequence
  Description of Artificial Sequence: Synthetic oligonucleotide
  Target: ATXN1; (-) strand; PAM type: YTN; PAM sequence: TTA
tgtggatgtgatctctctca

SEQ ID NO: 211333 - DNA, 20 bp, Artificial Sequence
  Description of Artificial Sequence: Synthetic oligonucleotide
  Target: ATXN1; (-) strand; PAM type: YTN; PAM sequence: CTA
taataaaagttatgtggatg

SEQ ID NO: 211334 - DNA, 20 bp, Artificial Sequence
  Description of Artificial Sequence: Synthetic oligonucleotide
  Target: ATXN1; (-) strand; PAM type: YTN; PAM sequence: TTA
tataaaaatatactataata

SEQ ID NO: 211335 - DNA, 20 bp, Artificial Sequence
  Description of Artificial Sequence: Synthetic oligonucleotide
  Target: ATXN1; (-) strand; PAM type: YTN; PAM sequence: CTT
atataaaaatatactataat

SEQ ID NO: 211336 - DNA, 20 bp, Artificial Sequence
  Description of Artificial Sequence: Synthetic oligonucleotide
  Target: ATXN1; (-) strand; PAM type: YTN; PAM sequence: CTA
ataatcaaataaaatactta

SEQ ID NO: 211337 - DNA, 20 bp, Artificial Sequence
  Description of Artificial Sequence: Synthetic oligonucleotide
  Target: ATXN1; (-) strand; PAM type: YTN; PAM sequence: TTA
acaacaataactaataatca

SEQ ID NO: 211338 - DNA, 20 bp, Artificial Sequence
  Description of Artificial Sequence: Synthetic oligonucleotide
  Target: ATXN1; (-) strand; PAM type: YTN; PAM sequence: TTA
gagattaacaacaataacta

SEQ ID NO: 211339 - DNA, 20 bp, Artificial Sequence
  Description of Artificial Sequence: Synthetic oligonucleotide
  Target: ATXN1; (-) strand; PAM type: YTN; PAM sequence: TTC
aatgtataaattagagatta

SEQ ID NO: 211340 - DNA, 20 bp, Artificial Sequence
  Description of Artificial Sequence: Synthetic oligonucleotide
  Target: ATXN1; (-) strand; PAM type: YTN; PAM sequence: CTG
tacgtacacaccatgataaa

SEQ ID NO: 211341 - DNA, 20 bp, Artificial Sequence
  Description of Artificial Sequence: Synthetic oligonucleotide
  Target: ATXN1; (-) strand; PAM type: YTN; PAM sequence: TTC
ctgtacgtacacaccatgat

SEQ ID NO: 211342 - DNA, 20 bp, Artificial Sequence
  Description of Artificial Sequence: Synthetic oligonucleotide
  Target: ATXN1; (-) strand; PAM type: YTN; PAM sequence: TTT
cctgtacgtacacaccatga

SEQ ID NO: 211343 - DNA, 20 bp, Artificial Sequence
  Description of Artificial Sequence: Synthetic oligonucleotide
  Target: ATXN1; (-) strand; PAM type: YTN; PAM sequence: TTT
tcctgtacgtacacaccatg

SEQ ID NO: 211344 - DNA, 20 bp, Artificial Sequence
  Description of Artificial Sequence: Synthetic oligonucleotide
  Target: ATXN1; (-) strand; PAM type: YTN; PAM sequence: TTT
ttcctgtacgtacacaccat

SEQ ID NO: 211345 - DNA, 20 bp, Artificial Sequence
  Description of Artificial Sequence: Synthetic oligonucleotide
  Target: ATXN1; (-) strand; PAM type: YTN; PAM sequence: TTT
tttcctgtacgtacacacca

SEQ ID NO: 211346 - DNA, 20 bp, Artificial Sequence
  Description of Artificial Sequence: Synthetic oligonucleotide
  Target: ATXN1; (-) strand; PAM type: YTN; PAM sequence: TTG
tgttttttcctgtacgtaca

SEQ ID NO: 211347 - DNA, 20 bp, Artificial Sequence
  Description of Artificial Sequence: Synthetic oligonucleotide
  Target: ATXN1; (-) strand; PAM type: YTN; PAM sequence: CTA
tatagattgtgttttttcct

SEQ ID NO: 211348 - DNA, 20 bp, Artificial Sequence
  Description of Artificial Sequence: Synthetic oligonucleotide
  Target: ATXN1; (-) strand; PAM type: YTN; PAM sequence: TTA
gtaccaaaccctatatagat

SEQ ID NO: 211349 - DNA, 20 bp, Artificial Sequence
  Description of Artificial Sequence: Synthetic oligonucleotide
  Target: ATXN1; (-) strand; PAM type: YTN; PAM sequence: CTG
ccagttagtaccaaacccta

SEQ ID NO: 211350 - DNA, 20 bp, Artificial Sequence
  Description of Artificial Sequence: Synthetic oligonucleotide
  Target: ATXN1; (-) strand; PAM type: YTN; PAM sequence: CTG
aaactgccagttagtaccaa

SEQ ID NO: 211351 - DNA, 20 bp, Artificial Sequence
  Description of Artificial Sequence: Synthetic oligonucleotide
  Target: ATXN1; (-) strand; PAM type: YTN; PAM sequence: TTC
ctgaaactgccagttagtac

SEQ ID NO: 211352 - DNA, 20 bp, Artificial Sequence
  Description of Artificial Sequence: Synthetic oligonucleotide
  Target: ATXN1; (-) strand; PAM type: YTN; PAM sequence: CTG
gtggattcctgaaactgcca

SEQ ID NO: 211353 - DNA, 20 bp, Artificial Sequence
  Description of Artificial Sequence: Synthetic oligonucleotide
  Target: ATXN1; (-) strand; PAM type: YTN; PAM sequence: TTC
catacccctggtggattcct

SEQ ID NO: 211354 - DNA, 20 bp, Artificial Sequence
  Description of Artificial Sequence: Synthetic oligonucleotide
  Target: ATXN1; (-) strand; PAM type: YTN; PAM sequence: CTG
ggggcatgttccatacccct

SEQ ID NO: 211355 - DNA, 20 bp, Artificial Sequence
  Description of Artificial Sequence: Synthetic oligonucleotide
  Target: ATXN1; (-) strand; PAM type: YTN; PAM sequence: TTA
tacagtagtccccccgatca

SEQ ID NO: 211356 - DNA, 20 bp, Artificial Sequence
  Description of Artificial Sequence: Synthetic oligonucleotide
  Target: ATXN1; (-) strand; PAM type: YTN; PAM sequence: CTT
atacagtagtccccccgatc

SEQ ID NO: 211357 - DNA, 20 bp, Artificial Sequence
  Description of Artificial Sequence: Synthetic oligonucleotide
  Target: ATXN1; (-) strand; PAM type: YTN; PAM sequence: TTC
cttatacagtagtccccccg

SEQ ID NO: 211358 - DNA, 20 bp, Artificial Sequence
  Description of Artificial Sequence: Synthetic oligonucleotide
  Target: ATXN1; (-) strand; PAM type: YTN; PAM sequence: TTT
ccttatacagtagtcccccc

SEQ ID NO: 211359 - DNA, 20 bp, Artificial Sequence
  Description of Artificial Sequence: Synthetic oligonucleotide
  Target: ATXN1; (-) strand; PAM type: YTN; PAM sequence: TTT
tccttatacagtagtccccc

SEQ ID NO: 211360 - DNA, 20 bp, Artificial Sequence
  Description of Artificial Sequence: Synthetic oligonucleotide
  Target: ATXN1; (-) strand; PAM type: YTN; PAM sequence: TTA
ttttccttatacagtagtcc

SEQ ID NO: 211361 - DNA, 20 bp, Artificial Sequence
  Description of Artificial Sequence: Synthetic oligonucleotide
  Target: ATXN1; (-) strand; PAM type: YTN; PAM sequence: TTT
attttccttatacagtagtc

SEQ ID NO: 211362 - DNA, 20 bp, Artificial Sequence
  Description of Artificial Sequence: Synthetic oligonucleotide
  Target: ATXN1; (-) strand; PAM type: YTN; PAM sequence: CTT
tattttccttatacagtagt

SEQ ID NO: 211363 - DNA, 20 bp, Artificial Sequence
  Description of Artificial Sequence: Synthetic oligonucleotide
  Target: ATXN1; (-) strand; PAM type: YTN; PAM sequence: TTA
atctttattttccttataca

SEQ ID NO: 211364 - DNA, 20 bp, Artificial Sequence
  Description of Artificial Sequence: Synthetic oligonucleotide
  Target: ATXN1; (-) strand; PAM type: YTN; PAM sequence: CTT
aatctttattttccttatac

SEQ ID NO: 211365 - DNA, 20 bp, Artificial Sequence
  Description of Artificial Sequence: Synthetic oligonucleotide
  Target: ATXN1; (-) strand; PAM type: YTN; PAM sequence: TTG
tgcacttaatctttattttc

SEQ ID NO: 211366 - DNA, 20 bp, Artificial Sequence
  Description of Artificial Sequence: Synthetic oligonucleotide
  Target: ATXN1; (-) strand; PAM type: YTN; PAM sequence: TTA
taattgtgcacttaatcttt

SEQ ID NO: 211367 - DNA, 20 bp, Artificial Sequence
  Description of Artificial Sequence: Synthetic oligonucleotide
  Target: ATXN1; (-) strand; PAM type: YTN; PAM sequence: TTG
gttataattgtgcacttaat

SEQ ID NO: 211368 - DNA, 20 bp, Artificial Sequence
  Description of Artificial Sequence: Synthetic oligonucleotide
  Target: ATXN1; (-) strand; PAM type: YTN; PAM sequence: TTA
cagtgttggttataattgtg

SEQ ID NO: 211369 - DNA, 20 bp, Artificial Sequence
  Description of Artificial Sequence: Synthetic oligonucleotide
  Target: ATXN1; (-) strand; PAM type: YTN; PAM sequence: TTT
acagtgttggttataattgt

SEQ ID NO: 211370 - DNA, 20 bp, Artificial Sequence
  Description of Artificial Sequence: Synthetic oligonucleotide
  Target: ATXN1; (-) strand; PAM type: YTN; PAM sequence: TTT
tacagtgttggttataattg

SEQ ID NO: 211371 - DNA, 20 bp, Artificial Sequence
  Description of Artificial Sequence: Synthetic oligonucleotide
  Target: ATXN1; (-) strand; PAM type: YTN; PAM sequence: TTA
gagattttacagtgttggtt

SEQ ID NO: 211372 - DNA, 20 bp, Artificial Sequence
  Description of Artificial Sequence: Synthetic oligonucleotide
  Target: ATXN1; (-) strand; PAM type: YTN; PAM sequence: TTT
agagattttacagtgttggt

SEQ ID NO: 211373 - DNA, 20 bp, Artificial Sequence
  Description of Artificial Sequence: Synthetic oligonucleotide
  Target: ATXN1; (-) strand; PAM type: YTN; PAM sequence: CTT
tagagattttacagtgttgg

SEQ ID NO: 211374 - DNA, 20 bp, Artificial Sequence
  Description of Artificial Sequence: Synthetic oligonucleotide
  Target: ATXN1; (-) strand; PAM type: YTN; PAM sequence: TTC
tttagagattttacagtgtt

SEQ ID NO: 211375 - DNA, 20 bp, Artificial Sequence
  Description of Artificial Sequence: Synthetic oligonucleotide
  Target: ATXN1; (-) strand; PAM type: YTN; PAM sequence: TTT
ctttagagattttacagtgt

SEQ ID NO: 211376 - DNA, 20 bp, Artificial Sequence
  Description of Artificial Sequence: Synthetic oligonucleotide
  Target: ATXN1; (-) strand; PAM type: YTN; PAM sequence: TTT
tctttagagattttacagtg

SEQ ID NO: 211377 - DNA, 20 bp, Artificial Sequence
  Description of Artificial Sequence: Synthetic oligonucleotide
  Target: ATXN1; (-) strand; PAM type: YTN; PAM sequence: TTG
ttttctttagagattttaca

SEQ ID NO: 211378 - DNA, 20 bp, Artificial Sequence
  Description of Artificial Sequence: Synthetic oligonucleotide
  Target: ATXN1; (-) strand; PAM type: YTN; PAM sequence: CTT
gttttctttagagattttac

SEQ ID NO: 211379 - DNA, 20 bp, Artificial Sequence
  Description of Artificial Sequence: Synthetic oligonucleotide
  Target: ATXN1; (-) strand; PAM type: YTN; PAM sequence: TTC
ttgttttctttagagatttt

SEQ ID NO: 211380 - DNA, 20 bp, Artificial Sequence
  Description of Artificial Sequence: Synthetic oligonucleotide
  Target: ATXN1; (-) strand; PAM type: YTN; PAM sequence: CTG
agcagttcttgttttcttta

SEQ ID NO: 211381 - DNA, 20 bp, Artificial Sequence
  Description of Artificial Sequence: Synthetic oligonucleotide
  Target: ATXN1; (-) strand; PAM type: YTN; PAM sequence: TTA
tagaatctgagcagttcttg

SEQ ID NO: 211382 - DNA, 20 bp, Artificial Sequence
  Description of Artificial Sequence: Synthetic oligonucleotide
  Target: ATXN1; (-) strand; PAM type: YTN; PAM sequence: TTT
atagaatctgagcagttctt

SEQ ID NO: 211383 - DNA, 20 bp, Artificial Sequence
  Description of Artificial Sequence: Synthetic oligonucleotide
  Target: ATXN1; (-) strand; PAM type: YTN; PAM sequence: TTT
tatagaatctgagcagttct

SEQ ID NO: 211384 - DNA, 20 bp, Artificial Sequence
  Description of Artificial Sequence: Synthetic oligonucleotide
  Target: ATXN1; (-) strand; PAM type: YTN; PAM sequence: TTT
ttatagaatctgagcagttc

SEQ ID NO: 211385 - DNA, 20 bp, Artificial Sequence
  Description of Artificial Sequence: Synthetic oligonucleotide
  Target: ATXN1; (-) strand; PAM type: YTN; PAM sequence: CTG
tttttatagaatctgagcag

SEQ ID NO: 211386 - DNA, 20 bp, Artificial Sequence
  Description of Artificial Sequence: Synthetic oligonucleotide
  Target: ATXN1; (-) strand; PAM type: YTN; PAM sequence: TTC
tgtttttatagaatctgagc

SEQ ID NO: 211387 - DNA, 20 bp, Artificial Sequence
  Description of Artificial Sequence: Synthetic oligonucleotide
  Target: ATXN1; (-) strand; PAM type: YTN; PAM sequence: TTT
ctgtttttatagaatctgag

SEQ ID NO: 211388 - DNA, 20 bp, Artificial Sequence
  Description of Artificial Sequence: Synthetic oligonucleotide
  Target: ATXN1; (-) strand; PAM type: YTN; PAM sequence: TTT
tctgtttttatagaatctga

SEQ ID NO: 211389 - DNA, 20 bp, Artificial Sequence
  Description of Artificial Sequence: Synthetic oligonucleotide
  Target: ATXN1; (-) strand; PAM type: YTN; PAM sequence: TTA
gtaatgcattttctgttttt

SEQ ID NO: 211390 - DNA, 20 bp, Artificial Sequence
  Description of Artificial Sequence: Synthetic oligonucleotide
  Target: ATXN1; (-) strand; PAM type: YTN; PAM sequence: TTT
agtaatgcattttctgtttt

SEQ ID NO: 211391 - DNA, 20 bp, Artificial Sequence
  Description of Artificial Sequence: Synthetic oligonucleotide
  Target: ATXN1; (-) strand; PAM type: YTN; PAM sequence: TTT
tagtaatgcattttctgttt

SEQ ID NO: 211392 - DNA, 20 bp, Artificial Sequence
  Description of Artificial Sequence: Synthetic oligonucleotide
  Target: ATXN1; (-) strand; PAM type: YTN; PAM sequence: TTT
ttagtaatgcattttctgtt

SEQ ID NO: 211393 - DNA, 20 bp, Artificial Sequence
  Description of Artificial Sequence: Synthetic oligonucleotide
  Target: ATXN1; (-) strand; PAM type: YTN; PAM sequence: TTT
tttagtaatgcattttctgt

SEQ ID NO: 211394 - DNA, 20 bp, Artificial Sequence
  Description of Artificial Sequence: Synthetic oligonucleotide
  Target: ATXN1; (-) strand; PAM type: YTN; PAM sequence: TTA
gttttttagtaatgcatttt

SEQ ID NO: 211395 - DNA, 20 bp, Artificial Sequence
  Description of Artificial Sequence: Synthetic oligonucleotide
  Target: ATXN1; (-) strand; PAM type: YTN; PAM sequence: TTT
agttttttagtaatgcattt

SEQ ID NO: 211396 - DNA, 20 bp, Artificial Sequence
  Description of Artificial Sequence: Synthetic oligonucleotide
  Target: ATXN1; (-) strand; PAM type: YTN; PAM sequence: CTT
tagttttttagtaatgcatt

SEQ ID NO: 211397 - DNA, 20 bp, Artificial Sequence
  Description of Artificial Sequence: Synthetic oligonucleotide
  Target: ATXN1; (-) strand; PAM type: YTN; PAM sequence: TTC
ctttagttttttagtaatgc

SEQ ID NO: 211398 - DNA, 20 bp, Artificial Sequence
  Description of Artificial Sequence: Synthetic oligonucleotide
  Target: ATXN1; (-) strand; PAM type: YTN; PAM sequence: TTT
cctttagttttttagtaatg

SEQ ID NO: 211399 - DNA, 20 bp, Artificial Sequence
  Description of Artificial Sequence: Synthetic oligonucleotide
  Target: ATXN1; (-) strand; PAM type: YTN; PAM sequence: TTT
tcctttagttttttagtaat

SEQ ID NO: 211400 - DNA, 20 bp, Artificial Sequence
  Description of Artificial Sequence: Synthetic oligonucleotide
  Target: ATXN1; (-) strand; PAM type: YTN; PAM sequence: TTT
ttcctttagttttttagtaa

SEQ ID NO: 211401 - DNA, 20 bp, Artificial Sequence
  Description of Artificial Sequence: Synthetic oligonucleotide
  Target: ATXN1; (-) strand; PAM type: YTN; PAM sequence: TTG
atccatgcacaatgtttttc

SEQ ID NO: 211402 - DNA, 20 bp, Artificial Sequence
  Description of Artificial Sequence: Synthetic oligonucleotide
  Target: ATXN1; (-) strand; PAM type: YTN; PAM sequence: TTT
gatccatgcacaatgttttt

SEQ ID NO: 211403 - DNA, 20 bp, Artificial Sequence
  Description of Artificial Sequence: Synthetic oligonucleotide
  Target: ATXN1; (-) strand; PAM type: YTN; PAM sequence: TTT
tgatccatgcacaatgtttt

SEQ ID NO: 211404 - DNA, 20 bp, Artificial Sequence
  Description of Artificial Sequence: Synthetic oligonucleotide
  Target: ATXN1; (-) strand; PAM type: YTN; PAM sequence: TTT
ttgatccatgcacaatgttt

SEQ ID NO: 211405 - DNA, 20 bp, Artificial Sequence
  Description of Artificial Sequence: Synthetic oligonucleotide
  Target: ATXN1; (-) strand; PAM type: YTN; PAM sequence: TTG
taatttttgatccatgcaca

SEQ ID NO: 211406 - DNA, 20 bp, Artificial Sequence
  Description of Artificial Sequence: Synthetic oligonucleotide
  Target: ATXN1; (-) strand; PAM type: YTN; PAM sequence: CTT
gtaatttttgatccatgcac

SEQ ID NO: 211407 - DNA, 20 bp, Artificial Sequence
  Description of Artificial Sequence: Synthetic oligonucleotide
  Target: ATXN1; (-) strand; PAM type: YTN; PAM sequence: CTC
ttgtaatttttgatccatgc

SEQ ID NO: 211408 - DNA, 20 bp, Artificial Sequence
  Description of Artificial Sequence: Synthetic oligonucleotide
  Target: ATXN1; (-) strand; PAM type: YTN; PAM sequence: CTG
aactcttgtaatttttgatc

SEQ ID NO: 211409 - DNA, 20 bp, Artificial Sequence
  Description of Artificial Sequence: Synthetic oligonucleotide
  Target: ATXN1; (-) strand; PAM type: YTN; PAM sequence: TTA
ctgaactcttgtaatttttg

SEQ ID NO: 211410 - DNA, 20 bp, Artificial Sequence
  Description of Artificial Sequence: Synthetic oligonucleotide
  Target: ATXN1; (-) strand; PAM type: YTN; PAM sequence: TTT
actgaactcttgtaattttt

SEQ ID NO: 211411 - DNA, 20 bp, Artificial Sequence
  Description of Artificial Sequence: Synthetic oligonucleotide
  Target: ATXN1; (-) strand; PAM type: YTN; PAM sequence: CTT
tactgaactcttgtaatttt

SEQ ID NO: 211412 - DNA, 20 bp, Artificial Sequence
  Description of Artificial Sequence: Synthetic oligonucleotide
  Target: ATXN1; (-) strand; PAM type: YTN; PAM sequence: TTC
agagagaatggaagtcttta

SEQ ID NO: 211413 - DNA, 20 bp, Artificial Sequence
  Description of Artificial Sequence: Synthetic oligonucleotide
  Target: ATXN1; (-) strand; PAM type: YTN; PAM sequence: TTA
gatatcaattcagagagaat

SEQ ID NO: 211414 - DNA, 20 bp, Artificial Sequence
  Description of Artificial Sequence: Synthetic oligonucleotide
  Target: ATXN1; (-) strand; PAM type: YTN; PAM sequence: TTA
atagattagatatcaattca

SEQ ID NO: 211415 - DNA, 20 bp, Artificial Sequence
  Description of Artificial Sequence: Synthetic oligonucleotide
  Target: ATXN1; (-) strand; PAM type: YTN; PAM sequence: TTT
aatagattagatatcaattc

SEQ ID NO: 211416 - DNA, 20 bp, Artificial Sequence
  Description of Artificial Sequence: Synthetic oligonucleotide
  Target: ATXN1; (-) strand; PAM type: YTN; PAM sequence: TTA
atttaatagattagatatca

SEQ ID NO: 211417 - DNA, 20 bp, Artificial Sequence
  Description of Artificial Sequence: Synthetic oligonucleotide
  Target: ATXN1; (-) strand; PAM type: YTN; PAM sequence: TTT
aatttaatagattagatatc

SEQ ID NO: 211418 - DNA, 20 bp, Artificial Sequence
  Description of Artificial Sequence: Synthetic oligonucleotide
  Target: ATXN1; (-) strand; PAM type: YTN; PAM sequence: TTC
aaaataaaatttaatttaat

SEQ ID NO: 211419 - DNA, 20 bp, Artificial Sequence
  Description of Artificial Sequence: Synthetic oligonucleotide
  Target: ATXN1; (-) strand; PAM type: YTN; PAM sequence: TTT
caaaataaaatttaatttaa

SEQ ID NO: 211420 - DNA, 20 bp, Artificial Sequence
  Description of Artificial Sequence: Synthetic oligonucleotide
  Target: ATXN1; (-) strand; PAM type: YTN; PAM sequence: TTT
tcaaaataaaatttaattta

SEQ ID NO: 211421 - DNA, 20 bp, Artificial Sequence
  Description of Artificial Sequence: Synthetic oligonucleotide
  Target: ATXN1; (-) strand; PAM type: YTN; PAM sequence: CTT
ttcaaaataaaatttaattt

SEQ ID NO: 211422 - DNA, 20 bp, Artificial Sequence
  Description of Artificial Sequence: Synthetic oligonucleotide
  Target: ATXN1; (-) strand; PAM type: YTN; PAM sequence: TTA
aaacatcttttcaaaataaa

SEQ ID NO: 211423 - DNA, 20 bp, Artificial Sequence
  Description of Artificial Sequence: Synthetic oligonucleotide
  Target: ATXN1; (-) strand; PAM type: YTN; PAM sequence: TTT
aaaacatcttttcaaaataa

SEQ ID NO: 211424 - DNA, 20 bp, Artificial Sequence
  Description of Artificial Sequence: Synthetic oligonucleotide
  Target: ATXN1; (-) strand; PAM type: YTN; PAM sequence: TTT
taaaacatcttttcaaaata

SEQ ID NO: 211425 - DNA, 20 bp, Artificial Sequence
  Description of Artificial Sequence: Synthetic oligonucleotide
  Target: ATXN1; (-) strand; PAM type: YTN; PAM sequence: TTA
gtcagattttaaaacatctt

SEQ ID NO: 211426 - DNA, 20 bp, Artificial Sequence
  Description of Artificial Sequence: Synthetic oligonucleotide
  Target: ATXN1; (-) strand; PAM type: YTN; PAM sequence: TTT
agtcagattttaaaacatct

SEQ ID NO: 211427 - DNA, 20 bp, Artificial Sequence
  Description of Artificial Sequence: Synthetic oligonucleotide
  Target: ATXN1; (-) strand; PAM type: YTN; PAM sequence: CTA
atttagtcagattttaaaac

SEQ ID NO: 211428 - DNA, 20 bp, Artificial Sequence
  Description of Artificial Sequence: Synthetic oligonucleotide
  Target: ATXN1; (-) strand; PAM type: YTN; PAM sequence: TTC
atgtgtacatagactaattt

SEQ ID NO: 211429 - DNA, 20 bp, Artificial Sequence
  Description of Artificial Sequence: Synthetic oligonucleotide
  Target: ATXN1; (-) strand; PAM type: YTN; PAM sequence: TTT
catgtgtacatagactaatt

SEQ ID NO: 211430 - DNA, 20 bp, Artificial Sequence
  Description of Artificial Sequence: Synthetic oligonucleotide
  Target: ATXN1; (-) strand; PAM type: YTN; PAM sequence: CTT
tcatgtgtacatagactaat

SEQ ID NO: 211431 - DNA, 20 bp, Artificial Sequence
  Description of Artificial Sequence: Synthetic oligonucleotide
  Target: ATXN1; (-) strand; PAM type: YTN; PAM sequence: TTC
tttcatgtgtacatagacta

SEQ ID NO: 211432 - DNA, 20 bp, Artificial Sequence
  Description of Artificial Sequence: Synthetic oligonucleotide
  Target: ATXN1; (-) strand; PAM type: YTN; PAM sequence: TTA
ttctttcatgtgtacataga

SEQ ID NO: 211433 - DNA, 20 bp, Artificial Sequence
  Description of Artificial Sequence: Synthetic oligonucleotide
  Target: ATXN1; (-) strand; PAM type: YTN; PAM sequence: TTT
attctttcatgtgtacatag

SEQ ID NO: 211434 - DNA, 20 bp, Artificial Sequence
  Description of Artificial Sequence: Synthetic oligonucleotide
  Target: ATXN1; (-) strand; PAM type: YTN; PAM sequence: CTA
tttattctttcatgtgtaca

SEQ ID NO: 211435 - DNA, 20 bp, Artificial Sequence
  Description of Artificial Sequence: Synthetic oligonucleotide
  Target: ATXN1; (-) strand; PAM type: YTN; PAM sequence: TTA
gtctatttattctttcatgt

SEQ ID NO: 211436 - DNA, 20 bp, Artificial Sequence
  Description of Artificial Sequence: Synthetic oligonucleotide
  Target: ATXN1; (-) strand; PAM type: YTN; PAM sequence: TTT
agtctatttattctttcatg

SEQ ID NO: 211437 - DNA, 20 bp, Artificial Sequence
  Description of Artificial Sequence: Synthetic oligonucleotide
  Target: ATXN1; (-) strand; PAM type: YTN; PAM sequence: TTT
tagtctatttattctttcat

SEQ ID NO: 211438 - DNA, 20 bp, Artificial Sequence
  Description of Artificial Sequence: Synthetic oligonucleotide
  Target: ATXN1; (-) strand; PAM type: YTN; PAM sequence: TTT
ttagtctatttattctttca

SEQ ID NO: 211439 - DNA, 20 bp, Artificial Sequence
  Description of Artificial Sequence: Synthetic oligonucleotide
  Target: ATXN1; (-) strand; PAM type: YTN; PAM sequence: CTA
tttttagtctatttattctt

SEQ ID NO: 211440 - DNA, 20 bp, Artificial Sequence
  Description of Artificial Sequence: Synthetic oligonucleotide
  Target: ATXN1; (-) strand; PAM type: YTN; PAM sequence: TTA
gctatttttagtctatttat

SEQ ID NO: 211441 - DNA, 20 bp, Artificial Sequence
  Description of Artificial Sequence: Synthetic oligonucleotide
  Target: ATXN1; (-) strand; PAM type: YTN; PAM sequence: TTA
ttagctatttttagtctatt

SEQ ID NO: 211442 - DNA, 20 bp, Artificial Sequence
  Description of Artificial Sequence: Synthetic oligonucleotide
  Target: ATXN1; (-) strand; PAM type: YTN; PAM sequence: TTT
attagctatttttagtctat

SEQ ID NO: 211443 - DNA, 20 bp, Artificial Sequence
  Description of Artificial Sequence: Synthetic oligonucleotide
  Target: ATXN1; (-) strand; PAM type: YTN; PAM sequence: TTC
agcatttattagctattttt

SEQ ID NO: 211444 - DNA, 20 bp, Artificial Sequence
  Description of Artificial Sequence: Synthetic oligonucleotide
  Target: ATXN1; (-) strand; PAM type: YTN; PAM sequence: TTT
cagcatttattagctatttt

SEQ ID NO: 211445 - DNA, 20 bp, Artificial Sequence
  Description of Artificial Sequence: Synthetic oligonucleotide
  Target: ATXN1; (-) strand; PAM type: YTN; PAM sequence: TTT
tcagcatttattagctattt

SEQ ID NO: 211446 - DNA, 20 bp, Artificial Sequence
  Description of Artificial Sequence: Synthetic oligonucleotide
  Target: ATXN1; (-) strand; PAM type: YTN; PAM sequence: TTT
ttcagcatttattagctatt

SEQ ID NO: 211447 - DNA, 20 bp, Artificial Sequence
  Description of Artificial Sequence: Synthetic oligonucleotide
  Target: ATXN1; (-) strand; PAM type: YTN; PAM sequence: TTT
tttcagcatttattagctat

SEQ ID NO: 211448 - DNA, 20 bp, Artificial Sequence
  Description of Artificial Sequence: Synthetic oligonucleotide
  Target: ATXN1; (-) strand; PAM type: YTN; PAM sequence: TTT
ttttcagcatttattagcta

SEQ ID NO: 211449 - DNA, 20 bp, Artificial Sequence
  Description of Artificial Sequence: Synthetic oligonucleotide
  Target: ATXN1; (-) strand; PAM type: YTN; PAM sequence: TTT
tttttcagcatttattagct

SEQ ID NO: 211450 - DNA, 20 bp, Artificial Sequence
  Description of Artificial Sequence: Synthetic oligonucleotide
  Target: ATXN1; (-) strand; PAM type: YTN; PAM sequence: TTC
atatattttttttcagcatt

SEQ ID NO: 211451 - DNA, 20 bp, Artificial Sequence
  Description of Artificial Sequence: Synthetic oligonucleotide
  Target: ATXN1; (-) strand; PAM type: YTN; PAM sequence: TTT
catatattttttttcagcat

SEQ ID NO: 211452 - DNA, 20 bp, Artificial Sequence
  Description of Artificial Sequence: Synthetic oligonucleotide
  Target: ATXN1; (-) strand; PAM type: YTN; PAM sequence: CTT
tcatatattttttttcagca

SEQ ID NO: 211453 - DNA, 20 bp, Artificial Sequence
  Description of Artificial Sequence: Synthetic oligonucleotide
  Target: ATXN1; (-) strand; PAM type: YTN; PAM sequence: TTC
tttcatatattttttttcag

SEQ ID NO: 211454 - DNA, 20 bp, Artificial Sequence
  Description of Artificial Sequence: Synthetic oligonucleotide
  Target: ATXN1; (-) strand; PAM type: YTN; PAM sequence: TTA
gattctttcatatatttttt

SEQ ID NO: 211455 - DNA, 20 bp, Artificial Sequence
  Description of Artificial Sequence: Synthetic oligonucleotide
  Target: ATXN1; (-) strand; PAM type: YTN; PAM sequence: TTA
atataattagattctttcat

SEQ ID NO: 211456 - DNA, 20 bp, Artificial Sequence
  Description of Artificial Sequence: Synthetic oligonucleotide
  Target: ATXN1; (-) strand; PAM type: YTN; PAM sequence: TTT
aatataattagattctttca

SEQ ID NO: 211457 - DNA, 20 bp, Artificial Sequence
  Description of Artificial Sequence: Synthetic oligonucleotide
  Target: ATXN1; (-) strand; PAM type: YTN; PAM sequence: TTT
taatataattagattctttc

SEQ ID NO: 211458 - DNA, 20 bp, Artificial Sequence
  Description of Artificial Sequence: Synthetic oligonucleotide
  Target: ATXN1; (-) strand; PAM type: YTN; PAM sequence: TTA
gaagattttaatataattag

SEQ ID NO: 211459 - DNA, 20 bp, Artificial Sequence
  Description of Artificial Sequence: Synthetic oligonucleotide
  Target: ATXN1; (-) strand; PAM type: YTN; PAM sequence: TTT
agaagattttaatataatta

SEQ ID NO: 211460 - DNA, 20 bp, Artificial Sequence
  Description of Artificial Sequence: Synthetic oligonucleotide
  Target: ATXN1; (-) strand; PAM type: YTN; PAM sequence: CTA
tgagtttagaagattttaat

SEQ ID NO: 211461 - DNA, 20 bp, Artificial Sequence
  Description of Artificial Sequence: Synthetic oligonucleotide
  Target: ATXN1; (-) strand; PAM type: YTN; PAM sequence: TTC
tatgagtttagaagatttta

SEQ ID NO: 211462 - DNA, 20 bp, Artificial Sequence
  Description of Artificial Sequence: Synthetic oligonucleotide
  Target: ATXN1; (-) strand; PAM type: YTN; PAM sequence: TTG
attctatgagtttagaagat

SEQ ID NO: 211463 - DNA, 20 bp, Artificial Sequence
  Description of Artificial Sequence: Synthetic oligonucleotide
  Target: ATXN1; (-) strand; PAM type: YTN; PAM sequence: TTT
gattctatgagtttagaaga

SEQ ID NO: 211464 - DNA, 20 bp, Artificial Sequence
  Description of Artificial Sequence: Synthetic oligonucleotide
  Target: ATXN1; (-) strand; PAM type: YTN; PAM sequence: TTT
tgattctatgagtttagaag

SEQ ID NO: 211465 - DNA, 20 bp, Artificial Sequence
  Description of Artificial Sequence: Synthetic oligonucleotide
  Target: ATXN1; (-) strand; PAM type: YTN; PAM sequence: CTT
ttgattctatgagtttagaa

SEQ ID NO: 211466 - DNA, 20 bp, Artificial Sequence
  Description of Artificial Sequence: Synthetic oligonucleotide
  Target: ATXN1; (-) strand; PAM type: YTN; PAM sequence: TTG
cttttgattctatgagttta

SEQ ID NO: 211467 - DNA, 20 bp, Artificial Sequence
  Description of Artificial Sequence: Synthetic oligonucleotide
  Target: ATXN1; (-) strand; PAM type: YTN; PAM sequence: TTT
gcttttgattctatgagttt

SEQ ID NO: 211468 - DNA, 20 bp, Artificial Sequence
  Description of Artificial Sequence: Synthetic oligonucleotide
  Target: ATXN1; (-) strand; PAM type: YTN; PAM sequence: TTT
tgcttttgattctatgagtt

SEQ ID NO: 211469 - DNA, 20 bp, Artificial Sequence
  Description of Artificial Sequence: Synthetic oligonucleotide
  Target: ATXN1; (-) strand; PAM type: YTN; PAM sequence: CTA
ttttgcttttgattctatga

SEQ ID NO: 211470 - DNA, 20 bp, Artificial Sequence
  Description of Artificial Sequence: Synthetic oligonucleotide
  Target: ATXN1; (-) strand; PAM type: YTN; PAM sequence: TTC
tattttgcttttgattctat

SEQ ID NO: 211471 - DNA, 20 bp, Artificial Sequence
  Description of Artificial Sequence: Synthetic oligonucleotide
  Target: ATXN1; (-) strand; PAM type: YTN; PAM sequence: TTT
ctattttgcttttgattcta

SEQ ID NO: 211472 - DNA, 20 bp, Artificial Sequence
  Description of Artificial Sequence: Synthetic oligonucleotide
  Target: ATXN1; (-) strand; PAM type: YTN; PAM sequence: TTT
tctattttgcttttgattct

SEQ ID NO: 211473 - DNA, 20 bp, Artificial Sequence
  Description of Artificial Sequence: Synthetic oligonucleotide
  Target: ATXN1; (-) strand; PAM type: YTN; PAM sequence: TTT
ttctattttgcttttgattc

SEQ ID NO: 211474 - DNA, 20 bp, Artificial Sequence
  Description of Artificial Sequence: Synthetic oligonucleotide
  Target: ATXN1; (-) strand; PAM type: YTN; PAM sequence: TTT
tttctattttgcttttgatt

SEQ ID NO: 211475 - DNA, 20 bp, Artificial Sequence
  Description of Artificial Sequence: Synthetic oligonucleotide
  Target: ATXN1; (-) strand; PAM type: YTN; PAM sequence: TTT
ttttctattttgcttttgat

SEQ ID NO: 211476 - DNA, 20 bp, Artificial Sequence
  Description of Artificial Sequence: Synthetic oligonucleotide
  Target: ATXN1; (-) strand; PAM type: YTN; PAM sequence: TTT
tttttctattttgcttttga

SEQ ID NO: 211477 - DNA, 20 bp, Artificial Sequence
  Description of Artificial Sequence: Synthetic oligonucleotide
  Target: ATXN1; (-) strand; PAM type: YTN; PAM sequence: TTG
ttttttttctattttgcttt

SEQ ID NO: 211478 - DNA, 20 bp, Artificial Sequence
  Description of Artificial Sequence: Synthetic oligonucleotide
  Target: ATXN1; (-) strand; PAM type: YTN; PAM sequence: TTT
gttttttttctattttgctt

SEQ ID NO: 211479 - DNA, 20 bp, Artificial Sequence
  Description of Artificial Sequence: Synthetic oligonucleotide
  Target: ATXN1; (-) strand; PAM type: YTN; PAM sequence: TTG
atatttgttttttttctatt

SEQ ID NO: 211480 - DNA, 20 bp, Artificial Sequence
  Description of Artificial Sequence: Synthetic oligonucleotide
  Target: ATXN1; (-) strand; PAM type: YTN; PAM sequence: CTT
gatatttgttttttttctat

SEQ ID NO: 211481 - DNA, 20 bp, Artificial Sequence
  Description of Artificial Sequence: Synthetic oligonucleotide
  Target: ATXN1; (-) strand; PAM type: YTN; PAM sequence: TTA
tcttgatatttgtttttttt

SEQ ID NO: 211482 - DNA, 20 bp, Artificial Sequence
  Description of Artificial Sequence: Synthetic oligonucleotide
  Target: ATXN1; (-) strand; PAM type: YTN; PAM sequence: CTG
ttatcttgatatttgttttt

SEQ ID NO: 211483 - DNA, 20 bp, Artificial Sequence
  Description of Artificial Sequence: Synthetic oligonucleotide
  Target: ATXN1; (-) strand; PAM type: YTN; PAM sequence: TTC
tgttatcttgatatttgttt

SEQ ID NO: 211484 - DNA, 20 bp, Artificial Sequence
  Description of Artificial Sequence: Synthetic oligonucleotide
  Target: ATXN1; (-) strand; PAM type: YTN; PAM sequence: TTA
tattctgttatcttgatatt

SEQ ID NO: 211485 - DNA, 20 bp, Artificial Sequence
  Description of Artificial Sequence: Synthetic oligonucleotide
  Target: ATXN1; (-) strand; PAM type: YTN; PAM sequence: CTT
atattctgttatcttgatat

SEQ ID NO: 211486 - DNA, 20 bp, Artificial Sequence
  Description of Artificial Sequence: Synthetic oligonucleotide
  Target: ATXN1; (-) strand; PAM type: YTN; PAM sequence: CTA
agccttatattctgttatct

SEQ ID NO: 211487 - DNA, 20 bp, Artificial Sequence
  Description of Artificial Sequence: Synthetic oligonucleotide
  Target: ATXN1; (-) strand; PAM type: YTN; PAM sequence: TTC
taagccttatattctgttat

SEQ ID NO: 211488 - DNA, 20 bp, Artificial Sequence
  Description of Artificial Sequence: Synthetic oligonucleotide
  Target: ATXN1; (-) strand; PAM type: YTN; PAM sequence: TTT
ctaagccttatattctgtta

SEQ ID NO: 211489 - DNA, 20 bp, Artificial Sequence
  Description of Artificial Sequence: Synthetic oligonucleotide
  Target: ATXN1; (-) strand; PAM type: YTN; PAM sequence: CTC
gtgatccgcatttctaagcc

SEQ ID NO: 211490 - DNA, 20 bp, Artificial Sequence
  Description of Artificial Sequence: Synthetic oligonucleotide
  Target: ATXN1; (-) strand; PAM type: YTN; PAM sequence: CTG
acctcgtgatccgcatttct

SEQ ID NO: 211491 - DNA, 20 bp, Artificial Sequence
  Description of Artificial Sequence: Synthetic oligonucleotide
  Target: ATXN1; (-) strand; PAM type: YTN; PAM sequence: CTC
ctgacctcgtgatccgcatt

SEQ ID NO: 211492 - DNA, 20 bp, Artificial Sequence
  Description of Artificial Sequence: Synthetic oligonucleotide
  Target: ATXN1; (-) strand; PAM type: YTN; PAM sequence: CTC
gatctcctgacctcgtgatc

SEQ ID NO: 211493 - DNA, 20 bp, Artificial Sequence
  Description of Artificial Sequence: Synthetic oligonucleotide
  Target: ATXN1; (-) strand; PAM type: YTN; PAM sequence: TTA
gccaggatggtctcgatctc

SEQ ID NO: 211494 - DNA, 20 bp, Artificial Sequence
  Description of Artificial Sequence: Synthetic oligonucleotide
  Target: ATXN1; (-) strand; PAM type: YTN; PAM sequence: CTG
tgttagccaggatggtctcg

SEQ ID NO: 211495 - DNA, 20 bp, Artificial Sequence
  Description of Artificial Sequence: Synthetic oligonucleotide
  Target: ATXN1; (-) strand; PAM type: YTN; PAM sequence: TTC
actgtgttagccaggatggt

SEQ ID NO: 211496 - DNA, 20 bp, Artificial Sequence
  Description of Artificial Sequence: Synthetic oligonucleotide
  Target: ATXN1; (-) strand; PAM type: YTN; PAM sequence: TTT
cactgtgttagccaggatgg

SEQ ID NO: 211497 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggtttcactg

SEQ ID NO: 211498 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggtttcact

SEQ ID NO: 211499 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggtttcac

SEQ ID NO: 211500 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggtttca

SEQ ID NO: 211501 - DNA, 20 bp, Artificial Sequence
  Description of Artificial Sequence: Synthetic oligonucleotide
  Target: ATXN1; (-) strand; PAM type: YTN; PAM sequence: TTG
tgtgtgtttttagtagagac

SEQ ID NO: 211502 - DNA, 20 bp, Artificial Sequence
  Description of Artificial Sequence: Synthetic oligonucleotide
  Target: ATXN1; (-) strand; PAM type: YTN; PAM sequence: TTT
gtgtgtgtttttagtagaga

SEQ ID NO: 211503 - DNA, 20 bp, Artificial Sequence
  Description of Artificial Sequence: Synthetic oligonucleotide
  Target: ATXN1; (-) strand; PAM type: YTN; PAM sequence: TTT
tgtgtgtgtttttagtagag

SEQ ID NO: 211504 - DNA, 20 bp, Artificial Sequence
  Description of Artificial Sequence: Synthetic oligonucleotide
  Target: ATXN1; (-) strand; PAM type: YTN; PAM sequence: TTT
ttgtgtgtgtttttagtaga

SEQ ID NO: 211505 - DNA, 20 bp, Artificial Sequence
  Description of Artificial Sequence: Synthetic oligonucleotide
  Target: ATXN1; (-) strand; PAM type: YTN; PAM sequence: CTA
atttttgtgtgtgtttttag

SEQ ID NO: 211506 - DNA, 20 bp, Artificial Sequence
  Description of Artificial Sequence: Synthetic oligonucleotide
  Target: ATXN1; (-) strand; PAM type: YTN; PAM sequence: CTG
caggcgcccgccaccacgcc

SEQ ID NO: 211507 - DNA, 20 bp, Artificial Sequence
  Description of Artificial Sequence: Synthetic oligonucleotide
  Target: ATXN1; (-) strand; PAM type: YTN; PAM sequence: CTG
ggactgcaggcgcccgccac

SEQ ID NO: 211508 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggactgcag

SEQ ID NO: 211509 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctggga

SEQ ID NO: 211510 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 211511 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagta

SEQ ID NO: 211512 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgag

SEQ ID NO: 211513 - DNA, 20 bp, Artificial Sequence
  Description of Artificial Sequence: Synthetic oligonucleotide
  Target: ATXN1; (-) strand; PAM type: YTN; PAM sequence: TTC
aggccattctcctgcctcag

SEQ ID NO: 211514 - DNA, 20 bp, Artificial Sequence
  Description of Artificial Sequence: Synthetic oligonucleotide
  Target: ATXN1; (-) strand; PAM type: YTN; PAM sequence: CTC
acgggttcaggccattctcc

SEQ ID NO: 211515 - DNA, 20 bp, Artificial Sequence
  Description of Artificial Sequence: Synthetic oligonucleotide
  Target: ATXN1; (-) strand; PAM type: YTN; PAM sequence: CTC
cgcctcacgggttcaggcca

SEQ ID NO: 211516 - DNA, 20 bp, Artificial Sequence
  Description of Artificial Sequence: Synthetic oligonucleotide
  Target: ATXN1; (-) strand; PAM type: YTN; PAM sequence: CTG
caagctccgcctcacgggtt

SEQ ID NO: 211517 - DNA, 20 bp, Artificial Sequence
  Description of Artificial Sequence: Synthetic oligonucleotide
  Target: ATXN1; (-) strand; PAM type: YTN; PAM sequence: CTC
actgcaagctccgcctcacg

SEQ ID NO: 211518 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaagctccgcc

SEQ ID NO: 211519 - DNA, 20 bp, Artificial Sequence
  Description of Artificial Sequence: Synthetic oligonucleotide
  Target: ATXN1; (-) strand; PAM type: YTN; PAM sequence: TTG
cccaggcaggagtgcagcgg

SEQ ID NO: 211520 - DNA, 20 bp, Artificial Sequence
  Description of Artificial Sequence: Synthetic oligonucleotide
  Target: ATXN1; (-) strand; PAM type: YTN; PAM sequence: CTA
ttgcccaggcaggagtgcag

SEQ ID NO: 211521 - DNA, 20 bp, Artificial Sequence
  Description of Artificial Sequence: Synthetic oligonucleotide
  Target: ATXN1; (-) strand; PAM type: YTN; PAM sequence: CTC
tattgcccaggcaggagtgc

SEQ ID NO: 211522 - DNA, 20 bp, Artificial Sequence
  Description of Artificial Sequence: Synthetic oligonucleotide
  Target: ATXN1; (-) strand; PAM type: YTN; PAM sequence: CTC
tctattgcccaggcaggagt

SEQ ID NO: 211523 - DNA, 20 bp, Artificial Sequence
  Description of Artificial Sequence: Synthetic oligonucleotide
  Target: ATXN1; (-) strand; PAM type: YTN; PAM sequence: TTC
tctctattgcccaggcagga

SEQ ID NO: 211524 - DNA, 20 bp, Artificial Sequence
  Description of Artificial Sequence: Synthetic oligonucleotide
  Target: ATXN1; (-) strand; PAM type: YTN; PAM sequence: TTT
ctctctattgcccaggcagg

SEQ ID NO: 211525 - DNA, 20 bp, Artificial Sequence
  Description of Artificial Sequence: Synthetic oligonucleotide
  Target: ATXN1; (-) strand; PAM type: YTN; PAM sequence: TTG
agacagagtttctctctatt

SEQ ID NO: 211526 - DNA, 20 bp, Artificial Sequence
  Description of Artificial Sequence: Synthetic oligonucleotide
  Target: ATXN1; (-) strand; PAM type: YTN; PAM sequence: TTT
gagacagagtttctctctat

SEQ ID NO: 211527 - DNA, 20 bp, Artificial Sequence
  Description of Artificial Sequence: Synthetic oligonucleotide
  Target: ATXN1; (-) strand; PAM type: YTN; PAM sequence: TTT
tgagacagagtttctctcta

SEQ ID NO: 211528 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagtttctctct

SEQ ID NO: 211529 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagtttctctc

SEQ ID NO: 211530 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagtttctct

SEQ ID NO: 211531 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagtttctc

SEQ ID NO: 211532 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagagtttct

SEQ ID NO: 211533 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagagtttc

SEQ ID NO: 211534 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagagttt

SEQ ID NO: 211535 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacagagtt

SEQ ID NO: 211536 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacagagt

SEQ ID NO: 211537 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacagag

SEQ ID NO: 211538 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacaga

SEQ ID NO: 211539 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacag

SEQ ID NO: 211540 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttgagaca

SEQ ID NO: 211541 - DNA, 20 bp, Artificial Sequence
  Description of Artificial Sequence: Synthetic oligonucleotide
  Target: ATXN1; (-) strand; PAM type: YTN; PAM sequence: TTC
ttttttttttttttttgaga

SEQ ID NO: 211542 - DNA, 20 bp, Artificial Sequence
  Description of Artificial Sequence: Synthetic oligonucleotide
  Target: ATXN1; (-) strand; PAM type: YTN; PAM sequence: TTT
cttttttttttttttttgag

SEQ ID NO: 211543 - DNA, 20 bp, Artificial Sequence
  Description of Artificial Sequence: Synthetic oligonucleotide
  Target: ATXN1; (-) strand; PAM type: YTN; PAM sequence: TTA
gaaacatgagtatatttctt

SEQ ID NO: 211544 - DNA, 20 bp, Artificial Sequence
  Description of Artificial Sequence: Synthetic oligonucleotide
  Target: ATXN1; (-) strand; PAM type: YTN; PAM sequence: TTT
agaaacatgagtatatttct

SEQ ID NO: 211545 - DNA, 20 bp, Artificial Sequence
  Description of Artificial Sequence: Synthetic oligonucleotide
  Target: ATXN1; (-) strand; PAM type: YTN; PAM sequence: TTT
tagaaacatgagtatatttc

SEQ ID NO: 211546 - DNA, 20 bp, Artificial Sequence
  Description of Artificial Sequence: Synthetic oligonucleotide
  Target: ATXN1; (-) strand; PAM type: YTN; PAM sequence: TTT
ttagaaacatgagtatattt

SEQ ID NO: 211547 - DNA, 20 bp, Artificial Sequence
  Description of Artificial Sequence: Synthetic oligonucleotide
  Target: ATXN1; (-) strand; PAM type: YTN; PAM sequence: CTA
aatgtttttagaaacatgag

SEQ ID NO: 211548 - DNA, 20 bp, Artificial Sequence
  Description of Artificial Sequence: Synthetic oligonucleotide
  Target: ATXN1; (-) strand; PAM type: YTN; PAM sequence: CTA
ataaaaactaaatgttttta

SEQ ID NO: 211549 - DNA, 20 bp, Artificial Sequence
  Description of Artificial Sequence: Synthetic oligonucleotide
  Target: ATXN1; (-) strand; PAM type: YTN; PAM sequence: TTA
agtactaataaaaactaaat

SEQ ID NO: 211550 - DNA, 20 bp, Artificial Sequence
  Description of Artificial Sequence: Synthetic oligonucleotide
  Target: ATXN1; (-) strand; PAM type: YTN; PAM sequence: TTA
ttaagtactaataaaaacta

SEQ ID NO: 211551 - DNA, 20 bp, Artificial Sequence
  Description of Artificial Sequence: Synthetic oligonucleotide
  Target: ATXN1; (-) strand; PAM type: YTN; PAM sequence: TTT
attaagtactaataaaaact

SEQ ID NO: 211552 - DNA, 20 bp, Artificial Sequence
  Description of Artificial Sequence: Synthetic oligonucleotide
  Target: ATXN1; (-) strand; PAM type: YTN; PAM sequence: CTT
tattaagtactaataaaaac

SEQ ID NO: 211553 - DNA, 20 bp, Artificial Sequence
  Description of Artificial Sequence: Synthetic oligonucleotide
  Target: ATXN1; (-) strand; PAM type: YTN; PAM sequence: CTG
agaggagacatcatctttat

SEQ ID NO: 211554 - DNA, 20 bp, Artificial Sequence
  Description of Artificial Sequence: Synthetic oligonucleotide
  Target: ATXN1; (-) strand; PAM type: YTN; PAM sequence: TTG
ccccactgagaggagacatc

SEQ ID NO: 211555 - DNA, 20 bp, Artificial Sequence
  Description of Artificial Sequence: Synthetic oligonucleotide
  Target: ATXN1; (-) strand; PAM type: YTN; PAM sequence: TTT
gccccactgagaggagacat

SEQ ID NO: 211556 - DNA, 20 bp, Artificial Sequence
  Description of Artificial Sequence: Synthetic oligonucleotide
  Target: ATXN1; (-) strand; PAM type: YTN; PAM sequence: TTT
tgccccactgagaggagaca

SEQ ID NO: 211557 - DNA, 20 bp, Artificial Sequence
  Description of Artificial Sequence: Synthetic oligonucleotide
  Target: ATXN1; (-) strand; PAM type: YTN; PAM sequence: CTT
ttgccccactgagaggagac

SEQ ID NO: 211558 - DNA, 20 bp, Artificial Sequence
  Description of Artificial Sequence: Synthetic oligonucleotide
  Target: ATXN1; (-) strand; PAM type: YTN; PAM sequence: TTA
gtcttttgccccactgagag

SEQ ID NO: 211559 - DNA, 20 bp, Artificial Sequence
  Description of Artificial Sequence: Synthetic oligonucleotide
  Target: ATXN1; (-) strand; PAM type: YTN; PAM sequence: TTA
ttagtcttttgccccactga

SEQ ID NO: 211560 - DNA, 20 bp, Artificial Sequence
  Description of Artificial Sequence: Synthetic oligonucleotide
  Target: ATXN1; (-) strand; PAM type: YTN; PAM sequence: TTT
attagtcttttgccccactg

SEQ ID NO: 211561 - DNA, 20 bp, Artificial Sequence
  Description of Artificial Sequence: Synthetic oligonucleotide
  Target: ATXN1; (-) strand; PAM type: YTN; PAM sequence: TTA
tgtatttattagtcttttgc

SEQ ID NO: 211562 - DNA, 20 bp, Artificial Sequence
  Description of Artificial Sequence: Synthetic oligonucleotide
  Target: ATXN1; (-) strand; PAM type: YTN; PAM sequence: CTC
acattatgtatttattagtc

SEQ ID NO: 211563 - DNA, 20 bp, Artificial Sequence
  Description of Artificial Sequence: Synthetic oligonucleotide
  Target: ATXN1; (-) strand; PAM type: YTN; PAM sequence: TTC
tcacattatgtatttattag

SEQ ID NO: 211564 - DNA, 20 bp, Artificial Sequence
  Description of Artificial Sequence: Synthetic oligonucleotide
  Target: ATXN1; (-) strand; PAM type: YTN; PAM sequence: TTG
ttctcacattatgtatttat

SEQ ID NO: 211565 - DNA, 20 bp, Artificial Sequence
  Description of Artificial Sequence: Synthetic oligonucleotide
  Target: ATXN1; (-) strand; PAM type: YTN; PAM sequence: TTA
gatcagttgttctcacatta

SEQ ID NO: 211566 - DNA, 20 bp, Artificial Sequence
  Description of Artificial Sequence: Synthetic oligonucleotide
  Target: ATXN1; (-) strand; PAM type: YTN; PAM sequence: TTG
tcaaatattagatcagttgt

SEQ ID NO: 211567 - DNA, 20 bp, Artificial Sequence
  Description of Artificial Sequence: Synthetic oligonucleotide
  Target: ATXN1; (-) strand; PAM type: YTN; PAM sequence: TTT
gtcaaatattagatcagttg

SEQ ID NO: 211568 - DNA, 20 bp, Artificial Sequence
  Description of Artificial Sequence: Synthetic oligonucleotide
  Target: ATXN1; (-) strand; PAM type: YTN; PAM sequence: TTT
tgtcaaatattagatcagtt

SEQ ID NO: 211569 - DNA, 20 bp, Artificial Sequence
  Description of Artificial Sequence: Synthetic oligonucleotide
  Target: ATXN1; (-) strand; PAM type: YTN; PAM sequence: CTT
ttgtcaaatattagatcagt

SEQ ID NO: 211570 - DNA, 20 bp, Artificial Sequence
  Description of Artificial Sequence: Synthetic oligonucleotide
  Target: ATXN1; (-) strand; PAM type: YTN; PAM sequence: TTC
aatgaacttttgtcaaatat

SEQ ID NO: 211571 - DNA, 20 bp, Artificial Sequence
  Description of Artificial Sequence: Synthetic oligonucleotide
  Target: ATXN1; (-) strand; PAM type: YTN; PAM sequence: TTA
gacatgaggattcaatgaac

SEQ ID NO: 211572 - DNA, 20 bp, Artificial Sequence
  Description of Artificial Sequence: Synthetic oligonucleotide
  Target: ATXN1; (-) strand; PAM type: YTN; PAM sequence: CTT
agacatgaggattcaatgaa

SEQ ID NO: 211573 - DNA, 20 bp, Artificial Sequence
  Description of Artificial Sequence: Synthetic oligonucleotide
  Target: ATXN1; (-) strand; PAM type: YTN; PAM sequence: TTG
atgtgcgatcttagacatga

SEQ ID NO: 211574 - DNA, 20 bp, Artificial Sequence
  Description of Artificial Sequence: Synthetic oligonucleotide
  Target: ATXN1; (-) strand; PAM type: YTN; PAM sequence: TTT
gatgtgcgatcttagacatg

SEQ ID NO: 211575 - DNA, 20 bp, Artificial Sequence
  Description of Artificial Sequence: Synthetic oligonucleotide
  Target: ATXN1; (-) strand; PAM type: YTN; PAM sequence: TTT
tgatgtgcgatcttagacat

SEQ ID NO: 211576 - DNA, 20 bp, Artificial Sequence
  Description of Artificial Sequence: Synthetic oligonucleotide
  Target: ATXN1; (-) strand; PAM type: YTN; PAM sequence: TTA
ttttgatgtgcgatcttaga

SEQ ID NO: 211577 - DNA, 20 bp, Artificial Sequence
  Description of Artificial Sequence: Synthetic oligonucleotide
  Target: ATXN1; (-) strand; PAM type: YTN; PAM sequence: TTT
attttgatgtgcgatcttag

SEQ ID NO: 211578 - DNA, 20 bp, Artificial Sequence
  Description of Artificial Sequence: Synthetic oligonucleotide
  Target: ATXN1; (-) strand; PAM type: YTN; PAM sequence: TTA
tcgtttattttgatgtgcga

SEQ ID NO: 211579 - DNA, 20 bp, Artificial Sequence
  Description of Artificial Sequence: Synthetic oligonucleotide
  Target: ATXN1; (-) strand; PAM type: YTN; PAM sequence: TTT
atcgtttattttgatgtgcg

SEQ ID NO: 211580 - DNA, 20 bp, Artificial Sequence
  Description of Artificial Sequence: Synthetic oligonucleotide
  Target: ATXN1; (-) strand; PAM type: YTN; PAM sequence: TTA
tatttatcgtttattttgat

SEQ ID NO: 211581 - DNA, 20 bp, Artificial Sequence
  Description of Artificial Sequence: Synthetic oligonucleotide
  Target: ATXN1; (-) strand; PAM type: YTN; PAM sequence: TTT
atatttatcgtttattttga

SEQ ID NO: 211582 - DNA, 20 bp, Artificial Sequence
  Description of Artificial Sequence: Synthetic oligonucleotide
  Target: ATXN1; (-) strand; PAM type: YTN; PAM sequence: CTC
atagtttatatttatcgttt

SEQ ID NO: 211583 - DNA, 20 bp, Artificial Sequence
  Description of Artificial Sequence: Synthetic oligonucleotide
  Target: ATXN1; (-) strand; PAM type: YTN; PAM sequence: TTA
tctcatagtttatatttatc

SEQ ID NO: 211584 - DNA, 20 bp, Artificial Sequence
  Description of Artificial Sequence: Synthetic oligonucleotide
  Target: ATXN1; (-) strand; PAM type: YTN; PAM sequence: TTA
ttatctcatagtttatattt

SEQ ID NO: 211585 - DNA, 20 bp, Artificial Sequence
  Description of Artificial Sequence: Synthetic oligonucleotide
  Target: ATXN1; (-) strand; PAM type: YTN; PAM sequence: TTT
attatctcatagtttatatt

SEQ ID NO: 211586 - DNA, 20 bp, Artificial Sequence
  Description of Artificial Sequence: Synthetic oligonucleotide
  Target: ATXN1; (-) strand; PAM type: YTN; PAM sequence: CTT
tattatctcatagtttatat

SEQ ID NO: 211587 - DNA, 20 bp, Artificial Sequence
  Description of Artificial Sequence: Synthetic oligonucleotide
  Target: ATXN1; (-) strand; PAM type: YTN; PAM sequence: TTC
tttattatctcatagtttat

SEQ ID NO: 211588 - DNA, 20 bp, Artificial Sequence
  Description of Artificial Sequence: Synthetic oligonucleotide
  Target: ATXN1; (-) strand; PAM type: YTN; PAM sequence: TTG
tagttctttattatctcata

SEQ ID NO: 211589 - DNA, 20 bp, Artificial Sequence
  Description of Artificial Sequence: Synthetic oligonucleotide
  Target: ATXN1; (-) strand; PAM type: YTN; PAM sequence: TTA
ttgtagttctttattatctc

SEQ ID NO: 211590 - DNA, 20 bp, Artificial Sequence
  Description of Artificial Sequence: Synthetic oligonucleotide
  Target: ATXN1; (-) strand; PAM type: YTN; PAM sequence: TTT
attgtagttctttattatct

SEQ ID NO: 211591 - DNA, 20 bp, Artificial Sequence
  Description of Artificial Sequence: Synthetic oligonucleotide
  Target: ATXN1; (-) strand; PAM type: YTN; PAM sequence: TTA
cccacaatttattgtagttc

SEQ ID NO: 211592 - DNA, 20 bp, Artificial Sequence
  Description of Artificial Sequence: Synthetic oligonucleotide
  Target: ATXN1; (-) strand; PAM type: YTN; PAM sequence: TTT
acccacaatttattgtagtt

SEQ ID NO: 211593 - DNA, 20 bp, Artificial Sequence
  Description of Artificial Sequence: Synthetic oligonucleotide
  Target: ATXN1; (-) strand; PAM type: YTN; PAM sequence: CTA
tttacccacaatttattgta

SEQ ID NO: 211594 - DNA, 20 bp, Artificial Sequence
  Description of Artificial Sequence: Synthetic oligonucleotide
  Target: ATXN1; (-) strand; PAM type: YTN; PAM sequence: CTA
gggtcagataactatttacc

SEQ ID NO: 211595 - DNA, 20 bp, Artificial Sequence
  Description of Artificial Sequence: Synthetic oligonucleotide
  Target: ATXN1; (-) strand; PAM type: YTN; PAM sequence: TTC
actagggtcagataactatt

SEQ ID NO: 211596 - DNA, 20 bp, Artificial Sequence
  Description of Artificial Sequence: Synthetic oligonucleotide
  Target: ATXN1; (-) strand; PAM type: YTN; PAM sequence: TTC
cattcactagggtcagataa

SEQ ID NO: 211597 - DNA, 20 bp, Artificial Sequence
  Description of Artificial Sequence: Synthetic oligonucleotide
  Target: ATXN1; (-) strand; PAM type: YTN; PAM sequence: CTT
ccattcactagggtcagata

SEQ ID NO: 211598 - DNA, 20 bp, Artificial Sequence
  Description of Artificial Sequence: Synthetic oligonucleotide
  Target: ATXN1; (-) strand; PAM type: YTN; PAM sequence: CTA
gaaaagccttccattcacta

SEQ ID NO: 211599 - DNA, 20 bp, Artificial Sequence
  Description of Artificial Sequence: Synthetic oligonucleotide
  Target: ATXN1; (-) strand; PAM type: YTN; PAM sequence: TTA
tacctagaaaagccttccat

SEQ ID NO: 211600 - DNA, 20 bp, Artificial Sequence
  Description of Artificial Sequence: Synthetic oligonucleotide
  Target: ATXN1; (-) strand; PAM type: YTN; PAM sequence: TTT
atacctagaaaagccttcca

SEQ ID NO: 211601 - DNA, 20 bp, Artificial Sequence
  Description of Artificial Sequence: Synthetic oligonucleotide
  Target: ATXN1; (-) strand; PAM type: YTN; PAM sequence: TTT
tatacctagaaaagccttcc

SEQ ID NO: 211602 - DNA, 20 bp, Artificial Sequence
  Description of Artificial Sequence: Synthetic oligonucleotide
  Target: ATXN1; (-) strand; PAM type: YTN; PAM sequence: CTT
ttatacctagaaaagccttc

SEQ ID NO: 211603 - DNA, 20 bp, Artificial Sequence
  Description of Artificial Sequence: Synthetic oligonucleotide
  Target: ATXN1; (-) strand; PAM type: YTN; PAM sequence: TTG
cttttatacctagaaaagcc

SEQ ID NO: 211604 - DNA, 20 bp, Artificial Sequence
  Description of Artificial Sequence: Synthetic oligonucleotide
  Target: ATXN1; (-) strand; PAM type: YTN; PAM sequence: TTT
gcttttatacctagaaaagc

SEQ ID NO: 211605 - DNA, 20 bp, Artificial Sequence
  Description of Artificial Sequence: Synthetic oligonucleotide
  Target: ATXN1; (-) strand; PAM type: YTN; PAM sequence: TTT
tgcttttatacctagaaaag

SEQ ID NO: 211606 - DNA, 20 bp, Artificial Sequence
  Description of Artificial Sequence: Synthetic oligonucleotide
  Target: ATXN1; (-) strand; PAM type: YTN; PAM sequence: TTT
ttgcttttatacctagaaaa

SEQ ID NO: 211607 - DNA, 20 bp, Artificial Sequence
  Description of Artificial Sequence: Synthetic oligonucleotide
  Target: ATXN1; (-) strand; PAM type: YTN; PAM sequence: TTT
tttgcttttatacctagaaa

SEQ ID NO: 211608 - DNA, 20 bp, Artificial Sequence
  Description of Artificial Sequence: Synthetic oligonucleotide
  Target: ATXN1; (-) strand; PAM type: YTN; PAM sequence: TTT
ttttgcttttatacctagaa

SEQ ID NO: 211609 - DNA, 20 bp, Artificial Sequence
  Description of Artificial Sequence: Synthetic oligonucleotide
  Target: ATXN1; (-) strand; PAM type: YTN; PAM sequence: TTT
tttttgcttttatacctaga

SEQ ID NO: 211610 - DNA, 20 bp, Artificial Sequence
  Description of Artificial Sequence: Synthetic oligonucleotide
  Target: ATXN1; (-) strand; PAM type: YTN; PAM sequence: TTT
ttttttgcttttatacctag

SEQ ID NO: 211611 - DNA, 20 bp, Artificial Sequence
  Description of Artificial Sequence: Synthetic oligonucleotide
  Target: ATXN1; (-) strand; PAM type: YTN; PAM sequence: TTT
tttttttgcttttataccta

SEQ ID NO: 211612 - DNA, 20 bp, Artificial Sequence
  Description of Artificial Sequence: Synthetic oligonucleotide
  Target: ATXN1; (-) strand; PAM type: YTN; PAM sequence: TTT
ttttttttgcttttatacct

SEQ ID NO: 211613 - DNA, 20 bp, Artificial Sequence
  Description of Artificial Sequence: Synthetic oligonucleotide
  Target: ATXN1; (-) strand; PAM type: YTN; PAM sequence: TTA
atttttttttttgcttttat

SEQ ID NO: 211614 - DNA, 20 bp, Artificial Sequence
  Description of Artificial Sequence: Synthetic oligonucleotide
  Target: ATXN1; (-) strand; PAM type: YTN; PAM sequence: TTT
aatttttttttttgctttta

SEQ ID NO: 211615 - DNA, 20 bp, Artificial Sequence
  Description of Artificial Sequence: Synthetic oligonucleotide
  Target: ATXN1; (-) strand; PAM type: YTN; PAM sequence: TTT
taatttttttttttgctttt

SEQ ID NO: 211616 - DNA, 20 bp, Artificial Sequence
  Description of Artificial Sequence: Synthetic oligonucleotide
  Target: ATXN1; (-) strand; PAM type: YTN; PAM sequence: TTT
ttaatttttttttttgcttt

SEQ ID NO: 211617 - DNA, 20 bp, Artificial Sequence
  Description of Artificial Sequence: Synthetic oligonucleotide
  Target: ATXN1; (-) strand; PAM type: YTN; PAM sequence: TTT
tttaatttttttttttgctt

SEQ ID NO: 211618 - DNA, 20 bp, Artificial Sequence
  Description of Artificial Sequence: Synthetic oligonucleotide
  Target: ATXN1; (-) strand; PAM type: YTN; PAM sequence: TTT
ttttaatttttttttttgct

SEQ ID NO: 211619 - DNA, 20 bp, Artificial Sequence
  Description of Artificial Sequence: Synthetic oligonucleotide
  Target: ATXN1; (-) strand; PAM type: YTN; PAM sequence: TTT
tttttaatttttttttttgc

SEQ ID NO: 211620 - DNA, 20 bp, Artificial Sequence
  Description of Artificial Sequence: Synthetic oligonucleotide
  Target: ATXN1; (-) strand; PAM type: YTN; PAM sequence: TTT
ttttttaatttttttttttg

SEQ ID NO: 211621 - DNA, 20 bp, Artificial Sequence
  Description of Artificial Sequence: Synthetic oligonucleotide
  Target: ATXN1; (-) strand; PAM type: YTN; PAM sequence: CTG
caatttttttttaatttttt

SEQ ID NO: 211622 - DNA, 20 bp, Artificial Sequence
  Description of Artificial Sequence: Synthetic oligonucleotide
  Target: ATXN1; (-) strand; PAM type: YTN; PAM sequence: TTA
tggctgcaatttttttttaa

SEQ ID NO: 211623 - DNA, 20 bp, Artificial Sequence
  Description of Artificial Sequence: Synthetic oligonucleotide
  Target: ATXN1; (-) strand; PAM type: YTN; PAM sequence: TTT
atggctgcaattttttttta

SEQ ID NO: 211624 - DNA, 20 bp, Artificial Sequence
  Description of Artificial Sequence: Synthetic oligonucleotide
  Target: ATXN1; (-) strand; PAM type: YTN; PAM sequence: TTT
tatggctgcaattttttttt

SEQ ID NO: 211625 - DNA, 20 bp, Artificial Sequence
  Description of Artificial Sequence: Synthetic oligonucleotide
  Target: ATXN1; (-) strand; PAM type: YTN; PAM sequence: TTT
ttatggctgcaatttttttt

SEQ ID NO: 211626 - DNA, 20 bp, Artificial Sequence
  Description of Artificial Sequence: Synthetic oligonucleotide
  Target: ATXN1; (-) strand; PAM type: YTN; PAM sequence: TTT
tttatggctgcaattttttt

SEQ ID NO: 211627 - DNA, 20 bp, Artificial Sequence
  Description of Artificial Sequence: Synthetic oligonucleotide
  Target: ATXN1; (-) strand; PAM type: YTN; PAM sequence: CTT
ttttatggctgcaatttttt

SEQ ID NO: 211628 - DNA, 20 bp, Artificial Sequence
  Description of Artificial Sequence: Synthetic oligonucleotide
  Target: ATXN1; (-) strand; PAM type: YTN; PAM sequence: TTC
ttttttatggctgcaatttt

SEQ ID NO: 211629 - DNA, 20 bp, Artificial Sequence
  Description of Artificial Sequence: Synthetic oligonucleotide
  Target: ATXN1; (-) strand; PAM type: YTN; PAM sequence: CTC
attcttttttatggctgcaa

SEQ ID NO: 211630 - DNA, 20 bp, Artificial Sequence
  Description of Artificial Sequence: Synthetic oligonucleotide
  Target: ATXN1; (-) strand; PAM type: YTN; PAM sequence: CTG
taaaggacatgatctcattc

SEQ ID NO: 211631 - DNA, 20 bp, Artificial Sequence
  Description of Artificial Sequence: Synthetic oligonucleotide
  Target: ATXN1; (-) strand; PAM type: YTN; PAM sequence: TTC
atccatgtccctgtaaagga

SEQ ID NO: 211632 - DNA, 20 bp, Artificial Sequence
  Description of Artificial Sequence: Synthetic oligonucleotide
  Target: ATXN1; (-) strand; PAM type: YTN; PAM sequence: CTT
catccatgtccctgtaaagg

SEQ ID NO: 211633 - DNA, 20 bp, Artificial Sequence
  Description of Artificial Sequence: Synthetic oligonucleotide
  Target: ATXN1; (-) strand; PAM type: YTN; PAM sequence: TTC
cagcttcatccatgtccctg

SEQ ID NO: 211634 - DNA, 20 bp, Artificial Sequence
  Description of Artificial Sequence: Synthetic oligonucleotide
  Target: ATXN1; (-) strand; PAM type: YTN; PAM sequence: TTT
ccagcttcatccatgtccct

SEQ ID NO: 211635 - DNA, 20 bp, Artificial Sequence
  Description of Artificial Sequence: Synthetic oligonucleotide
  Target: ATXN1; (-) strand; PAM type: YTN; PAM sequence: CTG
agaatgatggtttccagctt

SEQ ID NO: 211636 - DNA, 20 bp, Artificial Sequence
  Description of Artificial Sequence: Synthetic oligonucleotide
  Target: ATXN1; (-) strand; PAM type: YTN; PAM sequence: TTG
ctgagaatgatggtttccag

SEQ ID NO: 211637 - DNA, 20 bp, Artificial Sequence
  Description of Artificial Sequence: Synthetic oligonucleotide
  Target: ATXN1; (-) strand; PAM type: YTN; PAM sequence: TTT
gctgagaatgatggtttcca

SEQ ID NO: 211638 - DNA, 20 bp, Artificial Sequence
  Description of Artificial Sequence: Synthetic oligonucleotide
  Target: ATXN1; (-) strand; PAM type: YTN; PAM sequence: TTA
gtttgctgagaatgatggtt

SEQ ID NO: 211639 - DNA, 20 bp, Artificial Sequence
  Description of Artificial Sequence: Synthetic oligonucleotide
  Target: ATXN1; (-) strand; PAM type: YTN; PAM sequence: CTG
ggttagtttgctgagaatga

SEQ ID NO: 211640 - DNA, 20 bp, Artificial Sequence
  Description of Artificial Sequence: Synthetic oligonucleotide
  Target: ATXN1; (-) strand; PAM type: YTN; PAM sequence: TTC
ctgggttagtttgctgagaa

SEQ ID NO: 211641 - DNA, 20 bp, Artificial Sequence
  Description of Artificial Sequence: Synthetic oligonucleotide
  Target: ATXN1; (-) strand; PAM type: YTN; PAM sequence: CTG
ttcctgggttagtttgctga

SEQ ID NO: 211642 - DNA, 20 bp, Artificial Sequence
  Description of Artificial Sequence: Synthetic oligonucleotide
  Target: ATXN1; (-) strand; PAM type: YTN; PAM sequence: TTC
tgttcctgggttagtttgct

SEQ ID NO: 211643 - DNA, 20 bp, Artificial Sequence
  Description of Artificial Sequence: Synthetic oligonucleotide
  Target: ATXN1; (-) strand; PAM type: YTN; PAM sequence: TTT
ctgttcctgggttagtttgc

SEQ ID NO: 211644 - DNA, 20 bp, Artificial Sequence
  Description of Artificial Sequence: Synthetic oligonucleotide
  Target: ATXN1; (-) strand; PAM type: YTN; PAM sequence: TTT
tctgttcctgggttagtttg

SEQ ID NO: 211645 - DNA, 20 bp, Artificial Sequence
  Description of Artificial Sequence: Synthetic oligonucleotide
  Target: ATXN1; (-) strand; PAM type: YTN; PAM sequence: TTG
gttttctgttcctgggttag

SEQ ID NO: 211646 - DNA, 20 bp, Artificial Sequence
  Description of Artificial Sequence: Synthetic oligonucleotide
  Target: ATXN1; (-) strand; PAM type: YTN; PAM sequence: TTT
ggttttctgttcctgggtta

SEQ ID NO: 211647 - DNA, 20 bp, Artificial Sequence
  Description of Artificial Sequence: Synthetic oligonucleotide
  Target: ATXN1; (-) strand; PAM type: YTN; PAM sequence: TTA
tgagtgagaacatgcggtgt

SEQ ID NO: 211648 - DNA, 20 bp, Artificial Sequence
  Description of Artificial Sequence: Synthetic oligonucleotide
  Target: ATXN1; (-) strand; PAM type: YTN; PAM sequence: CTT
atgagtgagaacatgcggtg

SEQ ID NO: 211649 - DNA, 20 bp, Artificial Sequence
  Description of Artificial Sequence: Synthetic oligonucleotide
  Target: ATXN1; (-) strand; PAM type: YTN; PAM sequence: CTC
ccacttatgagtgagaacat

SEQ ID NO: 211650 - DNA, 20 bp, Artificial Sequence
  Description of Artificial Sequence: Synthetic oligonucleotide
  Target: ATXN1; (-) strand; PAM type: YTN; PAM sequence: TTA
aactcccacttatgagtgag

SEQ ID NO: 211651 - DNA, 20 bp, Artificial Sequence
  Description of Artificial Sequence: Synthetic oligonucleotide
  Target: ATXN1; (-) strand; PAM type: YTN; PAM sequence: CTC
aatgttaaactcccacttat

SEQ ID NO: 211652 - DNA, 20 bp, Artificial Sequence
  Description of Artificial Sequence: Synthetic oligonucleotide
  Target: ATXN1; (-) strand; PAM type: YTN; PAM sequence: TTC
tcaatgttaaactcccactt

SEQ ID NO: 211653 - DNA, 20 bp, Artificial Sequence
  Description of Artificial Sequence: Synthetic oligonucleotide
  Target: ATXN1; (-) strand; PAM type: YTN; PAM sequence: CTG
tgtccatgtgttctcaatgt

SEQ ID NO: 211654 - DNA, 20 bp, Artificial Sequence
  Description of Artificial Sequence: Synthetic oligonucleotide
  Target: ATXN1; (-) strand; PAM type: YTN; PAM sequence: CTC
tgtgtccatgtgttctcaat

SEQ ID NO: 211655 - DNA, 20 bp, Artificial Sequence
  Description of Artificial Sequence: Synthetic oligonucleotide
  Target: ATXN1; (-) strand; PAM type: YTN; PAM sequence: CTC
tctgtgtccatgtgttctca

SEQ ID NO: 211656 - DNA, 20 bp, Artificial Sequence
  Description of Artificial Sequence: Synthetic oligonucleotide
  Target: ATXN1; (-) strand; PAM type: YTN; PAM sequence: TTC
ccctctctgtgtccatgtgt

SEQ ID NO: 211657 - DNA, 20 bp, Artificial Sequence
  Description of Artificial Sequence: Synthetic oligonucleotide
  Target: ATXN1; (-) strand; PAM type: YTN; PAM sequence: CTC
cgacaggccccggtgtgtga

SEQ ID NO: 211658 - DNA, 20 bp, Artificial Sequence
  Description of Artificial Sequence: Synthetic oligonucleotide
  Target: ATXN1; (-) strand; PAM type: YTN; PAM sequence: CTC
cctccgacaggccccggtgt

SEQ ID NO: 211659 - DNA, 20 bp, Artificial Sequence
  Description of Artificial Sequence: Synthetic oligonucleotide
  Target: ATXN1; (-) strand; PAM type: YTN; PAM sequence: TTG
tccctccctccgacaggccc

SEQ ID NO: 211660 - DNA, 20 bp, Artificial Sequence
  Description of Artificial Sequence: Synthetic oligonucleotide
  Target: ATXN1; (-) strand; PAM type: YTN; PAM sequence: CTT
gtccctccctccgacaggcc

SEQ ID NO: 211661 - DNA, 20 bp, Artificial Sequence
  Description of Artificial Sequence: Synthetic oligonucleotide
  Target: ATXN1; (-) strand; PAM type: YTN; PAM sequence: CTC
cccttgtccctccctccgac

SEQ ID NO: 211662 - DNA, 20 bp, Artificial Sequence
  Description of Artificial Sequence: Synthetic oligonucleotide
  Target: ATXN1; (-) strand; PAM type: YTN; PAM sequence: TTC
ctccccttgtccctccctcc

SEQ ID NO: 211663 - DNA, 20 bp, Artificial Sequence
  Description of Artificial Sequence: Synthetic oligonucleotide
  Target: ATXN1; (-) strand; PAM type: YTN; PAM sequence: CTT
cctccccttgtccctccctc

SEQ ID NO: 211664 - DNA, 20 bp, Artificial Sequence
  Description of Artificial Sequence: Synthetic oligonucleotide
  Target: ATXN1; (-) strand; PAM type: YTN; PAM sequence: CTC
ttcctccccttgtccctccc

SEQ ID NO: 211665 - DNA, 20 bp, Artificial Sequence
  Description of Artificial Sequence: Synthetic oligonucleotide
  Target: ATXN1; (-) strand; PAM type: YTN; PAM sequence: TTA
acactcttcctccccttgtc

SEQ ID NO: 211666 - DNA, 20 bp, Artificial Sequence
  Description of Artificial Sequence: Synthetic oligonucleotide
  Target: ATXN1; (-) strand; PAM type: YTN; PAM sequence: CTT
aacactcttcctccccttgt

SEQ ID NO: 211667 - DNA, 20 bp, Artificial Sequence
  Description of Artificial Sequence: Synthetic oligonucleotide
  Target: ATXN1; (-) strand; PAM type: YTN; PAM sequence: TTG
tcttaacactcttcctcccc

SEQ ID NO: 211668 - DNA, 20 bp, Artificial Sequence
  Description of Artificial Sequence: Synthetic oligonucleotide
  Target: ATXN1; (-) strand; PAM type: YTN; PAM sequence: TTT
gtcttaacactcttcctccc

SEQ ID NO: 211669 - DNA, 20 bp, Artificial Sequence
  Description of Artificial Sequence: Synthetic oligonucleotide
  Target: ATXN1; (-) strand; PAM type: YTN; PAM sequence: TTC
ggtatttgtcttaacactct

SEQ ID NO: 211670 - DNA, 20 bp, Artificial Sequence
  Description of Artificial Sequence: Synthetic oligonucleotide
  Target: ATXN1; (-) strand; PAM type: YTN; PAM sequence: CTG
catgcattcggtatttgtct

SEQ ID NO: 211671 - DNA, 20 bp, Artificial Sequence
  Description of Artificial Sequence: Synthetic oligonucleotide
  Target: ATXN1; (-) strand; PAM type: YTN; PAM sequence: TTA
agccctgcatgcattcggta

SEQ ID NO: 211672 - DNA, 20 bp, Artificial Sequence
  Description of Artificial Sequence: Synthetic oligonucleotide
  Target: ATXN1; (-) strand; PAM type: YTN; PAM sequence: TTT
aagccctgcatgcattcggt

SEQ ID NO: 211673 - DNA, 20 bp, Artificial Sequence
  Description of Artificial Sequence: Synthetic oligonucleotide
  Target: ATXN1; (-) strand; PAM type: YTN; PAM sequence: TTT
taagccctgcatgcattcgg

SEQ ID NO: 211674 - DNA, 20 bp, Artificial Sequence
  Description of Artificial Sequence: Synthetic oligonucleotide
  Target: ATXN1; (-) strand; PAM type: YTN; PAM sequence: CTA
ggttttaagccctgcatgca

SEQ ID NO: 211675 - DNA, 20 bp, Artificial Sequence
  Description of Artificial Sequence: Synthetic oligonucleotide
  Target: ATXN1; (-) strand; PAM type: YTN; PAM sequence: CTG
tcatctaggttttaagccct

SEQ ID NO: 211676 - DNA, 20 bp, Artificial Sequence
  Description of Artificial Sequence: Synthetic oligonucleotide
  Target: ATXN1; (-) strand; PAM type: YTN; PAM sequence: CTA
tcaacctgtcatctaggttt

SEQ ID NO: 211677 - DNA, 20 bp, Artificial Sequence
  Description of Artificial Sequence: Synthetic oligonucleotide
  Target: ATXN1; (-) strand; PAM type: YTN; PAM sequence: CTG
tacctatcaacctgtcatct

SEQ ID NO: 211678 - DNA, 20 bp, Artificial Sequence
  Description of Artificial Sequence: Synthetic oligonucleotide
  Target: ATXN1; (-) strand; PAM type: YTN; PAM sequence: TTG
ctgtacctatcaacctgtca

SEQ ID NO: 211679 - DNA, 20 bp, Artificial Sequence
  Description of Artificial Sequence: Synthetic oligonucleotide
  Target: ATXN1; (-) strand; PAM type: YTN; PAM sequence: TTT
gctgtacctatcaacctgtc

SEQ ID NO: 211680 - DNA, 20 bp, Artificial Sequence
  Description of Artificial Sequence: Synthetic oligonucleotide
  Target: ATXN1; (-) strand; PAM type: YTN; PAM sequence: TTA
cataggtatacatgtgccat

SEQ ID NO: 211681 - DNA, 20 bp, Artificial Sequence
  Description of Artificial Sequence: Synthetic oligonucleotide
  Target: ATXN1; (-) strand; PAM type: YTN; PAM sequence: TTG
ttacataggtatacatgtgc

SEQ ID NO: 211682 - DNA, 20 bp, Artificial Sequence
  Description of Artificial Sequence: Synthetic oligonucleotide
  Target: ATXN1; (-) strand; PAM type: YTN; PAM sequence: TTT
gttacataggtatacatgtg

SEQ ID NO: 211683 - DNA, 20 bp, Artificial Sequence
  Description of Artificial Sequence: Synthetic oligonucleotide
  Target: ATXN1; (-) strand; PAM type: YTN; PAM sequence: TTG
caggtttgttacataggtat

SEQ ID NO: 211684 - DNA, 20 bp, Artificial Sequence
  Description of Artificial Sequence: Synthetic oligonucleotide
  Target: ATXN1; (-) strand; PAM type: YTN; PAM sequence: CTT
gcaggtttgttacataggta

SEQ ID NO: 211685 - DNA, 20 bp, Artificial Sequence
  Description of Artificial Sequence: Synthetic oligonucleotide
  Target: ATXN1; (-) strand; PAM type: YTN; PAM sequence: CTG
ggatacacgtgcagaacttg

SEQ ID NO: 211686 - DNA, 20 bp, Artificial Sequence
  Description of Artificial Sequence: Synthetic oligonucleotide
  Target: ATXN1; (-) strand; PAM type: YTN; PAM sequence: TTC
tgggatacacgtgcagaact

SEQ ID NO: 211687 - DNA, 20 bp, Artificial Sequence
  Description of Artificial Sequence: Synthetic oligonucleotide
  Target: ATXN1; (-) strand; PAM type: YTN; PAM sequence: TTA
agttctgggatacacgtgca

SEQ ID NO: 211688 - DNA, 20 bp, Artificial Sequence
  Description of Artificial Sequence: Synthetic oligonucleotide
  Target: ATXN1; (-) strand; PAM type: YTN; PAM sequence: TTT
aagttctgggatacacgtgc

SEQ ID NO: 211689 - DNA, 20 bp, Artificial Sequence
  Description of Artificial Sequence: Synthetic oligonucleotide
  Target: ATXN1; (-) strand; PAM type: YTN; PAM sequence: CTT
taagttctgggatacacgtg

SEQ ID NO: 211690 - DNA, 20 bp, Artificial Sequence
  Description of Artificial Sequence: Synthetic oligonucleotide
  Target: ATXN1; (-) strand; PAM type: YTN; PAM sequence: TTA
ctttaagttctgggatacac

SEQ ID NO: 211691 - DNA, 20 bp, Artificial Sequence
  Description of Artificial Sequence: Synthetic oligonucleotide
  Target: ATXN1; (-) strand; PAM type: YTN; PAM sequence: TTT
actttaagttctgggataca

SEQ ID NO: 211692 - DNA, 20 bp, Artificial Sequence
  Description of Artificial Sequence: Synthetic oligonucleotide
  Target: ATXN1; (-) strand; PAM type: YTN; PAM sequence: TTT
tactttaagttctgggatac

SEQ ID NO: 211693 - DNA, 20 bp, Artificial Sequence
  Description of Artificial Sequence: Synthetic oligonucleotide
  Target: ATXN1; (-) strand; PAM type: YTN; PAM sequence: TTG
ttttactttaagttctggga

SEQ ID NO: 211694 - DNA, 20 bp, Artificial Sequence
  Description of Artificial Sequence: Synthetic oligonucleotide
  Target: ATXN1; (-) strand; PAM type: YTN; PAM sequence: TTT
gttttactttaagttctggg

SEQ ID NO: 211695 - DNA, 20 bp, Artificial Sequence
  Description of Artificial Sequence: Synthetic oligonucleotide
  Target: ATXN1; (-) strand; PAM type: YTN; PAM sequence: TTG
tttgttttactttaagttct

SEQ ID NO: 211696 - DNA, 20 bp, Artificial Sequence
  Description of Artificial Sequence: Synthetic oligonucleotide
  Target: ATXN1; (-) strand; PAM type: YTN; PAM sequence: TTT
gtttgttttactttaagttc

SEQ ID NO: 211697 - DNA, 20 bp, Artificial Sequence
  Description of Artificial Sequence: Synthetic oligonucleotide
  Target: ATXN1; (-) strand; PAM type: YTN; PAM sequence: TTT
tgtttgttttactttaagtt

SEQ ID NO: 211698 - DNA, 20 bp, Artificial Sequence
  Description of Artificial Sequence: Synthetic oligonucleotide
  Target: ATXN1; (-) strand; PAM type: YTN; PAM sequence: TTG
ttttgtttgttttactttaa

SEQ ID NO: 211699 - DNA, 20 bp, Artificial Sequence
  Description of Artificial Sequence: Synthetic oligonucleotide
  Target: ATXN1; (-) strand; PAM type: YTN; PAM sequence: TTT
gttttgtttgttttacttta

SEQ ID NO: 211700 - DNA, 20 bp, Artificial Sequence
  Description of Artificial Sequence: Synthetic oligonucleotide
  Target: ATXN1; (-) strand; PAM type: YTN; PAM sequence: TTT
tgttttgtttgttttacttt

SEQ ID NO: 211701 - DNA, 20 bp, Artificial Sequence
  Description of Artificial Sequence: Synthetic oligonucleotide
  Target: ATXN1; (-) strand; PAM type: YTN; PAM sequence: CTT
ttgttttgtttgttttactt

SEQ ID NO: 211702 - DNA, 20 bp, Artificial Sequence
  Description of Artificial Sequence: Synthetic oligonucleotide
  Target: ATXN1; (-) strand; PAM type: YTN; PAM sequence: TTC
ttttgttttgtttgttttac

SEQ ID NO: 211703 - DNA, 20 bp, Artificial Sequence
  Description of Artificial Sequence: Synthetic oligonucleotide
  Target: ATXN1; (-) strand; PAM type: YTN; PAM sequence: CTG
aattcttttgttttgtttgt

SEQ ID NO: 211704 - DNA, 20 bp, Artificial Sequence
  Description of Artificial Sequence: Synthetic oligonucleotide
  Target: ATXN1; (-) strand; PAM type: YTN; PAM sequence: CTG
cctgaattcttttgttttgt

SEQ ID NO: 211705 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccacacc

SEQ ID NO: 211706 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 211707 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 211708 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 211709 - DNA, 20 bp, Artificial Sequence
  Description of Artificial Sequence: Synthetic oligonucleotide
  Target: ATXN1; (-) strand; PAM type: YTN; PAM sequence: CTG
cctcggcctcccaaagtgct

SEQ ID NO: 211710 - DNA, 20 bp, Artificial Sequence
  Description of Artificial Sequence: Synthetic oligonucleotide
  Target: ATXN1; (-) strand; PAM type: YTN; PAM sequence: CTC
aggtgatccatctgcctcgg

SEQ ID NO: 211711 - DNA, 20 bp, Artificial Sequence
  Description of Artificial Sequence: Synthetic oligonucleotide
  Target: ATXN1; (-) strand; PAM type: YTN; PAM sequence: CTC
gtgacctcaggtgatccatc

SEQ ID NO: 211712 - DNA, 20 bp, Artificial Sequence
  Description of Artificial Sequence: Synthetic oligonucleotide
  Target: ATXN1; (-) strand; PAM type: YTN; PAM sequence: CTG
gtcacgaactcgtgacctca

SEQ ID NO: 211713 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtcacgaactc

SEQ ID NO: 211714 - DNA, 20 bp, Artificial Sequence
  Description of Artificial Sequence: Synthetic oligonucleotide
  Target: ATXN1; (-) strand; PAM type: YTN; PAM sequence: TTC
gccatgttggccaggctggt

SEQ ID NO: 211715 - DNA, 20 bp, Artificial Sequence
  Description of Artificial Sequence: Synthetic oligonucleotide
  Target: ATXN1; (-) strand; PAM type: YTN; PAM sequence: TTT
cgccatgttggccaggctgg

SEQ ID NO: 211716 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttcgcca

SEQ ID NO: 211717 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttcgcc

SEQ ID NO: 211718 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttcgc

SEQ ID NO: 211719 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttcg

SEQ ID NO: 211720 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 211721 - DNA, 20 bp, Artificial Sequence
  Description of Artificial Sequence: Synthetic oligonucleotide
  Target: ATXN1; (-) strand; PAM type: YTN; PAM sequence: CTT
gtatttttagtagagatggg

SEQ ID NO: 211722 - DNA, 20 bp, Artificial Sequence
  Description of Artificial Sequence: Synthetic oligonucleotide
  Target: ATXN1; (-) strand; PAM type: YTN; PAM sequence: TTC
ttgtatttttagtagagatg

SEQ ID NO: 211723 - DNA, 20 bp, Artificial Sequence
  Description of Artificial Sequence: Synthetic oligonucleotide
  Target: ATXN1; (-) strand; PAM type: YTN; PAM sequence: TTT
cttgtatttttagtagagat

SEQ ID NO: 211724 - DNA, 20 bp, Artificial Sequence
  Description of Artificial Sequence: Synthetic oligonucleotide
  Target: ATXN1; (-) strand; PAM type: YTN; PAM sequence: CTA
atttcttgtatttttagtag

SEQ ID NO: 211725 - DNA, 20 bp, Artificial Sequence
  Description of Artificial Sequence: Synthetic oligonucleotide
  Target: ATXN1; (-) strand; PAM type: YTN; PAM sequence: CTA
caggtgtgtaccaccacgtc

SEQ ID NO: 211726 - DNA, 20 bp, Artificial Sequence
  Description of Artificial Sequence: Synthetic oligonucleotide
  Target: ATXN1; (-) strand; PAM type: YTN; PAM sequence: CTC
cagactacaggtgtgtacca

SEQ ID NO: 211727 - DNA, 20 bp, Artificial Sequence
  Description of Artificial Sequence: Synthetic oligonucleotide
  Target: ATXN1; (-) strand; PAM type: YTN; PAM sequence: TTC
agcctccagactacaggtgt

SEQ ID NO: 211728 - DNA, 20 bp, Artificial Sequence
  Description of Artificial Sequence: Synthetic oligonucleotide
  Target: ATXN1; (-) strand; PAM type: YTN; PAM sequence: CTT
cagcctccagactacaggtg

SEQ ID NO: 211729 - DNA, 20 bp, Artificial Sequence
  Description of Artificial Sequence: Synthetic oligonucleotide
  Target: ATXN1; (-) strand; PAM type: YTN; PAM sequence: CTG
cttcagcctccagactacag

SEQ ID NO: 211730 - DNA, 20 bp, Artificial Sequence
  Description of Artificial Sequence: Synthetic oligonucleotide
  Target: ATXN1; (-) strand; PAM type: YTN; PAM sequence: CTC
ctgcttcagcctccagacta

SEQ ID NO: 211731 - DNA, 20 bp, Artificial Sequence
  Description of Artificial Sequence: Synthetic oligonucleotide
  Target: ATXN1; (-) strand; PAM type: YTN; PAM sequence: TTC
tcctgcttcagcctccagac

SEQ ID NO: 211732 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgcttcag

SEQ ID NO: 211733 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagcgattctcc

SEQ ID NO: 211734 - DNA, 20 bp, Artificial Sequence
  Description of Artificial Sequence: Synthetic oligonucleotide
  Target: ATXN1; (-) strand; PAM type: YTN; PAM sequence: CTC
cgcctcccgggttcaagcga

SEQ ID NO: 211735 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctcccgggtt

SEQ ID NO: 211736 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcctcccg

SEQ ID NO: 211737 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacctccgcct

SEQ ID NO: 211738 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacctccgcc

SEQ ID NO: 211739 - DNA, 20 bp, Artificial Sequence
  Description of Artificial Sequence: Synthetic oligonucleotide
  Target: ATXN1; (-) strand; PAM type: YTN; PAM sequence: CTG
cagtgcagtggcacgatctt

SEQ ID NO: 211740 - DNA, 20 bp, Artificial Sequence
  Description of Artificial Sequence: Synthetic oligonucleotide
  Target: ATXN1; (-) strand; PAM type: YTN; PAM sequence: CTG
ccacccaggctgcagtgcag

SEQ ID NO: 211741 - DNA, 20 bp, Artificial Sequence
  Description of Artificial Sequence: Synthetic oligonucleotide
  Target: ATXN1; (-) strand; PAM type: YTN; PAM sequence: CTC
tgccacccaggctgcagtgc

SEQ ID NO: 211742 - DNA, 20 bp, Artificial Sequence
  Description of Artificial Sequence: Synthetic oligonucleotide
  Target: ATXN1; (-) strand; PAM type: YTN; PAM sequence: CTC
gctctgccacccaggctgca

SEQ ID NO: 211743 - DNA, 20 bp, Artificial Sequence
  Description of Artificial Sequence: Synthetic oligonucleotide
  Target: ATXN1; (-) strand; PAM type: YTN; PAM sequence: TTG
agacggagtctcgctctgcc

SEQ ID NO: 211744 - DNA, 20 bp, Artificial Sequence
  Description of Artificial Sequence: Synthetic oligonucleotide
  Target: ATXN1; (-) strand; PAM type: YTN; PAM sequence: TTT
gagacggagtctcgctctgc

SEQ ID NO: 211745 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtctcgctctg

SEQ ID NO: 211746 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagtctcgctct

SEQ ID NO: 211747 - DNA, 20 bp, Artificial Sequence
  Description of Artificial Sequence: Synthetic oligonucleotide
  Target: ATXN1; (-) strand; PAM type: YTN; PAM sequence: TTT
tttgagacggagtctcgctc

SEQ ID NO: 211748 - DNA, 20 bp, Artificial Sequence
  Description of Artificial Sequence: Synthetic oligonucleotide
  Target: ATXN1; (-) strand; PAM type: YTN; PAM sequence: TTT
ttttgagacggagtctcgct

SEQ ID NO: 211749 - DNA, 20 bp, Artificial Sequence
  Description of Artificial Sequence: Synthetic oligonucleotide
  Target: ATXN1; (-) strand; PAM type: YTN; PAM sequence: TTT
tttttgagacggagtctcgc

SEQ ID NO: 211750 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacggagtctcg

SEQ ID NO: 211751 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacggagtctc

SEQ ID NO: 211752 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacggagtct

SEQ ID NO: 211753 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacggagtc

SEQ ID NO: 211754 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacggagt

SEQ ID NO: 211755 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacggag

SEQ ID NO: 211756 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacgga

SEQ ID NO: 211757 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacgg

SEQ ID NO: 211758 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagacg

SEQ ID NO: 211759 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttgagac

SEQ ID NO: 211760 - DNA, 20 bp, Artificial Sequence
  Description of Artificial Sequence: Synthetic oligonucleotide
  Target: ATXN1; (-) strand; PAM type: YTN; PAM sequence: TTG
aatccttttttttttttttt

SEQ ID NO: 211761 - DNA, 20 bp, Artificial Sequence
  Description of Artificial Sequence: Synthetic oligonucleotide
  Target: ATXN1; (-) strand; PAM type: YTN; PAM sequence: TTC
ccacagttgaatcctttttt

SEQ ID NO: 211762 - DNA, 20 bp, Artificial Sequence
  Description of Artificial Sequence: Synthetic oligonucleotide
  Target: ATXN1; (-) strand; PAM type: YTN; PAM sequence: TTT
cccacagttgaatccttttt

SEQ ID NO: 211763 - DNA, 20 bp, Artificial Sequence
  Description of Artificial Sequence: Synthetic oligonucleotide
  Target: ATXN1; (-) strand; PAM type: YTN; PAM sequence: TTT
tcccacagttgaatcctttt

SEQ ID NO: 211764 - DNA, 20 bp, Artificial Sequence
  Description of Artificial Sequence: Synthetic oligonucleotide
  Target: ATXN1; (-) strand; PAM type: YTN; PAM sequence: TTT
ttcccacagttgaatccttt

SEQ ID NO: 211765 - DNA, 20 bp, Artificial Sequence
  Description of Artificial Sequence: Synthetic oligonucleotide
  Target: ATXN1; (-) strand; PAM type: YTN; PAM sequence: TTT
tttcccacagttgaatcctt

SEQ ID NO: 211766 - DNA, 20 bp, Artificial Sequence
  Description of Artificial Sequence: Synthetic oligonucleotide
  Target: ATXN1; (-) strand; PAM type: YTN; PAM sequence: TTT
ttttcccacagttgaatcct

SEQ ID NO: 211767 - DNA, 20 bp, Artificial Sequence
  Description of Artificial Sequence: Synthetic oligonucleotide
  Target: ATXN1; (-) strand; PAM type: YTN; PAM sequence: TTT
tttttcccacagttgaatcc

SEQ ID NO: 211768 - DNA, 20 bp, Artificial Sequence
  Description of Artificial Sequence: Synthetic oligonucleotide
  Target: ATXN1; (-) strand; PAM type: YTN; PAM sequence: TTT
ttttttcccacagttgaatc

SEQ ID NO: 211769 - DNA, 20 bp, Artificial Sequence
  Description of Artificial Sequence: Synthetic oligonucleotide
  Target: ATXN1; (-) strand; PAM type: YTN; PAM sequence: TTT
tttttttcccacagttgaat

SEQ ID NO: 211770 - DNA, 20 bp, Artificial Sequence
  Description of Artificial Sequence: Synthetic oligonucleotide
  Target: ATXN1; (-) strand; PAM type: YTN; PAM sequence: TTT
ttttttttcccacagttgaa

SEQ ID NO: 211771 - DNA, 20 bp, Artificial Sequence
  Description of Artificial Sequence: Synthetic oligonucleotide
  Target: ATXN1; (-) strand; PAM type: YTN; PAM sequence: CTT
tttttttttcccacagttga

SEQ ID NO: 211772 - DNA, 20 bp, Artificial Sequence
  Description of Artificial Sequence: Synthetic oligonucleotide
  Target: ATXN1; (-) strand; PAM type: YTN; PAM sequence: TTG
ctttttttttttcccacagt

SEQ ID NO: 211773 - DNA, 20 bp, Artificial Sequence
  Description of Artificial Sequence: Synthetic oligonucleotide
  Target: ATXN1; (-) strand; PAM type: YTN; PAM sequence: TTT
gctttttttttttcccacag

SEQ ID NO: 211774 - DNA, 20 bp, Artificial Sequence
  Description of Artificial Sequence: Synthetic oligonucleotide
  Target: ATXN1; (-) strand; PAM type: YTN; PAM sequence: TTT
tgctttttttttttcccaca

SEQ ID NO: 211775 - DNA, 20 bp, Artificial Sequence
  Description of Artificial Sequence: Synthetic oligonucleotide
  Target: ATXN1; (-) strand; PAM type: YTN; PAM sequence: TTC
aaaaagtgttttgctttttt

SEQ ID NO: 211776 - DNA, 20 bp, Artificial Sequence
  Description of Artificial Sequence: Synthetic oligonucleotide
  Target: ATXN1; (-) strand; PAM type: YTN; PAM sequence: TTT
caaaaagtgttttgcttttt

SEQ ID NO: 211777 - DNA, 20 bp, Artificial Sequence
  Description of Artificial Sequence: Synthetic oligonucleotide
  Target: ATXN1; (-) strand; PAM type: YTN; PAM sequence: TTT
tcaaaaagtgttttgctttt

SEQ ID NO: 211778 - DNA, 20 bp, Artificial Sequence
  Description of Artificial Sequence: Synthetic oligonucleotide
  Target: ATXN1; (-) strand; PAM type: YTN; PAM sequence: TTA
ataattttcaaaaagtgttt

SEQ ID NO: 211779 - DNA, 20 bp, Artificial Sequence
  Description of Artificial Sequence: Synthetic oligonucleotide
  Target: ATXN1; (-) strand; PAM type: YTN; PAM sequence: CTG
tgtagtcaagcatattaata

SEQ ID NO: 211780 - DNA, 20 bp, Artificial Sequence
  Description of Artificial Sequence: Synthetic oligonucleotide
  Target: ATXN1; (-) strand; PAM type: YTN; PAM sequence: TTA
caaaatcaaaatatctgtgt

SEQ ID NO: 211781 - DNA, 20 bp, Artificial Sequence
  Description of Artificial Sequence: Synthetic oligonucleotide
  Target: ATXN1; (-) strand; PAM type: YTN; PAM sequence: TTT
acaaaatcaaaatatctgtg

SEQ ID NO: 211782 - DNA, 20 bp, Artificial Sequence
  Description of Artificial Sequence: Synthetic oligonucleotide
  Target: ATXN1; (-) strand; PAM type: YTN; PAM sequence: TTA
tttacaaaatcaaaatatct

SEQ ID NO: 211783 - DNA, 20 bp, Artificial Sequence
  Description of Artificial Sequence: Synthetic oligonucleotide
  Target: ATXN1; (-) strand; PAM type: YTN; PAM sequence: TTT
atttacaaaatcaaaatatc

SEQ ID NO: 211784 - DNA, 20 bp, Artificial Sequence
  Description of Artificial Sequence: Synthetic oligonucleotide
  Target: ATXN1; (-) strand; PAM type: YTN; PAM sequence: TTT
tatttacaaaatcaaaatat

SEQ ID NO: 211785 - DNA, 20 bp, Artificial Sequence
  Description of Artificial Sequence: Synthetic oligonucleotide
  Target: ATXN1; (-) strand; PAM type: YTN; PAM sequence: TTT
ttatttacaaaatcaaaata

SEQ ID NO: 211786 - DNA, 20 bp, Artificial Sequence
  Description of Artificial Sequence: Synthetic oligonucleotide
  Target: ATXN1; (-) strand; PAM type: YTN; PAM sequence: TTG
atttttatttacaaaatcaa

SEQ ID NO: 211787 - DNA, 20 bp, Artificial Sequence
  Description of Artificial Sequence: Synthetic oligonucleotide
  Target: ATXN1; (-) strand; PAM type: YTN; PAM sequence: TTA
cgttgatttttatttacaaa

SEQ ID NO: 211788 - DNA, 20 bp, Artificial Sequence
  Description of Artificial Sequence: Synthetic oligonucleotide
  Target: ATXN1; (-) strand; PAM type: YTN; PAM sequence: CTT
acgttgatttttatttacaa

SEQ ID NO: 211789 - DNA, 20 bp, Artificial Sequence
  Description of Artificial Sequence: Synthetic oligonucleotide
  Target: ATXN1; (-) strand; PAM type: YTN; PAM sequence: TTA
cttacgttgatttttattta

SEQ ID NO: 211790 - DNA, 20 bp, Artificial Sequence
  Description of Artificial Sequence: Synthetic oligonucleotide
  Target: ATXN1; (-) strand; PAM type: YTN; PAM sequence: TTT
acttacgttgatttttattt

SEQ ID NO: 211791 - DNA, 20 bp, Artificial Sequence
  Description of Artificial Sequence: Synthetic oligonucleotide
  Target: ATXN1; (-) strand; PAM type: YTN; PAM sequence: TTT
tacttacgttgatttttatt

SEQ ID NO: 211792 - DNA, 20 bp, Artificial Sequence
  Description of Artificial Sequence: Synthetic oligonucleotide
  Target: ATXN1; (-) strand; PAM type: YTN; PAM sequence: TTG
aattttacttacgttgattt

SEQ ID NO: 211793 - DNA, 20 bp, Artificial Sequence
  Description of Artificial Sequence: Synthetic oligonucleotide
  Target: ATXN1; (-) strand; PAM type: YTN; PAM sequence: TTT
gaattttacttacgttgatt

SEQ ID NO: 211794 - DNA, 20 bp, Artificial Sequence
  Description of Artificial Sequence: Synthetic oligonucleotide
  Target: ATXN1; (-) strand; PAM type: YTN; PAM sequence: CTT
tgaattttacttacgttgat

SEQ ID NO: 211795 - DNA, 20 bp, Artificial Sequence
  Description of Artificial Sequence: Synthetic oligonucleotide
  Target: ATXN1; (-) strand; PAM type: YTN; PAM sequence: TTC
ctttgaattttacttacgtt

SEQ ID NO: 211796 - DNA, 20 bp, Artificial Sequence
  Description of Artificial Sequence: Synthetic oligonucleotide
  Target: ATXN1; (-) strand; PAM type: YTN; PAM sequence: TTT
cctttgaattttacttacgt

SEQ ID NO: 211797 - DNA, 20 bp, Artificial Sequence
  Description of Artificial Sequence: Synthetic oligonucleotide
  Target: ATXN1; (-) strand; PAM type: YTN; PAM sequence: TTT
tcctttgaattttacttacg

SEQ ID NO: 211798 - DNA, 20 bp, Artificial Sequence
  Description of Artificial Sequence: Synthetic oligonucleotide
  Target: ATXN1; (-) strand; PAM type: YTN; PAM sequence: TTG
atattttcctttgaatttta

SEQ ID NO: 211799 - DNA, 20 bp, Artificial Sequence
  Description of Artificial Sequence: Synthetic oligonucleotide
  Target: ATXN1; (-) strand; PAM type: YTN; PAM sequence: TTT
gatattttcctttgaatttt

SEQ ID NO: 211800 - DNA, 20 bp, Artificial Sequence
  Description of Artificial Sequence: Synthetic oligonucleotide
  Target: ATXN1; (-) strand; PAM type: YTN; PAM sequence: CTT
tgatattttcctttgaattt

SEQ ID NO: 211801 - DNA, 20 bp, Artificial Sequence
  Description of Artificial Sequence: Synthetic oligonucleotide
  Target: ATXN1; (-) strand; PAM type: YTN; PAM sequence: TTC
ccactttgatattttccttt

SEQ ID NO: 211802 - DNA, 20 bp, Artificial Sequence
  Description of Artificial Sequence: Synthetic oligonucleotide
  Target: ATXN1; (-) strand; PAM type: YTN; PAM sequence: TTT
cccactttgatattttcctt

SEQ ID NO: 211803 - DNA, 20 bp, Artificial Sequence
  Description of Artificial Sequence: Synthetic oligonucleotide
  Target: ATXN1; (-) strand; PAM type: YTN; PAM sequence: TTT
tcccactttgatattttcct

SEQ ID NO: 211804 - DNA, 20 bp, Artificial Sequence
  Description of Artificial Sequence: Synthetic oligonucleotide
  Target: ATXN1; (-) strand; PAM type: YTN; PAM sequence: TTT
ttcccactttgatattttcc

SEQ ID NO: 211805 - DNA, 20 bp, Artificial Sequence
  Description of Artificial Sequence: Synthetic oligonucleotide
  Target: ATXN1; (-) strand; PAM type: YTN; PAM sequence: TTG
gaaatatttttcccactttg

SEQ ID NO: 211806 - DNA, 20 bp, Artificial Sequence
  Description of Artificial Sequence: Synthetic oligonucleotide
  Target: ATXN1; (-) strand; PAM type: YTN; PAM sequence: TTA
atggtattggaaatattttt

SEQ ID NO: 211807 - DNA, 20 bp, Artificial Sequence
  Description of Artificial Sequence: Synthetic oligonucleotide
  Target: ATXN1; (-) strand; PAM type: YTN; PAM sequence: TTT
aatggtattggaaatatttt

SEQ ID NO: 211808 - DNA, 20 bp, Artificial Sequence
  Description of Artificial Sequence: Synthetic oligonucleotide
  Target: ATXN1; (-) strand; PAM type: YTN; PAM sequence: TTG
tttaatggtattggaaatat

SEQ ID NO: 211809 - DNA, 20 bp, Artificial Sequence
  Description of Artificial Sequence: Synthetic oligonucleotide
  Target: ATXN1; (-) strand; PAM type: YTN; PAM sequence: TTT
gtttaatggtattggaaata

SEQ ID NO: 211810 - DNA, 20 bp, Artificial Sequence
  Description of Artificial Sequence: Synthetic oligonucleotide
  Target: ATXN1; (-) strand; PAM type: YTN; PAM sequence: CTT
tgtttaatggtattggaaat

SEQ ID NO: 211811 - DNA, 20 bp, Artificial Sequence
  Description of Artificial Sequence: Synthetic oligonucleotide
  Target: ATXN1; (-) strand; PAM type: YTN; PAM sequence: CTC
tttgtttaatggtattggaa

SEQ ID NO: 211812 - DNA, 20 bp, Artificial Sequence
  Description of Artificial Sequence: Synthetic oligonucleotide
  Target: ATXN1; (-) strand; PAM type: YTN; PAM sequence: TTA
actctttgtttaatggtatt

SEQ ID NO: 211813 - DNA, 20 bp, Artificial Sequence
  Description of Artificial Sequence: Synthetic oligonucleotide
  Target: ATXN1; (-) strand; PAM type: YTN; PAM sequence: TTA
aggatattaactctttgttt

SEQ ID NO: 211814 - DNA, 20 bp, Artificial Sequence
  Description of Artificial Sequence: Synthetic oligonucleotide
  Target: ATXN1; (-) strand; PAM type: YTN; PAM sequence: TTG
tattaaggatattaactctt

SEQ ID NO: 211815 - DNA, 20 bp, Artificial Sequence
  Description of Artificial Sequence: Synthetic oligonucleotide
  Target: ATXN1; (-) strand; PAM type: YTN; PAM sequence: TTT
gtattaaggatattaactct

SEQ ID NO: 211816 - DNA, 20 bp, Artificial Sequence
  Description of Artificial Sequence: Synthetic oligonucleotide
  Target: ATXN1; (-) strand; PAM type: YTN; PAM sequence: TTT
tgtattaaggatattaactc

SEQ ID NO: 211817 - DNA, 20 bp, Artificial Sequence
  Description of Artificial Sequence: Synthetic oligonucleotide
  Target: ATXN1; (-) strand; PAM type: YTN; PAM sequence: TTA
ttttgtattaaggatattaa

SEQ ID NO: 211818 - DNA, 20 bp, Artificial Sequence
  Description of Artificial Sequence: Synthetic oligonucleotide
  Target: ATXN1; (-) strand; PAM type: YTN; PAM sequence: TTT
attttgtattaaggatatta

SEQ ID NO: 211819 - DNA, 20 bp, Artificial Sequence
  Description of Artificial Sequence: Synthetic oligonucleotide
  Target: ATXN1; (-) strand; PAM type: YTN; PAM sequence: TTA
catgtatttattttgtatta

SEQ ID NO: 211820 - DNA, 20 bp, Artificial Sequence
  Description of Artificial Sequence: Synthetic oligonucleotide
  Target: ATXN1; (-) strand; PAM type: YTN; PAM sequence: CTC
acaattacatgtatttattt

SEQ ID NO: 211821 - DNA, 20 bp, Artificial Sequence
  Description of Artificial Sequence: Synthetic oligonucleotide
  Target: ATXN1; (-) strand; PAM type: YTN; PAM sequence: TTA
ctcacaattacatgtattta

SEQ ID NO: 211822 - DNA, 20 bp, Artificial Sequence
  Description of Artificial Sequence: Synthetic oligonucleotide
  Target: ATXN1; (-) strand; PAM type: YTN; PAM sequence: TTT
actcacaattacatgtattt

SEQ ID NO: 211823 - DNA, 20 bp, Artificial Sequence
  Description of Artificial Sequence: Synthetic oligonucleotide
  Target: ATXN1; (-) strand; PAM type: YTN; PAM sequence: TTT
tactcacaattacatgtatt

SEQ ID NO: 211824 - DNA, 20 bp, Artificial Sequence
  Description of Artificial Sequence: Synthetic oligonucleotide
  Target: ATXN1; (-) strand; PAM type: YTN; PAM sequence: CTT
ttactcacaattacatgtat

SEQ ID NO: 211825 - DNA, 20 bp, Artificial Sequence
  Description of Artificial Sequence: Synthetic oligonucleotide
  Target: ATXN1; (-) strand; PAM type: YTN; PAM sequence: TTC
cttttactcacaattacatg

SEQ ID NO: 211826 - DNA, 20 bp, Artificial Sequence
  Description of Artificial Sequence: Synthetic oligonucleotide
  Target: ATXN1; (-) strand; PAM type: YTN; PAM sequence: TTT
ccttttactcacaattacat

SEQ ID NO: 211827 - DNA, 20 bp, Artificial Sequence
  Description of Artificial Sequence: Synthetic oligonucleotide
  Target: ATXN1; (-) strand; PAM type: YTN; PAM sequence: TTT
tccttttactcacaattaca

SEQ ID NO: 211828 - DNA, 20 bp, Artificial Sequence
  Description of Artificial Sequence: Synthetic oligonucleotide
  Target: ATXN1; (-) strand; PAM type: YTN; PAM sequence: TTT
ttccttttactcacaattac

SEQ ID NO: 211829 - DNA, 20 bp, Artificial Sequence
  Description of Artificial Sequence: Synthetic oligonucleotide
  Target: ATXN1; (-) strand; PAM type: YTN; PAM sequence: TTA
gaaagtttttccttttactc

SEQ ID NO: 211830 - DNA, 20 bp, Artificial Sequence
  Description of Artificial Sequence: Synthetic oligonucleotide
  Target: ATXN1; (-) strand; PAM type: YTN; PAM sequence: CTT
agaaagtttttccttttact

SEQ ID NO: 211831 - DNA, 20 bp, Artificial Sequence
  Description of Artificial Sequence: Synthetic oligonucleotide
  Target: ATXN1; (-) strand; PAM type: YTN; PAM sequence: TTG
tcttagaaagtttttccttt

SEQ ID NO: 211832 - DNA, 20 bp, Artificial Sequence
  Description of Artificial Sequence: Synthetic oligonucleotide
  Target: ATXN1; (-) strand; PAM type: YTN; PAM sequence: TTT
gtcttagaaagtttttcctt

SEQ ID NO: 211833 - DNA, 20 bp, Artificial Sequence
  Description of Artificial Sequence: Synthetic oligonucleotide
  Target: ATXN1; (-) strand; PAM type: YTN; PAM sequence: TTT
tgtcttagaaagtttttcct

SEQ ID NO: 211834 - DNA, 20 bp, Artificial Sequence
  Description of Artificial Sequence: Synthetic oligonucleotide
  Target: ATXN1; (-) strand; PAM type: YTN; PAM sequence: TTT
ttgtcttagaaagtttttcc

SEQ ID NO: 211835 - DNA, 20 bp, Artificial Sequence
  Description of Artificial Sequence: Synthetic oligonucleotide
  Target: ATXN1; (-) strand; PAM type: YTN; PAM sequence: TTA
tttttgtcttagaaagtttt

SEQ ID NO: 211836 - DNA, 20 bp, Artificial Sequence
  Description of Artificial Sequence: Synthetic oligonucleotide
  Target: ATXN1; (-) strand; PAM type: YTN; PAM sequence: CTT
atttttgtcttagaaagttt

SEQ ID NO: 211837 - DNA, 20 bp, Artificial Sequence
  Description of Artificial Sequence: Synthetic oligonucleotide
  Target: ATXN1; (-) strand; PAM type: YTN; PAM sequence: TTG
cttatttttgtcttagaaag

SEQ ID NO: 211838 - DNA, 20 bp, Artificial Sequence
  Description of Artificial Sequence: Synthetic oligonucleotide
  Target: ATXN1; (-) strand; PAM type: YTN; PAM sequence: TTC
attgcttatttttgtcttag

SEQ ID NO: 211839 - DNA, 20 bp, Artificial Sequence
  Description of Artificial Sequence: Synthetic oligonucleotide
  Target: ATXN1; (-) strand; PAM type: YTN; PAM sequence: TTC
gtgttcattgcttatttttg

SEQ ID NO: 211840 - DNA, 20 bp, Artificial Sequence
  Description of Artificial Sequence: Synthetic oligonucleotide
  Target: ATXN1; (-) strand; PAM type: YTN; PAM sequence: TTG
gccattcgtgttcattgctt

SEQ ID NO: 211841 - DNA, 20 bp, Artificial Sequence
  Description of Artificial Sequence: Synthetic oligonucleotide
  Target: ATXN1; (-) strand; PAM type: YTN; PAM sequence: TTA
aattggccattcgtgttcat

SEQ ID NO: 211842 - DNA, 20 bp, Artificial Sequence
  Description of Artificial Sequence: Synthetic oligonucleotide
  Target: ATXN1; (-) strand; PAM type: YTN; PAM sequence: TTT
aaattggccattcgtgttca

SEQ ID NO: 211843 - DNA, 20 bp, Artificial Sequence
  Description of Artificial Sequence: Synthetic oligonucleotide
  Target: ATXN1; (-) strand; PAM type: YTN; PAM sequence: TTT
taaattggccattcgtgttc

SEQ ID NO: 211844 - DNA, 20 bp, Artificial Sequence
  Description of Artificial Sequence: Synthetic oligonucleotide
  Target: ATXN1; (-) strand; PAM type: YTN; PAM sequence: TTT
ttaaattggccattcgtgtt

SEQ ID NO: 211845 - DNA, 20 bp, Artificial Sequence
  Description of Artificial Sequence: Synthetic oligonucleotide
  Target: ATXN1; (-) strand; PAM type: YTN; PAM sequence: TTT
tttaaattggccattcgtgt

SEQ ID NO: 211846 - DNA, 20 bp, Artificial Sequence
  Description of Artificial Sequence: Synthetic oligonucleotide
  Target: ATXN1; (-) strand; PAM type: YTN; PAM sequence: CTT
ttttaaattggccattcgtg

SEQ ID NO: 211847 - DNA, 20 bp, Artificial Sequence
  Description of Artificial Sequence: Synthetic oligonucleotide
  Target: ATXN1; (-) strand; PAM type: YTN; PAM sequence: TTC
ttttttaaattggccattcg

SEQ ID NO: 211848 - DNA, 20 bp, Artificial Sequence
  Description of Artificial Sequence: Synthetic oligonucleotide
  Target: ATXN1; (-) strand; PAM type: YTN; PAM sequence: TTT
cttttttaaattggccattc

SEQ ID NO: 211849 - DNA, 20 bp, Artificial Sequence
  Description of Artificial Sequence: Synthetic oligonucleotide
  Target: ATXN1; (-) strand; PAM type: YTN; PAM sequence: TTA
catttcttttttaaattggc

SEQ ID NO: 211850 - DNA, 20 bp, Artificial Sequence
  Description of Artificial Sequence: Synthetic oligonucleotide
  Target: ATXN1; (-) strand; PAM type: YTN; PAM sequence: TTT
acatttcttttttaaattgg

SEQ ID NO: 211851 - DNA, 20 bp, Artificial Sequence
  Description of Artificial Sequence: Synthetic oligonucleotide
  Target: ATXN1; (-) strand; PAM type: YTN; PAM sequence: TTT
tacatttcttttttaaattg

SEQ ID NO: 211852 - DNA, 20 bp, Artificial Sequence
  Description of Artificial Sequence: Synthetic oligonucleotide
  Target: ATXN1; (-) strand; PAM type: YTN; PAM sequence: TTT
ttacatttcttttttaaatt

SEQ ID NO: 211853 - DNA, 20 bp, Artificial Sequence
  Description of Artificial Sequence: Synthetic oligonucleotide
  Target: ATXN1; (-) strand; PAM type: YTN; PAM sequence: TTT
tttacatttcttttttaaat

SEQ ID NO: 211854 - DNA, 20 bp, Artificial Sequence
  Description of Artificial Sequence: Synthetic oligonucleotide
  Target: ATXN1; (-) strand; PAM type: YTN; PAM sequence: CTG
ttttttacatttctttttta

SEQ ID NO: 211855 - DNA, 20 bp, Artificial Sequence
  Description of Artificial Sequence: Synthetic oligonucleotide
  Target: ATXN1; (-) strand; PAM type: YTN; PAM sequence: CTC
tgttttttacatttcttttt

SEQ ID NO: 211856 - DNA, 20 bp, Artificial Sequence
  Description of Artificial Sequence: Synthetic oligonucleotide
  Target: ATXN1; (-) strand; PAM type: YTN; PAM sequence: TTC
tctgttttttacatttcttt

SEQ ID NO: 211857 - DNA, 20 bp, Artificial Sequence
  Description of Artificial Sequence: Synthetic oligonucleotide
  Target: ATXN1; (-) strand; PAM type: YTN; PAM sequence: TTT
ctctgttttttacatttctt

SEQ ID NO: 211858 - DNA, 20 bp, Artificial Sequence
  Description of Artificial Sequence: Synthetic oligonucleotide
  Target: ATXN1; (-) strand; PAM type: YTN; PAM sequence: TTA
tgtttctctgttttttacat

SEQ ID NO: 211859 - DNA, 20 bp, Artificial Sequence
  Description of Artificial Sequence: Synthetic oligonucleotide
  Target: ATXN1; (-) strand; PAM type: YTN; PAM sequence: CTT
atgtttctctgttttttaca

SEQ ID NO: 211860 - DNA, 20 bp, Artificial Sequence
  Description of Artificial Sequence: Synthetic oligonucleotide
  Target: ATXN1; (-) strand; PAM type: YTN; PAM sequence: TTC
cttatgtttctctgtttttt

SEQ ID NO: 211861 - DNA, 20 bp, Artificial Sequence
  Description of Artificial Sequence: Synthetic oligonucleotide
  Target: ATXN1; (-) strand; PAM type: YTN; PAM sequence: TTT
ccttatgtttctctgttttt

SEQ ID NO: 211862 - DNA, 20 bp, Artificial Sequence
  Description of Artificial Sequence: Synthetic oligonucleotide
  Target: ATXN1; (-) strand; PAM type: YTN; PAM sequence: TTT
tccttatgtttctctgtttt

SEQ ID NO: 211863 - DNA, 20 bp, Artificial Sequence
  Description of Artificial Sequence: Synthetic oligonucleotide
  Target: ATXN1; (-) strand; PAM type: YTN; PAM sequence: TTC
aagtgagggtggatattttc

SEQ ID NO: 211864 - DNA, 20 bp, Artificial Sequence
  Description of Artificial Sequence: Synthetic oligonucleotide
  Target: ATXN1; (-) strand; PAM type: YTN; PAM sequence: TTT
caagtgagggtggatatttt

SEQ ID NO: 211865 - DNA, 20 bp, Artificial Sequence
  Description of Artificial Sequence: Synthetic oligonucleotide
  Target: ATXN1; (-) strand; PAM type: YTN; PAM sequence: TTA
gtgtagtttcaagtgagggt

SEQ ID NO: 211866 - DNA, 20 bp, Artificial Sequence
  Description of Artificial Sequence: Synthetic oligonucleotide
  Target: ATXN1; (-) strand; PAM type: YTN; PAM sequence: TTT
agtgtagtttcaagtgaggg

SEQ ID NO: 211867 - DNA, 20 bp, Artificial Sequence
  Description of Artificial Sequence: Synthetic oligonucleotide
  Target: ATXN1; (-) strand; PAM type: YTN; PAM sequence: TTT
tagtgtagtttcaagtgagg

SEQ ID NO: 211868 - DNA, 20 bp, Artificial Sequence
  Description of Artificial Sequence: Synthetic oligonucleotide
  Target: ATXN1; (-) strand; PAM type: YTN; PAM sequence: TTT
ttagtgtagtttcaagtgag

SEQ ID NO: 211869 - DNA, 20 bp, Artificial Sequence
  Description of Artificial Sequence: Synthetic oligonucleotide
  Target: ATXN1; (-) strand; PAM type: YTN; PAM sequence: TTT
tttagtgtagtttcaagtga

SEQ ID NO: 211870 - DNA, 20 bp, Artificial Sequence
  Description of Artificial Sequence: Synthetic oligonucleotide
  Target: ATXN1; (-) strand; PAM type: YTN; PAM sequence: TTT
ttttagtgtagtttcaagtg

SEQ ID NO: 211871 - DNA, 20 bp, Artificial Sequence
  Description of Artificial Sequence: Synthetic oligonucleotide
  Target: ATXN1; (-) strand; PAM type: YTN; PAM sequence: CTT
tttttagtgtagtttcaagt

SEQ ID NO: 211872 - DNA, 20 bp, Artificial Sequence
  Description of Artificial Sequence: Synthetic oligonucleotide
  Target: ATXN1; (-) strand; PAM type: YTN; PAM sequence: TTG
ctttttttagtgtagtttca

SEQ ID NO: 211873 - DNA, 20 bp, Artificial Sequence
  Description of Artificial Sequence: Synthetic oligonucleotide
  Target: ATXN1; (-) strand; PAM type: YTN; PAM sequence: TTT
gctttttttagtgtagtttc

SEQ ID NO: 211874 - DNA, 20 bp, Artificial Sequence
  Description of Artificial Sequence: Synthetic oligonucleotide
  Target: ATXN1; (-) strand; PAM type: YTN; PAM sequence: TTA
atttgctttttttagtgtag

SEQ ID NO: 211875 - DNA, 20 bp, Artificial Sequence
  Description of Artificial Sequence: Synthetic oligonucleotide
  Target: ATXN1; (-) strand; PAM type: YTN; PAM sequence: TTT
aatttgctttttttagtgta

SEQ ID NO: 211876 - DNA, 20 bp, Artificial Sequence
  Description of Artificial Sequence: Synthetic oligonucleotide
  Target: ATXN1; (-) strand; PAM type: YTN; PAM sequence: TTT
taatttgctttttttagtgt

SEQ ID NO: 211877 - DNA, 20 bp, Artificial Sequence
  Description of Artificial Sequence: Synthetic oligonucleotide
  Target: ATXN1; (-) strand; PAM type: YTN; PAM sequence: TTG
ttttaatttgctttttttag

SEQ ID NO: 211878 - DNA, 20 bp, Artificial Sequence
  Description of Artificial Sequence: Synthetic oligonucleotide
  Target: ATXN1; (-) strand; PAM type: YTN; PAM sequence: CTT
gttttaatttgcttttttta

SEQ ID NO: 211879 - DNA, 20 bp, Artificial Sequence
  Description of Artificial Sequence: Synthetic oligonucleotide
  Target: ATXN1; (-) strand; PAM type: YTN; PAM sequence: TTA
tatcttgttttaatttgctt

SEQ ID NO: 211880 - DNA, 20 bp, Artificial Sequence
  Description of Artificial Sequence: Synthetic oligonucleotide
  Target: ATXN1; (-) strand; PAM type: YTN; PAM sequence: TTA
aaaattatatcttgttttaa

SEQ ID NO: 211881 - DNA, 20 bp, Artificial Sequence
  Description of Artificial Sequence: Synthetic oligonucleotide
  Target: ATXN1; (-) strand; PAM type: YTN; PAM sequence: TTG
ataagttaaaaattatatct

SEQ ID NO: 211882 - DNA, 20 bp, Artificial Sequence
  Description of Artificial Sequence: Synthetic oligonucleotide
  Target: ATXN1; (-) strand; PAM type: YTN; PAM sequence: TTT
gataagttaaaaattatatc

SEQ ID NO: 211883 - DNA, 20 bp, Artificial Sequence
  Description of Artificial Sequence: Synthetic oligonucleotide
  Target: ATXN1; (-) strand; PAM type: YTN; PAM sequence: CTG
ccaatttgataagttaaaaa

SEQ ID NO: 211884 - DNA, 20 bp, Artificial Sequence
  Description of Artificial Sequence: Synthetic oligonucleotide
  Target: ATXN1; (-) strand; PAM type: YTN; PAM sequence: CTC
tgccaatttgataagttaaa

SEQ ID NO: 211885 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaagaaacaaacaa

SEQ ID NO: 211886 - DNA, 20 bp, Artificial Sequence
  Description of Artificial Sequence: Synthetic oligonucleotide
  Target: ATXN1; (-) strand; PAM type: YTN; PAM sequence: CTG
taattaaaaaaaaaagaaac

SEQ ID NO: 211887 - DNA, 20 bp, Artificial Sequence
  Description of Artificial Sequence: Synthetic oligonucleotide
  Target: ATXN1; (-) strand; PAM type: YTN; PAM sequence: CTA
agtactgtaattaaaaaaaa

SEQ ID NO: 211888 - DNA, 20 bp, Artificial Sequence
  Description of Artificial Sequence: Synthetic oligonucleotide
  Target: ATXN1; (-) strand; PAM type: YTN; PAM sequence: CTG
gacaacactaagtactgtaa

SEQ ID NO: 211889 - DNA, 20 bp, Artificial Sequence
  Description of Artificial Sequence: Synthetic oligonucleotide
  Target: ATXN1; (-) strand; PAM type: YTN; PAM sequence: CTC
tggacaacactaagtactgt

SEQ ID NO: 211890 - DNA, 20 bp, Artificial Sequence
  Description of Artificial Sequence: Synthetic oligonucleotide
  Target: ATXN1; (-) strand; PAM type: YTN; PAM sequence: CTG
cactctggacaacactaagt

SEQ ID NO: 211891 - DNA, 20 bp, Artificial Sequence
  Description of Artificial Sequence: Synthetic oligonucleotide
  Target: ATXN1; (-) strand; PAM type: YTN; PAM sequence: TTC
atgtgtctgcactctggaca

SEQ ID NO: 211892 - DNA, 20 bp, Artificial Sequence
  Description of Artificial Sequence: Synthetic oligonucleotide
  Target: ATXN1; (-) strand; PAM type: YTN; PAM sequence: TTG
ccaaccatgacaaagaacgt

SEQ ID NO: 211893 - DNA, 20 bp, Artificial Sequence
  Description of Artificial Sequence: Synthetic oligonucleotide
  Target: ATXN1; (-) strand; PAM type: YTN; PAM sequence: CTT
gccaaccatgacaaagaacg

SEQ ID NO: 211894 - DNA, 20 bp, Artificial Sequence
  Description of Artificial Sequence: Synthetic oligonucleotide
  Target: ATXN1; (-) strand; PAM type: YTN; PAM sequence: TTG
agcacttgccaaccatgaca

SEQ ID NO: 211895 - DNA, 20 bp, Artificial Sequence
  Description of Artificial Sequence: Synthetic oligonucleotide
  Target: ATXN1; (-) strand; PAM type: YTN; PAM sequence: CTT
gagcacttgccaaccatgac

SEQ ID NO: 211896 - DNA, 20 bp, Artificial Sequence
  Description of Artificial Sequence: Synthetic oligonucleotide
  Target: ATXN1; (-) strand; PAM type: YTN; PAM sequence: TTC
ttgagcacttgccaaccatg

SEQ ID NO: 211897 - DNA, 20 bp, Artificial Sequence
  Description of Artificial Sequence: Synthetic oligonucleotide
  Target: ATXN1; (-) strand; PAM type: YTN; PAM sequence: CTT
cttgagcacttgccaaccat

SEQ ID NO: 211898 - DNA, 20 bp, Artificial Sequence
  Description of Artificial Sequence: Synthetic oligonucleotide
  Target: ATXN1; (-) strand; PAM type: YTN; PAM sequence: CTC
ttcttgagcacttgccaacc

SEQ ID NO: 211899 - DNA, 20 bp, Artificial Sequence
  Description of Artificial Sequence: Synthetic oligonucleotide
  Target: ATXN1; (-) strand; PAM type: YTN; PAM sequence: TTA
ctcttcttgagcacttgcca

SEQ ID NO: 211900 - DNA, 20 bp, Artificial Sequence
  Description of Artificial Sequence: Synthetic oligonucleotide
  Target: ATXN1; (-) strand; PAM type: YTN; PAM sequence: TTA
aattactcttcttgagcact

SEQ ID NO: 211901 - DNA, 20 bp, Artificial Sequence
  Description of Artificial Sequence: Synthetic oligonucleotide
  Target: ATXN1; (-) strand; PAM type: YTN; PAM sequence: TTA
ttaaattactcttcttgagc

SEQ ID NO: 211902 - DNA, 20 bp, Artificial Sequence
  Description of Artificial Sequence: Synthetic oligonucleotide
  Target: ATXN1; (-) strand; PAM type: YTN; PAM sequence: TTG
atatgtgttattaaattact

SEQ ID NO: 211903 - DNA, 20 bp, Artificial Sequence
  Description of Artificial Sequence: Synthetic oligonucleotide
  Target: ATXN1; (-) strand; PAM type: YTN; PAM sequence: TTT
gatatgtgttattaaattac

SEQ ID NO: 211904 - DNA, 20 bp, Artificial Sequence
  Description of Artificial Sequence: Synthetic oligonucleotide
  Target: ATXN1; (-) strand; PAM type: YTN; PAM sequence: TTT
tgatatgtgttattaaatta

SEQ ID NO: 211905 - DNA, 20 bp, Artificial Sequence
  Description of Artificial Sequence: Synthetic oligonucleotide
  Target: ATXN1; (-) strand; PAM type: YTN; PAM sequence: CTT
ttgatatgtgttattaaatt

SEQ ID NO: 211906 - DNA, 20 bp, Artificial Sequence
  Description of Artificial Sequence: Synthetic oligonucleotide
  Target: ATXN1; (-) strand; PAM type: YTN; PAM sequence: TTA
taaggcttttgatatgtgtt

SEQ ID NO: 211907 - DNA, 20 bp, Artificial Sequence
  Description of Artificial Sequence: Synthetic oligonucleotide
  Target: ATXN1; (-) strand; PAM type: YTN; PAM sequence: TTT
ataaggcttttgatatgtgt

SEQ ID NO: 211908 - DNA, 20 bp, Artificial Sequence
  Description of Artificial Sequence: Synthetic oligonucleotide
  Target: ATXN1; (-) strand; PAM type: YTN; PAM sequence: CTT
tataaggcttttgatatgtg

SEQ ID NO: 211909 - DNA, 20 bp, Artificial Sequence
  Description of Artificial Sequence: Synthetic oligonucleotide
  Target: ATXN1; (-) strand; PAM type: YTN; PAM sequence: CTC
aaatagtaaggccctttata

SEQ ID NO: 211910 - DNA, 20 bp, Artificial Sequence
  Description of Artificial Sequence: Synthetic oligonucleotide
  Target: ATXN1; (-) strand; PAM type: YTN; PAM sequence: CTG
gtggctcaaatagtaaggcc

SEQ ID NO: 211911 - DNA, 20 bp, Artificial Sequence
  Description of Artificial Sequence: Synthetic oligonucleotide
  Target: ATXN1; (-) strand; PAM type: YTN; PAM sequence: CTA
gagctggtggctcaaatagt

SEQ ID NO: 211912 - DNA, 20 bp, Artificial Sequence
  Description of Artificial Sequence: Synthetic oligonucleotide
  Target: ATXN1; (-) strand; PAM type: YTN; PAM sequence: TTC
cagaactagagctggtggct

SEQ ID NO: 211913 - DNA, 20 bp, Artificial Sequence
  Description of Artificial Sequence: Synthetic oligonucleotide
  Target: ATXN1; (-) strand; PAM type: YTN; PAM sequence: TTT
ccagaactagagctggtggc

SEQ ID NO: 211914 - DNA, 20 bp, Artificial Sequence
  Description of Artificial Sequence: Synthetic oligonucleotide
  Target: ATXN1; (-) strand; PAM type: YTN; PAM sequence: TTA
ggataaatttccagaactag

SEQ ID NO: 211915 - DNA, 20 bp, Artificial Sequence
  Description of Artificial Sequence: Synthetic oligonucleotide
  Target: ATXN1; (-) strand; PAM type: YTN; PAM sequence: CTT
aggataaatttccagaacta

SEQ ID NO: 211916 - DNA, 20 bp, Artificial Sequence
  Description of Artificial Sequence: Synthetic oligonucleotide
  Target: ATXN1; (-) strand; PAM type: YTN; PAM sequence: TTC
cttaggataaatttccagaa

SEQ ID NO: 211917 - DNA, 20 bp, Artificial Sequence
  Description of Artificial Sequence: Synthetic oligonucleotide
  Target: ATXN1; (-) strand; PAM type: YTN; PAM sequence: TTT
ccttaggataaatttccaga

SEQ ID NO: 211918 - DNA, 20 bp, Artificial Sequence
  Description of Artificial Sequence: Synthetic oligonucleotide
  Target: ATXN1; (-) strand; PAM type: YTN; PAM sequence: TTG
tttccttaggataaatttcc

SEQ ID NO: 211919 - DNA, 20 bp, Artificial Sequence
  Description of Artificial Sequence: Synthetic oligonucleotide
  Target: ATXN1; (-) strand; PAM type: YTN; PAM sequence: CTG
gttgtttccttaggataaat

SEQ ID NO: 211920 - DNA, 20 bp, Artificial Sequence
  Description of Artificial Sequence: Synthetic oligonucleotide
  Target: ATXN1; (-) strand; PAM type: YTN; PAM sequence: CTC
tggttgtttccttaggataa

SEQ ID NO: 211921 - DNA, 20 bp, Artificial Sequence
  Description of Artificial Sequence: Synthetic oligonucleotide
  Target: ATXN1; (-) strand; PAM type: YTN; PAM sequence: TTC
aacatctctggttgtttcct

SEQ ID NO: 211922 - DNA, 20 bp, Artificial Sequence
  Description of Artificial Sequence: Synthetic oligonucleotide
  Target: ATXN1; (-) strand; PAM type: YTN; PAM sequence: TTT
caacatctctggttgtttcc

SEQ ID NO: 211923 - DNA, 20 bp, Artificial Sequence
  Description of Artificial Sequence: Synthetic oligonucleotide
  Target: ATXN1; (-) strand; PAM type: YTN; PAM sequence: TTT
tcaacatctctggttgtttc

SEQ ID NO: 211924 - DNA, 20 bp, Artificial Sequence
  Description of Artificial Sequence: Synthetic oligonucleotide
  Target: ATXN1; (-) strand; PAM type: YTN; PAM sequence: TTT
ttcaacatctctggttgttt

SEQ ID NO: 211925 - DNA, 20 bp, Artificial Sequence
  Description of Artificial Sequence: Synthetic oligonucleotide
  Target: ATXN1; (-) strand; PAM type: YTN; PAM sequence: TTT
tttcaacatctctggttgtt

SEQ ID NO: 211926 - DNA, 20 bp, Artificial Sequence
  Description of Artificial Sequence: Synthetic oligonucleotide
  Target: ATXN1; (-) strand; PAM type: YTN; PAM sequence: CTT
ttttcaacatctctggttgt

SEQ ID NO: 211927 - DNA, 20 bp, Artificial Sequence
  Description of Artificial Sequence: Synthetic oligonucleotide
  Target: ATXN1; (-) strand; PAM type: YTN; PAM sequence: TTG
aacatatatatcttttttca

SEQ ID NO: 211928 - DNA, 20 bp, Artificial Sequence
  Description of Artificial Sequence: Synthetic oligonucleotide
  Target: ATXN1; (-) strand; PAM type: YTN; PAM sequence: CTT
gaacatatatatcttttttc

SEQ ID NO: 211929 - DNA, 20 bp, Artificial Sequence
  Description of Artificial Sequence: Synthetic oligonucleotide
  Target: ATXN1; (-) strand; PAM type: YTN; PAM sequence: TTC
ttgaacatatatatcttttt

SEQ ID NO: 211930 - DNA, 20 bp, Artificial Sequence
  Description of Artificial Sequence: Synthetic oligonucleotide
  Target: ATXN1; (-) strand; PAM type: YTN; PAM sequence: CTT
cttgaacatatatatctttt

SEQ ID NO: 211931 - DNA, 20 bp, Artificial Sequence
  Description of Artificial Sequence: Synthetic oligonucleotide
  Target: ATXN1; (-) strand; PAM type: YTN; PAM sequence: CTG
gacttcttgaacatatatat

SEQ ID NO: 211932 - DNA, 20 bp, Artificial Sequence
  Description of Artificial Sequence: Synthetic oligonucleotide
  Target: ATXN1; (-) strand; PAM type: YTN; PAM sequence: CTG
tgctggacttcttgaacata

SEQ ID NO: 211933 - DNA, 20 bp, Artificial Sequence
  Description of Artificial Sequence: Synthetic oligonucleotide
  Target: ATXN1; (-) strand; PAM type: YTN; PAM sequence: TTA
gtgatgctgtgctggacttc

SEQ ID NO: 211934 - DNA, 20 bp, Artificial Sequence
  Description of Artificial Sequence: Synthetic oligonucleotide
  Target: ATXN1; (-) strand; PAM type: YTN; PAM sequence: TTT
agtgatgctgtgctggactt

SEQ ID NO: 211935 - DNA, 20 bp, Artificial Sequence
  Description of Artificial Sequence: Synthetic oligonucleotide
  Target: ATXN1; (-) strand; PAM type: YTN; PAM sequence: CTA
tcgtttagtgatgctgtgct

SEQ ID NO: 211936 - DNA, 20 bp, Artificial Sequence
  Description of Artificial Sequence: Synthetic oligonucleotide
  Target: ATXN1; (-) strand; PAM type: YTN; PAM sequence: TTG
tgctatcgtttagtgatgct

SEQ ID NO: 211937 - DNA, 20 bp, Artificial Sequence
  Description of Artificial Sequence: Synthetic oligonucleotide
  Target: ATXN1; (-) strand; PAM type: YTN; PAM sequence: TTC
cagatattgtgctatcgttt

SEQ ID NO: 211938 - DNA, 20 bp, Artificial Sequence
  Description of Artificial Sequence: Synthetic oligonucleotide
  Target: ATXN1; (-) strand; PAM type: YTN; PAM sequence: TTT
ccagatattgtgctatcgtt

SEQ ID NO: 211939 - DNA, 20 bp, Artificial Sequence
  Description of Artificial Sequence: Synthetic oligonucleotide
  Target: ATXN1; (-) strand; PAM type: YTN; PAM sequence: TTT
tccagatattgtgctatcgt

SEQ ID NO: 211940 - DNA, 20 bp, Artificial Sequence
  Description of Artificial Sequence: Synthetic oligonucleotide
  Target: ATXN1; (-) strand; PAM type: YTN; PAM sequence: TTA
attttccagatattgtgcta

SEQ ID NO: 211941 - DNA, 20 bp, Artificial Sequence
  Description of Artificial Sequence: Synthetic oligonucleotide
  Target: ATXN1; (-) strand; PAM type: YTN; PAM sequence: TTT
aattttccagatattgtgct

SEQ ID NO: 211942 - DNA, 20 bp, Artificial Sequence
  Description of Artificial Sequence: Synthetic oligonucleotide
  Target: ATXN1; (-) strand; PAM type: YTN; PAM sequence: CTA
gcatttaattttccagatat

SEQ ID NO: 211943 - DNA, 20 bp, Artificial Sequence
  Description of Artificial Sequence: Synthetic oligonucleotide
  Target: ATXN1; (-) strand; PAM type: YTN; PAM sequence: TTA
tctagcatttaattttccag

SEQ ID NO: 211944 - DNA, 20 bp, Artificial Sequence
  Description of Artificial Sequence: Synthetic oligonucleotide
  Target: ATXN1; (-) strand; PAM type: YTN; PAM sequence: TTT
atctagcatttaattttcca

SEQ ID NO: 211945 - DNA, 20 bp, Artificial Sequence
  Description of Artificial Sequence: Synthetic oligonucleotide
  Target: ATXN1; (-) strand; PAM type: YTN; PAM sequence: CTA
tttatctagcatttaatttt

SEQ ID NO: 211946 - DNA, 20 bp, Artificial Sequence
  Description of Artificial Sequence: Synthetic oligonucleotide
  Target: ATXN1; (-) strand; PAM type: YTN; PAM sequence: TTC
catccataatctatttatct

SEQ ID NO: 211947 - DNA, 20 bp, Artificial Sequence
  Description of Artificial Sequence: Synthetic oligonucleotide
  Target: ATXN1; (-) strand; PAM type: YTN; PAM sequence: TTT
ccatccataatctatttatc

SEQ ID NO: 211948 - DNA, 20 bp, Artificial Sequence
  Description of Artificial Sequence: Synthetic oligonucleotide
  Target: ATXN1; (-) strand; PAM type: YTN; PAM sequence: CTG
taatttccatccataatcta

SEQ ID NO: 211949 - DNA, 20 bp, Artificial Sequence
  Description of Artificial Sequence: Synthetic oligonucleotide
  Target: ATXN1; (-) strand; PAM type: YTN; PAM sequence: CTC
atagatactgtaatttccat

SEQ ID NO: 211950 - DNA, 20 bp, Artificial Sequence
  Description of Artificial Sequence: Synthetic oligonucleotide
  Target: ATXN1; (-) strand; PAM type: YTN; PAM sequence: TTA
catcactcatagatactgta

SEQ ID NO: 211951 - DNA, 20 bp, Artificial Sequence
  Description of Artificial Sequence: Synthetic oligonucleotide
  Target: ATXN1; (-) strand; PAM type: YTN; PAM sequence: TTT
acatcactcatagatactgt

SEQ ID NO: 211952 - DNA, 20 bp, Artificial Sequence
  Description of Artificial Sequence: Synthetic oligonucleotide
  Target: ATXN1; (-) strand; PAM type: YTN; PAM sequence: TTT
tacatcactcatagatactg

SEQ ID NO: 211953 - DNA, 20 bp, Artificial Sequence
  Description of Artificial Sequence: Synthetic oligonucleotide
  Target: ATXN1; (-) strand; PAM type: YTN; PAM sequence: CTA
tcgtaagttttacatcactc

SEQ ID NO: 211954 - DNA, 20 bp, Artificial Sequence
  Description of Artificial Sequence: Synthetic oligonucleotide
  Target: ATXN1; (-) strand; PAM type: YTN; PAM sequence: TTA
gggcctatcgtaagttttac

SEQ ID NO: 211955 - DNA, 20 bp, Artificial Sequence
  Description of Artificial Sequence: Synthetic oligonucleotide
  Target: ATXN1; (-) strand; PAM type: YTN; PAM sequence: CTT
agggcctatcgtaagtttta

SEQ ID NO: 211956 - DNA, 20 bp, Artificial Sequence
  Description of Artificial Sequence: Synthetic oligonucleotide
  Target: ATXN1; (-) strand; PAM type: YTN; PAM sequence: TTC
aagcccacacagtgtgatct

SEQ ID NO: 211957 - DNA, 20 bp, Artificial Sequence
  Description of Artificial Sequence: Synthetic oligonucleotide
  Target: ATXN1; (-) strand; PAM type: YTN; PAM sequence: TTT
caagcccacacagtgtgatc

SEQ ID NO: 211958 - DNA, 20 bp, Artificial Sequence
  Description of Artificial Sequence: Synthetic oligonucleotide
  Target: ATXN1; (-) strand; PAM type: YTN; PAM sequence: TTT
tcaagcccacacagtgtgat

SEQ ID NO: 211959 - DNA, 20 bp, Artificial Sequence
  Description of Artificial Sequence: Synthetic oligonucleotide
  Target: ATXN1; (-) strand; PAM type: YTN; PAM sequence: CTG
tgtgattttcaagcccacac

SEQ ID NO: 211960 - DNA, 20 bp, Artificial Sequence
  Description of Artificial Sequence: Synthetic oligonucleotide
  Target: ATXN1; (-) strand; PAM type: YTN; PAM sequence: CTG
ctgtgtgattttcaagccca

SEQ ID NO: 211961 - DNA, 20 bp, Artificial Sequence
  Description of Artificial Sequence: Synthetic oligonucleotide
  Target: ATXN1; (-) strand; PAM type: YTN; PAM sequence: TTG
taaacatgctgctgtgtgat

SEQ ID NO: 211962 - DNA, 20 bp, Artificial Sequence
  Description of Artificial Sequence: Synthetic oligonucleotide
  Target: ATXN1; (-) strand; PAM type: YTN; PAM sequence: CTG
tatattgtaaacatgctgct

SEQ ID NO: 211963 - DNA, 20 bp, Artificial Sequence
  Description of Artificial Sequence: Synthetic oligonucleotide
  Target: ATXN1; (-) strand; PAM type: YTN; PAM sequence: TTA
ccaggggtctgtatattgta

SEQ ID NO: 211964 - DNA, 20 bp, Artificial Sequence
  Description of Artificial Sequence: Synthetic oligonucleotide
  Target: ATXN1; (-) strand; PAM type: YTN; PAM sequence: TTT
accaggggtctgtatattgt

SEQ ID NO: 211965 - DNA, 20 bp, Artificial Sequence
  Description of Artificial Sequence: Synthetic oligonucleotide
  Target: ATXN1; (-) strand; PAM type: YTN; PAM sequence: CTG
atatttaccaggggtctgta

SEQ ID NO: 211966 - DNA, 20 bp, Artificial Sequence
  Description of Artificial Sequence: Synthetic oligonucleotide
  Target: ATXN1; (-) strand; PAM type: YTN; PAM sequence: CTG
cctgatatttaccaggggtc

SEQ ID NO: 211967 - DNA, 20 bp, Artificial Sequence
  Description of Artificial Sequence: Synthetic oligonucleotide
  Target: ATXN1; (-) strand; PAM type: YTN; PAM sequence: CTA
gctgcctgatatttaccagg

SEQ ID NO: 211968 - DNA, 20 bp, Artificial Sequence
  Description of Artificial Sequence: Synthetic oligonucleotide
  Target: ATXN1; (-) strand; PAM type: YTN; PAM sequence: TTG
tgagctagctgcctgatatt

SEQ ID NO: 211969 - DNA, 20 bp, Artificial Sequence
  Description of Artificial Sequence: Synthetic oligonucleotide
  Target: ATXN1; (-) strand; PAM type: YTN; PAM sequence: TTT
gtgagctagctgcctgatat

SEQ ID NO: 211970 - DNA, 20 bp, Artificial Sequence
  Description of Artificial Sequence: Synthetic oligonucleotide
  Target: ATXN1; (-) strand; PAM type: YTN; PAM sequence: CTG
tttgtgagctagctgcctga

SEQ ID NO: 211971 - DNA, 20 bp, Artificial Sequence
  Description of Artificial Sequence: Synthetic oligonucleotide
  Target: ATXN1; (-) strand; PAM type: YTN; PAM sequence: TTA
ctgtttgtgagctagctgcc

SEQ ID NO: 211972 - DNA, 20 bp, Artificial Sequence
  Description of Artificial Sequence: Synthetic oligonucleotide
  Target: ATXN1; (-) strand; PAM type: YTN; PAM sequence: TTT
actgtttgtgagctagctgc

SEQ ID NO: 211973 - DNA, 20 bp, Artificial Sequence
  Description of Artificial Sequence: Synthetic oligonucleotide
  Target: ATXN1; (-) strand; PAM type: YTN; PAM sequence: CTG
atttactgtttgtgagctag

SEQ ID NO: 211974 - DNA, 20 bp, Artificial Sequence
  Description of Artificial Sequence: Synthetic oligonucleotide
  Target: ATXN1; (-) strand; PAM type: YTN; PAM sequence: CTG
ggatcatgctgatttactgt

SEQ ID NO: 211975 - DNA, 20 bp, Artificial Sequence
  Description of Artificial Sequence: Synthetic oligonucleotide
  Target: ATXN1; (-) strand; PAM type: YTN; PAM sequence: TTA
actgggatcatgctgattta

SEQ ID NO: 211976 - DNA, 20 bp, Artificial Sequence
  Description of Artificial Sequence: Synthetic oligonucleotide
  Target: ATXN1; (-) strand; PAM type: YTN; PAM sequence: TTT
aactgggatcatgctgattt

SEQ ID NO: 211977 - DNA, 20 bp, Artificial Sequence
  Description of Artificial Sequence: Synthetic oligonucleotide
  Target: ATXN1; (-) strand; PAM type: YTN; PAM sequence: TTT
taactgggatcatgctgatt

SEQ ID NO: 211978 - DNA, 20 bp, Artificial Sequence
  Description of Artificial Sequence: Synthetic oligonucleotide
  Target: ATXN1; (-) strand; PAM type: YTN; PAM sequence: TTT
ttaactgggatcatgctgat

SEQ ID NO: 211979 - DNA, 20 bp, Artificial Sequence
  Description of Artificial Sequence: Synthetic oligonucleotide
  Target: ATXN1; (-) strand; PAM type: YTN; PAM sequence: TTT
tttaactgggatcatgctga

SEQ ID NO: 211980 - DNA, 20 bp, Artificial Sequence
  Description of Artificial Sequence: Synthetic oligonucleotide
  Target: ATXN1; (-) strand; PAM type: YTN; PAM sequence: CTA
gtcatatagattttttaact

SEQ ID NO: 211981 - DNA, 20 bp, Artificial Sequence
  Description of Artificial Sequence: Synthetic oligonucleotide
  Target: ATXN1; (-) strand; PAM type: YTN; PAM sequence: CTC
tagtcatatagattttttaa

SEQ ID NO: 211982 - DNA, 20 bp, Artificial Sequence
  Description of Artificial Sequence: Synthetic oligonucleotide
  Target: ATXN1; (-) strand; PAM type: YTN; PAM sequence: TTA
gtgtctctagtcatatagat

SEQ ID NO: 211983 - DNA, 20 bp, Artificial Sequence
  Description of Artificial Sequence: Synthetic oligonucleotide
  Target: ATXN1; (-) strand; PAM type: YTN; PAM sequence: TTT
agtgtctctagtcatataga

SEQ ID NO: 211984 - DNA, 20 bp, Artificial Sequence
  Description of Artificial Sequence: Synthetic oligonucleotide
  Target: ATXN1; (-) strand; PAM type: YTN; PAM sequence: TTT
tagtgtctctagtcatatag

SEQ ID NO: 211985 - DNA, 20 bp, Artificial Sequence
  Description of Artificial Sequence: Synthetic oligonucleotide
  Target: ATXN1; (-) strand; PAM type: YTN; PAM sequence: TTT
ttagtgtctctagtcatata

SEQ ID NO: 211986 - DNA, 20 bp, Artificial Sequence
  Description of Artificial Sequence: Synthetic oligonucleotide
  Target: ATXN1; (-) strand; PAM type: YTN; PAM sequence: CTG
gaaatacagaaaagaatgca

SEQ ID NO: 211987 - DNA, 20 bp, Artificial Sequence
  Description of Artificial Sequence: Synthetic oligonucleotide
  Target: ATXN1; (-) strand; PAM type: YTN; PAM sequence: TTA
gaaaaactggaaatacagaa

SEQ ID NO: 211988 - DNA, 20 bp, Artificial Sequence
  Description of Artificial Sequence: Synthetic oligonucleotide
  Target: ATXN1; (-) strand; PAM type: YTN; PAM sequence: TTT
agaaaaactggaaatacaga

SEQ ID NO: 211989 - DNA, 20 bp, Artificial Sequence
  Description of Artificial Sequence: Synthetic oligonucleotide
  Target: ATXN1; (-) strand; PAM type: YTN; PAM sequence: TTC
atttagaaaaactggaaata

SEQ ID NO: 211990 - DNA, 20 bp, Artificial Sequence
  Description of Artificial Sequence: Synthetic oligonucleotide
  Target: ATXN1; (-) strand; PAM type: YTN; PAM sequence: CTG
atcacagaagggatgtatat

SEQ ID NO: 211991 - DNA, 20 bp, Artificial Sequence
  Description of Artificial Sequence: Synthetic oligonucleotide
  Target: ATXN1; (-) strand; PAM type: YTN; PAM sequence: TTC
cctgatcacagaagggatgt

SEQ ID NO: 211992 - DNA, 20 bp, Artificial Sequence
  Description of Artificial Sequence: Synthetic oligonucleotide
  Target: ATXN1; (-) strand; PAM type: YTN; PAM sequence: TTT
ccctgatcacagaagggatg

SEQ ID NO: 211993 - DNA, 20 bp, Artificial Sequence
  Description of Artificial Sequence: Synthetic oligonucleotide
  Target: ATXN1; (-) strand; PAM type: YTN; PAM sequence: TTG
tttccctgatcacagaaggg

SEQ ID NO: 211994 - DNA, 20 bp, Artificial Sequence
  Description of Artificial Sequence: Synthetic oligonucleotide
  Target: ATXN1; (-) strand; PAM type: YTN; PAM sequence: TTA
ttgtttccctgatcacagaa

SEQ ID NO: 211995 - DNA, 20 bp, Artificial Sequence
  Description of Artificial Sequence: Synthetic oligonucleotide
  Target: ATXN1; (-) strand; PAM type: YTN; PAM sequence: TTT
attgtttccctgatcacaga

SEQ ID NO: 211996 - DNA, 20 bp, Artificial Sequence
  Description of Artificial Sequence: Synthetic oligonucleotide
  Target: ATXN1; (-) strand; PAM type: YTN; PAM sequence: TTG
tttattgtttccctgatcac

SEQ ID NO: 211997 - DNA, 20 bp, Artificial Sequence
  Description of Artificial Sequence: Synthetic oligonucleotide
  Target: ATXN1; (-) strand; PAM type: YTN; PAM sequence: CTC
cagggcatgccccagaaatt

SEQ ID NO: 211998 - DNA, 20 bp, Artificial Sequence
  Description of Artificial Sequence: Synthetic oligonucleotide
  Target: ATXN1; (-) strand; PAM type: YTN; PAM sequence: CTG
actccagggcatgccccaga

SEQ ID NO: 211999 - DNA, 20 bp, Artificial Sequence
  Description of Artificial Sequence: Synthetic oligonucleotide
  Target: ATXN1; (-) strand; PAM type: YTN; PAM sequence: TTG
aatccaagcagtctgactcc

SEQ ID NO: 212000 - DNA, 20 bp, Artificial Sequence
  Description of Artificial Sequence: Synthetic oligonucleotide
  Target: ATXN1; (-) strand; PAM type: YTN; PAM sequence: TTT
gaatccaagcagtctgactc

SEQ ID NO: 212001 - DNA, 20 bp, Artificial Sequence
  Description of Artificial Sequence: Synthetic oligonucleotide
  Target: ATXN1; (-) strand; PAM type: YTN; PAM sequence: CTA
tgatttgaatccaagcagtc

SEQ ID NO: 212002 - DNA, 20 bp, Artificial Sequence
  Description of Artificial Sequence: Synthetic oligonucleotide
  Target: ATXN1; (-) strand; PAM type: YTN; PAM sequence: CTA
tagagctatgatttgaatcc

SEQ ID NO: 212003 - DNA, 20 bp, Artificial Sequence
  Description of Artificial Sequence: Synthetic oligonucleotide
  Target: ATXN1; (-) strand; PAM type: YTN; PAM sequence: TTG
ccacgcatggctatagagct

SEQ ID NO: 212004 - DNA, 20 bp, Artificial Sequence
  Description of Artificial Sequence: Synthetic oligonucleotide
  Target: ATXN1; (-) strand; PAM type: YTN; PAM sequence: CTA
tagtgcatgttgccacgcat

SEQ ID NO: 212005 - DNA, 20 bp, Artificial Sequence
  Description of Artificial Sequence: Synthetic oligonucleotide
  Target: ATXN1; (-) strand; PAM type: YTN; PAM sequence: CTG
ggactatagtgcatgttgcc

SEQ ID NO: 212006 - DNA, 20 bp, Artificial Sequence
  Description of Artificial Sequence: Synthetic oligonucleotide
  Target: ATXN1; (-) strand; PAM type: YTN; PAM sequence: CTG
tgtagctgggactatagtgc

SEQ ID NO: 212007 - DNA, 20 bp, Artificial Sequence
  Description of Artificial Sequence: Synthetic oligonucleotide
  Target: ATXN1; (-) strand; PAM type: YTN; PAM sequence: CTC
ctgtgtagctgggactatag

SEQ ID NO: 212008 - DNA, 20 bp, Artificial Sequence
  Description of Artificial Sequence: Synthetic oligonucleotide
  Target: ATXN1; (-) strand; PAM type: YTN; PAM sequence: CTC
agcctcctgtgtagctggga

SEQ ID NO: 212009 - DNA, 20 bp, Artificial Sequence
  Description of Artificial Sequence: Synthetic oligonucleotide
  Target: ATXN1; (-) strand; PAM type: YTN; PAM sequence: TTG
cccctcagcctcctgtgtag

SEQ ID NO: 212010 - DNA, 20 bp, Artificial Sequence
  Description of Artificial Sequence: Synthetic oligonucleotide
  Target: ATXN1; (-) strand; PAM type: YTN; PAM sequence: CTT
gcccctcagcctcctgtgta

SEQ ID NO: 212011 - DNA, 20 bp, Artificial Sequence
  Description of Artificial Sequence: Synthetic oligonucleotide
  Target: ATXN1; (-) strand; PAM type: YTN; PAM sequence: CTC
aagcgatccttgcccctcag

SEQ ID NO: 212012 - DNA, 20 bp, Artificial Sequence
  Description of Artificial Sequence: Synthetic oligonucleotide
  Target: ATXN1; (-) strand; PAM type: YTN; PAM sequence: CTG
ggctcaagcgatccttgccc

SEQ ID NO: 212013 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagcgatccttg

SEQ ID NO: 212014 - DNA, 20 bp, Artificial Sequence
  Description of Artificial Sequence: Synthetic oligonucleotide
  Target: ATXN1; (-) strand; PAM type: YTN; PAM sequence: CTC
caactcctgggctcaagcga

SEQ ID NO: 212015 - DNA, 20 bp, Artificial Sequence
  Description of Artificial Sequence: Synthetic oligonucleotide
  Target: ATXN1; (-) strand; PAM type: YTN; PAM sequence: CTG
gcctccaactcctgggctca

SEQ ID NO: 212016 - DNA, 20 bp, Artificial Sequence
  Description of Artificial Sequence: Synthetic oligonucleotide
  Target: ATXN1; (-) strand; PAM type: YTN; PAM sequence: CTC
aggctggcctccaactcctg

SEQ ID NO: 212017 - DNA, 20 bp, Artificial Sequence
  Description of Artificial Sequence: Synthetic oligonucleotide
  Target: ATXN1; (-) strand; PAM type: YTN; PAM sequence: TTG
ctcaggctggcctccaactc

SEQ ID NO: 212018 - DNA, 20 bp, Artificial Sequence
  Description of Artificial Sequence: Synthetic oligonucleotide
  Target: ATXN1; (-) strand; PAM type: YTN; PAM sequence: TTA
tgttgctcaggctggcctcc

SEQ ID NO: 212019 - DNA, 20 bp, Artificial Sequence
  Description of Artificial Sequence: Synthetic oligonucleotide
  Target: ATXN1; (-) strand; PAM type: YTN; PAM sequence: CTC
attatgttgctcaggctggc

SEQ ID NO: 212020 - DNA, 20 bp, Artificial Sequence
  Description of Artificial Sequence: Synthetic oligonucleotide
  Target: ATXN1; (-) strand; PAM type: YTN; PAM sequence: TTA
gagacggagtctcattatgt

SEQ ID NO: 212021 - DNA, 20 bp, Artificial Sequence
  Description of Artificial Sequence: Synthetic oligonucleotide
  Target: ATXN1; (-) strand; PAM type: YTN; PAM sequence: CTT
agagacggagtctcattatg

SEQ ID NO: 212022 - DNA, 20 bp, Artificial Sequence
  Description of Artificial Sequence: Synthetic oligonucleotide
  Target: ATXN1; (-) strand; PAM type: YTN; PAM sequence: TTC
ccttagagacggagtctcat

SEQ ID NO: 212023 - DNA, 20 bp, Artificial Sequence
  Description of Artificial Sequence: Synthetic oligonucleotide
  Target: ATXN1; (-) strand; PAM type: YTN; PAM sequence: TTT
cccttagagacggagtctca

SEQ ID NO: 212024 - DNA, 20 bp, Artificial Sequence
  Description of Artificial Sequence: Synthetic oligonucleotide
  Target: ATXN1; (-) strand; PAM type: YTN; PAM sequence: TTT
tcccttagagacggagtctc

SEQ ID NO: 212025 - DNA, 20 bp, Artificial Sequence
  Description of Artificial Sequence: Synthetic oligonucleotide
  Target: ATXN1; (-) strand; PAM type: YTN; PAM sequence: TTT
ttcccttagagacggagtct

SEQ ID NO: 212026 - DNA, 20 bp, Artificial Sequence
  Description of Artificial Sequence: Synthetic oligonucleotide
  Target: ATXN1; (-) strand; PAM type: YTN; PAM sequence: TTT
tttcccttagagacggagtc

SEQ ID NO: 212027 - DNA, 20 bp, Artificial Sequence
  Description of Artificial Sequence: Synthetic oligonucleotide
  Target: ATXN1; (-) strand; PAM type: YTN; PAM sequence: TTT
ttttcccttagagacggagt

SEQ ID NO: 212028 - DNA, 20 bp, Artificial Sequence
  Description of Artificial Sequence: Synthetic oligonucleotide
  Target: ATXN1; (-) strand; PAM type: YTN; PAM sequence: TTT
tttttcccttagagacggag

SEQ ID NO: 212029 - DNA, 20 bp, Artificial Sequence
  Description of Artificial Sequence: Synthetic oligonucleotide
  Target: ATXN1; (-) strand; PAM type: YTN; PAM sequence: TTT
ttttttcccttagagacgga

SEQ ID NO: 212030 - DNA, 20 bp, Artificial Sequence
  Description of Artificial Sequence: Synthetic oligonucleotide
  Target: ATXN1; (-) strand; PAM type: YTN; PAM sequence: TTT
tttttttcccttagagacgg

SEQ ID NO: 212031 - DNA, 20 bp, Artificial Sequence
  Description of Artificial Sequence: Synthetic oligonucleotide
  Target: ATXN1; (-) strand; PAM type: YTN; PAM sequence: TTT
ttttttttcccttagagacg

SEQ ID NO: 212032 - DNA, 20 bp, Artificial Sequence
  Description of Artificial Sequence: Synthetic oligonucleotide
  Target: ATXN1; (-) strand; PAM type: YTN; PAM sequence: CTT
tttttttttcccttagagac

SEQ ID NO: 212033 - DNA, 20 bp, Artificial Sequence
  Description of Artificial Sequence: Synthetic oligonucleotide
  Target: ATXN1; (-) strand; PAM type: YTN; PAM sequence: TTC
tttttttttttcccttagag

SEQ ID NO: 212034 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttcccttaga

SEQ ID NO: 212035 - DNA, 20 bp, Artificial Sequence
  Description of Artificial Sequence: Synthetic oligonucleotide
  Target: ATXN1; (-) strand; PAM type: YTN; PAM sequence: TTT
tctttttttttttcccttag

SEQ ID NO: 212036 - DNA, 20 bp, Artificial Sequence
  Description of Artificial Sequence: Synthetic oligonucleotide
  Target: ATXN1; (-) strand; PAM type: YTN; PAM sequence: TTT
ttctttttttttttccctta

SEQ ID NO: 212037 - DNA, 20 bp, Artificial Sequence
  Description of Artificial Sequence: Synthetic oligonucleotide
  Target: ATXN1; (-) strand; PAM type: YTN; PAM sequence: TTT
tttctttttttttttccctt

SEQ ID NO: 212038 - DNA, 20 bp, Artificial Sequence
  Description of Artificial Sequence: Synthetic oligonucleotide
  Target: ATXN1; (-) strand; PAM type: YTN; PAM sequence: TTT
ttttctttttttttttccct

SEQ ID NO: 212039 - DNA, 20 bp, Artificial Sequence
  Description of Artificial Sequence: Synthetic oligonucleotide
  Target: ATXN1; (-) strand; PAM type: YTN; PAM sequence: TTT
tttttctttttttttttccc

SEQ ID NO: 212040 - DNA, 20 bp, Artificial Sequence
  Description of Artificial Sequence: Synthetic oligonucleotide
  Target: ATXN1; (-) strand; PAM type: YTN; PAM sequence: TTT
ttttttctttttttttttcc

SEQ ID NO: 212041 - DNA, 20 bp, Artificial Sequence
  Description of Artificial Sequence: Synthetic oligonucleotide
  Target: ATXN1; (-) strand; PAM type: YTN; PAM sequence: TTT
tttttttctttttttttttc

SEQ ID NO: 212042 - DNA, 20 bp, Artificial Sequence
  Description of Artificial Sequence: Synthetic oligonucleotide
  Target: ATXN1; (-) strand; PAM type: YTN; PAM sequence: TTT
ttttttttcttttttttttt

SEQ ID NO: 212043 - DNA, 20 bp, Artificial Sequence
  Description of Artificial Sequence: Synthetic oligonucleotide
  Target: ATXN1; (-) strand; PAM type: YTN; PAM sequence: TTT
tttttttttctttttttttt

SEQ ID NO: 212044 - DNA, 20 bp, Artificial Sequence
  Description of Artificial Sequence: Synthetic oligonucleotide
  Target: ATXN1; (-) strand; PAM type: YTN; PAM sequence: CTA
tgttttttttttttcttttt

SEQ ID NO: 212045 - DNA, 20 bp, Artificial Sequence
  Description of Artificial Sequence: Synthetic oligonucleotide
  Target: ATXN1; (-) strand; PAM type: YTN; PAM sequence: TTA
aagtgatagagctatgtttt

SEQ ID NO: 212046 - DNA, 20 bp, Artificial Sequence
  Description of Artificial Sequence: Synthetic oligonucleotide
  Target: ATXN1; (-) strand; PAM type: YTN; PAM sequence: CTT
aaagtgatagagctatgttt

SEQ ID NO: 212047 - DNA, 20 bp, Artificial Sequence
  Description of Artificial Sequence: Synthetic oligonucleotide
  Target: ATXN1; (-) strand; PAM type: YTN; PAM sequence: TTG
cccaaggtggcagatcttaa

SEQ ID NO: 212048 - DNA, 20 bp, Artificial Sequence
  Description of Artificial Sequence: Synthetic oligonucleotide
  Target: ATXN1; (-) strand; PAM type: YTN; PAM sequence: CTT
gcccaaggtggcagatctta

SEQ ID NO: 212049 - DNA, 20 bp, Artificial Sequence
  Description of Artificial Sequence: Synthetic oligonucleotide
  Target: ATXN1; (-) strand; PAM type: YTN; PAM sequence: CTC
agagaggataagcaacttgc

SEQ ID NO: 212050 - DNA, 20 bp, Artificial Sequence
  Description of Artificial Sequence: Synthetic oligonucleotide
  Target: ATXN1; (-) strand; PAM type: YTN; PAM sequence: TTG
aggctcagagaggataagca

SEQ ID NO: 212051 - DNA, 20 bp, Artificial Sequence
  Description of Artificial Sequence: Synthetic oligonucleotide
  Target: ATXN1; (-) strand; PAM type: YTN; PAM sequence: TTG
acagaacaggaagttgaggc

SEQ ID NO: 212052 - DNA, 20 bp, Artificial Sequence
  Description of Artificial Sequence: Synthetic oligonucleotide
  Target: ATXN1; (-) strand; PAM type: YTN; PAM sequence: TTT
gacagaacaggaagttgagg

SEQ ID NO: 212053 - DNA, 20 bp, Artificial Sequence
  Description of Artificial Sequence: Synthetic oligonucleotide
  Target: ATXN1; (-) strand; PAM type: YTN; PAM sequence: TTA
gccccatttgacagaacagg

SEQ ID NO: 212054 - DNA, 20 bp, Artificial Sequence
  Description of Artificial Sequence: Synthetic oligonucleotide
  Target: ATXN1; (-) strand; PAM type: YTN; PAM sequence: TTA
ttagccccatttgacagaac

SEQ ID NO: 212055 - DNA, 20 bp, Artificial Sequence
  Description of Artificial Sequence: Synthetic oligonucleotide
  Target: ATXN1; (-) strand; PAM type: YTN; PAM sequence: TTG
ccacagcagcccaacagcat

SEQ ID NO: 212056 - DNA, 20 bp, Artificial Sequence
  Description of Artificial Sequence: Synthetic oligonucleotide
  Target: ATXN1; (-) strand; PAM type: YTN; PAM sequence: TTC
aattgccacagcagcccaac

SEQ ID NO: 212057 - DNA, 20 bp, Artificial Sequence
  Description of Artificial Sequence: Synthetic oligonucleotide
  Target: ATXN1; (-) strand; PAM type: YTN; PAM sequence: TTA
catacatgtaaaattcaatt

SEQ ID NO: 212058 - DNA, 20 bp, Artificial Sequence
  Description of Artificial Sequence: Synthetic oligonucleotide
  Target: ATXN1; (-) strand; PAM type: YTN; PAM sequence: TTT
acatacatgtaaaattcaat

SEQ ID NO: 212059 - DNA, 20 bp, Artificial Sequence
  Description of Artificial Sequence: Synthetic oligonucleotide
  Target: ATXN1; (-) strand; PAM type: YTN; PAM sequence: CTT
tacatacatgtaaaattcaa

SEQ ID NO: 212060 - DNA, 20 bp, Artificial Sequence
  Description of Artificial Sequence: Synthetic oligonucleotide
  Target: ATXN1; (-) strand; PAM type: YTN; PAM sequence: CTA
agtgctttacatacatgtaa

SEQ ID NO: 212061 - DNA, 20 bp, Artificial Sequence
  Description of Artificial Sequence: Synthetic oligonucleotide
  Target: ATXN1; (-) strand; PAM type: YTN; PAM sequence: CTG
tactaagtgctttacataca

SEQ ID NO: 212062 - DNA, 20 bp, Artificial Sequence
  Description of Artificial Sequence: Synthetic oligonucleotide
  Target: ATXN1; (-) strand; PAM type: YTN; PAM sequence: TTA
tggtccagatgctgtactaa

SEQ ID NO: 212063 - DNA, 20 bp, Artificial Sequence
  Description of Artificial Sequence: Synthetic oligonucleotide
  Target: ATXN1; (-) strand; PAM type: YTN; PAM sequence: TTA
ttatggtccagatgctgtac

SEQ ID NO: 212064 - DNA, 20 bp, Artificial Sequence
  Description of Artificial Sequence: Synthetic oligonucleotide
  Target: ATXN1; (-) strand; PAM type: YTN; PAM sequence: CTT
attatggtccagatgctgta

SEQ ID NO: 212065 - DNA, 20 bp, Artificial Sequence
  Description of Artificial Sequence: Synthetic oligonucleotide
  Target: ATXN1; (-) strand; PAM type: YTN; PAM sequence: CTC
ttattatggtccagatgctg

SEQ ID NO: 212066 - DNA, 20 bp, Artificial Sequence
  Description of Artificial Sequence: Synthetic oligonucleotide
  Target: ATXN1; (-) strand; PAM type: YTN; PAM sequence: CTA
atatataatgagctcttatt

SEQ ID NO: 212067 - DNA, 20 bp, Artificial Sequence
  Description of Artificial Sequence: Synthetic oligonucleotide
  Target: ATXN1; (-) strand; PAM type: YTN; PAM sequence: TTA
aaatcaaaataatactaata

SEQ ID NO: 212068 - DNA, 20 bp, Artificial Sequence
  Description of Artificial Sequence: Synthetic oligonucleotide
  Target: ATXN1; (-) strand; PAM type: YTN; PAM sequence: TTT
aaaatcaaaataatactaat

SEQ ID NO: 212069 - DNA, 20 bp, Artificial Sequence
  Description of Artificial Sequence: Synthetic oligonucleotide
  Target: ATXN1; (-) strand; PAM type: YTN; PAM sequence: TTT
taaaatcaaaataatactaa

SEQ ID NO: 212070 - DNA, 20 bp, Artificial Sequence
  Description of Artificial Sequence: Synthetic oligonucleotide
  Target: ATXN1; (-) strand; PAM type: YTN; PAM sequence: TTG
ttttaaaatcaaaataatac

SEQ ID NO: 212071 - DNA, 20 bp, Artificial Sequence
  Description of Artificial Sequence: Synthetic oligonucleotide
  Target: ATXN1; (-) strand; PAM type: YTN; PAM sequence: TTA
ttgttttaaaatcaaaataa

SEQ ID NO: 212072 - DNA, 20 bp, Artificial Sequence
  Description of Artificial Sequence: Synthetic oligonucleotide
  Target: ATXN1; (-) strand; PAM type: YTN; PAM sequence: TTG
aggggggttattgttttaaa

SEQ ID NO: 212073 - DNA, 20 bp, Artificial Sequence
  Description of Artificial Sequence: Synthetic oligonucleotide
  Target: ATXN1; (-) strand; PAM type: YTN; PAM sequence: TTG
gttgaggggggttattgttt

SEQ ID NO: 212074 - DNA, 20 bp, Artificial Sequence
  Description of Artificial Sequence: Synthetic oligonucleotide
  Target: ATXN1; (-) strand; PAM type: YTN; PAM sequence: TTT
ggttgaggggggttattgtt

SEQ ID NO: 212075 - DNA, 20 bp, Artificial Sequence
  Description of Artificial Sequence: Synthetic oligonucleotide
  Target: ATXN1; (-) strand; PAM type: YTN; PAM sequence: CTG
taaaagtttggttgaggggg

SEQ ID NO: 212076 - DNA, 20 bp, Artificial Sequence
  Description of Artificial Sequence: Synthetic oligonucleotide
  Target: ATXN1; (-) strand; PAM type: YTN; PAM sequence: CTA
ctgtaaaagtttggttgagg

SEQ ID NO: 212077 - DNA, 20 bp, Artificial Sequence
  Description of Artificial Sequence: Synthetic oligonucleotide
  Target: ATXN1; (-) strand; PAM type: YTN; PAM sequence: CTC
ctactgtaaaagtttggttg

SEQ ID NO: 212078 - DNA, 20 bp, Artificial Sequence
  Description of Artificial Sequence: Synthetic oligonucleotide
  Target: ATXN1; (-) strand; PAM type: YTN; PAM sequence: TTC
tcctactgtaaaagtttggt

SEQ ID NO: 212079 - DNA, 20 bp, Artificial Sequence
  Description of Artificial Sequence: Synthetic oligonucleotide
  Target: ATXN1; (-) strand; PAM type: YTN; PAM sequence: TTT
ctcctactgtaaaagtttgg

SEQ ID NO: 212080 - DNA, 20 bp, Artificial Sequence
  Description of Artificial Sequence: Synthetic oligonucleotide
  Target: ATXN1; (-) strand; PAM type: YTN; PAM sequence: CTA
gcatagaaataagatcaagg

SEQ ID NO: 212081 - DNA, 20 bp, Artificial Sequence
  Description of Artificial Sequence: Synthetic oligonucleotide
  Target: ATXN1; (-) strand; PAM type: YTN; PAM sequence: CTC
tagcatagaaataagatcaa

SEQ ID NO: 212082 - DNA, 20 bp, Artificial Sequence
  Description of Artificial Sequence: Synthetic oligonucleotide
  Target: ATXN1; (-) strand; PAM type: YTN; PAM sequence: TTC
ctctagcatagaaataagat

SEQ ID NO: 212083 - DNA, 20 bp, Artificial Sequence
  Description of Artificial Sequence: Synthetic oligonucleotide
  Target: ATXN1; (-) strand; PAM type: YTN; PAM sequence: TTT
cctctagcatagaaataaga

SEQ ID NO: 212084 - DNA, 20 bp, Artificial Sequence
  Description of Artificial Sequence: Synthetic oligonucleotide
  Target: ATXN1; (-) strand; PAM type: YTN; PAM sequence: TTT
tcctctagcatagaaataag

SEQ ID NO: 212085 - DNA, 20 bp, Artificial Sequence
  Description of Artificial Sequence: Synthetic oligonucleotide
  Target: ATXN1; (-) strand; PAM type: YTN; PAM sequence: CTT
ttcctctagcatagaaataa

SEQ ID NO: 212086 - DNA, 20 bp, Artificial Sequence
  Description of Artificial Sequence: Synthetic oligonucleotide
  Target: ATXN1; (-) strand; PAM type: YTN; PAM sequence: CTG
cttttcctctagcatagaaa

SEQ ID NO: 212087 - DNA, 20 bp, Artificial Sequence
  Description of Artificial Sequence: Synthetic oligonucleotide
  Target: ATXN1; (-) strand; PAM type: YTN; PAM sequence: CTA
ctgcttttcctctagcatag

SEQ ID NO: 212088 - DNA, 20 bp, Artificial Sequence
  Description of Artificial Sequence: Synthetic oligonucleotide
  Target: ATXN1; (-) strand; PAM type: YTN; PAM sequence: TTG
aagactactgcttttcctct

SEQ ID NO: 212089 - DNA, 20 bp, Artificial Sequence
  Description of Artificial Sequence: Synthetic oligonucleotide
  Target: ATXN1; (-) strand; PAM type: YTN; PAM sequence: TTT
gaagactactgcttttcctc

SEQ ID NO: 212090 - DNA, 20 bp, Artificial Sequence
  Description of Artificial Sequence: Synthetic oligonucleotide
  Target: ATXN1; (-) strand; PAM type: YTN; PAM sequence: CTT
tgaagactactgcttttcct

SEQ ID NO: 212091 - DNA, 20 bp, Artificial Sequence
  Description of Artificial Sequence: Synthetic oligonucleotide
  Target: ATXN1; (-) strand; PAM type: YTN; PAM sequence: TTA
cagcctttgaagactactgc

SEQ ID NO: 212092 - DNA, 20 bp, Artificial Sequence
  Description of Artificial Sequence: Synthetic oligonucleotide
  Target: ATXN1; (-) strand; PAM type: YTN; PAM sequence: TTT
acagcctttgaagactactg

SEQ ID NO: 212093 - DNA, 20 bp, Artificial Sequence
  Description of Artificial Sequence: Synthetic oligonucleotide
  Target: ATXN1; (-) strand; PAM type: YTN; PAM sequence: TTG
tgtttacagcctttgaagac

SEQ ID NO: 212094 - DNA, 20 bp, Artificial Sequence
  Description of Artificial Sequence: Synthetic oligonucleotide
  Target: ATXN1; (-) strand; PAM type: YTN; PAM sequence: TTT
gtgtttacagcctttgaaga

SEQ ID NO: 212095 - DNA, 20 bp, Artificial Sequence
  Description of Artificial Sequence: Synthetic oligonucleotide
  Target: ATXN1; (-) strand; PAM type: YTN; PAM sequence: TTT
tgtgtttacagcctttgaag

SEQ ID NO: 212096 - DNA, 20 bp, Artificial Sequence
  Description of Artificial Sequence: Synthetic oligonucleotide
  Target: ATXN1; (-) strand; PAM type: YTN; PAM sequence: TTA
acattttgtgtttacagcct

SEQ ID NO: 212097 - DNA, 20 bp, Artificial Sequence
  Description of Artificial Sequence: Synthetic oligonucleotide
  Target: ATXN1; (-) strand; PAM type: YTN; PAM sequence: TTT
aacattttgtgtttacagcc

SEQ ID NO: 212098 - DNA, 20 bp, Artificial Sequence
  Description of Artificial Sequence: Synthetic oligonucleotide
  Target: ATXN1; (-) strand; PAM type: YTN; PAM sequence: TTG
agagacagagagagagagag

SEQ ID NO: 212099 - DNA, 20 bp, Artificial Sequence
  Description of Artificial Sequence: Synthetic oligonucleotide
  Target: ATXN1; (-) strand; PAM type: YTN; PAM sequence: TTT
gagagacagagagagagaga

SEQ ID NO: 212100 - DNA, 20 bp, Artificial Sequence
  Description of Artificial Sequence: Synthetic oligonucleotide
  Target: ATXN1; (-) strand; PAM type: YTN; PAM sequence: CTG
tgtgtgtgtgtgtgtgtgtg

SEQ ID NO: 212101 - DNA, 20 bp, Artificial Sequence
  Description of Artificial Sequence: Synthetic oligonucleotide
  Target: ATXN1; (-) strand; PAM type: YTN; PAM sequence: TTC
tgtgtgtgtgtgtgtgtgtg

SEQ ID NO: 212102 - DNA, 20 bp, Artificial Sequence
  Description of Artificial Sequence: Synthetic oligonucleotide
  Target: ATXN1; (-) strand; PAM type: YTN; PAM sequence: TTC
acatattctgtgtgtgtgtg

SEQ ID NO: 212103 - DNA, 20 bp, Artificial Sequence
  Description of Artificial Sequence: Synthetic oligonucleotide
  Target: ATXN1; (-) strand; PAM type: YTN; PAM sequence: TTA
aatattcacatattctgtgt

SEQ ID NO: 212104 - DNA, 20 bp, Artificial Sequence
  Description of Artificial Sequence: Synthetic oligonucleotide
  Target: ATXN1; (-) strand; PAM type: YTN; PAM sequence: TTA
tgttaaatattcacatattc

SEQ ID NO: 212105 - DNA, 20 bp, Artificial Sequence
  Description of Artificial Sequence: Synthetic oligonucleotide
  Target: ATXN1; (-) strand; PAM type: YTN; PAM sequence: TTA
tagttatgttaaatattcac

SEQ ID NO: 212106 - DNA, 20 bp, Artificial Sequence
  Description of Artificial Sequence: Synthetic oligonucleotide
  Target: ATXN1; (-) strand; PAM type: YTN; PAM sequence: TTG
gaaattatagttatgttaaa

SEQ ID NO: 212107 - DNA, 20 bp, Artificial Sequence
  Description of Artificial Sequence: Synthetic oligonucleotide
  Target: ATXN1; (-) strand; PAM type: YTN; PAM sequence: TTA
tggttggaaattatagttat

SEQ ID NO: 212108 - DNA, 20 bp, Artificial Sequence
  Description of Artificial Sequence: Synthetic oligonucleotide
  Target: ATXN1; (-) strand; PAM type: YTN; PAM sequence: CTA
gataaatagattatggttgg

SEQ ID NO: 212109 - DNA, 20 bp, Artificial Sequence
  Description of Artificial Sequence: Synthetic oligonucleotide
  Target: ATXN1; (-) strand; PAM type: YTN; PAM sequence: TTG
aatgctagataaatagatta

SEQ ID NO: 212110 - DNA, 20 bp, Artificial Sequence
  Description of Artificial Sequence: Synthetic oligonucleotide
  Target: ATXN1; (-) strand; PAM type: YTN; PAM sequence: CTG
gagaattgaatgctagataa

SEQ ID NO: 212111 - DNA, 20 bp, Artificial Sequence
  Description of Artificial Sequence: Synthetic oligonucleotide
  Target: ATXN1; (-) strand; PAM type: YTN; PAM sequence: CTA
aacgatagcacaatatctgg

SEQ ID NO: 212112 - DNA, 20 bp, Artificial Sequence
  Description of Artificial Sequence: Synthetic oligonucleotide
  Target: ATXN1; (-) strand; PAM type: YTN; PAM sequence: TTC
aagaagtccagcacagcatc

SEQ ID NO: 212113 - DNA, 20 bp, Artificial Sequence
  Description of Artificial Sequence: Synthetic oligonucleotide
  Target: ATXN1; (-) strand; PAM type: YTN; PAM sequence: TTG
aaaaaagatatatatgttca

SEQ ID NO: 212114 - DNA, 20 bp, Artificial Sequence
  Description of Artificial Sequence: Synthetic oligonucleotide
  Target: ATXN1; (-) strand; PAM type: YTN; PAM sequence: CTA
aggaaacaaccagagatgtt

SEQ ID NO: 212115 - DNA, 20 bp, Artificial Sequence
  Description of Artificial Sequence: Synthetic oligonucleotide
  Target: ATXN1; (-) strand; PAM type: YTN; PAM sequence: TTG
tcctaaggaaacaaccagag

SEQ ID NO: 212116 - DNA, 20 bp, Artificial Sequence
  Description of Artificial Sequence: Synthetic oligonucleotide
  Target: ATXN1; (-) strand; PAM type: YTN; PAM sequence: TTT
gtcctaaggaaacaaccaga

SEQ ID NO: 212117 - DNA, 20 bp, Artificial Sequence
  Description of Artificial Sequence: Synthetic oligonucleotide
  Target: ATXN1; (-) strand; PAM type: YTN; PAM sequence: CTG
tgtgtgtatgtgtgtgtgag

SEQ ID NO: 212118 - DNA, 20 bp, Artificial Sequence
  Description of Artificial Sequence: Synthetic oligonucleotide
  Target: ATXN1; (-) strand; PAM type: YTN; PAM sequence: CTG
tctgtgtgtgtatgtgtgtg

SEQ ID NO: 212119 - DNA, 20 bp, Artificial Sequence
  Description of Artificial Sequence: Synthetic oligonucleotide
  Target: ATXN1; (-) strand; PAM type: YTN; PAM sequence: CTC
tgtctgtgtgtgtatgtgtg

SEQ ID NO: 212120 - DNA, 20 bp, Artificial Sequence
  Description of Artificial Sequence: Synthetic oligonucleotide
  Target: ATXN1; (-) strand; PAM type: YTN; PAM sequence: CTC
tctgtctgtgtgtgtatgtg

SEQ ID NO: 212121 - DNA, 20 bp, Artificial Sequence
  Description of Artificial Sequence: Synthetic oligonucleotide
  Target: ATXN1; (-) strand; PAM type: YTN; PAM sequence: CTC
tctctgtctgtgtgtgtatg

SEQ ID NO: 212122 - DNA, 20 bp, Artificial Sequence
  Description of Artificial Sequence: Synthetic oligonucleotide
  Target: ATXN1; (-) strand; PAM type: YTN; PAM sequence: CTC
tctctctgtctgtgtgtgta

SEQ ID NO: 212123 - DNA, 20 bp, Artificial Sequence
  Description of Artificial Sequence: Synthetic oligonucleotide
  Target: ATXN1; (-) strand; PAM type: YTN; PAM sequence: CTC
tctctctctgtctgtgtgtg

SEQ ID NO: 212124 - DNA, 20 bp, Artificial Sequence
  Description of Artificial Sequence: Synthetic oligonucleotide
  Target: ATXN1; (-) strand; PAM type: YTN; PAM sequence: TTC
atctctctctctctgtctgt

SEQ ID NO: 212125 - DNA, 20 bp, Artificial Sequence
  Description of Artificial Sequence: Synthetic oligonucleotide
  Target: ATXN1; (-) strand; PAM type: YTN; PAM sequence: CTT
catctctctctctctgtctg

SEQ ID NO: 212126 - DNA, 20 bp, Artificial Sequence
  Description of Artificial Sequence: Synthetic oligonucleotide
  Target: ATXN1; (-) strand; PAM type: YTN; PAM sequence: CTA
ggatatgagaatcttcatct

SEQ ID NO: 212127 - DNA, 20 bp, Artificial Sequence
  Description of Artificial Sequence: Synthetic oligonucleotide
  Target: ATXN1; (-) strand; PAM type: YTN; PAM sequence: TTA
ggatcctaggatatgagaat

SEQ ID NO: 212128 - DNA, 20 bp, Artificial Sequence
  Description of Artificial Sequence: Synthetic oligonucleotide
  Target: ATXN1; (-) strand; PAM type: YTN; PAM sequence: CTT
aggatcctaggatatgagaa

SEQ ID NO: 212129 - DNA, 20 bp, Artificial Sequence
  Description of Artificial Sequence: Synthetic oligonucleotide
  Target: ATXN1; (-) strand; PAM type: YTN; PAM sequence: TTC
ttaggatcctaggatatgag

SEQ ID NO: 212130 - DNA, 20 bp, Artificial Sequence
  Description of Artificial Sequence: Synthetic oligonucleotide
  Target: ATXN1; (-) strand; PAM type: YTN; PAM sequence: TTT
cttaggatcctaggatatga

SEQ ID NO: 212131 - DNA, 20 bp, Artificial Sequence
  Description of Artificial Sequence: Synthetic oligonucleotide
  Target: ATXN1; (-) strand; PAM type: YTN; PAM sequence: TTG
ccccaatttcttaggatcct

SEQ ID NO: 212132 - DNA, 20 bp, Artificial Sequence
  Description of Artificial Sequence: Synthetic oligonucleotide
  Target: ATXN1; (-) strand; PAM type: YTN; PAM sequence: TTA
aagattgccccaatttctta

SEQ ID NO: 212133 - DNA, 20 bp, Artificial Sequence
  Description of Artificial Sequence: Synthetic oligonucleotide
  Target: ATXN1; (-) strand; PAM type: YTN; PAM sequence: TTA
aagatgcatattaaagattg

SEQ ID NO: 212134 - DNA, 20 bp, Artificial Sequence
  Description of Artificial Sequence: Synthetic oligonucleotide
  Target: ATXN1; (-) strand; PAM type: YTN; PAM sequence: CTT
aaagatgcatattaaagatt

SEQ ID NO: 212135 - DNA, 20 bp, Artificial Sequence
  Description of Artificial Sequence: Synthetic oligonucleotide
  Target: ATXN1; (-) strand; PAM type: YTN; PAM sequence: CTC
cttaaagatgcatattaaag

SEQ ID NO: 212136 - DNA, 20 bp, Artificial Sequence
  Description of Artificial Sequence: Synthetic oligonucleotide
  Target: ATXN1; (-) strand; PAM type: YTN; PAM sequence: CTC
agatgatctccttaaagatg

SEQ ID NO: 212137 - DNA, 20 bp, Artificial Sequence
  Description of Artificial Sequence: Synthetic oligonucleotide
  Target: ATXN1; (-) strand; PAM type: YTN; PAM sequence: TTG
accaaactcagatgatctcc

SEQ ID NO: 212138 - DNA, 20 bp, Artificial Sequence
  Description of Artificial Sequence: Synthetic oligonucleotide
  Target: ATXN1; (-) strand; PAM type: YTN; PAM sequence: TTG
ggttgaccaaactcagatga

SEQ ID NO: 212139 - DNA, 20 bp, Artificial Sequence
  Description of Artificial Sequence: Synthetic oligonucleotide
  Target: ATXN1; (-) strand; PAM type: YTN; PAM sequence: CTT
gggttgaccaaactcagatg

SEQ ID NO: 212140 - DNA, 20 bp, Artificial Sequence
  Description of Artificial Sequence: Synthetic oligonucleotide
  Target: ATXN1; (-) strand; PAM type: YTN; PAM sequence: TTC
gacttgggttgaccaaactc

SEQ ID NO: 212141 - DNA, 20 bp, Artificial Sequence
  Description of Artificial Sequence: Synthetic oligonucleotide
  Target: ATXN1; (-) strand; PAM type: YTN; PAM sequence: CTT
cgacttgggttgaccaaact

SEQ ID NO: 212142 - DNA, 20 bp, Artificial Sequence
  Description of Artificial Sequence: Synthetic oligonucleotide
  Target: ATXN1; (-) strand; PAM type: YTN; PAM sequence: CTC
ttcgacttgggttgaccaaa

SEQ ID NO: 212143 - DNA, 20 bp, Artificial Sequence
  Description of Artificial Sequence: Synthetic oligonucleotide
  Target: ATXN1; (-) strand; PAM type: YTN; PAM sequence: TTA
tataacgtacctcttcgact

SEQ ID NO: 212144 - DNA, 20 bp, Artificial Sequence
  Description of Artificial Sequence: Synthetic oligonucleotide
  Target: ATXN1; (-) strand; PAM type: YTN; PAM sequence: TTT
atataacgtacctcttcgac

SEQ ID NO: 212145 - DNA, 20 bp, Artificial Sequence
  Description of Artificial Sequence: Synthetic oligonucleotide
  Target: ATXN1; (-) strand; PAM type: YTN; PAM sequence: CTT
tatataacgtacctcttcga

SEQ ID NO: 212146 - DNA, 20 bp, Artificial Sequence
  Description of Artificial Sequence: Synthetic oligonucleotide
  Target: ATXN1; (-) strand; PAM type: YTN; PAM sequence: TTC
tttatataacgtacctcttc

SEQ ID NO: 212147 - DNA, 20 bp, Artificial Sequence
  Description of Artificial Sequence: Synthetic oligonucleotide
  Target: ATXN1; (-) strand; PAM type: YTN; PAM sequence: CTT
ctttatataacgtacctctt

SEQ ID NO: 212148 - DNA, 20 bp, Artificial Sequence
  Description of Artificial Sequence: Synthetic oligonucleotide
  Target: ATXN1; (-) strand; PAM type: YTN; PAM sequence: CTA
gcttctttatataacgtacc

SEQ ID NO: 212149 - DNA, 20 bp, Artificial Sequence
  Description of Artificial Sequence: Synthetic oligonucleotide
  Target: ATXN1; (-) strand; PAM type: YTN; PAM sequence: TTA
gatcatctagcttctttata

SEQ ID NO: 212150 - DNA, 20 bp, Artificial Sequence
  Description of Artificial Sequence: Synthetic oligonucleotide
  Target: ATXN1; (-) strand; PAM type: YTN; PAM sequence: CTT
agatcatctagcttctttat

SEQ ID NO: 212151 - DNA, 20 bp, Artificial Sequence
  Description of Artificial Sequence: Synthetic oligonucleotide
  Target: ATXN1; (-) strand; PAM type: YTN; PAM sequence: TTC
ttagatcatctagcttcttt

SEQ ID NO: 212152 - DNA, 20 bp, Artificial Sequence
  Description of Artificial Sequence: Synthetic oligonucleotide
  Target: ATXN1; (-) strand; PAM type: YTN; PAM sequence: TTT
cttagatcatctagcttctt

SEQ ID NO: 212153 - DNA, 20 bp, Artificial Sequence
  Description of Artificial Sequence: Synthetic oligonucleotide
  Target: ATXN1; (-) strand; PAM type: YTN; PAM sequence: TTT
tcttagatcatctagcttct

SEQ ID NO: 212154 - DNA, 20 bp, Artificial Sequence
  Description of Artificial Sequence: Synthetic oligonucleotide
  Target: ATXN1; (-) strand; PAM type: YTN; PAM sequence: CTG
ttttcttagatcatctagct

SEQ ID NO: 212155 - DNA, 20 bp, Artificial Sequence
  Description of Artificial Sequence: Synthetic oligonucleotide
  Target: ATXN1; (-) strand; PAM type: YTN; PAM sequence: CTC
tgttttcttagatcatctag

SEQ ID NO: 212156 - DNA, 20 bp, Artificial Sequence
  Description of Artificial Sequence: Synthetic oligonucleotide
  Target: ATXN1; (-) strand; PAM type: YTN; PAM sequence: CTG
atgatcaacaacctctgttt

SEQ ID NO: 212157 - DNA, 20 bp, Artificial Sequence
  Description of Artificial Sequence: Synthetic oligonucleotide
  Target: ATXN1; (-) strand; PAM type: YTN; PAM sequence: TTG
ggggggcatatatgggccaa

SEQ ID NO: 212158 - DNA, 20 bp, Artificial Sequence
  Description of Artificial Sequence: Synthetic oligonucleotide
  Target: ATXN1; (-) strand; PAM type: YTN; PAM sequence: TTT
gggggggcatatatgggcca

SEQ ID NO: 212159 - DNA, 20 bp, Artificial Sequence
  Description of Artificial Sequence: Synthetic oligonucleotide
  Target: ATXN1; (-) strand; PAM type: YTN; PAM sequence: TTT
tgggggggcatatatgggcc

SEQ ID NO: 212160 - DNA, 20 bp, Artificial Sequence
  Description of Artificial Sequence: Synthetic oligonucleotide
  Target: ATXN1; (-) strand; PAM type: YTN; PAM sequence: CTT
ttgggggggcatatatgggc

SEQ ID NO: 212161 - DNA, 20 bp, Artificial Sequence
  Description of Artificial Sequence: Synthetic oligonucleotide
  Target: ATXN1; (-) strand; PAM type: YTN; PAM sequence: CTA
aagccttttgggggggcata

SEQ ID NO: 212162 - DNA, 20 bp, Artificial Sequence
  Description of Artificial Sequence: Synthetic oligonucleotide
  Target: ATXN1; (-) strand; PAM type: YTN; PAM sequence: CTG
tgccatggagggctaaagcc

SEQ ID NO: 212163 - DNA, 20 bp, Artificial Sequence
  Description of Artificial Sequence: Synthetic oligonucleotide
  Target: ATXN1; (-) strand; PAM type: YTN; PAM sequence: CTG
taaatacacctgtgccatgg

SEQ ID NO: 212164 - DNA, 20 bp, Artificial Sequence
  Description of Artificial Sequence: Synthetic oligonucleotide
  Target: ATXN1; (-) strand; PAM type: YTN; PAM sequence: TTG
cacacccagctgtaaataca

SEQ ID NO: 212165 - DNA, 20 bp, Artificial Sequence
  Description of Artificial Sequence: Synthetic oligonucleotide
  Target: ATXN1; (-) strand; PAM type: YTN; PAM sequence: TTT
gcacacccagctgtaaatac

SEQ ID NO: 212166 - DNA, 20 bp, Artificial Sequence
  Description of Artificial Sequence: Synthetic oligonucleotide
  Target: ATXN1; (-) strand; PAM type: YTN; PAM sequence: CTT
tgcacacccagctgtaaata

SEQ ID NO: 212167 - DNA, 20 bp, Artificial Sequence
  Description of Artificial Sequence: Synthetic oligonucleotide
  Target: ATXN1; (-) strand; PAM type: YTN; PAM sequence: TTG
gcactttgcacacccagctg

SEQ ID NO: 212168 - DNA, 20 bp, Artificial Sequence
  Description of Artificial Sequence: Synthetic oligonucleotide
  Target: ATXN1; (-) strand; PAM type: YTN; PAM sequence: CTT
ggcactttgcacacccagct

SEQ ID NO: 212169 - DNA, 20 bp, Artificial Sequence
  Description of Artificial Sequence: Synthetic oligonucleotide
  Target: ATXN1; (-) strand; PAM type: YTN; PAM sequence: CTC
cttggcactttgcacaccca

SEQ ID NO: 212170 - DNA, 20 bp, Artificial Sequence
  Description of Artificial Sequence: Synthetic oligonucleotide
  Target: ATXN1; (-) strand; PAM type: YTN; PAM sequence: CTG
aaacccagtggcatcctcct

SEQ ID NO: 212171 - DNA, 20 bp, Artificial Sequence
  Description of Artificial Sequence: Synthetic oligonucleotide
  Target: ATXN1; (-) strand; PAM type: YTN; PAM sequence: TTC
tgaaacccagtggcatcctc

SEQ ID NO: 212172 - DNA, 20 bp, Artificial Sequence
  Description of Artificial Sequence: Synthetic oligonucleotide
  Target: ATXN1; (-) strand; PAM type: YTN; PAM sequence: CTT
ctgaaacccagtggcatcct

SEQ ID NO: 212173 - DNA, 20 bp, Artificial Sequence
  Description of Artificial Sequence: Synthetic oligonucleotide
  Target: ATXN1; (-) strand; PAM type: YTN; PAM sequence: CTC
cttctgaaacccagtggcat

SEQ ID NO: 212174 - DNA, 20 bp, Artificial Sequence
  Description of Artificial Sequence: Synthetic oligonucleotide
  Target: ATXN1; (-) strand; PAM type: YTN; PAM sequence: CTG
gggctccttctgaaacccag

SEQ ID NO: 212175 - DNA, 20 bp, Artificial Sequence
  Description of Artificial Sequence: Synthetic oligonucleotide
  Target: ATXN1; (-) strand; PAM type: YTN; PAM sequence: TTC
tggggctccttctgaaaccc

SEQ ID NO: 212176 - DNA, 20 bp, Artificial Sequence
  Description of Artificial Sequence: Synthetic oligonucleotide
  Target: ATXN1; (-) strand; PAM type: YTN; PAM sequence: TTT
ctggggctccttctgaaacc

SEQ ID NO: 212177 - DNA, 20 bp, Artificial Sequence
  Description of Artificial Sequence: Synthetic oligonucleotide
  Target: ATXN1; (-) strand; PAM type: YTN; PAM sequence: CTT
tctggggctccttctgaaac

SEQ ID NO: 212178 - DNA, 20 bp, Artificial Sequence
  Description of Artificial Sequence: Synthetic oligonucleotide
  Target: ATXN1; (-) strand; PAM type: YTN; PAM sequence: CTC
cctttctggggctccttctg

SEQ ID NO: 212179 - DNA, 20 bp, Artificial Sequence
  Description of Artificial Sequence: Synthetic oligonucleotide
  Target: ATXN1; (-) strand; PAM type: YTN; PAM sequence: CTG
actccctttctggggctcct

SEQ ID NO: 212180 - DNA, 20 bp, Artificial Sequence
  Description of Artificial Sequence: Synthetic oligonucleotide
  Target: ATXN1; (-) strand; PAM type: YTN; PAM sequence: TTA
tgcagcctgactccctttct

SEQ ID NO: 212181 - DNA, 20 bp, Artificial Sequence
  Description of Artificial Sequence: Synthetic oligonucleotide
  Target: ATXN1; (-) strand; PAM type: YTN; PAM sequence: CTT
atgcagcctgactccctttc

SEQ ID NO: 212182 - DNA, 20 bp, Artificial Sequence
  Description of Artificial Sequence: Synthetic oligonucleotide
  Target: ATXN1; (-) strand; PAM type: YTN; PAM sequence: CTA
gaacttatgcagcctgactc

SEQ ID NO: 212183 - DNA, 20 bp, Artificial Sequence
  Description of Artificial Sequence: Synthetic oligonucleotide
  Target: ATXN1; (-) strand; PAM type: YTN; PAM sequence: CTG
gccagcggagtaggtggggg

SEQ ID NO: 212184 - DNA, 20 bp, Artificial Sequence
  Description of Artificial Sequence: Synthetic oligonucleotide
  Target: ATXN1; (-) strand; PAM type: YTN; PAM sequence: CTG
tgggaccacatgtggtgctg

SEQ ID NO: 212185 - DNA, 20 bp, Artificial Sequence
  Description of Artificial Sequence: Synthetic oligonucleotide
  Target: ATXN1; (-) strand; PAM type: YTN; PAM sequence: TTA
tagaggagagtgtagtcctg

SEQ ID NO: 212186 - DNA, 20 bp, Artificial Sequence
  Description of Artificial Sequence: Synthetic oligonucleotide
  Target: ATXN1; (-) strand; PAM type: YTN; PAM sequence: CTT
atagaggagagtgtagtcct

SEQ ID NO: 212187 - DNA, 20 bp, Artificial Sequence
  Description of Artificial Sequence: Synthetic oligonucleotide
  Target: ATXN1; (-) strand; PAM type: YTN; PAM sequence: TTG
cttatagaggagagtgtagt

SEQ ID NO: 212188 - DNA, 20 bp, Artificial Sequence
  Description of Artificial Sequence: Synthetic oligonucleotide
  Target: ATXN1; (-) strand; PAM type: YTN; PAM sequence: TTT
gcttatagaggagagtgtag

SEQ ID NO: 212189 - DNA, 20 bp, Artificial Sequence
  Description of Artificial Sequence: Synthetic oligonucleotide
  Target: ATXN1; (-) strand; PAM type: YTN; PAM sequence: CTT
tgcttatagaggagagtgta

SEQ ID NO: 212190 - DNA, 20 bp, Artificial Sequence
  Description of Artificial Sequence: Synthetic oligonucleotide
  Target: ATXN1; (-) strand; PAM type: YTN; PAM sequence: CTC
ctttgcttatagaggagagt

SEQ ID NO: 212191 - DNA, 20 bp, Artificial Sequence
  Description of Artificial Sequence: Synthetic oligonucleotide
  Target: ATXN1; (-) strand; PAM type: YTN; PAM sequence: TTC
tcctttgcttatagaggaga

SEQ ID NO: 212192 - DNA, 20 bp, Artificial Sequence
  Description of Artificial Sequence: Synthetic oligonucleotide
  Target: ATXN1; (-) strand; PAM type: YTN; PAM sequence: CTA
gaaagggccccagagagttc

SEQ ID NO: 212193 - DNA, 20 bp, Artificial Sequence
  Description of Artificial Sequence: Synthetic oligonucleotide
  Target: ATXN1; (-) strand; PAM type: YTN; PAM sequence: CTC
agatctagaaagggccccag

SEQ ID NO: 212194 - DNA, 20 bp, Artificial Sequence
  Description of Artificial Sequence: Synthetic oligonucleotide
  Target: ATXN1; (-) strand; PAM type: YTN; PAM sequence: TTA
gtaggacctcagatctagaa

SEQ ID NO: 212195 - DNA, 20 bp, Artificial Sequence
  Description of Artificial Sequence: Synthetic oligonucleotide
  Target: ATXN1; (-) strand; PAM type: YTN; PAM sequence: TTT
agtaggacctcagatctaga

SEQ ID NO: 212196 - DNA, 20 bp, Artificial Sequence
  Description of Artificial Sequence: Synthetic oligonucleotide
  Target: ATXN1; (-) strand; PAM type: YTN; PAM sequence: TTT
tagtaggacctcagatctag

SEQ ID NO: 212197 - DNA, 20 bp, Artificial Sequence
  Description of Artificial Sequence: Synthetic oligonucleotide
  Target: ATXN1; (-) strand; PAM type: YTN; PAM sequence: TTT
ttagtaggacctcagatcta

SEQ ID NO: 212198 - DNA, 20 bp, Artificial Sequence
  Description of Artificial Sequence: Synthetic oligonucleotide
  Target: ATXN1; (-) strand; PAM type: YTN; PAM sequence: CTT
tttagtaggacctcagatct

SEQ ID NO: 212199 - DNA, 20 bp, Artificial Sequence
  Description of Artificial Sequence: Synthetic oligonucleotide
  Target: ATXN1; (-) strand; PAM type: YTN; PAM sequence: TTG
tcaccctttttagtaggacc

SEQ ID NO: 212200 - DNA, 20 bp, Artificial Sequence
  Description of Artificial Sequence: Synthetic oligonucleotide
  Target: ATXN1; (-) strand; PAM type: YTN; PAM sequence: CTG
aggttgtcaccctttttagt

SEQ ID NO: 212201 - DNA, 20 bp, Artificial Sequence
  Description of Artificial Sequence: Synthetic oligonucleotide
  Target: ATXN1; (-) strand; PAM type: YTN; PAM sequence: TTC
agagctgaggttgtcaccct

SEQ ID NO: 212202 - DNA, 20 bp, Artificial Sequence
  Description of Artificial Sequence: Synthetic oligonucleotide
  Target: ATXN1; (-) strand; PAM type: YTN; PAM sequence: CTA
atgttcagagctgaggttgt

SEQ ID NO: 212203 - DNA, 20 bp, Artificial Sequence
  Description of Artificial Sequence: Synthetic oligonucleotide
  Target: ATXN1; (-) strand; PAM type: YTN; PAM sequence: TTG
aaataaaacaactaatgttc

SEQ ID NO: 212204 - DNA, 20 bp, Artificial Sequence
  Description of Artificial Sequence: Synthetic oligonucleotide
  Target: ATXN1; (-) strand; PAM type: YTN; PAM sequence: TTG
gagttgaaataaaacaacta

SEQ ID NO: 212205 - DNA, 20 bp, Artificial Sequence
  Description of Artificial Sequence: Synthetic oligonucleotide
  Target: ATXN1; (-) strand; PAM type: YTN; PAM sequence: TTT
ggagttgaaataaaacaact

SEQ ID NO: 212206 - DNA, 20 bp, Artificial Sequence
  Description of Artificial Sequence: Synthetic oligonucleotide
  Target: ATXN1; (-) strand; PAM type: YTN; PAM sequence: CTT
tggagttgaaataaaacaac

SEQ ID NO: 212207 - DNA, 20 bp, Artificial Sequence
  Description of Artificial Sequence: Synthetic oligonucleotide
  Target: ATXN1; (-) strand; PAM type: YTN; PAM sequence: TTC
gggatgtagaagcccacttt

SEQ ID NO: 212208 - DNA, 20 bp, Artificial Sequence
  Description of Artificial Sequence: Synthetic oligonucleotide
  Target: ATXN1; (-) strand; PAM type: YTN; PAM sequence: TTT
cgggatgtagaagcccactt

SEQ ID NO: 212209 - DNA, 20 bp, Artificial Sequence
  Description of Artificial Sequence: Synthetic oligonucleotide
  Target: ATXN1; (-) strand; PAM type: YTN; PAM sequence: TTG
tttcgggatgtagaagccca

SEQ ID NO: 212210 - DNA, 20 bp, Artificial Sequence
  Description of Artificial Sequence: Synthetic oligonucleotide
  Target: ATXN1; (-) strand; PAM type: YTN; PAM sequence: TTT
gtttcgggatgtagaagccc

SEQ ID NO: 212211 - DNA, 20 bp, Artificial Sequence
  Description of Artificial Sequence: Synthetic oligonucleotide
  Target: ATXN1; (-) strand; PAM type: YTN; PAM sequence: TTC
atttgtttcgggatgtagaa

SEQ ID NO: 212212 - DNA, 20 bp, Artificial Sequence
  Description of Artificial Sequence: Synthetic oligonucleotide
  Target: ATXN1; (-) strand; PAM type: YTN; PAM sequence: TTT
catttgtttcgggatgtaga

SEQ ID NO: 212213 - DNA, 20 bp, Artificial Sequence
  Description of Artificial Sequence: Synthetic oligonucleotide
  Target: ATXN1; (-) strand; PAM type: YTN; PAM sequence: CTT
tcatttgtttcgggatgtag

SEQ ID NO: 212214 - DNA, 20 bp, Artificial Sequence
  Description of Artificial Sequence: Synthetic oligonucleotide
  Target: ATXN1; (-) strand; PAM type: YTN; PAM sequence: TTC
tttcatttgtttcgggatgt

SEQ ID NO: 212215 - DNA, 20 bp, Artificial Sequence
  Description of Artificial Sequence: Synthetic oligonucleotide
  Target: ATXN1; (-) strand; PAM type: YTN; PAM sequence: TTT
ctttcatttgtttcgggatg

SEQ ID NO: 212216 - DNA, 20 bp, Artificial Sequence
  Description of Artificial Sequence: Synthetic oligonucleotide
  Target: ATXN1; (-) strand; PAM type: YTN; PAM sequence: TTT
tctttcatttgtttcgggat

SEQ ID NO: 212217 - DNA, 20 bp, Artificial Sequence
  Description of Artificial Sequence: Synthetic oligonucleotide
  Target: ATXN1; (-) strand; PAM type: YTN; PAM sequence: TTA
attttctttcatttgtttcg

SEQ ID NO: 212218 - DNA, 20 bp, Artificial Sequence
  Description of Artificial Sequence: Synthetic oligonucleotide
  Target: ATXN1; (-) strand; PAM type: YTN; PAM sequence: TTT
aattttctttcatttgtttc

SEQ ID NO: 212219 - DNA, 20 bp, Artificial Sequence
  Description of Artificial Sequence: Synthetic oligonucleotide
  Target: ATXN1; (-) strand; PAM type: YTN; PAM sequence: TTT
taattttctttcatttgttt

SEQ ID NO: 212220 - DNA, 20 bp, Artificial Sequence
  Description of Artificial Sequence: Synthetic oligonucleotide
  Target: ATXN1; (-) strand; PAM type: YTN; PAM sequence: CTT
ttaattttctttcatttgtt

SEQ ID NO: 212221 - DNA, 20 bp, Artificial Sequence
  Description of Artificial Sequence: Synthetic oligonucleotide
  Target: ATXN1; (-) strand; PAM type: YTN; PAM sequence: TTA
tcttttaattttctttcatt

SEQ ID NO: 212222 - DNA, 20 bp, Artificial Sequence
  Description of Artificial Sequence: Synthetic oligonucleotide
  Target: ATXN1; (-) strand; PAM type: YTN; PAM sequence: TTT
atcttttaattttctttcat

SEQ ID NO: 212223 - DNA, 20 bp, Artificial Sequence
  Description of Artificial Sequence: Synthetic oligonucleotide
  Target: ATXN1; (-) strand; PAM type: YTN; PAM sequence: TTA
tttatcttttaattttcttt

SEQ ID NO: 212224 - DNA, 20 bp, Artificial Sequence
  Description of Artificial Sequence: Synthetic oligonucleotide
  Target: ATXN1; (-) strand; PAM type: YTN; PAM sequence: TTT
atttatcttttaattttctt

SEQ ID NO: 212225 - DNA, 20 bp, Artificial Sequence
  Description of Artificial Sequence: Synthetic oligonucleotide
  Target: ATXN1; (-) strand; PAM type: YTN; PAM sequence: CTT
tatttatcttttaattttct

SEQ ID NO: 212226 - DNA, 20 bp, Artificial Sequence
  Description of Artificial Sequence: Synthetic oligonucleotide
  Target: ATXN1; (-) strand; PAM type: YTN; PAM sequence: TTC
atggatgccaggaatgcttt

SEQ ID NO: 212227 - DNA, 20 bp, Artificial Sequence
  Description of Artificial Sequence: Synthetic oligonucleotide
  Target: ATXN1; (-) strand; PAM type: YTN; PAM sequence: TTT
catggatgccaggaatgctt

SEQ ID NO: 212228 - DNA, 20 bp, Artificial Sequence
  Description of Artificial Sequence: Synthetic oligonucleotide
  Target: ATXN1; (-) strand; PAM type: YTN; PAM sequence: CTT
tcatggatgccaggaatgct

SEQ ID NO: 212229 - DNA, 20 bp, Artificial Sequence
  Description of Artificial Sequence: Synthetic oligonucleotide
  Target: ATXN1; (-) strand; PAM type: YTN; PAM sequence: CTG
aaataacatgaacagggaaa

SEQ ID NO: 212230 - DNA, 20 bp, Artificial Sequence
  Description of Artificial Sequence: Synthetic oligonucleotide
  Target: ATXN1; (-) strand; PAM type: YTN; PAM sequence: TTA
ctgaaataacatgaacaggg

SEQ ID NO: 212231 - DNA, 20 bp, Artificial Sequence
  Description of Artificial Sequence: Synthetic oligonucleotide
  Target: ATXN1; (-) strand; PAM type: YTN; PAM sequence: TTT
actgaaataacatgaacagg

SEQ ID NO: 212232 - DNA, 20 bp, Artificial Sequence
  Description of Artificial Sequence: Synthetic oligonucleotide
  Target: ATXN1; (-) strand; PAM type: YTN; PAM sequence: CTA
gatttactgaaataacatga

SEQ ID NO: 212233 - DNA, 20 bp, Artificial Sequence
  Description of Artificial Sequence: Synthetic oligonucleotide
  Target: ATXN1; (-) strand; PAM type: YTN; PAM sequence: CTG
ctagatttactgaaataaca

SEQ ID NO: 212234 - DNA, 20 bp, Artificial Sequence
  Description of Artificial Sequence: Synthetic oligonucleotide
  Target: ATXN1; (-) strand; PAM type: YTN; PAM sequence: CTA
cactgctagatttactgaaa

SEQ ID NO: 212235 - DNA, 20 bp, Artificial Sequence
  Description of Artificial Sequence: Synthetic oligonucleotide
  Target: ATXN1; (-) strand; PAM type: YTN; PAM sequence: TTC
tacactgctagatttactga

SEQ ID NO: 212236 - DNA, 20 bp, Artificial Sequence
  Description of Artificial Sequence: Synthetic oligonucleotide
  Target: ATXN1; (-) strand; PAM type: YTN; PAM sequence: TTT
ctacactgctagatttactg

SEQ ID NO: 212237 - DNA, 20 bp, Artificial Sequence
  Description of Artificial Sequence: Synthetic oligonucleotide
  Target: ATXN1; (-) strand; PAM type: YTN; PAM sequence: CTT
tctacactgctagatttact

SEQ ID NO: 212238 - DNA, 20 bp, Artificial Sequence
  Description of Artificial Sequence: Synthetic oligonucleotide
  Target: ATXN1; (-) strand; PAM type: YTN; PAM sequence: CTC
tttctacactgctagattta

SEQ ID NO: 212239 - DNA, 20 bp, Artificial Sequence
  Description of Artificial Sequence: Synthetic oligonucleotide
  Target: ATXN1; (-) strand; PAM type: YTN; PAM sequence: TTG
tctctttctacactgctaga

SEQ ID NO: 212240 - DNA, 20 bp, Artificial Sequence
  Description of Artificial Sequence: Synthetic oligonucleotide
  Target: ATXN1; (-) strand; PAM type: YTN; PAM sequence: TTT
gtctctttctacactgctag

SEQ ID NO: 212241 - DNA, 20 bp, Artificial Sequence
  Description of Artificial Sequence: Synthetic oligonucleotide
  Target: ATXN1; (-) strand; PAM type: YTN; PAM sequence: CTC
atttgtctctttctacactg

SEQ ID NO: 212242 - DNA, 20 bp, Artificial Sequence
  Description of Artificial Sequence: Synthetic oligonucleotide
  Target: ATXN1; (-) strand; PAM type: YTN; PAM sequence: CTG
cgctcatttgtctctttcta

SEQ ID NO: 212243 - DNA, 20 bp, Artificial Sequence
  Description of Artificial Sequence: Synthetic oligonucleotide
  Target: ATXN1; (-) strand; PAM type: YTN; PAM sequence: TTG
taatctgcgctcatttgtct

SEQ ID NO: 212244 - DNA, 20 bp, Artificial Sequence
  Description of Artificial Sequence: Synthetic oligonucleotide
  Target: ATXN1; (-) strand; PAM type: YTN; PAM sequence: CTT
gtaatctgcgctcatttgtc

SEQ ID NO: 212245 - DNA, 20 bp, Artificial Sequence
  Description of Artificial Sequence: Synthetic oligonucleotide
  Target: ATXN1; (-) strand; PAM type: YTN; PAM sequence: CTG
ccttgtaatctgcgctcatt

SEQ ID NO: 212246 - DNA, 20 bp, Artificial Sequence
  Description of Artificial Sequence: Synthetic oligonucleotide
  Target: ATXN1; (-) strand; PAM type: YTN; PAM sequence: CTC
cgaacaggtgctgccttgta

SEQ ID NO: 212247 - DNA, 20 bp, Artificial Sequence
  Description of Artificial Sequence: Synthetic oligonucleotide
  Target: ATXN1; (-) strand; PAM type: YTN; PAM sequence: TTG
ggctccgaacaggtgctgcc

SEQ ID NO: 212248 - DNA, 20 bp, Artificial Sequence
  Description of Artificial Sequence: Synthetic oligonucleotide
  Target: ATXN1; (-) strand; PAM type: YTN; PAM sequence: CTT
gggctccgaacaggtgctgc

SEQ ID NO: 212249 - DNA, 20 bp, Artificial Sequence
  Description of Artificial Sequence: Synthetic oligonucleotide
  Target: ATXN1; (-) strand; PAM type: YTN; PAM sequence: CTA
atgaccttgggctccgaaca

SEQ ID NO: 212250 - DNA, 20 bp, Artificial Sequence
  Description of Artificial Sequence: Synthetic oligonucleotide
  Target: ATXN1; (-) strand; PAM type: YTN; PAM sequence: CTA
atggcatctaatgaccttgg

SEQ ID NO: 212251 - DNA, 20 bp, Artificial Sequence
  Description of Artificial Sequence: Synthetic oligonucleotide
  Target: ATXN1; (-) strand; PAM type: YTN; PAM sequence: TTG
ctaatggcatctaatgacct

SEQ ID NO: 212252 - DNA, 20 bp, Artificial Sequence
  Description of Artificial Sequence: Synthetic oligonucleotide
  Target: ATXN1; (-) strand; PAM type: YTN; PAM sequence: TTA
tgccattgctaatggcatct

SEQ ID NO: 212253 - DNA, 20 bp, Artificial Sequence
  Description of Artificial Sequence: Synthetic oligonucleotide
  Target: ATXN1; (-) strand; PAM type: YTN; PAM sequence: TTT
atgccattgctaatggcatc

SEQ ID NO: 212254 - DNA, 20 bp, Artificial Sequence
  Description of Artificial Sequence: Synthetic oligonucleotide
  Target: ATXN1; (-) strand; PAM type: YTN; PAM sequence: CTT
tatgccattgctaatggcat

SEQ ID NO: 212255 - DNA, 20 bp, Artificial Sequence
  Description of Artificial Sequence: Synthetic oligonucleotide
  Target: ATXN1; (-) strand; PAM type: YTN; PAM sequence: CTA
aatgcatgtgtctttatgcc

SEQ ID NO: 212256 - DNA, 20 bp, Artificial Sequence
  Description of Artificial Sequence: Synthetic oligonucleotide
  Target: ATXN1; (-) strand; PAM type: YTN; PAM sequence: CTC
ctaaatgcatgtgtctttat

SEQ ID NO: 212257 - DNA, 20 bp, Artificial Sequence
  Description of Artificial Sequence: Synthetic oligonucleotide
  Target: ATXN1; (-) strand; PAM type: YTN; PAM sequence: TTA
tctcctaaatgcatgtgtct

SEQ ID NO: 212258 - DNA, 20 bp, Artificial Sequence
  Description of Artificial Sequence: Synthetic oligonucleotide
  Target: ATXN1; (-) strand; PAM type: YTN; PAM sequence: CTG
cgttatctcctaaatgcatg

SEQ ID NO: 212259 - DNA, 20 bp, Artificial Sequence
  Description of Artificial Sequence: Synthetic oligonucleotide
  Target: ATXN1; (-) strand; PAM type: YTN; PAM sequence: CTG
agctgcgttatctcctaaat

SEQ ID NO: 212260 - DNA, 20 bp, Artificial Sequence
  Description of Artificial Sequence: Synthetic oligonucleotide
  Target: ATXN1; (-) strand; PAM type: YTN; PAM sequence: CTG
tgagagcagccgacaaggtg

SEQ ID NO: 212261 - DNA, 20 bp, Artificial Sequence
  Description of Artificial Sequence: Synthetic oligonucleotide
  Target: ATXN1; (-) strand; PAM type: YTN; PAM sequence: CTG
aagcaggtctgtgagagcag

SEQ ID NO: 212262 - DNA, 20 bp, Artificial Sequence
  Description of Artificial Sequence: Synthetic oligonucleotide
  Target: ATXN1; (-) strand; PAM type: YTN; PAM sequence: CTG
agactgaagcaggtctgtga

SEQ ID NO: 212263 - DNA, 20 bp, Artificial Sequence
  Description of Artificial Sequence: Synthetic oligonucleotide
  Target: ATXN1; (-) strand; PAM type: YTN; PAM sequence: CTC
tgagactgaagcaggtctgt

SEQ ID NO: 212264 - DNA, 20 bp, Artificial Sequence
  Description of Artificial Sequence: Synthetic oligonucleotide
  Target: ATXN1; (-) strand; PAM type: YTN; PAM sequence: CTG
ggctctgagactgaagcagg

SEQ ID NO: 212265 - DNA, 20 bp, Artificial Sequence
  Description of Artificial Sequence: Synthetic oligonucleotide
  Target: ATXN1; (-) strand; PAM type: YTN; PAM sequence: TTG
tctgggctctgagactgaag

SEQ ID NO: 212266 - DNA, 20 bp, Artificial Sequence
  Description of Artificial Sequence: Synthetic oligonucleotide
  Target: ATXN1; (-) strand; PAM type: YTN; PAM sequence: CTA
ttgtctgggctctgagactg

SEQ ID NO: 212267 - DNA, 20 bp, Artificial Sequence
  Description of Artificial Sequence: Synthetic oligonucleotide
  Target: ATXN1; (-) strand; PAM type: YTN; PAM sequence: TTA
gtgctattgtctgggctctg

SEQ ID NO: 212268 - DNA, 20 bp, Artificial Sequence
  Description of Artificial Sequence: Synthetic oligonucleotide
  Target: ATXN1; (-) strand; PAM type: YTN; PAM sequence: TTT
agtgctattgtctgggctct

SEQ ID NO: 212269 - DNA, 20 bp, Artificial Sequence
  Description of Artificial Sequence: Synthetic oligonucleotide
  Target: ATXN1; (-) strand; PAM type: YTN; PAM sequence: TTG
ccgtgtttagtgctattgtc

SEQ ID NO: 212270 - DNA, 20 bp, Artificial Sequence
  Description of Artificial Sequence: Synthetic oligonucleotide
  Target: ATXN1; (-) strand; PAM type: YTN; PAM sequence: CTT
gccgtgtttagtgctattgt

SEQ ID NO: 212271 - DNA, 20 bp, Artificial Sequence
  Description of Artificial Sequence: Synthetic oligonucleotide
  Target: ATXN1; (-) strand; PAM type: YTN; PAM sequence: CTA
acgcccttgccgtgtttagt

SEQ ID NO: 212272 - DNA, 20 bp, Artificial Sequence
  Description of Artificial Sequence: Synthetic oligonucleotide
  Target: ATXN1; (-) strand; PAM type: YTN; PAM sequence: TTG
cagctaacgcccttgccgtg

SEQ ID NO: 212273 - DNA, 20 bp, Artificial Sequence
  Description of Artificial Sequence: Synthetic oligonucleotide
  Target: ATXN1; (-) strand; PAM type: YTN; PAM sequence: CTT
gcagctaacgcccttgccgt

SEQ ID NO: 212274 - DNA, 20 bp, Artificial Sequence
  Description of Artificial Sequence: Synthetic oligonucleotide
  Target: ATXN1; (-) strand; PAM type: YTN; PAM sequence: CTC
ttgcagctaacgcccttgcc

SEQ ID NO: 212275 - DNA, 20 bp, Artificial Sequence
  Description of Artificial Sequence: Synthetic oligonucleotide
  Target: ATXN1; (-) strand; PAM type: YTN; PAM sequence: TTC
agcctcttgcagctaacgcc

SEQ ID NO: 212276 - DNA, 20 bp, Artificial Sequence
  Description of Artificial Sequence: Synthetic oligonucleotide
  Target: ATXN1; (-) strand; PAM type: YTN; PAM sequence: TTT
cagcctcttgcagctaacgc

SEQ ID NO: 212277 - DNA, 20 bp, Artificial Sequence
  Description of Artificial Sequence: Synthetic oligonucleotide
  Target: ATXN1; (-) strand; PAM type: YTN; PAM sequence: TTC
agccaatttcagcctcttgc

SEQ ID NO: 212278 - DNA, 20 bp, Artificial Sequence
  Description of Artificial Sequence: Synthetic oligonucleotide
  Target: ATXN1; (-) strand; PAM type: YTN; PAM sequence: TTC
aggttcagccaatttcagcc

SEQ ID NO: 212279 - DNA, 20 bp, Artificial Sequence
  Description of Artificial Sequence: Synthetic oligonucleotide
  Target: ATXN1; (-) strand; PAM type: YTN; PAM sequence: TTT
caggttcagccaatttcagc

SEQ ID NO: 212280 - DNA, 20 bp, Artificial Sequence
  Description of Artificial Sequence: Synthetic oligonucleotide
  Target: ATXN1; (-) strand; PAM type: YTN; PAM sequence: CTC
atatttcaggttcagccaat

SEQ ID NO: 212281 - DNA, 20 bp, Artificial Sequence
  Description of Artificial Sequence: Synthetic oligonucleotide
  Target: ATXN1; (-) strand; PAM type: YTN; PAM sequence: TTA
ctcatatttcaggttcagcc

SEQ ID NO: 212282 - DNA, 20 bp, Artificial Sequence
  Description of Artificial Sequence: Synthetic oligonucleotide
  Target: ATXN1; (-) strand; PAM type: YTN; PAM sequence: TTT
actcatatttcaggttcagc

SEQ ID NO: 212283 - DNA, 20 bp, Artificial Sequence
  Description of Artificial Sequence: Synthetic oligonucleotide
  Target: ATXN1; (-) strand; PAM type: YTN; PAM sequence: CTT
tactcatatttcaggttcag

SEQ ID NO: 212284 - DNA, 20 bp, Artificial Sequence
  Description of Artificial Sequence: Synthetic oligonucleotide
  Target: ATXN1; (-) strand; PAM type: YTN; PAM sequence: TTG
catatacaaagactttactc

SEQ ID NO: 212285 - DNA, 20 bp, Artificial Sequence
  Description of Artificial Sequence: Synthetic oligonucleotide
  Target: ATXN1; (-) strand; PAM type: YTN; PAM sequence: TTT
gcatatacaaagactttact

SEQ ID NO: 212286 - DNA, 20 bp, Artificial Sequence
  Description of Artificial Sequence: Synthetic oligonucleotide
  Target: ATXN1; (-) strand; PAM type: YTN; PAM sequence: TTT
tgcatatacaaagactttac

SEQ ID NO: 212287 - DNA, 20 bp, Artificial Sequence
  Description of Artificial Sequence: Synthetic oligonucleotide
  Target: ATXN1; (-) strand; PAM type: YTN; PAM sequence: CTG
ttttgcatatacaaagactt

SEQ ID NO: 212288 - DNA, 20 bp, Artificial Sequence
  Description of Artificial Sequence: Synthetic oligonucleotide
  Target: ATXN1; (-) strand; PAM type: YTN; PAM sequence: TTC
tgttttgcatatacaaagac

SEQ ID NO: 212289 - DNA, 20 bp, Artificial Sequence
  Description of Artificial Sequence: Synthetic oligonucleotide
  Target: ATXN1; (-) strand; PAM type: YTN; PAM sequence: TTT
ctgttttgcatatacaaaga

SEQ ID NO: 212290 - DNA, 20 bp, Artificial Sequence
  Description of Artificial Sequence: Synthetic oligonucleotide
  Target: ATXN1; (-) strand; PAM type: YTN; PAM sequence: CTA
tttctgttttgcatatacaa

SEQ ID NO: 212291 - DNA, 20 bp, Artificial Sequence
  Description of Artificial Sequence: Synthetic oligonucleotide
  Target: ATXN1; (-) strand; PAM type: YTN; PAM sequence: TTA
gggctatttctgttttgcat

SEQ ID NO: 212292 - DNA, 20 bp, Artificial Sequence
  Description of Artificial Sequence: Synthetic oligonucleotide
  Target: ATXN1; (-) strand; PAM type: YTN; PAM sequence: TTT
agggctatttctgttttgca

SEQ ID NO: 212293 - DNA, 20 bp, Artificial Sequence
  Description of Artificial Sequence: Synthetic oligonucleotide
  Target: ATXN1; (-) strand; PAM type: YTN; PAM sequence: TTT
tagggctatttctgttttgc

SEQ ID NO: 212294 - DNA, 20 bp, Artificial Sequence
  Description of Artificial Sequence: Synthetic oligonucleotide
  Target: ATXN1; (-) strand; PAM type: YTN; PAM sequence: CTT
ttagggctatttctgttttg

SEQ ID NO: 212295 - DNA, 20 bp, Artificial Sequence
  Description of Artificial Sequence: Synthetic oligonucleotide
  Target: ATXN1; (-) strand; PAM type: YTN; PAM sequence: CTC
cttttagggctatttctgtt

SEQ ID NO: 212296 - DNA, 20 bp, Artificial Sequence
  Description of Artificial Sequence: Synthetic oligonucleotide
  Target: ATXN1; (-) strand; PAM type: YTN; PAM sequence: TTG
tgtctccttttagggctatt

SEQ ID NO: 212297 - DNA, 20 bp, Artificial Sequence
  Description of Artificial Sequence: Synthetic oligonucleotide
  Target: ATXN1; (-) strand; PAM type: YTN; PAM sequence: TTG
ataaatagttgtgtctcctt

SEQ ID NO: 212298 - DNA, 20 bp, Artificial Sequence
  Description of Artificial Sequence: Synthetic oligonucleotide
  Target: ATXN1; (-) strand; PAM type: YTN; PAM sequence: TTT
gataaatagttgtgtctcct

SEQ ID NO: 212299 - DNA, 20 bp, Artificial Sequence
  Description of Artificial Sequence: Synthetic oligonucleotide
  Target: ATXN1; (-) strand; PAM type: YTN; PAM sequence: TTT
tgataaatagttgtgtctcc

SEQ ID NO: 212300 - DNA, 20 bp, Artificial Sequence
  Description of Artificial Sequence: Synthetic oligonucleotide
  Target: ATXN1; (-) strand; PAM type: YTN; PAM sequence: TTT
ttgataaatagttgtgtctc

SEQ ID NO: 212301 - DNA, 20 bp, Artificial Sequence
  Description of Artificial Sequence: Synthetic oligonucleotide
  Target: ATXN1; (-) strand; PAM type: YTN; PAM sequence: CTT
tttgataaatagttgtgtct

SEQ ID NO: 212302 - DNA, 20 bp, Artificial Sequence
  Description of Artificial Sequence: Synthetic oligonucleotide
  Target: ATXN1; (-) strand; PAM type: YTN; PAM sequence: CTG
tatgcacctttttgataaat

SEQ ID NO: 212303 - DNA, 20 bp, Artificial Sequence
  Description of Artificial Sequence: Synthetic oligonucleotide
  Target: ATXN1; (-) strand; PAM type: YTN; PAM sequence: CTC
tgtatgcacctttttgataa

SEQ ID NO: 212304 - DNA, 20 bp, Artificial Sequence
  Description of Artificial Sequence: Synthetic oligonucleotide
  Target: ATXN1; (-) strand; PAM type: YTN; PAM sequence: TTC
tctgtatgcacctttttgat

SEQ ID NO: 212305 - DNA, 20 bp, Artificial Sequence
  Description of Artificial Sequence: Synthetic oligonucleotide
  Target: ATXN1; (-) strand; PAM type: YTN; PAM sequence: TTA
attctctgtatgcacctttt

SEQ ID NO: 212306 - DNA, 20 bp, Artificial Sequence
  Description of Artificial Sequence: Synthetic oligonucleotide
  Target: ATXN1; (-) strand; PAM type: YTN; PAM sequence: TTT
aattctctgtatgcaccttt

SEQ ID NO: 212307 - DNA, 20 bp, Artificial Sequence
  Description of Artificial Sequence: Synthetic oligonucleotide
  Target: ATXN1; (-) strand; PAM type: YTN; PAM sequence: TTG
tttaattctctgtatgcacc

SEQ ID NO: 212308 - DNA, 20 bp, Artificial Sequence
  Description of Artificial Sequence: Synthetic oligonucleotide
  Target: ATXN1; (-) strand; PAM type: YTN; PAM sequence: CTT
gtttaattctctgtatgcac

SEQ ID NO: 212309 - DNA, 20 bp, Artificial Sequence
  Description of Artificial Sequence: Synthetic oligonucleotide
  Target: ATXN1; (-) strand; PAM type: YTN; PAM sequence: CTG
gccttgtttaattctctgta

SEQ ID NO: 212310 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccgccgggcc

SEQ ID NO: 212311 - DNA, 20 bp, Artificial Sequence
  Description of Artificial Sequence: Synthetic oligonucleotide
  Target: ATXN1; (-) strand; PAM type: YTN; PAM sequence: TTG
ggattacaggcatgagccgc

SEQ ID NO: 212312 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgttgggattacag

SEQ ID NO: 212313 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgttgggat

SEQ ID NO: 212314 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgttggga

SEQ ID NO: 212315 - DNA, 20 bp, Artificial Sequence
  Description of Artificial Sequence: Synthetic oligonucleotide
  Target: ATXN1; (-) strand; PAM type: YTN; PAM sequence: CTG
ccttggcctcccaaagtgtt

SEQ ID NO: 212316 - DNA, 20 bp, Artificial Sequence
  Description of Artificial Sequence: Synthetic oligonucleotide
  Target: ATXN1; (-) strand; PAM type: YTN; PAM sequence: CTC
aggtgatccacctgccttgg

SEQ ID NO: 212317 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatccacctgc

SEQ ID NO: 212318 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatccacc

SEQ ID NO: 212319 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcaggtgat

SEQ ID NO: 212320 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcaggtga

SEQ ID NO: 212321 - DNA, 20 bp, Artificial Sequence
  Description of Artificial Sequence: Synthetic oligonucleotide
  Target: ATXN1; (-) strand; PAM type: YTN; PAM sequence: TTG
gccagggtggtcttgaactc

SEQ ID NO: 212322 - DNA, 20 bp, Artificial Sequence
  Description of Artificial Sequence: Synthetic oligonucleotide
  Target: ATXN1; (-) strand; PAM type: YTN; PAM sequence: CTC
catgttggccagggtggtct

SEQ ID NO: 212323 - DNA, 20 bp, Artificial Sequence
  Description of Artificial Sequence: Synthetic oligonucleotide
  Target: ATXN1; (-) strand; PAM type: YTN; PAM sequence: TTC
tccatgttggccagggtggt

SEQ ID NO: 212324 - DNA, 20 bp, Artificial Sequence
  Description of Artificial Sequence: Synthetic oligonucleotide
  Target: ATXN1; (-) strand; PAM type: YTN; PAM sequence: TTA
gtagagacggcattctccat

SEQ ID NO: 212325 - DNA, 20 bp, Artificial Sequence
  Description of Artificial Sequence: Synthetic oligonucleotide
  Target: ATXN1; (-) strand; PAM type: YTN; PAM sequence: TTT
agtagagacggcattctcca

SEQ ID NO: 212326 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggcattctcc

SEQ ID NO: 212327 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggcattctc

SEQ ID NO: 212328 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacggca

SEQ ID NO: 212329 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggc

SEQ ID NO: 212330 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 212331 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 212332 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 212333 - DNA, 20 bp, Artificial Sequence
  Description of Artificial Sequence: Synthetic oligonucleotide
  Target: ATXN1; (-) strand; PAM type: YTN; PAM sequence: TTA
caggtgtgcaccaccacacc

SEQ ID NO: 212334 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgcaccac

SEQ ID NO: 212335 - DNA, 20 bp, Artificial Sequence
  Description of Artificial Sequence: Synthetic oligonucleotide
  Target: ATXN1; (-) strand; PAM type: YTN; PAM sequence: CTA
gtagctgggattacaggtgt

SEQ ID NO: 212336 - DNA, 20 bp, Artificial Sequence
  Description of Artificial Sequence: Synthetic oligonucleotide
  Target: ATXN1; (-) strand; PAM type: YTN; PAM sequence: CTC
cctagtagctgggattacag

SEQ ID NO: 212337 - DNA, 20 bp, Artificial Sequence
  Description of Artificial Sequence: Synthetic oligonucleotide
  Target: ATXN1; (-) strand; PAM type: YTN; PAM sequence: CTC
agcctccctagtagctggga

SEQ ID NO: 212338 - DNA, 20 bp, Artificial Sequence
  Description of Artificial Sequence: Synthetic oligonucleotide
  Target: ATXN1; (-) strand; PAM type: YTN; PAM sequence: TTC
aagcctcagcctccctagta

SEQ ID NO: 212339 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagcctcagcct

SEQ ID NO: 212340 - DNA, 20 bp, Artificial Sequence
  Description of Artificial Sequence: Synthetic oligonucleotide
  Target: ATXN1; (-) strand; PAM type: YTN; PAM sequence: TTG
cctcccgggttcaagcctca

SEQ ID NO: 212341 - DNA, 20 bp, Artificial Sequence
  Description of Artificial Sequence: Synthetic oligonucleotide
  Target: ATXN1; (-) strand; PAM type: YTN; PAM sequence: CTC
cattgcctcccgggttcaag

SEQ ID NO: 212342 - DNA, 20 bp, Artificial Sequence
  Description of Artificial Sequence: Synthetic oligonucleotide
  Target: ATXN1; (-) strand; PAM type: YTN; PAM sequence: CTG
caacctccattgcctcccgg

SEQ ID NO: 212343 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccattgcctc

SEQ ID NO: 212344 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacctccattg

SEQ ID NO: 212345 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacctccatt

SEQ ID NO: 212346 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcacgatctt

SEQ ID NO: 212347 - DNA, 20 bp, Artificial Sequence
  Description of Artificial Sequence: Synthetic oligonucleotide
  Target: ATXN1; (-) strand; PAM type: YTN; PAM sequence: CTC
ccaggctggagtgcagtggc

SEQ ID NO: 212348 - DNA, 20 bp, Artificial Sequence
  Description of Artificial Sequence: Synthetic oligonucleotide
  Target: ATXN1; (-) strand; PAM type: YTN; PAM sequence: CTG
tctcccaggctggagtgcag

SEQ ID NO: 212349 - DNA, 20 bp, Artificial Sequence
  Description of Artificial Sequence: Synthetic oligonucleotide
  Target: ATXN1; (-) strand; PAM type: YTN; PAM sequence: CTC
tgtctcccaggctggagtgc

SEQ ID NO: 212350 - DNA, 20 bp, Artificial Sequence
  Description of Artificial Sequence: Synthetic oligonucleotide
  Target: ATXN1; (-) strand; PAM type: YTN; PAM sequence: CTC
gctctgtctcccaggctgga

SEQ ID NO: 212351 - DNA, 20 bp, Artificial Sequence
  Description of Artificial Sequence: Synthetic oligonucleotide
  Target: ATXN1; (-) strand; PAM type: YTN; PAM sequence: TTG
agatggaatctcgctctgtc

SEQ ID NO: 212352 - DNA, 20 bp, Artificial Sequence
  Description of Artificial Sequence: Synthetic oligonucleotide
  Target: ATXN1; (-) strand; PAM type: YTN; PAM sequence: TTT
gagatggaatctcgctctgt

SEQ ID NO: 212353 - DNA, 20 bp, Artificial Sequence
  Description of Artificial Sequence: Synthetic oligonucleotide
  Target: ATXN1; (-) strand; PAM type: YTN; PAM sequence: TTT
tgagatggaatctcgctctg

SEQ ID NO: 212354 - DNA, 20 bp, Artificial Sequence
  Description of Artificial Sequence: Synthetic oligonucleotide
  Target: ATXN1; (-) strand; PAM type: YTN; PAM sequence: TTT
ttgagatggaatctcgctct

SEQ ID NO: 212355 - DNA, 20 bp, Artificial Sequence
  Description of Artificial Sequence: Synthetic oligonucleotide
  Target: ATXN1; (-) strand; PAM type: YTN; PAM sequence: TTG
tttttgagatggaatctcgc

SEQ ID NO: 212356 - DNA, 20 bp, Artificial Sequence
  Description of Artificial Sequence: Synthetic oligonucleotide
  Target: ATXN1; (-) strand; PAM type: YTN; PAM sequence: TTT
gtttttgagatggaatctcg

SEQ ID NO: 212357 - DNA, 20 bp, Artificial Sequence
  Description of Artificial Sequence: Synthetic oligonucleotide
  Target: ATXN1; (-) strand; PAM type: YTN; PAM sequence: TTT
tgtttttgagatggaatctc

SEQ ID NO: 212358 - DNA, 20 bp, Artificial Sequence
  Description of Artificial Sequence: Synthetic oligonucleotide
  Target: ATXN1; (-) strand; PAM type: YTN; PAM sequence: TTT
ttgtttttgagatggaatct

SEQ ID NO: 212359 - DNA, 20 bp, Artificial Sequence
  Description of Artificial Sequence: Synthetic oligonucleotide
  Target: ATXN1; (-) strand; PAM type: YTN; PAM sequence: TTT
tttgtttttgagatggaatc

SEQ ID NO: 212360 - DNA, 20 bp, Artificial Sequence
  Description of Artificial Sequence: Synthetic oligonucleotide
  Target: ATXN1; (-) strand; PAM type: YTN; PAM sequence: TTG
ttttttgtttttgagatgga

SEQ ID NO: 212361 - DNA, 20 bp, Artificial Sequence
  Description of Artificial Sequence: Synthetic oligonucleotide
  Target: ATXN1; (-) strand; PAM type: YTN; PAM sequence: TTT
gttttttgtttttgagatgg

SEQ ID NO: 212362 - DNA, 20 bp, Artificial Sequence
  Description of Artificial Sequence: Synthetic oligonucleotide
  Target: ATXN1; (-) strand; PAM type: YTN; PAM sequence: CTT
tgttttttgtttttgagatg

SEQ ID NO: 212363 - DNA, 20 bp, Artificial Sequence
  Description of Artificial Sequence: Synthetic oligonucleotide
  Target: ATXN1; (-) strand; PAM type: YTN; PAM sequence: TTC
tttgttttttgtttttgaga

SEQ ID NO: 212364 - DNA, 20 bp, Artificial Sequence
  Description of Artificial Sequence: Synthetic oligonucleotide
  Target: ATXN1; (-) strand; PAM type: YTN; PAM sequence: TTA
attctttgttttttgttttt

SEQ ID NO: 212365 - DNA, 20 bp, Artificial Sequence
  Description of Artificial Sequence: Synthetic oligonucleotide
  Target: ATXN1; (-) strand; PAM type: YTN; PAM sequence: TTT
aattctttgttttttgtttt

SEQ ID NO: 212366 - DNA, 20 bp, Artificial Sequence
  Description of Artificial Sequence: Synthetic oligonucleotide
  Target: ATXN1; (-) strand; PAM type: YTN; PAM sequence: TTG
tttaattctttgttttttgt

SEQ ID NO: 212367 - DNA, 20 bp, Artificial Sequence
  Description of Artificial Sequence: Synthetic oligonucleotide
  Target: ATXN1; (-) strand; PAM type: YTN; PAM sequence: TTT
gtttaattctttgttttttg

SEQ ID NO: 212368 - DNA, 20 bp, Artificial Sequence
  Description of Artificial Sequence: Synthetic oligonucleotide
  Target: ATXN1; (-) strand; PAM type: YTN; PAM sequence: CTC
atcatttgtttaattctttg

SEQ ID NO: 212369 - DNA, 20 bp, Artificial Sequence
  Description of Artificial Sequence: Synthetic oligonucleotide
  Target: ATXN1; (-) strand; PAM type: YTN; PAM sequence: CTA
tcaactcatcatttgtttaa

SEQ ID NO: 212370 - DNA, 20 bp, Artificial Sequence
  Description of Artificial Sequence: Synthetic oligonucleotide
  Target: ATXN1; (-) strand; PAM type: YTN; PAM sequence: TTC
gggctatcaactcatcattt

SEQ ID NO: 212371 - DNA, 20 bp, Artificial Sequence
  Description of Artificial Sequence: Synthetic oligonucleotide
  Target: ATXN1; (-) strand; PAM type: YTN; PAM sequence: TTT
cgggctatcaactcatcatt

SEQ ID NO: 212372 - DNA, 20 bp, Artificial Sequence
  Description of Artificial Sequence: Synthetic oligonucleotide
  Target: ATXN1; (-) strand; PAM type: YTN; PAM sequence: TTT
tcgggctatcaactcatcat

SEQ ID NO: 212373 - DNA, 20 bp, Artificial Sequence
  Description of Artificial Sequence: Synthetic oligonucleotide
  Target: ATXN1; (-) strand; PAM type: YTN; PAM sequence: CTT
ttcgggctatcaactcatca

SEQ ID NO: 212374 - DNA, 20 bp, Artificial Sequence
  Description of Artificial Sequence: Synthetic oligonucleotide
  Target: ATXN1; (-) strand; PAM type: YTN; PAM sequence: TTC
ttttcgggctatcaactcat

SEQ ID NO: 212375 - DNA, 20 bp, Artificial Sequence
  Description of Artificial Sequence: Synthetic oligonucleotide
  Target: ATXN1; (-) strand; PAM type: YTN; PAM sequence: CTT
cttttcgggctatcaactca

SEQ ID NO: 212376 - DNA, 20 bp, Artificial Sequence
  Description of Artificial Sequence: Synthetic oligonucleotide
  Target: ATXN1; (-) strand; PAM type: YTN; PAM sequence: TTC
ttcttttcgggctatcaact

SEQ ID NO: 212377 - DNA, 20 bp, Artificial Sequence
  Description of Artificial Sequence: Synthetic oligonucleotide
  Target: ATXN1; (-) strand; PAM type: YTN; PAM sequence: TTT
cttcttttcgggctatcaac

SEQ ID NO: 212378 - DNA, 20 bp, Artificial Sequence
  Description of Artificial Sequence: Synthetic oligonucleotide
  Target: ATXN1; (-) strand; PAM type: YTN; PAM sequence: TTT
tcttcttttcgggctatcaa

SEQ ID NO: 212379 - DNA, 20 bp, Artificial Sequence
  Description of Artificial Sequence: Synthetic oligonucleotide
  Target: ATXN1; (-) strand; PAM type: YTN; PAM sequence: CTT
ttcttcttttcgggctatca

SEQ ID NO: 212380 - DNA, 20 bp, Artificial Sequence
  Description of Artificial Sequence: Synthetic oligonucleotide
  Target: ATXN1; (-) strand; PAM type: YTN; PAM sequence: TTG
catagagcatcttttcttct

SEQ ID NO: 212381 - DNA, 20 bp, Artificial Sequence
  Description of Artificial Sequence: Synthetic oligonucleotide
  Target: ATXN1; (-) strand; PAM type: YTN; PAM sequence: TTT
gcatagagcatcttttcttc

SEQ ID NO: 212382 - DNA, 20 bp, Artificial Sequence
  Description of Artificial Sequence: Synthetic oligonucleotide
  Target: ATXN1; (-) strand; PAM type: YTN; PAM sequence: TTT
tgcatagagcatcttttctt

SEQ ID NO: 212383 - DNA, 20 bp, Artificial Sequence
  Description of Artificial Sequence: Synthetic oligonucleotide
  Target: ATXN1; (-) strand; PAM type: YTN; PAM sequence: TTT
ttgcatagagcatcttttct

SEQ ID NO: 212384 - DNA, 20 bp, Artificial Sequence
  Description of Artificial Sequence: Synthetic oligonucleotide
  Target: ATXN1; (-) strand; PAM type: YTN; PAM sequence: TTA
tttttgcatagagcatcttt

SEQ ID NO: 212385 - DNA, 20 bp, Artificial Sequence
  Description of Artificial Sequence: Synthetic oligonucleotide
  Target: ATXN1; (-) strand; PAM type: YTN; PAM sequence: TTT
atttttgcatagagcatctt

SEQ ID NO: 212386 - DNA, 20 bp, Artificial Sequence
  Description of Artificial Sequence: Synthetic oligonucleotide
  Target: ATXN1; (-) strand; PAM type: YTN; PAM sequence: TTA
tttatttttgcatagagcat

SEQ ID NO: 212387 - DNA, 20 bp, Artificial Sequence
  Description of Artificial Sequence: Synthetic oligonucleotide
  Target: ATXN1; (-) strand; PAM type: YTN; PAM sequence: TTT
atttatttttgcatagagca

SEQ ID NO: 212388 - DNA, 20 bp, Artificial Sequence
  Description of Artificial Sequence: Synthetic oligonucleotide
  Target: ATXN1; (-) strand; PAM type: YTN; PAM sequence: TTA
tttatttatttttgcataga

SEQ ID NO: 212389 - DNA, 20 bp, Artificial Sequence
  Description of Artificial Sequence: Synthetic oligonucleotide
  Target: ATXN1; (-) strand; PAM type: YTN; PAM sequence: TTT
atttatttatttttgcatag

SEQ ID NO: 212390 - DNA, 20 bp, Artificial Sequence
  Description of Artificial Sequence: Synthetic oligonucleotide
  Target: ATXN1; (-) strand; PAM type: YTN; PAM sequence: TTT
tatttatttatttttgcata

SEQ ID NO: 212391 - DNA, 20 bp, Artificial Sequence
  Description of Artificial Sequence: Synthetic oligonucleotide
  Target: ATXN1; (-) strand; PAM type: YTN; PAM sequence: TTT
ttatttatttatttttgcat

SEQ ID NO: 212392 - DNA, 20 bp, Artificial Sequence
  Description of Artificial Sequence: Synthetic oligonucleotide
  Target: ATXN1; (-) strand; PAM type: YTN; PAM sequence: CTT
tttatttatttatttttgca

SEQ ID NO: 212393 - DNA, 20 bp, Artificial Sequence
  Description of Artificial Sequence: Synthetic oligonucleotide
  Target: ATXN1; (-) strand; PAM type: YTN; PAM sequence: CTC
agtgactttttatttattta

SEQ ID NO: 212394 - DNA, 20 bp, Artificial Sequence
  Description of Artificial Sequence: Synthetic oligonucleotide
  Target: ATXN1; (-) strand; PAM type: YTN; PAM sequence: TTC
tcagtgactttttatttatt

SEQ ID NO: 212395 - DNA, 20 bp, Artificial Sequence
  Description of Artificial Sequence: Synthetic oligonucleotide
  Target: ATXN1; (-) strand; PAM type: YTN; PAM sequence: CTA
gttctcagtgactttttatt

SEQ ID NO: 212396 - DNA, 20 bp, Artificial Sequence
  Description of Artificial Sequence: Synthetic oligonucleotide
  Target: ATXN1; (-) strand; PAM type: YTN; PAM sequence: CTG
ctagttctcagtgacttttt

SEQ ID NO: 212397 - DNA, 20 bp, Artificial Sequence
  Description of Artificial Sequence: Synthetic oligonucleotide
  Target: ATXN1; (-) strand; PAM type: YTN; PAM sequence: CTG
ctgctagttctcagtgactt

SEQ ID NO: 212398 - DNA, 20 bp, Artificial Sequence
  Description of Artificial Sequence: Synthetic oligonucleotide
  Target: ATXN1; (-) strand; PAM type: YTN; PAM sequence: CTA
tcatctgctgctagttctca

SEQ ID NO: 212399 - DNA, 20 bp, Artificial Sequence
  Description of Artificial Sequence: Synthetic oligonucleotide
  Target: ATXN1; (-) strand; PAM type: YTN; PAM sequence: CTG
cctatcatctgctgctagtt

SEQ ID NO: 212400 - DNA, 20 bp, Artificial Sequence
  Description of Artificial Sequence: Synthetic oligonucleotide
  Target: ATXN1; (-) strand; PAM type: YTN; PAM sequence: TTC
tgcctatcatctgctgctag

SEQ ID NO: 212401 - DNA, 20 bp, Artificial Sequence
  Description of Artificial Sequence: Synthetic oligonucleotide
  Target: ATXN1; (-) strand; PAM type: YTN; PAM sequence: TTT
ctgcctatcatctgctgcta

SEQ ID NO: 212402 - DNA, 20 bp, Artificial Sequence
  Description of Artificial Sequence: Synthetic oligonucleotide
  Target: ATXN1; (-) strand; PAM type: YTN; PAM sequence: TTT
tctgcctatcatctgctgct

SEQ ID NO: 212403 - DNA, 20 bp, Artificial Sequence
  Description of Artificial Sequence: Synthetic oligonucleotide
  Target: ATXN1; (-) strand; PAM type: YTN; PAM sequence: CTT
ttctgcctatcatctgctgc

SEQ ID NO: 212404 - DNA, 20 bp, Artificial Sequence
  Description of Artificial Sequence: Synthetic oligonucleotide
  Target: ATXN1; (-) strand; PAM type: YTN; PAM sequence: CTC
cacttttctgcctatcatct

SEQ ID NO: 212405 - DNA, 20 bp, Artificial Sequence
  Description of Artificial Sequence: Synthetic oligonucleotide
  Target: ATXN1; (-) strand; PAM type: YTN; PAM sequence: CTA
ctccacttttctgcctatca

SEQ ID NO: 212406 - DNA, 20 bp, Artificial Sequence
  Description of Artificial Sequence: Synthetic oligonucleotide
  Target: ATXN1; (-) strand; PAM type: YTN; PAM sequence: TTA
actactccacttttctgcct

SEQ ID NO: 212407 - DNA, 20 bp, Artificial Sequence
  Description of Artificial Sequence: Synthetic oligonucleotide
  Target: ATXN1; (-) strand; PAM type: YTN; PAM sequence: CTT
aactactccacttttctgcc

SEQ ID NO: 212408 - DNA, 20 bp, Artificial Sequence
  Description of Artificial Sequence: Synthetic oligonucleotide
  Target: ATXN1; (-) strand; PAM type: YTN; PAM sequence: TTG
tcttaactactccacttttc

SEQ ID NO: 212409 - DNA, 20 bp, Artificial Sequence
  Description of Artificial Sequence: Synthetic oligonucleotide
  Target: ATXN1; (-) strand; PAM type: YTN; PAM sequence: CTG
ttgtcttaactactccactt

SEQ ID NO: 212410 - DNA, 20 bp, Artificial Sequence
  Description of Artificial Sequence: Synthetic oligonucleotide
  Target: ATXN1; (-) strand; PAM type: YTN; PAM sequence: CTG
acaccaaagcctgttgtctt

SEQ ID NO: 212411 - DNA, 20 bp, Artificial Sequence
  Description of Artificial Sequence: Synthetic oligonucleotide
  Target: ATXN1; (-) strand; PAM type: YTN; PAM sequence: TTC
aaagccagtgtgcctgacac

SEQ ID NO: 212412 - DNA, 20 bp, Artificial Sequence
  Description of Artificial Sequence: Synthetic oligonucleotide
  Target: ATXN1; (-) strand; PAM type: YTN; PAM sequence: CTA
gaattcaaagccagtgtgcc

SEQ ID NO: 212413 - DNA, 20 bp, Artificial Sequence
  Description of Artificial Sequence: Synthetic oligonucleotide
  Target: ATXN1; (-) strand; PAM type: YTN; PAM sequence: TTG
tgggtggtggaggctagaat

SEQ ID NO: 212414 - DNA, 20 bp, Artificial Sequence
  Description of Artificial Sequence: Synthetic oligonucleotide
  Target: ATXN1; (-) strand; PAM type: YTN; PAM sequence: CTT
gtgggtggtggaggctagaa

SEQ ID NO: 212415 - DNA, 20 bp, Artificial Sequence
  Description of Artificial Sequence: Synthetic oligonucleotide
  Target: ATXN1; (-) strand; PAM type: YTN; PAM sequence: TTA
cccagcttgtgggtggtgga

SEQ ID NO: 212416 - DNA, 20 bp, Artificial Sequence
  Description of Artificial Sequence: Synthetic oligonucleotide
  Target: ATXN1; (-) strand; PAM type: YTN; PAM sequence: TTT
acccagcttgtgggtggtgg

SEQ ID NO: 212417 - DNA, 20 bp, Artificial Sequence
  Description of Artificial Sequence: Synthetic oligonucleotide
  Target: ATXN1; (-) strand; PAM type: YTN; PAM sequence: CTC
gcccacatttacccagcttg

SEQ ID NO: 212418 - DNA, 20 bp, Artificial Sequence
  Description of Artificial Sequence: Synthetic oligonucleotide
  Target: ATXN1; (-) strand; PAM type: YTN; PAM sequence: CTA
ctcgcccacatttacccagc

SEQ ID NO: 212419 - DNA, 20 bp, Artificial Sequence
  Description of Artificial Sequence: Synthetic oligonucleotide
  Target: ATXN1; (-) strand; PAM type: YTN; PAM sequence: TTA
aactactcgcccacatttac

SEQ ID NO: 212420 - DNA, 20 bp, Artificial Sequence
  Description of Artificial Sequence: Synthetic oligonucleotide
  Target: ATXN1; (-) strand; PAM type: YTN; PAM sequence: CTC
agatagattaaactactcgc

SEQ ID NO: 212421 - DNA, 20 bp, Artificial Sequence
  Description of Artificial Sequence: Synthetic oligonucleotide
  Target: ATXN1; (-) strand; PAM type: YTN; PAM sequence: TTA
aaaatggtggcactcagata

SEQ ID NO: 212422 - DNA, 20 bp, Artificial Sequence
  Description of Artificial Sequence: Synthetic oligonucleotide
  Target: ATXN1; (-) strand; PAM type: YTN; PAM sequence: TTT
aaaaatggtggcactcagat

SEQ ID NO: 212423 - DNA, 20 bp, Artificial Sequence
  Description of Artificial Sequence: Synthetic oligonucleotide
  Target: ATXN1; (-) strand; PAM type: YTN; PAM sequence: TTT
taaaaatggtggcactcaga

SEQ ID NO: 212424 - DNA, 20 bp, Artificial Sequence
  Description of Artificial Sequence: Synthetic oligonucleotide
  Target: ATXN1; (-) strand; PAM type: YTN; PAM sequence: TTT
ttaaaaatggtggcactcag

SEQ ID NO: 212425 - DNA, 20 bp, Artificial Sequence
  Description of Artificial Sequence: Synthetic oligonucleotide
  Target: ATXN1; (-) strand; PAM type: YTN; PAM sequence: CTA
cagatttttaaaaatggtgg

SEQ ID NO: 212426 - DNA, 20 bp, Artificial Sequence
  Description of Artificial Sequence: Synthetic oligonucleotide
  Target: ATXN1; (-) strand; PAM type: YTN; PAM sequence: TTC
tacagatttttaaaaatggt

SEQ ID NO: 212427 - DNA, 20 bp, Artificial Sequence
  Description of Artificial Sequence: Synthetic oligonucleotide
  Target: ATXN1; (-) strand; PAM type: YTN; PAM sequence: CTA
ttctacagatttttaaaaat

SEQ ID NO: 212428 - DNA, 20 bp, Artificial Sequence
  Description of Artificial Sequence: Synthetic oligonucleotide
  Target: ATXN1; (-) strand; PAM type: YTN; PAM sequence: TTA
ctattctacagatttttaaa

SEQ ID NO: 212429 - DNA, 20 bp, Artificial Sequence
  Description of Artificial Sequence: Synthetic oligonucleotide
  Target: ATXN1; (-) strand; PAM type: YTN; PAM sequence: CTG
ttactattctacagattttt

SEQ ID NO: 212430 - DNA, 20 bp, Artificial Sequence
  Description of Artificial Sequence: Synthetic oligonucleotide
  Target: ATXN1; (-) strand; PAM type: YTN; PAM sequence: TTG
ctgttactattctacagatt

SEQ ID NO: 212431 - DNA, 20 bp, Artificial Sequence
  Description of Artificial Sequence: Synthetic oligonucleotide
  Target: ATXN1; (-) strand; PAM type: YTN; PAM sequence: TTA
ttgctgttactattctacag

SEQ ID NO: 212432 - DNA, 20 bp, Artificial Sequence
  Description of Artificial Sequence: Synthetic oligonucleotide
  Target: ATXN1; (-) strand; PAM type: YTN; PAM sequence: TTG
aggtagttattgctgttact

SEQ ID NO: 212433 - DNA, 20 bp, Artificial Sequence
  Description of Artificial Sequence: Synthetic oligonucleotide
  Target: ATXN1; (-) strand; PAM type: YTN; PAM sequence: TTT
gaggtagttattgctgttac

SEQ ID NO: 212434 - DNA, 20 bp, Artificial Sequence
  Description of Artificial Sequence: Synthetic oligonucleotide
  Target: ATXN1; (-) strand; PAM type: YTN; PAM sequence: CTT
tgaggtagttattgctgtta

SEQ ID NO: 212435 - DNA, 20 bp, Artificial Sequence
  Description of Artificial Sequence: Synthetic oligonucleotide
  Target: ATXN1; (-) strand; PAM type: YTN; PAM sequence: CTC
tttgaggtagttattgctgt

SEQ ID NO: 212436 - DNA, 20 bp, Artificial Sequence
  Description of Artificial Sequence: Synthetic oligonucleotide
  Target: ATXN1; (-) strand; PAM type: YTN; PAM sequence: TTA
gcccaacaactctttgaggt

SEQ ID NO: 212437 - DNA, 20 bp, Artificial Sequence
  Description of Artificial Sequence: Synthetic oligonucleotide
  Target: ATXN1; (-) strand; PAM type: YTN; PAM sequence: CTG
aattagcccaacaactcttt

SEQ ID NO: 212438 - DNA, 20 bp, Artificial Sequence
  Description of Artificial Sequence: Synthetic oligonucleotide
  Target: ATXN1; (-) strand; PAM type: YTN; PAM sequence: CTG
atcataatcagtgatcatca

SEQ ID NO: 212439 - DNA, 20 bp, Artificial Sequence
  Description of Artificial Sequence: Synthetic oligonucleotide
  Target: ATXN1; (-) strand; PAM type: YTN; PAM sequence: CTC
actgatcataatcagtgatc

SEQ ID NO: 212440 - DNA, 20 bp, Artificial Sequence
  Description of Artificial Sequence: Synthetic oligonucleotide
  Target: ATXN1; (-) strand; PAM type: YTN; PAM sequence: CTA
gaagctcactgatcataatc

SEQ ID NO: 212441 - DNA, 20 bp, Artificial Sequence
  Description of Artificial Sequence: Synthetic oligonucleotide
  Target: ATXN1; (-) strand; PAM type: YTN; PAM sequence: CTG
tcacacctagaagctcactg

SEQ ID NO: 212442 - DNA, 20 bp, Artificial Sequence
  Description of Artificial Sequence: Synthetic oligonucleotide
  Target: ATXN1; (-) strand; PAM type: YTN; PAM sequence: CTG
ggcctgtcacacctagaagc

SEQ ID NO: 212443 - DNA, 20 bp, Artificial Sequence
  Description of Artificial Sequence: Synthetic oligonucleotide
  Target: ATXN1; (-) strand; PAM type: YTN; PAM sequence: TTA
aaactgggcctgtcacacct

SEQ ID NO: 212444 - DNA, 20 bp, Artificial Sequence
  Description of Artificial Sequence: Synthetic oligonucleotide
  Target: ATXN1; (-) strand; PAM type: YTN; PAM sequence: TTT
aaaactgggcctgtcacacc

SEQ ID NO: 212445 - DNA, 20 bp, Artificial Sequence
  Description of Artificial Sequence: Synthetic oligonucleotide
  Target: ATXN1; (-) strand; PAM type: YTN; PAM sequence: TTC
cagtgtttaaaactgggcct

SEQ ID NO: 212446 - DNA, 20 bp, Artificial Sequence
  Description of Artificial Sequence: Synthetic oligonucleotide
  Target: ATXN1; (-) strand; PAM type: YTN; PAM sequence: TTT
ccagtgtttaaaactgggcc

SEQ ID NO: 212447 - DNA, 20 bp, Artificial Sequence
  Description of Artificial Sequence: Synthetic oligonucleotide
  Target: ATXN1; (-) strand; PAM type: YTN; PAM sequence: TTG
tgtatttccagtgtttaaaa

SEQ ID NO: 212448 - DNA, 20 bp, Artificial Sequence
  Description of Artificial Sequence: Synthetic oligonucleotide
  Target: ATXN1; (-) strand; PAM type: YTN; PAM sequence: CTT
gtgtatttccagtgtttaaa

SEQ ID NO: 212449 - DNA, 20 bp, Artificial Sequence
  Description of Artificial Sequence: Synthetic oligonucleotide
  Target: ATXN1; (-) strand; PAM type: YTN; PAM sequence: CTG
tcacttgtgtatttccagtg

SEQ ID NO: 212450 - DNA, 20 bp, Artificial Sequence
  Description of Artificial Sequence: Synthetic oligonucleotide
  Target: ATXN1; (-) strand; PAM type: YTN; PAM sequence: TTA
catctgtcacttgtgtattt

SEQ ID NO: 212451 - DNA, 20 bp, Artificial Sequence
  Description of Artificial Sequence: Synthetic oligonucleotide
  Target: ATXN1; (-) strand; PAM type: YTN; PAM sequence: CTT
acatctgtcacttgtgtatt

SEQ ID NO: 212452 - DNA, 20 bp, Artificial Sequence
  Description of Artificial Sequence: Synthetic oligonucleotide
  Target: ATXN1; (-) strand; PAM type: YTN; PAM sequence: CTG
tggaagcagagcccatgctt

SEQ ID NO: 212453 - DNA, 20 bp, Artificial Sequence
  Description of Artificial Sequence: Synthetic oligonucleotide
  Target: ATXN1; (-) strand; PAM type: YTN; PAM sequence: TTA
agtctgtggaagcagagccc

SEQ ID NO: 212454 - DNA, 20 bp, Artificial Sequence
  Description of Artificial Sequence: Synthetic oligonucleotide
  Target: ATXN1; (-) strand; PAM type: YTN; PAM sequence: TTG
agagtgatgttaagtctgtg

SEQ ID NO: 212455 - DNA, 20 bp, Artificial Sequence
  Description of Artificial Sequence: Synthetic oligonucleotide
  Target: ATXN1; (-) strand; PAM type: YTN; PAM sequence: TTT
gagagtgatgttaagtctgt

SEQ ID NO: 212456 - DNA, 20 bp, Artificial Sequence
  Description of Artificial Sequence: Synthetic oligonucleotide
  Target: ATXN1; (-) strand; PAM type: YTN; PAM sequence: CTA
aaatttgagagtgatgttaa

SEQ ID NO: 212457 - DNA, 20 bp, Artificial Sequence
  Description of Artificial Sequence: Synthetic oligonucleotide
  Target: ATXN1; (-) strand; PAM type: YTN; PAM sequence: TTC
actaaaatttgagagtgatg

SEQ ID NO: 212458 - DNA, 20 bp, Artificial Sequence
  Description of Artificial Sequence: Synthetic oligonucleotide
  Target: ATXN1; (-) strand; PAM type: YTN; PAM sequence: TTT
cactaaaatttgagagtgat

SEQ ID NO: 212459 - DNA, 20 bp, Artificial Sequence
  Description of Artificial Sequence: Synthetic oligonucleotide
  Target: ATXN1; (-) strand; PAM type: YTN; PAM sequence: CTC
atttcactaaaatttgagag

SEQ ID NO: 212460 - DNA, 20 bp, Artificial Sequence
  Description of Artificial Sequence: Synthetic oligonucleotide
  Target: ATXN1; (-) strand; PAM type: YTN; PAM sequence: TTC
tcatttcactaaaatttgag

SEQ ID NO: 212461 - DNA, 20 bp, Artificial Sequence
  Description of Artificial Sequence: Synthetic oligonucleotide
  Target: ATXN1; (-) strand; PAM type: YTN; PAM sequence: TTT
ctcatttcactaaaatttga

SEQ ID NO: 212462 - DNA, 20 bp, Artificial Sequence
  Description of Artificial Sequence: Synthetic oligonucleotide
  Target: ATXN1; (-) strand; PAM type: YTN; PAM sequence: CTT
tctcatttcactaaaatttg

SEQ ID NO: 212463 - DNA, 20 bp, Artificial Sequence
  Description of Artificial Sequence: Synthetic oligonucleotide
  Target: ATXN1; (-) strand; PAM type: YTN; PAM sequence: TTG
tctttctcatttcactaaaa

SEQ ID NO: 212464 - DNA, 20 bp, Artificial Sequence
  Description of Artificial Sequence: Synthetic oligonucleotide
  Target: ATXN1; (-) strand; PAM type: YTN; PAM sequence: TTT
gtctttctcatttcactaaa

SEQ ID NO: 212465 - DNA, 20 bp, Artificial Sequence
  Description of Artificial Sequence: Synthetic oligonucleotide
  Target: ATXN1; (-) strand; PAM type: YTN; PAM sequence: TTG
tttgtctttctcatttcact

SEQ ID NO: 212466 - DNA, 20 bp, Artificial Sequence
  Description of Artificial Sequence: Synthetic oligonucleotide
  Target: ATXN1; (-) strand; PAM type: YTN; PAM sequence: CTT
gtttgtctttctcatttcac

SEQ ID NO: 212467 - DNA, 20 bp, Artificial Sequence
  Description of Artificial Sequence: Synthetic oligonucleotide
  Target: ATXN1; (-) strand; PAM type: YTN; PAM sequence: TTA
cacatacttgtttgtctttc

SEQ ID NO: 212468 - DNA, 20 bp, Artificial Sequence
  Description of Artificial Sequence: Synthetic oligonucleotide
  Target: ATXN1; (-) strand; PAM type: YTN; PAM sequence: CTT
acacatacttgtttgtcttt

SEQ ID NO: 212469 - DNA, 20 bp, Artificial Sequence
  Description of Artificial Sequence: Synthetic oligonucleotide
  Target: ATXN1; (-) strand; PAM type: YTN; PAM sequence: TTG
cacttacacatacttgtttg

SEQ ID NO: 212470 - DNA, 20 bp, Artificial Sequence
  Description of Artificial Sequence: Synthetic oligonucleotide
  Target: ATXN1; (-) strand; PAM type: YTN; PAM sequence: TTA
ttgcacttacacatacttgt

SEQ ID NO: 212471 - DNA, 20 bp, Artificial Sequence
  Description of Artificial Sequence: Synthetic oligonucleotide
  Target: ATXN1; (-) strand; PAM type: YTN; PAM sequence: CTT
attgcacttacacatacttg

SEQ ID NO: 212472 - DNA, 20 bp, Artificial Sequence
  Description of Artificial Sequence: Synthetic oligonucleotide
  Target: ATXN1; (-) strand; PAM type: YTN; PAM sequence: TTC
cttattgcacttacacatac

SEQ ID NO: 212473 - DNA, 20 bp, Artificial Sequence
  Description of Artificial Sequence: Synthetic oligonucleotide
  Target: ATXN1; (-) strand; PAM type: YTN; PAM sequence: TTT
ccttattgcacttacacata

SEQ ID NO: 212474 - DNA, 20 bp, Artificial Sequence
  Description of Artificial Sequence: Synthetic oligonucleotide
  Target: ATXN1; (-) strand; PAM type: YTN; PAM sequence: TTT
tccttattgcacttacacat

SEQ ID NO: 212475 - DNA, 20 bp, Artificial Sequence
  Description of Artificial Sequence: Synthetic oligonucleotide
  Target: ATXN1; (-) strand; PAM type: YTN; PAM sequence: TTT
ttccttattgcacttacaca

SEQ ID NO: 212476 - DNA, 20 bp, Artificial Sequence
  Description of Artificial Sequence: Synthetic oligonucleotide
  Target: ATXN1; (-) strand; PAM type: YTN; PAM sequence: TTA
atttttccttattgcactta

SEQ ID NO: 212477 - DNA, 20 bp, Artificial Sequence
  Description of Artificial Sequence: Synthetic oligonucleotide
  Target: ATXN1; (-) strand; PAM type: YTN; PAM sequence: TTT
aatttttccttattgcactt

SEQ ID NO: 212478 - DNA, 20 bp, Artificial Sequence
  Description of Artificial Sequence: Synthetic oligonucleotide
  Target: ATXN1; (-) strand; PAM type: YTN; PAM sequence: TTC
accggtttaatttttcctta

SEQ ID NO: 212479 - DNA, 20 bp, Artificial Sequence
  Description of Artificial Sequence: Synthetic oligonucleotide
  Target: ATXN1; (-) strand; PAM type: YTN; PAM sequence: CTT
caccggtttaatttttcctt

SEQ ID NO: 212480 - DNA, 20 bp, Artificial Sequence
  Description of Artificial Sequence: Synthetic oligonucleotide
  Target: ATXN1; (-) strand; PAM type: YTN; PAM sequence: TTA
tccccttcaccggtttaatt

SEQ ID NO: 212481 - DNA, 20 bp, Artificial Sequence
  Description of Artificial Sequence: Synthetic oligonucleotide
  Target: ATXN1; (-) strand; PAM type: YTN; PAM sequence: TTT
atccccttcaccggtttaat

SEQ ID NO: 212482 - DNA, 20 bp, Artificial Sequence
  Description of Artificial Sequence: Synthetic oligonucleotide
  Target: ATXN1; (-) strand; PAM type: YTN; PAM sequence: TTT
tatccccttcaccggtttaa

SEQ ID NO: 212483 - DNA, 20 bp, Artificial Sequence
  Description of Artificial Sequence: Synthetic oligonucleotide
  Target: ATXN1; (-) strand; PAM type: YTN; PAM sequence: TTT
ttatccccttcaccggttta

SEQ ID NO: 212484 - DNA, 20 bp, Artificial Sequence
  Description of Artificial Sequence: Synthetic oligonucleotide
  Target: ATXN1; (-) strand; PAM type: YTN; PAM sequence: CTC
atcagtttttatccccttca

SEQ ID NO: 212485 - DNA, 20 bp, Artificial Sequence
  Description of Artificial Sequence: Synthetic oligonucleotide
  Target: ATXN1; (-) strand; PAM type: YTN; PAM sequence: CTA
aaataacaccctcatcagtt

SEQ ID NO: 212486 - DNA, 20 bp, Artificial Sequence
  Description of Artificial Sequence: Synthetic oligonucleotide
  Target: ATXN1; (-) strand; PAM type: YTN; PAM sequence: CTC
taaaataacaccctcatcag

SEQ ID NO: 212487 - DNA, 20 bp, Artificial Sequence
  Description of Artificial Sequence: Synthetic oligonucleotide
  Target: ATXN1; (-) strand; PAM type: YTN; PAM sequence: TTA
ctctaaaataacaccctcat

SEQ ID NO: 212488 - DNA, 20 bp, Artificial Sequence
  Description of Artificial Sequence: Synthetic oligonucleotide
  Target: ATXN1; (-) strand; PAM type: YTN; PAM sequence: TTG
cattactctaaaataacacc

SEQ ID NO: 212489 - DNA, 20 bp, Artificial Sequence
  Description of Artificial Sequence: Synthetic oligonucleotide
  Target: ATXN1; (-) strand; PAM type: YTN; PAM sequence: TTT
gcattactctaaaataacac

SEQ ID NO: 212490 - DNA, 20 bp, Artificial Sequence
  Description of Artificial Sequence: Synthetic oligonucleotide
  Target: ATXN1; (-) strand; PAM type: YTN; PAM sequence: CTT
tgcattactctaaaataaca

SEQ ID NO: 212491 - DNA, 20 bp, Artificial Sequence
  Description of Artificial Sequence: Synthetic oligonucleotide
  Target: ATXN1; (-) strand; PAM type: YTN; PAM sequence: CTC
agggtctttgcattactcta

SEQ ID NO: 212492 - DNA, 20 bp, Artificial Sequence
  Description of Artificial Sequence: Synthetic oligonucleotide
  Target: ATXN1; (-) strand; PAM type: YTN; PAM sequence: CTC
cctcagggtctttgcattac

SEQ ID NO: 212493 - DNA, 20 bp, Artificial Sequence
  Description of Artificial Sequence: Synthetic oligonucleotide
  Target: ATXN1; (-) strand; PAM type: YTN; PAM sequence: TTC
ctccctcagggtctttgcat

SEQ ID NO: 212494 - DNA, 20 bp, Artificial Sequence
  Description of Artificial Sequence: Synthetic oligonucleotide
  Target: ATXN1; (-) strand; PAM type: YTN; PAM sequence: TTA
atgcaaacatgttcctccct

SEQ ID NO: 212495 - DNA, 20 bp, Artificial Sequence
  Description of Artificial Sequence: Synthetic oligonucleotide
  Target: ATXN1; (-) strand; PAM type: YTN; PAM sequence: TTT
aatgcaaacatgttcctccc

SEQ ID NO: 212496 - DNA, 20 bp, Artificial Sequence
  Description of Artificial Sequence: Synthetic oligonucleotide
  Target: ATXN1; (-) strand; PAM type: YTN; PAM sequence: TTA
ccgtttaatgcaaacatgtt

SEQ ID NO: 212497 - DNA, 20 bp, Artificial Sequence
  Description of Artificial Sequence: Synthetic oligonucleotide
  Target: ATXN1; (-) strand; PAM type: YTN; PAM sequence: CTT
accgtttaatgcaaacatgt

SEQ ID NO: 212498 - DNA, 20 bp, Artificial Sequence
  Description of Artificial Sequence: Synthetic oligonucleotide
  Target: ATXN1; (-) strand; PAM type: YTN; PAM sequence: CTC
cttaccgtttaatgcaaaca

SEQ ID NO: 212499 - DNA, 20 bp, Artificial Sequence
  Description of Artificial Sequence: Synthetic oligonucleotide
  Target: ATXN1; (-) strand; PAM type: YTN; PAM sequence: CTA
agctccttaccgtttaatgc

SEQ ID NO: 212500 - DNA, 20 bp, Artificial Sequence
  Description of Artificial Sequence: Synthetic oligonucleotide
  Target: ATXN1; (-) strand; PAM type: YTN; PAM sequence: CTG
agctaagctccttaccgttt

SEQ ID NO: 212501 - DNA, 20 bp, Artificial Sequence
  Description of Artificial Sequence: Synthetic oligonucleotide
  Target: ATXN1; (-) strand; PAM type: YTN; PAM sequence: TTA
tgagccctgagctaagctcc

SEQ ID NO: 212502 - DNA, 20 bp, Artificial Sequence
  Description of Artificial Sequence: Synthetic oligonucleotide
  Target: ATXN1; (-) strand; PAM type: YTN; PAM sequence: TTT
atgagccctgagctaagctc

SEQ ID NO: 212503 - DNA, 20 bp, Artificial Sequence
  Description of Artificial Sequence: Synthetic oligonucleotide
  Target: ATXN1; (-) strand; PAM type: YTN; PAM sequence: TTT
tatgagccctgagctaagct

SEQ ID NO: 212504 - DNA, 20 bp, Artificial Sequence
  Description of Artificial Sequence: Synthetic oligonucleotide
  Target: ATXN1; (-) strand; PAM type: YTN; PAM sequence: CTA
gagcacatggttttatgagc

SEQ ID NO: 212505 - DNA, 20 bp, Artificial Sequence
  Description of Artificial Sequence: Synthetic oligonucleotide
  Target: ATXN1; (-) strand; PAM type: YTN; PAM sequence: CTC
ctagagcacatggttttatg

SEQ ID NO: 212506 - DNA, 20 bp, Artificial Sequence
  Description of Artificial Sequence: Synthetic oligonucleotide
  Target: ATXN1; (-) strand; PAM type: YTN; PAM sequence: TTA
tgagaccaccaccaaccacc

SEQ ID NO: 212507 - DNA, 20 bp, Artificial Sequence
  Description of Artificial Sequence: Synthetic oligonucleotide
  Target: ATXN1; (-) strand; PAM type: YTN; PAM sequence: TTA
tcgttatgagaccaccacca

SEQ ID NO: 212508 - DNA, 20 bp, Artificial Sequence
  Description of Artificial Sequence: Synthetic oligonucleotide
  Target: ATXN1; (-) strand; PAM type: YTN; PAM sequence: TTG
gttatcgttatgagaccacc

SEQ ID NO: 212509 - DNA, 20 bp, Artificial Sequence
  Description of Artificial Sequence: Synthetic oligonucleotide
  Target: ATXN1; (-) strand; PAM type: YTN; PAM sequence: TTT
ggttatcgttatgagaccac

SEQ ID NO: 212510 - DNA, 20 bp, Artificial Sequence
  Description of Artificial Sequence: Synthetic oligonucleotide
  Target: ATXN1; (-) strand; PAM type: YTN; PAM sequence: TTG
tttggttatcgttatgagac

SEQ ID NO: 212511 - DNA, 20 bp, Artificial Sequence
  Description of Artificial Sequence: Synthetic oligonucleotide
  Target: ATXN1; (-) strand; PAM type: YTN; PAM sequence: CTT
gtttggttatcgttatgaga

SEQ ID NO: 212512 - DNA, 20 bp, Artificial Sequence
  Description of Artificial Sequence: Synthetic oligonucleotide
  Target: ATXN1; (-) strand; PAM type: YTN; PAM sequence: TTG
cttgtttggttatcgttatg

SEQ ID NO: 212513 - DNA, 20 bp, Artificial Sequence
  Description of Artificial Sequence: Synthetic oligonucleotide
  Target: ATXN1; (-) strand; PAM type: YTN; PAM sequence: TTT
gcttgtttggttatcgttat

SEQ ID NO: 212514 - DNA, 20 bp, Artificial Sequence
  Description of Artificial Sequence: Synthetic oligonucleotide
  Target: ATXN1; (-) strand; PAM type: YTN; PAM sequence: CTT
tgcttgtttggttatcgtta

SEQ ID NO: 212515 - DNA, 20 bp, Artificial Sequence
  Description of Artificial Sequence: Synthetic oligonucleotide
  Target: ATXN1; (-) strand; PAM type: YTN; PAM sequence: CTC
tttgcttgtttggttatcgt

SEQ ID NO: 212516 - DNA, 20 bp, Artificial Sequence
  Description of Artificial Sequence: Synthetic oligonucleotide
  Target: ATXN1; (-) strand; PAM type: YTN; PAM sequence: TTG
tactctttgcttgtttggtt

SEQ ID NO: 212517 - DNA, 20 bp, Artificial Sequence
  Description of Artificial Sequence: Synthetic oligonucleotide
  Target: ATXN1; (-) strand; PAM type: YTN; PAM sequence: CTT
gtactctttgcttgtttggt

SEQ ID NO: 212518 - DNA, 20 bp, Artificial Sequence
  Description of Artificial Sequence: Synthetic oligonucleotide
  Target: ATXN1; (-) strand; PAM type: YTN; PAM sequence: TTC
gcacatcccttgtactcttt

SEQ ID NO: 212519 - DNA, 20 bp, Artificial Sequence
  Description of Artificial Sequence: Synthetic oligonucleotide
  Target: ATXN1; (-) strand; PAM type: YTN; PAM sequence: CTA
ttcgcacatcccttgtactc

SEQ ID NO: 212520 - DNA, 20 bp, Artificial Sequence
  Description of Artificial Sequence: Synthetic oligonucleotide
  Target: ATXN1; (-) strand; PAM type: YTN; PAM sequence: CTG
tacctattcgcacatccctt

SEQ ID NO: 212521 - DNA, 20 bp, Artificial Sequence
  Description of Artificial Sequence: Synthetic oligonucleotide
  Target: ATXN1; (-) strand; PAM type: YTN; PAM sequence: TTA
atgtgggctgtacctattcg

SEQ ID NO: 212522 - DNA, 20 bp, Artificial Sequence
  Description of Artificial Sequence: Synthetic oligonucleotide
  Target: ATXN1; (-) strand; PAM type: YTN; PAM sequence: CTT
aatgtgggctgtacctattc

SEQ ID NO: 212523 - DNA, 20 bp, Artificial Sequence
  Description of Artificial Sequence: Synthetic oligonucleotide
  Target: ATXN1; (-) strand; PAM type: YTN; PAM sequence: TTA
cttaatgtgggctgtaccta

SEQ ID NO: 212524 - DNA, 20 bp, Artificial Sequence
  Description of Artificial Sequence: Synthetic oligonucleotide
  Target: ATXN1; (-) strand; PAM type: YTN; PAM sequence: TTT
acttaatgtgggctgtacct

SEQ ID NO: 212525 - DNA, 20 bp, Artificial Sequence
  Description of Artificial Sequence: Synthetic oligonucleotide
  Target: ATXN1; (-) strand; PAM type: YTN; PAM sequence: CTT
tacttaatgtgggctgtacc

SEQ ID NO: 212526 - DNA, 20 bp, Artificial Sequence
  Description of Artificial Sequence: Synthetic oligonucleotide
  Target: ATXN1; (-) strand; PAM type: YTN; PAM sequence: TTC
tttacttaatgtgggctgta

SEQ ID NO: 212527 - DNA, 20 bp, Artificial Sequence
  Description of Artificial Sequence: Synthetic oligonucleotide
  Target: ATXN1; (-) strand; PAM type: YTN; PAM sequence: TTT
ctttacttaatgtgggctgt

SEQ ID NO: 212528 - DNA, 20 bp, Artificial Sequence
  Description of Artificial Sequence: Synthetic oligonucleotide
  Target: ATXN1; (-) strand; PAM type: YTN; PAM sequence: TTC
atttctttacttaatgtggg

SEQ ID NO: 212529 - DNA, 20 bp, Artificial Sequence
  Description of Artificial Sequence: Synthetic oligonucleotide
  Target: ATXN1; (-) strand; PAM type: YTN; PAM sequence: TTG
tcagttcatttctttactta

SEQ ID NO: 212530 - DNA, 20 bp, Artificial Sequence
  Description of Artificial Sequence: Synthetic oligonucleotide
  Target: ATXN1; (-) strand; PAM type: YTN; PAM sequence: TTT
gtcagttcatttctttactt

SEQ ID NO: 212531 - DNA, 20 bp, Artificial Sequence
  Description of Artificial Sequence: Synthetic oligonucleotide
  Target: ATXN1; (-) strand; PAM type: YTN; PAM sequence: TTT
tgtcagttcatttctttact

SEQ ID NO: 212532 - DNA, 20 bp, Artificial Sequence
  Description of Artificial Sequence: Synthetic oligonucleotide
  Target: ATXN1; (-) strand; PAM type: YTN; PAM sequence: CTA
attttgtcagttcatttctt

SEQ ID NO: 212533 - DNA, 20 bp, Artificial Sequence
  Description of Artificial Sequence: Synthetic oligonucleotide
  Target: ATXN1; (-) strand; PAM type: YTN; PAM sequence: TTC
gatactaattttgtcagttc

SEQ ID NO: 212534 - DNA, 20 bp, Artificial Sequence
  Description of Artificial Sequence: Synthetic oligonucleotide
  Target: ATXN1; (-) strand; PAM type: YTN; PAM sequence: CTG
tgttcgatactaattttgtc

SEQ ID NO: 212535 - DNA, 20 bp, Artificial Sequence
  Description of Artificial Sequence: Synthetic oligonucleotide
  Target: ATXN1; (-) strand; PAM type: YTN; PAM sequence: TTC
ctgtgttcgatactaatttt

SEQ ID NO: 212536 - DNA, 20 bp, Artificial Sequence
  Description of Artificial Sequence: Synthetic oligonucleotide
  Target: ATXN1; (-) strand; PAM type: YTN; PAM sequence: CTT
cctgtgttcgatactaattt

SEQ ID NO: 212537 - DNA, 20 bp, Artificial Sequence
  Description of Artificial Sequence: Synthetic oligonucleotide
  Target: ATXN1; (-) strand; PAM type: YTN; PAM sequence: TTA
gtacttcctgtgttcgatac

SEQ ID NO: 212538 - DNA, 20 bp, Artificial Sequence
  Description of Artificial Sequence: Synthetic oligonucleotide
  Target: ATXN1; (-) strand; PAM type: YTN; PAM sequence: CTA
attagtacttcctgtgttcg

SEQ ID NO: 212539 - DNA, 20 bp, Artificial Sequence
  Description of Artificial Sequence: Synthetic oligonucleotide
  Target: ATXN1; (-) strand; PAM type: YTN; PAM sequence: TTC
taattagtacttcctgtgtt

SEQ ID NO: 212540 - DNA, 20 bp, Artificial Sequence
  Description of Artificial Sequence: Synthetic oligonucleotide
  Target: ATXN1; (-) strand; PAM type: YTN; PAM sequence: TTA
gtcaagattctaattagtac

SEQ ID NO: 212541 - DNA, 20 bp, Artificial Sequence
  Description of Artificial Sequence: Synthetic oligonucleotide
  Target: ATXN1; (-) strand; PAM type: YTN; PAM sequence: TTA
ataaatgaaaattagtcaag

SEQ ID NO: 212542 - DNA, 20 bp, Artificial Sequence
  Description of Artificial Sequence: Synthetic oligonucleotide
  Target: ATXN1; (-) strand; PAM type: YTN; PAM sequence: TTT
aataaatgaaaattagtcaa

SEQ ID NO: 212543 - DNA, 20 bp, Artificial Sequence
  Description of Artificial Sequence: Synthetic oligonucleotide
  Target: ATXN1; (-) strand; PAM type: YTN; PAM sequence: CTT
taataaatgaaaattagtca

SEQ ID NO: 212544 - DNA, 20 bp, Artificial Sequence
  Description of Artificial Sequence: Synthetic oligonucleotide
  Target: ATXN1; (-) strand; PAM type: YTN; PAM sequence: CTG
cagtctttaataaatgaaaa

SEQ ID NO: 212545 - DNA, 20 bp, Artificial Sequence
  Description of Artificial Sequence: Synthetic oligonucleotide
  Target: ATXN1; (-) strand; PAM type: YTN; PAM sequence: CTA
aaaatagaactgcagtcttt

SEQ ID NO: 212546 - DNA, 20 bp, Artificial Sequence
  Description of Artificial Sequence: Synthetic oligonucleotide
  Target: ATXN1; (-) strand; PAM type: YTN; PAM sequence: TTG
aaggatataactaaaaatag

SEQ ID NO: 212547 - DNA, 20 bp, Artificial Sequence
  Description of Artificial Sequence: Synthetic oligonucleotide
  Target: ATXN1; (-) strand; PAM type: YTN; PAM sequence: TTA
gattgaaggatataactaaa

SEQ ID NO: 212548 - DNA, 20 bp, Artificial Sequence
  Description of Artificial Sequence: Synthetic oligonucleotide
  Target: ATXN1; (-) strand; PAM type: YTN; PAM sequence: TTG
aatgatgttagattgaagga

SEQ ID NO: 212549 - DNA, 20 bp, Artificial Sequence
  Description of Artificial Sequence: Synthetic oligonucleotide
  Target: ATXN1; (-) strand; PAM type: YTN; PAM sequence: CTT
gaatgatgttagattgaagg

SEQ ID NO: 212550 - DNA, 20 bp, Artificial Sequence
  Description of Artificial Sequence: Synthetic oligonucleotide
  Target: ATXN1; (-) strand; PAM type: YTN; PAM sequence: TTC
ttgaatgatgttagattgaa

SEQ ID NO: 212551 - DNA, 20 bp, Artificial Sequence
  Description of Artificial Sequence: Synthetic oligonucleotide
  Target: ATXN1; (-) strand; PAM type: YTN; PAM sequence: TTT
cttgaatgatgttagattga

SEQ ID NO: 212552 - DNA, 20 bp, Artificial Sequence
  Description of Artificial Sequence: Synthetic oligonucleotide
  Target: ATXN1; (-) strand; PAM type: YTN; PAM sequence: TTT
tcttgaatgatgttagattg

SEQ ID NO: 212553 - DNA, 20 bp, Artificial Sequence
  Description of Artificial Sequence: Synthetic oligonucleotide
  Target: ATXN1; (-) strand; PAM type: YTN; PAM sequence: CTT
ttcttgaatgatgttagatt

SEQ ID NO: 212554 - DNA, 20 bp, Artificial Sequence
  Description of Artificial Sequence: Synthetic oligonucleotide
  Target: ATXN1; (-) strand; PAM type: YTN; PAM sequence: TTG
gagagaagcttttcttgaat

SEQ ID NO: 212555 - DNA, 20 bp, Artificial Sequence
  Description of Artificial Sequence: Synthetic oligonucleotide
  Target: ATXN1; (-) strand; PAM type: YTN; PAM sequence: TTT
ggagagaagcttttcttgaa

SEQ ID NO: 212556 - DNA, 20 bp, Artificial Sequence
  Description of Artificial Sequence: Synthetic oligonucleotide
  Target: ATXN1; (-) strand; PAM type: YTN; PAM sequence: TTT
tggagagaagcttttcttga

SEQ ID NO: 212557 - DNA, 20 bp, Artificial Sequence
  Description of Artificial Sequence: Synthetic oligonucleotide
  Target: ATXN1; (-) strand; PAM type: YTN; PAM sequence: TTT
ttggagagaagcttttcttg

SEQ ID NO: 212558 - DNA, 20 bp, Artificial Sequence
  Description of Artificial Sequence: Synthetic oligonucleotide
  Target: ATXN1; (-) strand; PAM type: YTN; PAM sequence: CTG
aaatagaatttttggagaga

SEQ ID NO: 212559 - DNA, 20 bp, Artificial Sequence
  Description of Artificial Sequence: Synthetic oligonucleotide
  Target: ATXN1; (-) strand; PAM type: YTN; PAM sequence: TTC
ctgaaatagaatttttggag

SEQ ID NO: 212560 - DNA, 20 bp, Artificial Sequence
  Description of Artificial Sequence: Synthetic oligonucleotide
  Target: ATXN1; (-) strand; PAM type: YTN; PAM sequence: TTA
cattcctgaaatagaatttt

SEQ ID NO: 212561 - DNA, 20 bp, Artificial Sequence
  Description of Artificial Sequence: Synthetic oligonucleotide
  Target: ATXN1; (-) strand; PAM type: YTN; PAM sequence: TTT
acattcctgaaatagaattt

SEQ ID NO: 212562 - DNA, 20 bp, Artificial Sequence
  Description of Artificial Sequence: Synthetic oligonucleotide
  Target: ATXN1; (-) strand; PAM type: YTN; PAM sequence: TTA
aaaatttacattcctgaaat

SEQ ID NO: 212563 - DNA, 20 bp, Artificial Sequence
  Description of Artificial Sequence: Synthetic oligonucleotide
  Target: ATXN1; (-) strand; PAM type: YTN; PAM sequence: TTT
aaaaatttacattcctgaaa

SEQ ID NO: 212564 - DNA, 20 bp, Artificial Sequence
  Description of Artificial Sequence: Synthetic oligonucleotide
  Target: ATXN1; (-) strand; PAM type: YTN; PAM sequence: TTT
taaaaatttacattcctgaa

SEQ ID NO: 212565 - DNA, 20 bp, Artificial Sequence
  Description of Artificial Sequence: Synthetic oligonucleotide
  Target: ATXN1; (-) strand; PAM type: YTN; PAM sequence: CTT
ttaaaaatttacattcctga

SEQ ID NO: 212566 - DNA, 20 bp, Artificial Sequence
  Description of Artificial Sequence: Synthetic oligonucleotide
  Target: ATXN1; (-) strand; PAM type: YTN; PAM sequence: TTA
cttttaaaaatttacattcc

SEQ ID NO: 212567 - DNA, 20 bp, Artificial Sequence
  Description of Artificial Sequence: Synthetic oligonucleotide
  Target: ATXN1; (-) strand; PAM type: YTN; PAM sequence: CTT
acttttaaaaatttacattc

SEQ ID NO: 212568 - DNA, 20 bp, Artificial Sequence
  Description of Artificial Sequence: Synthetic oligonucleotide
  Target: ATXN1; (-) strand; PAM type: YTN; PAM sequence: CTC
ttacttttaaaaatttacat

SEQ ID NO: 212569 - DNA, 20 bp, Artificial Sequence
  Description of Artificial Sequence: Synthetic oligonucleotide
  Target: ATXN1; (-) strand; PAM type: YTN; PAM sequence: CTG
ggtaaaaagaaatcatgcat

SEQ ID NO: 212570 - DNA, 20 bp, Artificial Sequence
  Description of Artificial Sequence: Synthetic oligonucleotide
  Target: ATXN1; (-) strand; PAM type: YTN; PAM sequence: CTA
aaaaccaacagaaagatggc

SEQ ID NO: 212571 - DNA, 20 bp, Artificial Sequence
  Description of Artificial Sequence: Synthetic oligonucleotide
  Target: ATXN1; (-) strand; PAM type: YTN; PAM sequence: CTG
gcaggctaaaaaccaacaga

SEQ ID NO: 212572 - DNA, 20 bp, Artificial Sequence
  Description of Artificial Sequence: Synthetic oligonucleotide
  Target: ATXN1; (-) strand; PAM type: YTN; PAM sequence: CTA
ctggcaggctaaaaaccaac

SEQ ID NO: 212573 - DNA, 20 bp, Artificial Sequence
  Description of Artificial Sequence: Synthetic oligonucleotide
  Target: ATXN1; (-) strand; PAM type: YTN; PAM sequence: TTA
aaatatcacatacacactac

SEQ ID NO: 212574 - DNA, 20 bp, Artificial Sequence
  Description of Artificial Sequence: Synthetic oligonucleotide
  Target: ATXN1; (-) strand; PAM type: YTN; PAM sequence: TTT
aaaatatcacatacacacta

SEQ ID NO: 212575 - DNA, 20 bp, Artificial Sequence
  Description of Artificial Sequence: Synthetic oligonucleotide
  Target: ATXN1; (-) strand; PAM type: YTN; PAM sequence: CTT
taaaatatcacatacacact

SEQ ID NO: 212576 - DNA, 20 bp, Artificial Sequence
  Description of Artificial Sequence: Synthetic oligonucleotide
  Target: ATXN1; (-) strand; PAM type: YTN; PAM sequence: CTG
catagtaagtctttaaaata

SEQ ID NO: 212577 - DNA, 20 bp, Artificial Sequence
  Description of Artificial Sequence: Synthetic oligonucleotide
  Target: ATXN1; (-) strand; PAM type: YTN; PAM sequence: CTA
agtaccctgcatagtaagtc

SEQ ID NO: 212578 - DNA, 20 bp, Artificial Sequence
  Description of Artificial Sequence: Synthetic oligonucleotide
  Target: ATXN1; (-) strand; PAM type: YTN; PAM sequence: TTC
taagtaccctgcatagtaag

SEQ ID NO: 212579 - DNA, 20 bp, Artificial Sequence
  Description of Artificial Sequence: Synthetic oligonucleotide
  Target: ATXN1; (-) strand; PAM type: YTN; PAM sequence: TTT
ctaagtaccctgcatagtaa

SEQ ID NO: 212580 - DNA, 20 bp, Artificial Sequence
  Description of Artificial Sequence: Synthetic oligonucleotide
  Target: ATXN1; (-) strand; PAM type: YTN; PAM sequence: CTC
atatgaaatttctaagtacc

SEQ ID NO: 212581 - DNA, 20 bp, Artificial Sequence
  Description of Artificial Sequence: Synthetic oligonucleotide
  Target: ATXN1; (-) strand; PAM type: YTN; PAM sequence: TTA
aatgctcatatgaaatttct

SEQ ID NO: 212582 - DNA, 20 bp, Artificial Sequence
  Description of Artificial Sequence: Synthetic oligonucleotide
  Target: ATXN1; (-) strand; PAM type: YTN; PAM sequence: TTT
aaatgctcatatgaaatttc

SEQ ID NO: 212583 - DNA, 20 bp, Artificial Sequence
  Description of Artificial Sequence: Synthetic oligonucleotide
  Target: ATXN1; (-) strand; PAM type: YTN; PAM sequence: TTT
taaatgctcatatgaaattt

SEQ ID NO: 212584 - DNA, 20 bp, Artificial Sequence
  Description of Artificial Sequence: Synthetic oligonucleotide
  Target: ATXN1; (-) strand; PAM type: YTN; PAM sequence: CTG
ccattttaaatgctcatatg

SEQ ID NO: 212585 - DNA, 20 bp, Artificial Sequence
  Description of Artificial Sequence: Synthetic oligonucleotide
  Target: ATXN1; (-) strand; PAM type: YTN; PAM sequence: TTC
tgccattttaaatgctcata

SEQ ID NO: 212586 - DNA, 20 bp, Artificial Sequence
  Description of Artificial Sequence: Synthetic oligonucleotide
  Target: ATXN1; (-) strand; PAM type: YTN; PAM sequence: TTT
ctgccattttaaatgctcat

SEQ ID NO: 212587 - DNA, 20 bp, Artificial Sequence
  Description of Artificial Sequence: Synthetic oligonucleotide
  Target: ATXN1; (-) strand; PAM type: YTN; PAM sequence: CTA
tttctgccattttaaatgct

SEQ ID NO: 212588 - DNA, 20 bp, Artificial Sequence
  Description of Artificial Sequence: Synthetic oligonucleotide
  Target: ATXN1; (-) strand; PAM type: YTN; PAM sequence: CTA
ccagctatttctgccatttt

SEQ ID NO: 212589 - DNA, 20 bp, Artificial Sequence
  Description of Artificial Sequence: Synthetic oligonucleotide
  Target: ATXN1; (-) strand; PAM type: YTN; PAM sequence: CTG
agagtacatgtggaaatgaa

SEQ ID NO: 212590 - DNA, 20 bp, Artificial Sequence
  Description of Artificial Sequence: Synthetic oligonucleotide
  Target: ATXN1; (-) strand; PAM type: YTN; PAM sequence: TTC
tgagagtacatgtggaaatg

SEQ ID NO: 212591 - DNA, 20 bp, Artificial Sequence
  Description of Artificial Sequence: Synthetic oligonucleotide
  Target: ATXN1; (-) strand; PAM type: YTN; PAM sequence: CTG
ttctgagagtacatgtggaa

SEQ ID NO: 212592 - DNA, 20 bp, Artificial Sequence
  Description of Artificial Sequence: Synthetic oligonucleotide
  Target: ATXN1; (-) strand; PAM type: YTN; PAM sequence: CTC
tgttctgagagtacatgtgg

SEQ ID NO: 212593 - DNA, 20 bp, Artificial Sequence
  Description of Artificial Sequence: Synthetic oligonucleotide
  Target: ATXN1; (-) strand; PAM type: YTN; PAM sequence: TTC
tctgttctgagagtacatgt

SEQ ID NO: 212594 - DNA, 20 bp, Artificial Sequence
  Description of Artificial Sequence: Synthetic oligonucleotide
  Target: ATXN1; (-) strand; PAM type: YTN; PAM sequence: TTT
ctctgttctgagagtacatg

SEQ ID NO: 212595 - DNA, 20 bp, Artificial Sequence
  Description of Artificial Sequence: Synthetic oligonucleotide
  Target: ATXN1; (-) strand; PAM type: YTN; PAM sequence: TTT
tctctgttctgagagtacat

SEQ ID NO: 212596 - DNA, 20 bp, Artificial Sequence
  Description of Artificial Sequence: Synthetic oligonucleotide
  Target: ATXN1; (-) strand; PAM type: YTN; PAM sequence: TTT
ttctctgttctgagagtaca

SEQ ID NO: 212597 - DNA, 20 bp, Artificial Sequence
  Description of Artificial Sequence: Synthetic oligonucleotide
  Target: ATXN1; (-) strand; PAM type: YTN; PAM sequence: CTC
gtttttctctgttctgagag

SEQ ID NO: 212598 - DNA, 20 bp, Artificial Sequence
  Description of Artificial Sequence: Synthetic oligonucleotide
  Target: ATXN1; (-) strand; PAM type: YTN; PAM sequence: TTA
gaactcgtttttctctgttc

SEQ ID NO: 212599 - DNA, 20 bp, Artificial Sequence
  Description of Artificial Sequence: Synthetic oligonucleotide
  Target: ATXN1; (-) strand; PAM type: YTN; PAM sequence: TTA
gaaagacatggattagaact

SEQ ID NO: 212600 - DNA, 20 bp, Artificial Sequence
  Description of Artificial Sequence: Synthetic oligonucleotide
  Target: ATXN1; (-) strand; PAM type: YTN; PAM sequence: CTT
agaaagacatggattagaac

SEQ ID NO: 212601 - DNA, 20 bp, Artificial Sequence
  Description of Artificial Sequence: Synthetic oligonucleotide
  Target: ATXN1; (-) strand; PAM type: YTN; PAM sequence: CTA
gaagcttagaaagacatgga

SEQ ID NO: 212602 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaaggctagaagct

SEQ ID NO: 212603 - DNA, 20 bp, Artificial Sequence
  Description of Artificial Sequence: Synthetic oligonucleotide
  Target: ATXN1; (-) strand; PAM type: YTN; PAM sequence: CTG
agacagttaaaaaaaaaagg

SEQ ID NO: 212604 - DNA, 20 bp, Artificial Sequence
  Description of Artificial Sequence: Synthetic oligonucleotide
  Target: ATXN1; (-) strand; PAM type: YTN; PAM sequence: TTC
accctgagacagttaaaaaa

SEQ ID NO: 212605 - DNA, 20 bp, Artificial Sequence
  Description of Artificial Sequence: Synthetic oligonucleotide
  Target: ATXN1; (-) strand; PAM type: YTN; PAM sequence: TTT
caccctgagacagttaaaaa

SEQ ID NO: 212606 - DNA, 20 bp, Artificial Sequence
  Description of Artificial Sequence: Synthetic oligonucleotide
  Target: ATXN1; (-) strand; PAM type: YTN; PAM sequence: TTA
aacaagtaaagtggaatttc

SEQ ID NO: 212607 - DNA, 20 bp, Artificial Sequence
  Description of Artificial Sequence: Synthetic oligonucleotide
  Target: ATXN1; (-) strand; PAM type: YTN; PAM sequence: TTC
aaaagtatgcatcattaaac

SEQ ID NO: 212608 - DNA, 20 bp, Artificial Sequence
  Description of Artificial Sequence: Synthetic oligonucleotide
  Target: ATXN1; (-) strand; PAM type: YTN; PAM sequence: TTT
caaaagtatgcatcattaaa

SEQ ID NO: 212609 - DNA, 20 bp, Artificial Sequence
  Description of Artificial Sequence: Synthetic oligonucleotide
  Target: ATXN1; (-) strand; PAM type: YTN; PAM sequence: TTG
taaaatttcaaaagtatgca

SEQ ID NO: 212610 - DNA, 20 bp, Artificial Sequence
  Description of Artificial Sequence: Synthetic oligonucleotide
  Target: ATXN1; (-) strand; PAM type: YTN; PAM sequence: TTT
gtaaaatttcaaaagtatgc

SEQ ID NO: 212611 - DNA, 20 bp, Artificial Sequence
  Description of Artificial Sequence: Synthetic oligonucleotide
  Target: ATXN1; (-) strand; PAM type: YTN; PAM sequence: TTT
tgtaaaatttcaaaagtatg

SEQ ID NO: 212612 - DNA, 20 bp, Artificial Sequence
  Description of Artificial Sequence: Synthetic oligonucleotide
  Target: ATXN1; (-) strand; PAM type: YTN; PAM sequence: TTT
ttgtaaaatttcaaaagtat

SEQ ID NO: 212613 - DNA, 20 bp, Artificial Sequence
  Description of Artificial Sequence: Synthetic oligonucleotide
  Target: ATXN1; (-) strand; PAM type: YTN; PAM sequence: TTA
tttttgtaaaatttcaaaag

SEQ ID NO: 212614 - DNA, 20 bp, Artificial Sequence
  Description of Artificial Sequence: Synthetic oligonucleotide
  Target: ATXN1; (-) strand; PAM type: YTN; PAM sequence: TTC
aaaatatgaatgattatttt

SEQ ID NO: 212615 - DNA, 20 bp, Artificial Sequence
  Description of Artificial Sequence: Synthetic oligonucleotide
  Target: ATXN1; (-) strand; PAM type: YTN; PAM sequence: TTG
cagaaaaattcaaaatatga

SEQ ID NO: 212616 - DNA, 20 bp, Artificial Sequence
  Description of Artificial Sequence: Synthetic oligonucleotide
  Target: ATXN1; (-) strand; PAM type: YTN; PAM sequence: TTA
cgttgcagaaaaattcaaaa

SEQ ID NO: 212617 - DNA, 20 bp, Artificial Sequence
  Description of Artificial Sequence: Synthetic oligonucleotide
  Target: ATXN1; (-) strand; PAM type: YTN; PAM sequence: CTG
atatgaagccaaaaaagtta

SEQ ID NO: 212618 - DNA, 20 bp, Artificial Sequence
  Description of Artificial Sequence: Synthetic oligonucleotide
  Target: ATXN1; (-) strand; PAM type: YTN; PAM sequence: TTC
agtaacctgatatgaagcca

SEQ ID NO: 212619 - DNA, 20 bp, Artificial Sequence
  Description of Artificial Sequence: Synthetic oligonucleotide
  Target: ATXN1; (-) strand; PAM type: YTN; PAM sequence: TTT
cagtaacctgatatgaagcc

SEQ ID NO: 212620 - DNA, 20 bp, Artificial Sequence
  Description of Artificial Sequence: Synthetic oligonucleotide
  Target: ATXN1; (-) strand; PAM type: YTN; PAM sequence: CTA
tataggagcaatatagatac

SEQ ID NO: 212621 - DNA, 20 bp, Artificial Sequence
  Description of Artificial Sequence: Synthetic oligonucleotide
  Target: ATXN1; (-) strand; PAM type: YTN; PAM sequence: CTA
aaactatataggagcaatat

SEQ ID NO: 212622 - DNA, 20 bp, Artificial Sequence
  Description of Artificial Sequence: Synthetic oligonucleotide
  Target: ATXN1; (-) strand; PAM type: YTN; PAM sequence: TTA
tgatatgatcaaatgacaga

SEQ ID NO: 212623 - DNA, 20 bp, Artificial Sequence
  Description of Artificial Sequence: Synthetic oligonucleotide
  Target: ATXN1; (-) strand; PAM type: YTN; PAM sequence: TTA
aagtgaaataaacaaattat

SEQ ID NO: 212624 - DNA, 20 bp, Artificial Sequence
  Description of Artificial Sequence: Synthetic oligonucleotide
  Target: ATXN1; (-) strand; PAM type: YTN; PAM sequence: TTA
ttaaagtgaaataaacaaat

SEQ ID NO: 212625 - DNA, 20 bp, Artificial Sequence
  Description of Artificial Sequence: Synthetic oligonucleotide
  Target: ATXN1; (-) strand; PAM type: YTN; PAM sequence: TTT
attaaagtgaaataaacaaa

SEQ ID NO: 212626 - DNA, 20 bp, Artificial Sequence
  Description of Artificial Sequence: Synthetic oligonucleotide
  Target: ATXN1; (-) strand; PAM type: YTN; PAM sequence: TTG
aatgtttattaaagtgaaat

SEQ ID NO: 212627 - DNA, 20 bp, Artificial Sequence
  Description of Artificial Sequence: Synthetic oligonucleotide
  Target: ATXN1; (-) strand; PAM type: YTN; PAM sequence: CTT
gaatgtttattaaagtgaaa

SEQ ID NO: 212628 - DNA, 20 bp, Artificial Sequence
  Description of Artificial Sequence: Synthetic oligonucleotide
  Target: ATXN1; (-) strand; PAM type: YTN; PAM sequence: CTA
cttgaatgtttattaaagtg

SEQ ID NO: 212629 - DNA, 20 bp, Artificial Sequence
  Description of Artificial Sequence: Synthetic oligonucleotide
  Target: ATXN1; (-) strand; PAM type: YTN; PAM sequence: TTA
aaaaaataaacccaaactac

SEQ ID NO: 212630 - DNA, 20 bp, Artificial Sequence
  Description of Artificial Sequence: Synthetic oligonucleotide
  Target: ATXN1; (-) strand; PAM type: YTN; PAM sequence: TTT
aaaaaaataaacccaaacta

SEQ ID NO: 212631 - DNA, 20 bp, Artificial Sequence
  Description of Artificial Sequence: Synthetic oligonucleotide
  Target: ATXN1; (-) strand; PAM type: YTN; PAM sequence: TTA
ataatggtttaaaaaaataa

SEQ ID NO: 212632 - DNA, 20 bp, Artificial Sequence
  Description of Artificial Sequence: Synthetic oligonucleotide
  Target: ATXN1; (-) strand; PAM type: YTN; PAM sequence: TTG
tgttaataatggtttaaaaa

SEQ ID NO: 212633 - DNA, 20 bp, Artificial Sequence
  Description of Artificial Sequence: Synthetic oligonucleotide
  Target: ATXN1; (-) strand; PAM type: YTN; PAM sequence: TTT
gtgttaataatggtttaaaa

SEQ ID NO: 212634 - DNA, 20 bp, Artificial Sequence
  Description of Artificial Sequence: Synthetic oligonucleotide
  Target: ATXN1; (-) strand; PAM type: YTN; PAM sequence: TTA
tttgtgttaataatggttta

SEQ ID NO: 212635 - DNA, 20 bp, Artificial Sequence
  Description of Artificial Sequence: Synthetic oligonucleotide
  Target: ATXN1; (-) strand; PAM type: YTN; PAM sequence: TTT
atttgtgttaataatggttt

SEQ ID NO: 212636 - DNA, 20 bp, Artificial Sequence
  Description of Artificial Sequence: Synthetic oligonucleotide
  Target: ATXN1; (-) strand; PAM type: YTN; PAM sequence: CTT
tatttgtgttaataatggtt

SEQ ID NO: 212637 - DNA, 20 bp, Artificial Sequence
  Description of Artificial Sequence: Synthetic oligonucleotide
  Target: ATXN1; (-) strand; PAM type: YTN; PAM sequence: CTC
cagcacagctttatttgtgt

SEQ ID NO: 212638 - DNA, 20 bp, Artificial Sequence
  Description of Artificial Sequence: Synthetic oligonucleotide
  Target: ATXN1; (-) strand; PAM type: YTN; PAM sequence: CTC
tccagcacagctttatttgt

SEQ ID NO: 212639 - DNA, 20 bp, Artificial Sequence
  Description of Artificial Sequence: Synthetic oligonucleotide
  Target: ATXN1; (-) strand; PAM type: YTN; PAM sequence: CTG
tataccacgagacatggagg

SEQ ID NO: 212640 - DNA, 20 bp, Artificial Sequence
  Description of Artificial Sequence: Synthetic oligonucleotide
  Target: ATXN1; (-) strand; PAM type: YTN; PAM sequence: CTG
tactgtataccacgagacat

SEQ ID NO: 212641 - DNA, 20 bp, Artificial Sequence
  Description of Artificial Sequence: Synthetic oligonucleotide
  Target: ATXN1; (-) strand; PAM type: YTN; PAM sequence: TTC
tgtactgtataccacgagac

SEQ ID NO: 212642 - DNA, 20 bp, Artificial Sequence
  Description of Artificial Sequence: Synthetic oligonucleotide
  Target: ATXN1; (-) strand; PAM type: YTN; PAM sequence: CTT
ctgtactgtataccacgaga

SEQ ID NO: 212643 - DNA, 20 bp, Artificial Sequence
  Description of Artificial Sequence: Synthetic oligonucleotide
  Target: ATXN1; (-) strand; PAM type: YTN; PAM sequence: CTA
gagacttctgtactgtatac

SEQ ID NO: 212644 - DNA, 20 bp, Artificial Sequence
  Description of Artificial Sequence: Synthetic oligonucleotide
  Target: ATXN1; (-) strand; PAM type: YTN; PAM sequence: TTC
ctagagacttctgtactgta

SEQ ID NO: 212645 - DNA, 20 bp, Artificial Sequence
  Description of Artificial Sequence: Synthetic oligonucleotide
  Target: ATXN1; (-) strand; PAM type: YTN; PAM sequence: TTT
cctagagacttctgtactgt

SEQ ID NO: 212646 - DNA, 20 bp, Artificial Sequence
  Description of Artificial Sequence: Synthetic oligonucleotide
  Target: ATXN1; (-) strand; PAM type: YTN; PAM sequence: CTA
ggtgtttcctagagacttct

SEQ ID NO: 212647 - DNA, 20 bp, Artificial Sequence
  Description of Artificial Sequence: Synthetic oligonucleotide
  Target: ATXN1; (-) strand; PAM type: YTN; PAM sequence: TTC
taggtgtttcctagagactt

SEQ ID NO: 212648 - DNA, 20 bp, Artificial Sequence
  Description of Artificial Sequence: Synthetic oligonucleotide
  Target: ATXN1; (-) strand; PAM type: YTN; PAM sequence: CTT
ctaggtgtttcctagagact

SEQ ID NO: 212649 - DNA, 20 bp, Artificial Sequence
  Description of Artificial Sequence: Synthetic oligonucleotide
  Target: ATXN1; (-) strand; PAM type: YTN; PAM sequence: TTC
cttctaggtgtttcctagag

SEQ ID NO: 212650 - DNA, 20 bp, Artificial Sequence
  Description of Artificial Sequence: Synthetic oligonucleotide
  Target: ATXN1; (-) strand; PAM type: YTN; PAM sequence: TTT
ccttctaggtgtttcctaga

SEQ ID NO: 212651 - DNA, 20 bp, Artificial Sequence
  Description of Artificial Sequence: Synthetic oligonucleotide
  Target: ATXN1; (-) strand; PAM type: YTN; PAM sequence: TTT
tccttctaggtgtttcctag

SEQ ID NO: 212652 - DNA, 20 bp, Artificial Sequence
  Description of Artificial Sequence: Synthetic oligonucleotide
  Target: ATXN1; (-) strand; PAM type: YTN; PAM sequence: CTC
agcaattttccttctaggtg

SEQ ID NO: 212653 - DNA, 20 bp, Artificial Sequence
  Description of Artificial Sequence: Synthetic oligonucleotide
  Target: ATXN1; (-) strand; PAM type: YTN; PAM sequence: CTG
tgactcagcaattttccttc

SEQ ID NO: 212654 - DNA, 20 bp, Artificial Sequence
  Description of Artificial Sequence: Synthetic oligonucleotide
  Target: ATXN1; (-) strand; PAM type: YTN; PAM sequence: TTA
acaaaaacaaatgtgtatac

SEQ ID NO: 212655 - DNA, 20 bp, Artificial Sequence
  Description of Artificial Sequence: Synthetic oligonucleotide
  Target: ATXN1; (-) strand; PAM type: YTN; PAM sequence: TTA
tccagttaacaaaaacaaat

SEQ ID NO: 212656 - DNA, 20 bp, Artificial Sequence
  Description of Artificial Sequence: Synthetic oligonucleotide
  Target: ATXN1; (-) strand; PAM type: YTN; PAM sequence: TTA
ggtattatccagttaacaaa

SEQ ID NO: 212657 - DNA, 20 bp, Artificial Sequence
  Description of Artificial Sequence: Synthetic oligonucleotide
  Target: ATXN1; (-) strand; PAM type: YTN; PAM sequence: TTA
gaaagacagttaggtattat

SEQ ID NO: 212658 - DNA, 20 bp, Artificial Sequence
  Description of Artificial Sequence: Synthetic oligonucleotide
  Target: ATXN1; (-) strand; PAM type: YTN; PAM sequence: TTT
agaaagacagttaggtatta

SEQ ID NO: 212659 - DNA, 20 bp, Artificial Sequence
  Description of Artificial Sequence: Synthetic oligonucleotide
  Target: ATXN1; (-) strand; PAM type: YTN; PAM sequence: TTG
gtacaaccatttagaaagac

SEQ ID NO: 212660 - DNA, 20 bp, Artificial Sequence
  Description of Artificial Sequence: Synthetic oligonucleotide
  Target: ATXN1; (-) strand; PAM type: YTN; PAM sequence: TTC
attggtacaaccatttagaa

SEQ ID NO: 212661 - DNA, 20 bp, Artificial Sequence
  Description of Artificial Sequence: Synthetic oligonucleotide
  Target: ATXN1; (-) strand; PAM type: YTN; PAM sequence: CTG
ataggaatattcattggtac

SEQ ID NO: 212662 - DNA, 20 bp, Artificial Sequence
  Description of Artificial Sequence: Synthetic oligonucleotide
  Target: ATXN1; (-) strand; PAM type: YTN; PAM sequence: CTG
ctgataggaatattcattgg

SEQ ID NO: 212663 - DNA, 20 bp, Artificial Sequence
  Description of Artificial Sequence: Synthetic oligonucleotide
  Target: ATXN1; (-) strand; PAM type: YTN; PAM sequence: TTA
tgtactgctgataggaatat

SEQ ID NO: 212664 - DNA, 20 bp, Artificial Sequence
  Description of Artificial Sequence: Synthetic oligonucleotide
  Target: ATXN1; (-) strand; PAM type: YTN; PAM sequence: TTT
atgtactgctgataggaata

SEQ ID NO: 212665 - DNA, 20 bp, Artificial Sequence
  Description of Artificial Sequence: Synthetic oligonucleotide
  Target: ATXN1; (-) strand; PAM type: YTN; PAM sequence: TTC
atgtttatgtactgctgata

SEQ ID NO: 212666 - DNA, 20 bp, Artificial Sequence
  Description of Artificial Sequence: Synthetic oligonucleotide
  Target: ATXN1; (-) strand; PAM type: YTN; PAM sequence: TTT
catgtttatgtactgctgat

SEQ ID NO: 212667 - DNA, 20 bp, Artificial Sequence
  Description of Artificial Sequence: Synthetic oligonucleotide
  Target: ATXN1; (-) strand; PAM type: YTN; PAM sequence: TTG
aaaaatggcatttcatgttt

SEQ ID NO: 212668 - DNA, 20 bp, Artificial Sequence
  Description of Artificial Sequence: Synthetic oligonucleotide
  Target: ATXN1; (-) strand; PAM type: YTN; PAM sequence: TTT
gaaaaatggcatttcatgtt

SEQ ID NO: 212669 - DNA, 20 bp, Artificial Sequence
  Description of Artificial Sequence: Synthetic oligonucleotide
  Target: ATXN1; (-) strand; PAM type: YTN; PAM sequence: TTG
gtccaagtttgaaaaatggc

SEQ ID NO: 212670 - DNA, 20 bp, Artificial Sequence
  Description of Artificial Sequence: Synthetic oligonucleotide
  Target: ATXN1; (-) strand; PAM type: YTN; PAM sequence: TTT
ggtccaagtttgaaaaatgg

SEQ ID NO: 212671 - DNA, 20 bp, Artificial Sequence
  Description of Artificial Sequence: Synthetic oligonucleotide
  Target: ATXN1; (-) strand; PAM type: YTN; PAM sequence: TTT
tggtccaagtttgaaaaatg

SEQ ID NO: 212672 - DNA, 20 bp, Artificial Sequence
  Description of Artificial Sequence: Synthetic oligonucleotide
  Target: ATXN1; (-) strand; PAM type: YTN; PAM sequence: TTC
ccagtaatgaatattttggt

SEQ ID NO: 212673 - DNA, 20 bp, Artificial Sequence
  Description of Artificial Sequence: Synthetic oligonucleotide
  Target: ATXN1; (-) strand; PAM type: YTN; PAM sequence: CTG
gagttcccagtaatgaatat

SEQ ID NO: 212674 - DNA, 20 bp, Artificial Sequence
  Description of Artificial Sequence: Synthetic oligonucleotide
  Target: ATXN1; (-) strand; PAM type: YTN; PAM sequence: TTG
agatctggagttcccagtaa

SEQ ID NO: 212675 - DNA, 20 bp, Artificial Sequence
  Description of Artificial Sequence: Synthetic oligonucleotide
  Target: ATXN1; (-) strand; PAM type: YTN; PAM sequence: TTT
gagatctggagttcccagta

SEQ ID NO: 212676 - DNA, 20 bp, Artificial Sequence
  Description of Artificial Sequence: Synthetic oligonucleotide
  Target: ATXN1; (-) strand; PAM type: YTN; PAM sequence: TTA
tttgagatctggagttccca

SEQ ID NO: 212677 - DNA, 20 bp, Artificial Sequence
  Description of Artificial Sequence: Synthetic oligonucleotide
  Target: ATXN1; (-) strand; PAM type: YTN; PAM sequence: CTT
atttgagatctggagttccc

SEQ ID NO: 212678 - DNA, 20 bp, Artificial Sequence
  Description of Artificial Sequence: Synthetic oligonucleotide
  Target: ATXN1; (-) strand; PAM type: YTN; PAM sequence: TTG
acttatttgagatctggagt

SEQ ID NO: 212679 - DNA, 20 bp, Artificial Sequence
  Description of Artificial Sequence: Synthetic oligonucleotide
  Target: ATXN1; (-) strand; PAM type: YTN; PAM sequence: CTT
gacttatttgagatctggag

SEQ ID NO: 212680 - DNA, 20 bp, Artificial Sequence
  Description of Artificial Sequence: Synthetic oligonucleotide
  Target: ATXN1; (-) strand; PAM type: YTN; PAM sequence: CTG
acacttgacttatttgagat

SEQ ID NO: 212681 - DNA, 20 bp, Artificial Sequence
  Description of Artificial Sequence: Synthetic oligonucleotide
  Target: ATXN1; (-) strand; PAM type: YTN; PAM sequence: TTG
accaaagcgatagatggaac

SEQ ID NO: 212682 - DNA, 20 bp, Artificial Sequence
  Description of Artificial Sequence: Synthetic oligonucleotide
  Target: ATXN1; (-) strand; PAM type: YTN; PAM sequence: TTG
aaattgaccaaagcgataga

SEQ ID NO: 212683 - DNA, 20 bp, Artificial Sequence
  Description of Artificial Sequence: Synthetic oligonucleotide
  Target: ATXN1; (-) strand; PAM type: YTN; PAM sequence: TTT
gaaattgaccaaagcgatag

SEQ ID NO: 212684 - DNA, 20 bp, Artificial Sequence
  Description of Artificial Sequence: Synthetic oligonucleotide
  Target: ATXN1; (-) strand; PAM type: YTN; PAM sequence: TTC
aaagaacagtttgaaattga

SEQ ID NO: 212685 - DNA, 20 bp, Artificial Sequence
  Description of Artificial Sequence: Synthetic oligonucleotide
  Target: ATXN1; (-) strand; PAM type: YTN; PAM sequence: TTG
ttcaaagaacagtttgaaat

SEQ ID NO: 212686 - DNA, 20 bp, Artificial Sequence
  Description of Artificial Sequence: Synthetic oligonucleotide
  Target: ATXN1; (-) strand; PAM type: YTN; PAM sequence: TTT
gttcaaagaacagtttgaaa

SEQ ID NO: 212687 - DNA, 20 bp, Artificial Sequence
  Description of Artificial Sequence: Synthetic oligonucleotide
  Target: ATXN1; (-) strand; PAM type: YTN; PAM sequence: CTG
gatttgttcaaagaacagtt

SEQ ID NO: 212688 - DNA, 20 bp, Artificial Sequence
  Description of Artificial Sequence: Synthetic oligonucleotide
  Target: ATXN1; (-) strand; PAM type: YTN; PAM sequence: TTC
aagtctggatttgttcaaag

SEQ ID NO: 212689 - DNA, 20 bp, Artificial Sequence
  Description of Artificial Sequence: Synthetic oligonucleotide
  Target: ATXN1; (-) strand; PAM type: YTN; PAM sequence: CTT
caagtctggatttgttcaaa

SEQ ID NO: 212690 - DNA, 20 bp, Artificial Sequence
  Description of Artificial Sequence: Synthetic oligonucleotide
  Target: ATXN1; (-) strand; PAM type: YTN; PAM sequence: TTC
ttcaagtctggatttgttca

SEQ ID NO: 212691 - DNA, 20 bp, Artificial Sequence
  Description of Artificial Sequence: Synthetic oligonucleotide
  Target: ATXN1; (-) strand; PAM type: YTN; PAM sequence: TTT
cttcaagtctggatttgttc

SEQ ID NO: 212692 - DNA, 20 bp, Artificial Sequence
  Description of Artificial Sequence: Synthetic oligonucleotide
  Target: ATXN1; (-) strand; PAM type: YTN; PAM sequence: TTA
acagaatggaaatttcttca

SEQ ID NO: 212693 - DNA, 20 bp, Artificial Sequence
  Description of Artificial Sequence: Synthetic oligonucleotide
  Target: ATXN1; (-) strand; PAM type: YTN; PAM sequence: TTT
aacagaatggaaatttcttc

SEQ ID NO: 212694 - DNA, 20 bp, Artificial Sequence
  Description of Artificial Sequence: Synthetic oligonucleotide
  Target: ATXN1; (-) strand; PAM type: YTN; PAM sequence: CTA
gaaatttaacagaatggaaa

SEQ ID NO: 212695 - DNA, 20 bp, Artificial Sequence
  Description of Artificial Sequence: Synthetic oligonucleotide
  Target: ATXN1; (-) strand; PAM type: YTN; PAM sequence: TTG
gctagaaatttaacagaatg

SEQ ID NO: 212696 - DNA, 20 bp, Artificial Sequence
  Description of Artificial Sequence: Synthetic oligonucleotide
  Target: ATXN1; (-) strand; PAM type: YTN; PAM sequence: TTG
tgatgagttggctagaaatt

SEQ ID NO: 212697 - DNA, 20 bp, Artificial Sequence
  Description of Artificial Sequence: Synthetic oligonucleotide
  Target: ATXN1; (-) strand; PAM type: YTN; PAM sequence: TTG
attgtgatgagttggctaga

SEQ ID NO: 212698 - DNA, 20 bp, Artificial Sequence
  Description of Artificial Sequence: Synthetic oligonucleotide
  Target: ATXN1; (-) strand; PAM type: YTN; PAM sequence: TTG
cgtagttgattgtgatgagt

SEQ ID NO: 212699 - DNA, 20 bp, Artificial Sequence
  Description of Artificial Sequence: Synthetic oligonucleotide
  Target: ATXN1; (-) strand; PAM type: YTN; PAM sequence: CTT
gcgtagttgattgtgatgag

SEQ ID NO: 212700 - DNA, 20 bp, Artificial Sequence
  Description of Artificial Sequence: Synthetic oligonucleotide
  Target: ATXN1; (-) strand; PAM type: YTN; PAM sequence: TTG
cttgcgtagttgattgtgat

SEQ ID NO: 212701 - DNA, 20 bp, Artificial Sequence
  Description of Artificial Sequence: Synthetic oligonucleotide
  Target: ATXN1; (-) strand; PAM type: YTN; PAM sequence: TTT
gcttgcgtagttgattgtga

SEQ ID NO: 212702 - DNA, 20 bp, Artificial Sequence
  Description of Artificial Sequence: Synthetic oligonucleotide
  Target: ATXN1; (-) strand; PAM type: YTN; PAM sequence: TTG
tttgcttgcgtagttgattg

SEQ ID NO: 212703 - DNA, 20 bp, Artificial Sequence
  Description of Artificial Sequence: Synthetic oligonucleotide
  Target: ATXN1; (-) strand; PAM type: YTN; PAM sequence: TTA
tggggtattgtttgcttgcg

SEQ ID NO: 212704 - DNA, 20 bp, Artificial Sequence
  Description of Artificial Sequence: Synthetic oligonucleotide
  Target: ATXN1; (-) strand; PAM type: YTN; PAM sequence: CTT
atggggtattgtttgcttgc

SEQ ID NO: 212705 - DNA, 20 bp, Artificial Sequence
  Description of Artificial Sequence: Synthetic oligonucleotide
  Target: ATXN1; (-) strand; PAM type: YTN; PAM sequence: TTC
ttatggggtattgtttgctt

SEQ ID NO: 212706 - DNA, 20 bp, Artificial Sequence
  Description of Artificial Sequence: Synthetic oligonucleotide
  Target: ATXN1; (-) strand; PAM type: YTN; PAM sequence: TTG
ttcttatggggtattgtttg

SEQ ID NO: 212707 - DNA, 20 bp, Artificial Sequence
  Description of Artificial Sequence: Synthetic oligonucleotide
  Target: ATXN1; (-) strand; PAM type: YTN; PAM sequence: TTG
ttgttcttatggggtattgt

SEQ ID NO: 212708 - DNA, 20 bp, Artificial Sequence
  Description of Artificial Sequence: Synthetic oligonucleotide
  Target: ATXN1; (-) strand; PAM type: YTN; PAM sequence: TTA
ttgttgttcttatggggtat

SEQ ID NO: 212709 - DNA, 20 bp, Artificial Sequence
  Description of Artificial Sequence: Synthetic oligonucleotide
  Target: ATXN1; (-) strand; PAM type: YTN; PAM sequence: CTT
attgttgttcttatggggta

SEQ ID NO: 212710 - DNA, 20 bp, Artificial Sequence
  Description of Artificial Sequence: Synthetic oligonucleotide
  Target: ATXN1; (-) strand; PAM type: YTN; PAM sequence: TTA
cttattgttgttcttatggg

SEQ ID NO: 212711 - DNA, 20 bp, Artificial Sequence
  Description of Artificial Sequence: Synthetic oligonucleotide
  Target: ATXN1; (-) strand; PAM type: YTN; PAM sequence: CTG
gagccagcaatatgtgatta

SEQ ID NO: 212712 - DNA, 20 bp, Artificial Sequence
  Description of Artificial Sequence: Synthetic oligonucleotide
  Target: ATXN1; (-) strand; PAM type: YTN; PAM sequence: TTC
ctggagccagcaatatgtga

SEQ ID NO: 212713 - DNA, 20 bp, Artificial Sequence
  Description of Artificial Sequence: Synthetic oligonucleotide
  Target: ATXN1; (-) strand; PAM type: YTN; PAM sequence: CTT
cctggagccagcaatatgtg

SEQ ID NO: 212714 - DNA, 20 bp, Artificial Sequence
  Description of Artificial Sequence: Synthetic oligonucleotide
  Target: ATXN1; (-) strand; PAM type: YTN; PAM sequence: TTG
cttcctggagccagcaatat

SEQ ID NO: 212715 - DNA, 20 bp, Artificial Sequence
  Description of Artificial Sequence: Synthetic oligonucleotide
  Target: ATXN1; (-) strand; PAM type: YTN; PAM sequence: TTT
gcttcctggagccagcaata

SEQ ID NO: 212716 - DNA, 20 bp, Artificial Sequence
  Description of Artificial Sequence: Synthetic oligonucleotide
  Target: ATXN1; (-) strand; PAM type: YTN; PAM sequence: TTT
tgcttcctggagccagcaat

SEQ ID NO: 212717 - DNA, 20 bp, Artificial Sequence
  Description of Artificial Sequence: Synthetic oligonucleotide
  Target: ATXN1; (-) strand; PAM type: YTN; PAM sequence: TTC
attttgcttcctggagccag

SEQ ID NO: 212718 - DNA, 20 bp, Artificial Sequence
  Description of Artificial Sequence: Synthetic oligonucleotide
  Target: ATXN1; (-) strand; PAM type: YTN; PAM sequence: CTT
cattttgcttcctggagcca

SEQ ID NO: 212719 - DNA, 20 bp, Artificial Sequence
  Description of Artificial Sequence: Synthetic oligonucleotide
  Target: ATXN1; (-) strand; PAM type: YTN; PAM sequence: TTA
aatgtcttcattttgcttcc

SEQ ID NO: 212720 - DNA, 20 bp, Artificial Sequence
  Description of Artificial Sequence: Synthetic oligonucleotide
  Target: ATXN1; (-) strand; PAM type: YTN; PAM sequence: TTT
aaatgtcttcattttgcttc

SEQ ID NO: 212721 - DNA, 20 bp, Artificial Sequence
  Description of Artificial Sequence: Synthetic oligonucleotide
  Target: ATXN1; (-) strand; PAM type: YTN; PAM sequence: TTA
atttaaatgtcttcattttg

SEQ ID NO: 212722 - DNA, 20 bp, Artificial Sequence
  Description of Artificial Sequence: Synthetic oligonucleotide
  Target: ATXN1; (-) strand; PAM type: YTN; PAM sequence: TTT
aatttaaatgtcttcatttt

SEQ ID NO: 212723 - DNA, 20 bp, Artificial Sequence
  Description of Artificial Sequence: Synthetic oligonucleotide
  Target: ATXN1; (-) strand; PAM type: YTN; PAM sequence: CTT
taatttaaatgtcttcattt

SEQ ID NO: 212724 - DNA, 20 bp, Artificial Sequence
  Description of Artificial Sequence: Synthetic oligonucleotide
  Target: ATXN1; (-) strand; PAM type: YTN; PAM sequence: TTG
ctttaatttaaatgtcttca

SEQ ID NO: 212725 - DNA, 20 bp, Artificial Sequence
  Description of Artificial Sequence: Synthetic oligonucleotide
  Target: ATXN1; (-) strand; PAM type: YTN; PAM sequence: TTT
gctttaatttaaatgtcttc

SEQ ID NO: 212726 - DNA, 20 bp, Artificial Sequence
  Description of Artificial Sequence: Synthetic oligonucleotide
  Target: ATXN1; (-) strand; PAM type: YTN; PAM sequence: TTG
taagcatgtttgctttaatt

SEQ ID NO: 212727 - DNA, 20 bp, Artificial Sequence
  Description of Artificial Sequence: Synthetic oligonucleotide
  Target: ATXN1; (-) strand; PAM type: YTN; PAM sequence: TTT
gtaagcatgtttgctttaat

SEQ ID NO: 212728 - DNA, 20 bp, Artificial Sequence
  Description of Artificial Sequence: Synthetic oligonucleotide
  Target: ATXN1; (-) strand; PAM type: YTN; PAM sequence: TTT
tgtaagcatgtttgctttaa

SEQ ID NO: 212729 - DNA, 20 bp, Artificial Sequence
  Description of Artificial Sequence: Synthetic oligonucleotide
  Target: ATXN1; (-) strand; PAM type: YTN; PAM sequence: TTT
ttgtaagcatgtttgcttta

SEQ ID NO: 212730 - DNA, 20 bp, Artificial Sequence
  Description of Artificial Sequence: Synthetic oligonucleotide
  Target: ATXN1; (-) strand; PAM type: YTN; PAM sequence: TTG
agatagccagaatatttttg

SEQ ID NO: 212731 - DNA, 20 bp, Artificial Sequence
  Description of Artificial Sequence: Synthetic oligonucleotide
  Target: ATXN1; (-) strand; PAM type: YTN; PAM sequence: TTA
attgagatagccagaatatt

SEQ ID NO: 212732 - DNA, 20 bp, Artificial Sequence
  Description of Artificial Sequence: Synthetic oligonucleotide
  Target: ATXN1; (-) strand; PAM type: YTN; PAM sequence: TTC
agattaattgagatagccag

SEQ ID NO: 212733 - DNA, 20 bp, Artificial Sequence
  Description of Artificial Sequence: Synthetic oligonucleotide
  Target: ATXN1; (-) strand; PAM type: YTN; PAM sequence: TTG
gttcagattaattgagatag

SEQ ID NO: 212734 - DNA, 20 bp, Artificial Sequence
  Description of Artificial Sequence: Synthetic oligonucleotide
  Target: ATXN1; (-) strand; PAM type: YTN; PAM sequence: TTT
ggttcagattaattgagata

SEQ ID NO: 212735 - DNA, 20 bp, Artificial Sequence
  Description of Artificial Sequence: Synthetic oligonucleotide
  Target: ATXN1; (-) strand; PAM type: YTN; PAM sequence: TTA
gtttggttcagattaattga

SEQ ID NO: 212736 - DNA, 20 bp, Artificial Sequence
  Description of Artificial Sequence: Synthetic oligonucleotide
  Target: ATXN1; (-) strand; PAM type: YTN; PAM sequence: CTT
agtttggttcagattaattg

SEQ ID NO: 212737 - DNA, 20 bp, Artificial Sequence
  Description of Artificial Sequence: Synthetic oligonucleotide
  Target: ATXN1; (-) strand; PAM type: YTN; PAM sequence: TTC
ttagtttggttcagattaat

SEQ ID NO: 212738 - DNA, 20 bp, Artificial Sequence
  Description of Artificial Sequence: Synthetic oligonucleotide
  Target: ATXN1; (-) strand; PAM type: YTN; PAM sequence: TTA
ttcttagtttggttcagatt

SEQ ID NO: 212739 - DNA, 20 bp, Artificial Sequence
  Description of Artificial Sequence: Synthetic oligonucleotide
  Target: ATXN1; (-) strand; PAM type: YTN; PAM sequence: CTA
gattattcttagtttggttc

SEQ ID NO: 212740 - DNA, 20 bp, Artificial Sequence
  Description of Artificial Sequence: Synthetic oligonucleotide
  Target: ATXN1; (-) strand; PAM type: YTN; PAM sequence: TTG
ggggaaatatctagattatt

SEQ ID NO: 212741 - DNA, 20 bp, Artificial Sequence
  Description of Artificial Sequence: Synthetic oligonucleotide
  Target: ATXN1; (-) strand; PAM type: YTN; PAM sequence: CTA
aatgggaacagaagattggg

SEQ ID NO: 212742 - DNA, 20 bp, Artificial Sequence
  Description of Artificial Sequence: Synthetic oligonucleotide
  Target: ATXN1; (-) strand; PAM type: YTN; PAM sequence: TTA
taaaaatgccatgaactaaa

SEQ ID NO: 212743 - DNA, 20 bp, Artificial Sequence
  Description of Artificial Sequence: Synthetic oligonucleotide
  Target: ATXN1; (-) strand; PAM type: YTN; PAM sequence: CTG
gcaagtcccgttataaaaat

SEQ ID NO: 212744 - DNA, 20 bp, Artificial Sequence
  Description of Artificial Sequence: Synthetic oligonucleotide
  Target: ATXN1; (-) strand; PAM type: YTN; PAM sequence: TTA
tctggcaagtcccgttataa

SEQ ID NO: 212745 - DNA, 20 bp, Artificial Sequence
  Description of Artificial Sequence: Synthetic oligonucleotide
  Target: ATXN1; (-) strand; PAM type: YTN; PAM sequence: CTT
atctggcaagtcccgttata

SEQ ID NO: 212746 - DNA, 20 bp, Artificial Sequence
  Description of Artificial Sequence: Synthetic oligonucleotide
  Target: ATXN1; (-) strand; PAM type: YTN; PAM sequence: TTC
ttatctggcaagtcccgtta

SEQ ID NO: 212747 - DNA, 20 bp, Artificial Sequence
  Description of Artificial Sequence: Synthetic oligonucleotide
  Target: ATXN1; (-) strand; PAM type: YTN; PAM sequence: CTT
cttatctggcaagtcccgtt

SEQ ID NO: 212748 - DNA, 20 bp, Artificial Sequence
  Description of Artificial Sequence: Synthetic oligonucleotide
  Target: ATXN1; (-) strand; PAM type: YTN; PAM sequence: CTC
agacacacacatgcttctta

SEQ ID NO: 212749 - DNA, 20 bp, Artificial Sequence
  Description of Artificial Sequence: Synthetic oligonucleotide
  Target: ATXN1; (-) strand; PAM type: YTN; PAM sequence: TTC
tcagacacacacatgcttct

SEQ ID NO: 212750 - DNA, 20 bp, Artificial Sequence
  Description of Artificial Sequence: Synthetic oligonucleotide
  Target: ATXN1; (-) strand; PAM type: YTN; PAM sequence: TTA
gttctcagacacacacatgc

SEQ ID NO: 212751 - DNA, 20 bp, Artificial Sequence
  Description of Artificial Sequence: Synthetic oligonucleotide
  Target: ATXN1; (-) strand; PAM type: YTN; PAM sequence: CTT
agttctcagacacacacatg

SEQ ID NO: 212752 - DNA, 20 bp, Artificial Sequence
  Description of Artificial Sequence: Synthetic oligonucleotide
  Target: ATXN1; (-) strand; PAM type: YTN; PAM sequence: TTC
cttagttctcagacacacac

SEQ ID NO: 212753 - DNA, 20 bp, Artificial Sequence
  Description of Artificial Sequence: Synthetic oligonucleotide
  Target: ATXN1; (-) strand; PAM type: YTN; PAM sequence: TTT
ccttagttctcagacacaca

SEQ ID NO: 212754 - DNA, 20 bp, Artificial Sequence
  Description of Artificial Sequence: Synthetic oligonucleotide
  Target: ATXN1; (-) strand; PAM type: YTN; PAM sequence: TTT
tccttagttctcagacacac

SEQ ID NO: 212755 - DNA, 20 bp, Artificial Sequence
  Description of Artificial Sequence: Synthetic oligonucleotide
  Target: ATXN1; (-) strand; PAM type: YTN; PAM sequence: TTT
ttccttagttctcagacaca

SEQ ID NO: 212756 - DNA, 20 bp, Artificial Sequence
  Description of Artificial Sequence: Synthetic oligonucleotide
  Target: ATXN1; (-) strand; PAM type: YTN; PAM sequence: TTT
tttccttagttctcagacac

SEQ ID NO: 212757 - DNA, 20 bp, Artificial Sequence
  Description of Artificial Sequence: Synthetic oligonucleotide
  Target: ATXN1; (-) strand; PAM type: YTN; PAM sequence: CTT
ttttccttagttctcagaca

SEQ ID NO: 212758 - DNA, 20 bp, Artificial Sequence
  Description of Artificial Sequence: Synthetic oligonucleotide
  Target: ATXN1; (-) strand; PAM type: YTN; PAM sequence: TTG
aagagacagtaaaaccaatc

SEQ ID NO: 212759 - DNA, 20 bp, Artificial Sequence
  Description of Artificial Sequence: Synthetic oligonucleotide
  Target: ATXN1; (-) strand; PAM type: YTN; PAM sequence: TTT
gaagagacagtaaaaccaat

SEQ ID NO: 212760 - DNA, 20 bp, Artificial Sequence
  Description of Artificial Sequence: Synthetic oligonucleotide
  Target: ATXN1; (-) strand; PAM type: YTN; PAM sequence: TTT
tgaagagacagtaaaaccaa

SEQ ID NO: 212761 - DNA, 20 bp, Artificial Sequence
  Description of Artificial Sequence: Synthetic oligonucleotide
  Target: ATXN1; (-) strand; PAM type: YTN; PAM sequence: TTT
ttgaagagacagtaaaacca

SEQ ID NO: 212762 - DNA, 20 bp, Artificial Sequence
  Description of Artificial Sequence: Synthetic oligonucleotide
  Target: ATXN1; (-) strand; PAM type: YTN; PAM sequence: TTC
acatcggatatgtttttgaa

SEQ ID NO: 212763 - DNA, 20 bp, Artificial Sequence
  Description of Artificial Sequence: Synthetic oligonucleotide
  Target: ATXN1; (-) strand; PAM type: YTN; PAM sequence: CTA
ttcacatcggatatgttttt

SEQ ID NO: 212764 - DNA, 20 bp, Artificial Sequence
  Description of Artificial Sequence: Synthetic oligonucleotide
  Target: ATXN1; (-) strand; PAM type: YTN; PAM sequence: TTA
gtctattcacatcggatatg

SEQ ID NO: 212765 - DNA, 20 bp, Artificial Sequence
  Description of Artificial Sequence: Synthetic oligonucleotide
  Target: ATXN1; (-) strand; PAM type: YTN; PAM sequence: TTT
agtctattcacatcggatat

SEQ ID NO: 212766 - DNA, 20 bp, Artificial Sequence
  Description of Artificial Sequence: Synthetic oligonucleotide
  Target: ATXN1; (-) strand; PAM type: YTN; PAM sequence: TTT
tagtctattcacatcggata

SEQ ID NO: 212767 - DNA, 20 bp, Artificial Sequence
  Description of Artificial Sequence: Synthetic oligonucleotide
  Target: ATXN1; (-) strand; PAM type: YTN; PAM sequence: TTT
ttagtctattcacatcggat

SEQ ID NO: 212768 - DNA, 20 bp, Artificial Sequence
  Description of Artificial Sequence: Synthetic oligonucleotide
  Target: ATXN1; (-) strand; PAM type: YTN; PAM sequence: TTG
aatggtttttagtctattca

SEQ ID NO: 212769 - DNA, 20 bp, Artificial Sequence
  Description of Artificial Sequence: Synthetic oligonucleotide
  Target: ATXN1; (-) strand; PAM type: YTN; PAM sequence: CTG
cagaattgaatggtttttag

SEQ ID NO: 212770 - DNA, 20 bp, Artificial Sequence
  Description of Artificial Sequence: Synthetic oligonucleotide
  Target: ATXN1; (-) strand; PAM type: YTN; PAM sequence: TTC
acaaactgcagaattgaatg

SEQ ID NO: 212771 - DNA, 20 bp, Artificial Sequence
  Description of Artificial Sequence: Synthetic oligonucleotide
  Target: ATXN1; (-) strand; PAM type: YTN; PAM sequence: CTG
gggatataattcacaaactg

SEQ ID NO: 212772 - DNA, 20 bp, Artificial Sequence
  Description of Artificial Sequence: Synthetic oligonucleotide
  Target: ATXN1; (-) strand; PAM type: YTN; PAM sequence: TTC
tggggatataattcacaaac

SEQ ID NO: 212773 - DNA, 20 bp, Artificial Sequence
  Description of Artificial Sequence: Synthetic oligonucleotide
  Target: ATXN1; (-) strand; PAM type: YTN; PAM sequence: TTT
ctggggatataattcacaaa

SEQ ID NO: 212774 - DNA, 20 bp, Artificial Sequence
  Description of Artificial Sequence: Synthetic oligonucleotide
  Target: ATXN1; (-) strand; PAM type: YTN; PAM sequence: CTT
tctggggatataattcacaa

SEQ ID NO: 212775 - DNA, 20 bp, Artificial Sequence
  Description of Artificial Sequence: Synthetic oligonucleotide
  Target: ATXN1; (-) strand; PAM type: YTN; PAM sequence: TTA
ataccagctttctggggata

SEQ ID NO: 212776 - DNA, 20 bp, Artificial Sequence
  Description of Artificial Sequence: Synthetic oligonucleotide
  Target: ATXN1; (-) strand; PAM type: YTN; PAM sequence: TTA
ttaataccagctttctgggg

SEQ ID NO: 212777 - DNA, 20 bp, Artificial Sequence
  Description of Artificial Sequence: Synthetic oligonucleotide
  Target: ATXN1; (-) strand; PAM type: YTN; PAM sequence: CTA
tattattaataccagctttc

SEQ ID NO: 212778 - DNA, 20 bp, Artificial Sequence
  Description of Artificial Sequence: Synthetic oligonucleotide
  Target: ATXN1; (-) strand; PAM type: YTN; PAM sequence: CTG
ctatattattaataccagct

SEQ ID NO: 212779 - DNA, 20 bp, Artificial Sequence
  Description of Artificial Sequence: Synthetic oligonucleotide
  Target: ATXN1; (-) strand; PAM type: YTN; PAM sequence: TTA
gctgctatattattaatacc

SEQ ID NO: 212780 - DNA, 20 bp, Artificial Sequence
  Description of Artificial Sequence: Synthetic oligonucleotide
  Target: ATXN1; (-) strand; PAM type: YTN; PAM sequence: CTT
agctgctatattattaatac

SEQ ID NO: 212781 - DNA, 20 bp, Artificial Sequence
  Description of Artificial Sequence: Synthetic oligonucleotide
  Target: ATXN1; (-) strand; PAM type: YTN; PAM sequence: TTC
acttagctgctatattatta

SEQ ID NO: 212782 - DNA, 20 bp, Artificial Sequence
  Description of Artificial Sequence: Synthetic oligonucleotide
  Target: ATXN1; (-) strand; PAM type: YTN; PAM sequence: TTT
cacttagctgctatattatt

SEQ ID NO: 212783 - DNA, 20 bp, Artificial Sequence
  Description of Artificial Sequence: Synthetic oligonucleotide
  Target: ATXN1; (-) strand; PAM type: YTN; PAM sequence: TTA
tttcacttagctgctatatt

SEQ ID NO: 212784 - DNA, 20 bp, Artificial Sequence
  Description of Artificial Sequence: Synthetic oligonucleotide
  Target: ATXN1; (-) strand; PAM type: YTN; PAM sequence: CTT
atttcacttagctgctatat

SEQ ID NO: 212785 - DNA, 20 bp, Artificial Sequence
  Description of Artificial Sequence: Synthetic oligonucleotide
  Target: ATXN1; (-) strand; PAM type: YTN; PAM sequence: CTG
gcttatttcacttagctgct

SEQ ID NO: 212786 - DNA, 20 bp, Artificial Sequence
  Description of Artificial Sequence: Synthetic oligonucleotide
  Target: ATXN1; (-) strand; PAM type: YTN; PAM sequence: TTA
tgactggcttatttcactta

SEQ ID NO: 212787 - DNA, 20 bp, Artificial Sequence
  Description of Artificial Sequence: Synthetic oligonucleotide
  Target: ATXN1; (-) strand; PAM type: YTN; PAM sequence: TTT
atgactggcttatttcactt

SEQ ID NO: 212788 - DNA, 20 bp, Artificial Sequence
  Description of Artificial Sequence: Synthetic oligonucleotide
  Target: ATXN1; (-) strand; PAM type: YTN; PAM sequence: TTT
tatgactggcttatttcact

SEQ ID NO: 212789 - DNA, 20 bp, Artificial Sequence
  Description of Artificial Sequence: Synthetic oligonucleotide
  Target: ATXN1; (-) strand; PAM type: YTN; PAM sequence: CTT
ttatgactggcttatttcac

SEQ ID NO: 212790 - DNA, 20 bp, Artificial Sequence
  Description of Artificial Sequence: Synthetic oligonucleotide
  Target: ATXN1; (-) strand; PAM type: YTN; PAM sequence: TTG
tccttttatgactggcttat

SEQ ID NO: 212791 - DNA, 20 bp, Artificial Sequence
  Description of Artificial Sequence: Synthetic oligonucleotide
  Target: ATXN1; (-) strand; PAM type: YTN; PAM sequence: TTT
gtccttttatgactggctta

SEQ ID NO: 212792 - DNA, 20 bp, Artificial Sequence
  Description of Artificial Sequence: Synthetic oligonucleotide
  Target: ATXN1; (-) strand; PAM type: YTN; PAM sequence: CTC
atagagggtgaatcatacag

SEQ ID NO: 212793 - DNA, 20 bp, Artificial Sequence
  Description of Artificial Sequence: Synthetic oligonucleotide
  Target: ATXN1; (-) strand; PAM type: YTN; PAM sequence: CTA
gatacctcatagagggtgaa

SEQ ID NO: 212794 - DNA, 20 bp, Artificial Sequence
  Description of Artificial Sequence: Synthetic oligonucleotide
  Target: ATXN1; (-) strand; PAM type: YTN; PAM sequence: CTC
tagatacctcatagagggtg

SEQ ID NO: 212795 - DNA, 20 bp, Artificial Sequence
  Description of Artificial Sequence: Synthetic oligonucleotide
  Target: ATXN1; (-) strand; PAM type: YTN; PAM sequence: CTA
ctctagatacctcatagagg

SEQ ID NO: 212796 - DNA, 20 bp, Artificial Sequence
  Description of Artificial Sequence: Synthetic oligonucleotide
  Target: ATXN1; (-) strand; PAM type: YTN; PAM sequence: CTA
tgacaatgtctactctagat

SEQ ID NO: 212797 - DNA, 20 bp, Artificial Sequence
  Description of Artificial Sequence: Synthetic oligonucleotide
  Target: ATXN1; (-) strand; PAM type: YTN; PAM sequence: TTC
tatgacaatgtctactctag

SEQ ID NO: 212798 - DNA, 20 bp, Artificial Sequence
  Description of Artificial Sequence: Synthetic oligonucleotide
  Target: ATXN1; (-) strand; PAM type: YTN; PAM sequence: TTT
ctatgacaatgtctactcta

SEQ ID NO: 212799 - DNA, 20 bp, Artificial Sequence
  Description of Artificial Sequence: Synthetic oligonucleotide
  Target: ATXN1; (-) strand; PAM type: YTN; PAM sequence: TTC
catttctatgacaatgtcta

SEQ ID NO: 212800 - DNA, 20 bp, Artificial Sequence
  Description of Artificial Sequence: Synthetic oligonucleotide
  Target: ATXN1; (-) strand; PAM type: YTN; PAM sequence: TTT
ccatttctatgacaatgtct

SEQ ID NO: 212801 - DNA, 20 bp, Artificial Sequence
  Description of Artificial Sequence: Synthetic oligonucleotide
  Target: ATXN1; (-) strand; PAM type: YTN; PAM sequence: TTT
tccatttctatgacaatgtc

SEQ ID NO: 212802 - DNA, 20 bp, Artificial Sequence
  Description of Artificial Sequence: Synthetic oligonucleotide
  Target: ATXN1; (-) strand; PAM type: YTN; PAM sequence: CTT
ttccatttctatgacaatgt

SEQ ID NO: 212803 - DNA, 20 bp, Artificial Sequence
  Description of Artificial Sequence: Synthetic oligonucleotide
  Target: ATXN1; (-) strand; PAM type: YTN; PAM sequence: CTG
cttttccatttctatgacaa

SEQ ID NO: 212804 - DNA, 20 bp, Artificial Sequence
  Description of Artificial Sequence: Synthetic oligonucleotide
  Target: ATXN1; (-) strand; PAM type: YTN; PAM sequence: TTG
gcaactgcttttccatttct

SEQ ID NO: 212805 - DNA, 20 bp, Artificial Sequence
  Description of Artificial Sequence: Synthetic oligonucleotide
  Target: ATXN1; (-) strand; PAM type: YTN; PAM sequence: CTT
ggcaactgcttttccatttc

SEQ ID NO: 212806 - DNA, 20 bp, Artificial Sequence
  Description of Artificial Sequence: Synthetic oligonucleotide
  Target: ATXN1; (-) strand; PAM type: YTN; PAM sequence: CTC
ccccaagcccttggcaactg

SEQ ID NO: 212807 - DNA, 20 bp, Artificial Sequence
  Description of Artificial Sequence: Synthetic oligonucleotide
  Target: ATXN1; (-) strand; PAM type: YTN; PAM sequence: TTC
tcccccaagcccttggcaac

SEQ ID NO: 212808 - DNA, 20 bp, Artificial Sequence
  Description of Artificial Sequence: Synthetic oligonucleotide
  Target: ATXN1; (-) strand; PAM type: YTN; PAM sequence: CTT
ctcccccaagcccttggcaa

SEQ ID NO: 212809 - DNA, 20 bp, Artificial Sequence
  Description of Artificial Sequence: Synthetic oligonucleotide
  Target: ATXN1; (-) strand; PAM type: YTN; PAM sequence: TTC
ccttctcccccaagcccttg

SEQ ID NO: 212810 - DNA, 20 bp, Artificial Sequence
  Description of Artificial Sequence: Synthetic oligonucleotide
  Target: ATXN1; (-) strand; PAM type: YTN; PAM sequence: TTT
cccttctcccccaagccctt

SEQ ID NO: 212811 - DNA, 20 bp, Artificial Sequence
  Description of Artificial Sequence: Synthetic oligonucleotide
  Target: ATXN1; (-) strand; PAM type: YTN; PAM sequence: TTT
tcccttctcccccaagccct

SEQ ID NO: 212812 - DNA, 20 bp, Artificial Sequence
  Description of Artificial Sequence: Synthetic oligonucleotide
  Target: ATXN1; (-) strand; PAM type: YTN; PAM sequence: CTT
ttcccttctcccccaagccc

SEQ ID NO: 212813 - DNA, 20 bp, Artificial Sequence
  Description of Artificial Sequence: Synthetic oligonucleotide
  Target: ATXN1; (-) strand; PAM type: YTN; PAM sequence: TTC
ttttcccttctcccccaagc

SEQ ID NO: 212814 - DNA, 20 bp, Artificial Sequence
  Description of Artificial Sequence: Synthetic oligonucleotide
  Target: ATXN1; (-) strand; PAM type: YTN; PAM sequence: CTT
cttttcccttctcccccaag

SEQ ID NO: 212815 - DNA, 20 bp, Artificial Sequence
  Description of Artificial Sequence: Synthetic oligonucleotide
  Target: ATXN1; (-) strand; PAM type: YTN; PAM sequence: CTC
ttcttttcccttctccccca

SEQ ID NO: 212816 - DNA, 20 bp, Artificial Sequence
  Description of Artificial Sequence: Synthetic oligonucleotide
  Target: ATXN1; (-) strand; PAM type: YTN; PAM sequence: TTA
aatagcaactcttcttttcc

SEQ ID NO: 212817 - DNA, 20 bp, Artificial Sequence
  Description of Artificial Sequence: Synthetic oligonucleotide
  Target: ATXN1; (-) strand; PAM type: YTN; PAM sequence: CTA
cccattaaatagcaactctt

SEQ ID NO: 212818 - DNA, 20 bp, Artificial Sequence
  Description of Artificial Sequence: Synthetic oligonucleotide
  Target: ATXN1; (-) strand; PAM type: YTN; PAM sequence: TTC
tacccattaaatagcaactc

SEQ ID NO: 212819 - DNA, 20 bp, Artificial Sequence
  Description of Artificial Sequence: Synthetic oligonucleotide
  Target: ATXN1; (-) strand; PAM type: YTN; PAM sequence: TTG
aaattctacccattaaatag

SEQ ID NO: 212820 - DNA, 20 bp, Artificial Sequence
  Description of Artificial Sequence: Synthetic oligonucleotide
  Target: ATXN1; (-) strand; PAM type: YTN; PAM sequence: TTG
caaaattgaaattctaccca

SEQ ID NO: 212821 - DNA, 20 bp, Artificial Sequence
  Description of Artificial Sequence: Synthetic oligonucleotide
  Target: ATXN1; (-) strand; PAM type: YTN; PAM sequence: TTT
gcaaaattgaaattctaccc

SEQ ID NO: 212822 - DNA, 20 bp, Artificial Sequence
  Description of Artificial Sequence: Synthetic oligonucleotide
  Target: ATXN1; (-) strand; PAM type: YTN; PAM sequence: TTT
tgcaaaattgaaattctacc

SEQ ID NO: 212823 - DNA, 20 bp, Artificial Sequence
  Description of Artificial Sequence: Synthetic oligonucleotide
  Target: ATXN1; (-) strand; PAM type: YTN; PAM sequence: TTA
ttttgcaaaattgaaattct

SEQ ID NO: 212824 - DNA, 20 bp, Artificial Sequence
  Description of Artificial Sequence: Synthetic oligonucleotide
  Target: ATXN1; (-) strand; PAM type: YTN; PAM sequence: TTT
attttgcaaaattgaaattc

SEQ ID NO: 212825 - DNA, 20 bp, Artificial Sequence
  Description of Artificial Sequence: Synthetic oligonucleotide
  Target: ATXN1; (-) strand; PAM type: YTN; PAM sequence: TTT
tattttgcaaaattgaaatt

SEQ ID NO: 212826 - DNA, 20 bp, Artificial Sequence
  Description of Artificial Sequence: Synthetic oligonucleotide
  Target: ATXN1; (-) strand; PAM type: YTN; PAM sequence: TTT
ttattttgcaaaattgaaat

SEQ ID NO: 212827 - DNA, 20 bp, Artificial Sequence
  Description of Artificial Sequence: Synthetic oligonucleotide
  Target: ATXN1; (-) strand; PAM type: YTN; PAM sequence: CTT
tttattttgcaaaattgaaa

SEQ ID NO: 212828 - DNA, 20 bp, Artificial Sequence
  Description of Artificial Sequence: Synthetic oligonucleotide
  Target: ATXN1; (-) strand; PAM type: YTN; PAM sequence: CTC
tttttattttgcaaaattga

SEQ ID NO: 212829 - DNA, 20 bp, Artificial Sequence
  Description of Artificial Sequence: Synthetic oligonucleotide
  Target: ATXN1; (-) strand; PAM type: YTN; PAM sequence: TTA
caggtgcgagccaccacgcc

SEQ ID NO: 212830 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgcgagccac

SEQ ID NO: 212831 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 212832 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 212833 - DNA, 20 bp, Artificial Sequence
  Description of Artificial Sequence: Synthetic oligonucleotide
  Target: ATXN1; (-) strand; PAM type: YTN; PAM sequence: CTG
cccacctcggcctcccaaag

SEQ ID NO: 212834 - DNA, 20 bp, Artificial Sequence
  Description of Artificial Sequence: Synthetic oligonucleotide
  Target: ATXN1; (-) strand; PAM type: YTN; PAM sequence: CTC
aggtgatctgcccacctcgg

SEQ ID NO: 212835 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatctgcccac

SEQ ID NO: 212836 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatctgcc

SEQ ID NO: 212837 - DNA, 20 bp, Artificial Sequence
  Description of Artificial Sequence: Synthetic oligonucleotide
  Target: ATXN1; (-) strand; PAM type: YTN; PAM sequence: CTC
aaactcctgacctcaggtga

SEQ ID NO: 212838 - DNA, 20 bp, Artificial Sequence
  Description of Artificial Sequence: Synthetic oligonucleotide
  Target: ATXN1; (-) strand; PAM type: YTN; PAM sequence: TTG
gtctcaaactcctgacctca

SEQ ID NO: 212839 - DNA, 20 bp, Artificial Sequence
  Description of Artificial Sequence: Synthetic oligonucleotide
  Target: ATXN1; (-) strand; PAM type: YTN; PAM sequence: TTG
gccaggttggtctcaaactc

SEQ ID NO: 212840 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggttggt

SEQ ID NO: 212841 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggttgg

SEQ ID NO: 212842 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcacca

SEQ ID NO: 212843 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcacc

SEQ ID NO: 212844 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcac

SEQ ID NO: 212845 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 212846 - DNA, 20 bp, Artificial Sequence
  Description of Artificial Sequence: Synthetic oligonucleotide
  Target: ATXN1; (-) strand; PAM type: YTN; PAM sequence: CTG
tatttttagtagagacaggg

SEQ ID NO: 212847 - DNA, 20 bp, Artificial Sequence
  Description of Artificial Sequence: Synthetic oligonucleotide
  Target: ATXN1; (-) strand; PAM type: YTN; PAM sequence: TTC
tgtatttttagtagagacag

SEQ ID NO: 212848 - DNA, 20 bp, Artificial Sequence
  Description of Artificial Sequence: Synthetic oligonucleotide
  Target: ATXN1; (-) strand; PAM type: YTN; PAM sequence: TTT
ctgtatttttagtagagaca

SEQ ID NO: 212849 - DNA, 20 bp, Artificial Sequence
  Description of Artificial Sequence: Synthetic oligonucleotide
  Target: ATXN1; (-) strand; PAM type: YTN; PAM sequence: CTA
atttctgtatttttagtaga

SEQ ID NO: 212850 - DNA, 20 bp, Artificial Sequence
  Description of Artificial Sequence: Synthetic oligonucleotide
  Target: ATXN1; (-) strand; PAM type: YTN; PAM sequence: CTG
gctaatttctgtatttttag

SEQ ID NO: 212851 - DNA, 20 bp, Artificial Sequence
  Description of Artificial Sequence: Synthetic oligonucleotide
  Target: ATXN1; (-) strand; PAM type: YTN; PAM sequence: CTG
ccacgacgcctggctaattt

SEQ ID NO: 212852 - DNA, 20 bp, Artificial Sequence
  Description of Artificial Sequence: Synthetic oligonucleotide
  Target: ATXN1; (-) strand; PAM type: YTN; PAM sequence: TTA
caggaacctgccacgacgcc

SEQ ID NO: 212853 - DNA, 20 bp, Artificial Sequence
  Description of Artificial Sequence: Synthetic oligonucleotide
  Target: ATXN1; (-) strand; PAM type: YTN; PAM sequence: CTG
ggattacaggaacctgccac

SEQ ID NO: 212854 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 212855 - DNA, 20 bp, Artificial Sequence
  Description of Artificial Sequence: Synthetic oligonucleotide
  Target: ATXN1; (-) strand; PAM type: YTN; PAM sequence: CTG
ccccagcctcccaagtagct

SEQ ID NO: 212856 - DNA, 20 bp, Artificial Sequence
  Description of Artificial Sequence: Synthetic oligonucleotide
  Target: ATXN1; (-) strand; PAM type: YTN; PAM sequence: CTC
ctgccccagcctcccaagta

SEQ ID NO: 212857 - DNA, 20 bp, Artificial Sequence
  Description of Artificial Sequence: Synthetic oligonucleotide
  Target: ATXN1; (-) strand; PAM type: YTN; PAM sequence: TTC
aagtgatcctcctgccccag

SEQ ID NO: 212858 - DNA, 20 bp, Artificial Sequence
  Description of Artificial Sequence: Synthetic oligonucleotide
  Target: ATXN1; (-) strand; PAM type: YTN; PAM sequence: CTG
ggttcaagtgatcctcctgc

SEQ ID NO: 212859 - DNA, 20 bp, Artificial Sequence
  Description of Artificial Sequence: Synthetic oligonucleotide
  Target: ATXN1; (-) strand; PAM type: YTN; PAM sequence: TTC
ctgggttcaagtgatcctcc

SEQ ID NO: 212860 - DNA, 20 bp, Artificial Sequence
  Description of Artificial Sequence: Synthetic oligonucleotide
  Target: ATXN1; (-) strand; PAM type: YTN; PAM sequence: CTT
cctgggttcaagtgatcctc

SEQ ID NO: 212861 - DNA, 20 bp, Artificial Sequence
  Description of Artificial Sequence: Synthetic oligonucleotide
  Target: ATXN1; (-) strand; PAM type: YTN; PAM sequence: CTG
cttcctgggttcaagtgatc

SEQ ID NO: 212862 - DNA, 20 bp, Artificial Sequence
  Description of Artificial Sequence: Synthetic oligonucleotide
  Target: ATXN1; (-) strand; PAM type: YTN; PAM sequence: CTC
tgcttcctgggttcaagtga

SEQ ID NO: 212863 - DNA, 20 bp, Artificial Sequence
  Description of Artificial Sequence: Synthetic oligonucleotide
  Target: ATXN1; (-) strand; PAM type: YTN; PAM sequence: CTG
caacctctgcttcctgggtt

SEQ ID NO: 212864 - DNA, 20 bp, Artificial Sequence
  Description of Artificial Sequence: Synthetic oligonucleotide
  Target: ATXN1; (-) strand; PAM type: YTN; PAM sequence: TTC
actgcaacctctgcttcctg

SEQ ID NO: 212865 - DNA, 20 bp, Artificial Sequence
  Description of Artificial Sequence: Synthetic oligonucleotide
  Target: ATXN1; (-) strand; PAM type: YTN; PAM sequence: CTC
agttcactgcaacctctgct

SEQ ID NO: 212866 - DNA, 20 bp, Artificial Sequence
  Description of Artificial Sequence: Synthetic oligonucleotide
  Target: ATXN1; (-) strand; PAM type: YTN; PAM sequence: CTG
gagtgtgatggtgtgatctc

SEQ ID NO: 212867 - DNA, 20 bp, Artificial Sequence
  Description of Artificial Sequence: Synthetic oligonucleotide
  Target: ATXN1; (-) strand; PAM type: YTN; PAM sequence: CTC
atcccccaggctggagtgtg

SEQ ID NO: 212868 - DNA, 20 bp, Artificial Sequence
  Description of Artificial Sequence: Synthetic oligonucleotide
  Target: ATXN1; (-) strand; PAM type: YTN; PAM sequence: CTC
tcatcccccaggctggagtg

SEQ ID NO: 212869 - DNA, 20 bp, Artificial Sequence
  Description of Artificial Sequence: Synthetic oligonucleotide
  Target: ATXN1; (-) strand; PAM type: YTN; PAM sequence: CTC
gctctcatcccccaggctgg

SEQ ID NO: 212870 - DNA, 20 bp, Artificial Sequence
  Description of Artificial Sequence: Synthetic oligonucleotide
  Target: ATXN1; (-) strand; PAM type: YTN; PAM sequence: TTG
agacaaagtctcgctctcat

SEQ ID NO: 212871 - DNA, 20 bp, Artificial Sequence
  Description of Artificial Sequence: Synthetic oligonucleotide
  Target: ATXN1; (-) strand; PAM type: YTN; PAM sequence: CTT
gagacaaagtctcgctctca

SEQ ID NO: 212872 - DNA, 20 bp, Artificial Sequence
  Description of Artificial Sequence: Synthetic oligonucleotide
  Target: ATXN1; (-) strand; PAM type: YTN; PAM sequence: TTC
ttgagacaaagtctcgctct

SEQ ID NO: 212873 - DNA, 20 bp, Artificial Sequence
  Description of Artificial Sequence: Synthetic oligonucleotide
  Target: ATXN1; (-) strand; PAM type: YTN; PAM sequence: TTT
cttgagacaaagtctcgctc

SEQ ID NO: 212874 - DNA, 20 bp, Artificial Sequence
  Description of Artificial Sequence: Synthetic oligonucleotide
  Target: ATXN1; (-) strand; PAM type: YTN; PAM sequence: TTT
tcttgagacaaagtctcgct

SEQ ID NO: 212875 - DNA, 20 bp, Artificial Sequence
  Description of Artificial Sequence: Synthetic oligonucleotide
  Target: ATXN1; (-) strand; PAM type: YTN; PAM sequence: TTT
ttcttgagacaaagtctcgc

SEQ ID NO: 212876 - DNA, 20 bp, Artificial Sequence
  Description of Artificial Sequence: Synthetic oligonucleotide
  Target: ATXN1; (-) strand; PAM type: YTN; PAM sequence: TTT
tttcttgagacaaagtctcg

SEQ ID NO: 212877 - DNA, 20 bp, Artificial Sequence
  Description of Artificial Sequence: Synthetic oligonucleotide
  Target: ATXN1; (-) strand; PAM type: YTN; PAM sequence: TTT
ttttcttgagacaaagtctc

SEQ ID NO: 212878 - DNA, 20 bp, Artificial Sequence
  Description of Artificial Sequence: Synthetic oligonucleotide
  Target: ATXN1; (-) strand; PAM type: YTN; PAM sequence: TTT
tttttcttgagacaaagtct

SEQ ID NO: 212879 - DNA, 20 bp, Artificial Sequence
  Description of Artificial Sequence: Synthetic oligonucleotide
  Target: ATXN1; (-) strand; PAM type: YTN; PAM sequence: TTT
ttttttcttgagacaaagtc

SEQ ID NO: 212880 - DNA, 20 bp, Artificial Sequence
  Description of Artificial Sequence: Synthetic oligonucleotide
  Target: ATXN1; (-) strand; PAM type: YTN; PAM sequence: TTT
tttttttcttgagacaaagt

SEQ ID NO: 212881 - DNA, 20 bp, Artificial Sequence
  Description of Artificial Sequence: Synthetic oligonucleotide
  Target: ATXN1; (-) strand; PAM type: YTN; PAM sequence: TTT
ttttttttcttgagacaaag

SEQ ID NO: 212882 - DNA, 20 bp, Artificial Sequence
  Description of Artificial Sequence: Synthetic oligonucleotide
  Target: ATXN1; (-) strand; PAM type: YTN; PAM sequence: TTT
tttttttttcttgagacaaa

SEQ ID NO: 212883 - DNA, 20 bp, Artificial Sequence
  Description of Artificial Sequence: Synthetic oligonucleotide
  Target: ATXN1; (-) strand; PAM type: YTN; PAM sequence: TTT
ttttttttttcttgagacaa

SEQ ID NO: 212884 - DNA, 20 bp, Artificial Sequence
  Description of Artificial Sequence: Synthetic oligonucleotide
  Target: ATXN1; (-) strand; PAM type: YTN; PAM sequence: TTT
tttttttttttcttgagaca

SEQ ID NO: 212885 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttcttgagac

SEQ ID NO: 212886 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttcttgaga

SEQ ID NO: 212887 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttcttgag

SEQ ID NO: 212888 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttcttga

SEQ ID NO: 212889 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttttcttg

SEQ ID NO: 212890 - DNA, 20 bp, Artificial Sequence
  Description of Artificial Sequence: Synthetic oligonucleotide
  Target: ATXN1; (-) strand; PAM type: YTN; PAM sequence: CTC
ttttttttttttttttttct

SEQ ID NO: 212891 - DNA, 20 bp, Artificial Sequence
  Description of Artificial Sequence: Synthetic oligonucleotide
  Target: ATXN1; (-) strand; PAM type: YTN; PAM sequence: CTC
cagaactctttttttttttt

SEQ ID NO: 212892 - DNA, 20 bp, Artificial Sequence
  Description of Artificial Sequence: Synthetic oligonucleotide
  Target: ATXN1; (-) strand; PAM type: YTN; PAM sequence: CTG
tcaccaccatccatctccag

SEQ ID NO: 212893 - DNA, 20 bp, Artificial Sequence
  Description of Artificial Sequence: Synthetic oligonucleotide
  Target: ATXN1; (-) strand; PAM type: YTN; PAM sequence: TTG
tacaactgtcaccaccatcc

SEQ ID NO: 212894 - DNA, 20 bp, Artificial Sequence
  Description of Artificial Sequence: Synthetic oligonucleotide
  Target: ATXN1; (-) strand; PAM type: YTN; PAM sequence: TTG
ttgtacaactgtcaccacca

SEQ ID NO: 212895 - DNA, 20 bp, Artificial Sequence
  Description of Artificial Sequence: Synthetic oligonucleotide
  Target: ATXN1; (-) strand; PAM type: YTN; PAM sequence: TTC
acattgttgtacaactgtca

SEQ ID NO: 212896 - DNA, 20 bp, Artificial Sequence
  Description of Artificial Sequence: Synthetic oligonucleotide
  Target: ATXN1; (-) strand; PAM type: YTN; PAM sequence: CTG
aattcacattgttgtacaac

SEQ ID NO: 212897 - DNA, 20 bp, Artificial Sequence
  Description of Artificial Sequence: Synthetic oligonucleotide
  Target: ATXN1; (-) strand; PAM type: YTN; PAM sequence: TTA
actgaattcacattgttgta

SEQ ID NO: 212898 - DNA, 20 bp, Artificial Sequence
  Description of Artificial Sequence: Synthetic oligonucleotide
  Target: ATXN1; (-) strand; PAM type: YTN; PAM sequence: TTC
agtggtattaactgaattca

SEQ ID NO: 212899 - DNA, 20 bp, Artificial Sequence
  Description of Artificial Sequence: Synthetic oligonucleotide
  Target: ATXN1; (-) strand; PAM type: YTN; PAM sequence: TTC
accatcaagtgtacattcag

SEQ ID NO: 212900 - DNA, 20 bp, Artificial Sequence
  Description of Artificial Sequence: Synthetic oligonucleotide
  Target: ATXN1; (-) strand; PAM type: YTN; PAM sequence: CTT
caccatcaagtgtacattca

SEQ ID NO: 212901 - DNA, 20 bp, Artificial Sequence
  Description of Artificial Sequence: Synthetic oligonucleotide
  Target: ATXN1; (-) strand; PAM type: YTN; PAM sequence: TTG
accgtcttcaccatcaagtg

SEQ ID NO: 212902 - DNA, 20 bp, Artificial Sequence
  Description of Artificial Sequence: Synthetic oligonucleotide
  Target: ATXN1; (-) strand; PAM type: YTN; PAM sequence: CTA
taaaattgaccgtcttcacc

SEQ ID NO: 212903 - DNA, 20 bp, Artificial Sequence
  Description of Artificial Sequence: Synthetic oligonucleotide
  Target: ATXN1; (-) strand; PAM type: YTN; PAM sequence: TTG
tggcaaaaggcatacactat

SEQ ID NO: 212904 - DNA, 20 bp, Artificial Sequence
  Description of Artificial Sequence: Synthetic oligonucleotide
  Target: ATXN1; (-) strand; PAM type: YTN; PAM sequence: TTA
agtaaataaataaaccatac

SEQ ID NO: 212905 - DNA, 20 bp, Artificial Sequence
  Description of Artificial Sequence: Synthetic oligonucleotide
  Target: ATXN1; (-) strand; PAM type: YTN; PAM sequence: TTT
aagtaaataaataaaccata

SEQ ID NO: 212906 - DNA, 20 bp, Artificial Sequence
  Description of Artificial Sequence: Synthetic oligonucleotide
  Target: ATXN1; (-) strand; PAM type: YTN; PAM sequence: TTT
taagtaaataaataaaccat

SEQ ID NO: 212907 - DNA, 20 bp, Artificial Sequence
  Description of Artificial Sequence: Synthetic oligonucleotide
  Target: ATXN1; (-) strand; PAM type: YTN; PAM sequence: CTT
ttaagtaaataaataaacca

SEQ ID NO: 212908 - DNA, 20 bp, Artificial Sequence
  Description of Artificial Sequence: Synthetic oligonucleotide
  Target: ATXN1; (-) strand; PAM type: YTN; PAM sequence: TTG
cttttaagtaaataaataaa

SEQ ID NO: 212909 - DNA, 20 bp, Artificial Sequence
  Description of Artificial Sequence: Synthetic oligonucleotide
  Target: ATXN1; (-) strand; PAM type: YTN; PAM sequence: TTT
gcttttaagtaaataaataa

SEQ ID NO: 212910 - DNA, 20 bp, Artificial Sequence
  Description of Artificial Sequence: Synthetic oligonucleotide
  Target: ATXN1; (-) strand; PAM type: YTN; PAM sequence: TTT
tgcttttaagtaaataaata

SEQ ID NO: 212911 - DNA, 20 bp, Artificial Sequence
  Description of Artificial Sequence: Synthetic oligonucleotide
  Target: ATXN1; (-) strand; PAM type: YTN; PAM sequence: CTT
ttgcttttaagtaaataaat

SEQ ID NO: 212912 - DNA, 20 bp, Artificial Sequence
  Description of Artificial Sequence: Synthetic oligonucleotide
  Target: ATXN1; (-) strand; PAM type: YTN; PAM sequence: CTG
aaacaaaacaccgccacttt

SEQ ID NO: 212913 - DNA, 20 bp, Artificial Sequence
  Description of Artificial Sequence: Synthetic oligonucleotide
  Target: ATXN1; (-) strand; PAM type: YTN; PAM sequence: CTA
atactgaaacaaaacaccgc

SEQ ID NO: 212914 - DNA, 20 bp, Artificial Sequence
  Description of Artificial Sequence: Synthetic oligonucleotide
  Target: ATXN1; (-) strand; PAM type: YTN; PAM sequence: TTG
aacccgacctaatactgaaa

SEQ ID NO: 212915 - DNA, 20 bp, Artificial Sequence
  Description of Artificial Sequence: Synthetic oligonucleotide
  Target: ATXN1; (-) strand; PAM type: YTN; PAM sequence: CTT
gaacccgacctaatactgaa

SEQ ID NO: 212916 - DNA, 20 bp, Artificial Sequence
  Description of Artificial Sequence: Synthetic oligonucleotide
  Target: ATXN1; (-) strand; PAM type: YTN; PAM sequence: TTG
cttgaacccgacctaatact

SEQ ID NO: 212917 - DNA, 20 bp, Artificial Sequence
  Description of Artificial Sequence: Synthetic oligonucleotide
  Target: ATXN1; (-) strand; PAM type: YTN; PAM sequence: TTT
gcttgaacccgacctaatac

SEQ ID NO: 212918 - DNA, 20 bp, Artificial Sequence
  Description of Artificial Sequence: Synthetic oligonucleotide
  Target: ATXN1; (-) strand; PAM type: YTN; PAM sequence: CTG
tttgcttgaacccgacctaa

SEQ ID NO: 212919 - DNA, 20 bp, Artificial Sequence
  Description of Artificial Sequence: Synthetic oligonucleotide
  Target: ATXN1; (-) strand; PAM type: YTN; PAM sequence: TTC
tgtttgcttgaacccgacct

SEQ ID NO: 212920 - DNA, 20 bp, Artificial Sequence
  Description of Artificial Sequence: Synthetic oligonucleotide
  Target: ATXN1; (-) strand; PAM type: YTN; PAM sequence: CTT
ctgtttgcttgaacccgacc

SEQ ID NO: 212921 - DNA, 20 bp, Artificial Sequence
  Description of Artificial Sequence: Synthetic oligonucleotide
  Target: ATXN1; (-) strand; PAM type: YTN; PAM sequence: TTA
tgaaggaataacccttctgt

SEQ ID NO: 212922 - DNA, 20 bp, Artificial Sequence
  Description of Artificial Sequence: Synthetic oligonucleotide
  Target: ATXN1; (-) strand; PAM type: YTN; PAM sequence: CTA
tggtgcagaatgtatatgat

SEQ ID NO: 212923 - DNA, 20 bp, Artificial Sequence
  Description of Artificial Sequence: Synthetic oligonucleotide
  Target: ATXN1; (-) strand; PAM type: YTN; PAM sequence: CTC
aatctatggtgcagaatgta

SEQ ID NO: 212924 - DNA, 20 bp, Artificial Sequence
  Description of Artificial Sequence: Synthetic oligonucleotide
  Target: ATXN1; (-) strand; PAM type: YTN; PAM sequence: TTA
taaaaataaaaaaatggtgc

SEQ ID NO: 212925 - DNA, 20 bp, Artificial Sequence
  Description of Artificial Sequence: Synthetic oligonucleotide
  Target: ATXN1; (-) strand; PAM type: YTN; PAM sequence: CTT
ataaaaataaaaaaatggtg

SEQ ID NO: 212926 - DNA, 20 bp, Artificial Sequence
  Description of Artificial Sequence: Synthetic oligonucleotide
  Target: ATXN1; (-) strand; PAM type: YTN; PAM sequence: TTG
gtatagcttataaaaataaa

SEQ ID NO: 212927 - DNA, 20 bp, Artificial Sequence
  Description of Artificial Sequence: Synthetic oligonucleotide
  Target: ATXN1; (-) strand; PAM type: YTN; PAM sequence: TTT
ggtatagcttataaaaataa

SEQ ID NO: 212928 - DNA, 20 bp, Artificial Sequence
  Description of Artificial Sequence: Synthetic oligonucleotide
  Target: ATXN1; (-) strand; PAM type: YTN; PAM sequence: CTG
aaatttggtatagcttataa

SEQ ID NO: 212929 - DNA, 20 bp, Artificial Sequence
  Description of Artificial Sequence: Synthetic oligonucleotide
  Target: ATXN1; (-) strand; PAM type: YTN; PAM sequence: TTG
tgcactgaaatttggtatag

SEQ ID NO: 212930 - DNA, 20 bp, Artificial Sequence
  Description of Artificial Sequence: Synthetic oligonucleotide
  Target: ATXN1; (-) strand; PAM type: YTN; PAM sequence: TTT
gtgcactgaaatttggtata

SEQ ID NO: 212931 - DNA, 20 bp, Artificial Sequence
  Description of Artificial Sequence: Synthetic oligonucleotide
  Target: ATXN1; (-) strand; PAM type: YTN; PAM sequence: TTA
tagcatttgtgcactgaaat

SEQ ID NO: 212932 - DNA, 20 bp, Artificial Sequence
  Description of Artificial Sequence: Synthetic oligonucleotide
  Target: ATXN1; (-) strand; PAM type: YTN; PAM sequence: CTG
ttatagcatttgtgcactga

SEQ ID NO: 212933 - DNA, 20 bp, Artificial Sequence
  Description of Artificial Sequence: Synthetic oligonucleotide
  Target: ATXN1; (-) strand; PAM type: YTN; PAM sequence: CTC
acccacagtatgtgctgtta

SEQ ID NO: 212934 - DNA, 20 bp, Artificial Sequence
  Description of Artificial Sequence: Synthetic oligonucleotide
  Target: ATXN1; (-) strand; PAM type: YTN; PAM sequence: TTC
tcacccacagtatgtgctgt

SEQ ID NO: 212935 - DNA, 20 bp, Artificial Sequence
  Description of Artificial Sequence: Synthetic oligonucleotide
  Target: ATXN1; (-) strand; PAM type: YTN; PAM sequence: TTA
tattctcacccacagtatgt

SEQ ID NO: 212936 - DNA, 20 bp, Artificial Sequence
  Description of Artificial Sequence: Synthetic oligonucleotide
  Target: ATXN1; (-) strand; PAM type: YTN; PAM sequence: TTT
atattctcacccacagtatg

SEQ ID NO: 212937 - DNA, 20 bp, Artificial Sequence
  Description of Artificial Sequence: Synthetic oligonucleotide
  Target: ATXN1; (-) strand; PAM type: YTN; PAM sequence: TTT
tatattctcacccacagtat

SEQ ID NO: 212938 - DNA, 20 bp, Artificial Sequence
  Description of Artificial Sequence: Synthetic oligonucleotide
  Target: ATXN1; (-) strand; PAM type: YTN; PAM sequence: TTT
ttatattctcacccacagta

SEQ ID NO: 212939 - DNA, 20 bp, Artificial Sequence
  Description of Artificial Sequence: Synthetic oligonucleotide
  Target: ATXN1; (-) strand; PAM type: YTN; PAM sequence: TTT
tttatattctcacccacagt

SEQ ID NO: 212940 - DNA, 20 bp, Artificial Sequence
  Description of Artificial Sequence: Synthetic oligonucleotide
  Target: ATXN1; (-) strand; PAM type: YTN; PAM sequence: TTC
acaattttttatattctcac

SEQ ID NO: 212941 - DNA, 20 bp, Artificial Sequence
  Description of Artificial Sequence: Synthetic oligonucleotide
  Target: ATXN1; (-) strand; PAM type: YTN; PAM sequence: TTT
cacaattttttatattctca

SEQ ID NO: 212942 - DNA, 20 bp, Artificial Sequence
  Description of Artificial Sequence: Synthetic oligonucleotide
  Target: ATXN1; (-) strand; PAM type: YTN; PAM sequence: CTT
tcacaattttttatattctc

SEQ ID NO: 212943 - DNA, 20 bp, Artificial Sequence
  Description of Artificial Sequence: Synthetic oligonucleotide
  Target: ATXN1; (-) strand; PAM type: YTN; PAM sequence: TTA
gactttcacaattttttata

SEQ ID NO: 212944 - DNA, 20 bp, Artificial Sequence
  Description of Artificial Sequence: Synthetic oligonucleotide
  Target: ATXN1; (-) strand; PAM type: YTN; PAM sequence: TTT
agactttcacaattttttat

SEQ ID NO: 212945 - DNA, 20 bp, Artificial Sequence
  Description of Artificial Sequence: Synthetic oligonucleotide
  Target: ATXN1; (-) strand; PAM type: YTN; PAM sequence: CTT
tagactttcacaatttttta

SEQ ID NO: 212946 - DNA, 20 bp, Artificial Sequence
  Description of Artificial Sequence: Synthetic oligonucleotide
  Target: ATXN1; (-) strand; PAM type: YTN; PAM sequence: TTG
caatgtgagcagtaacttta

SEQ ID NO: 212947 - DNA, 20 bp, Artificial Sequence
  Description of Artificial Sequence: Synthetic oligonucleotide
  Target: ATXN1; (-) strand; PAM type: YTN; PAM sequence: TTG
tgtcaaggttgcaatgtgag

SEQ ID NO: 212948 - DNA, 20 bp, Artificial Sequence
  Description of Artificial Sequence: Synthetic oligonucleotide
  Target: ATXN1; (-) strand; PAM type: YTN; PAM sequence: TTG
cagagtcgttgtgtcaaggt

SEQ ID NO: 212949 - DNA, 20 bp, Artificial Sequence
  Description of Artificial Sequence: Synthetic oligonucleotide
  Target: ATXN1; (-) strand; PAM type: YTN; PAM sequence: TTT
gcagagtcgttgtgtcaagg

SEQ ID NO: 212950 - DNA, 20 bp, Artificial Sequence
  Description of Artificial Sequence: Synthetic oligonucleotide
  Target: ATXN1; (-) strand; PAM type: YTN; PAM sequence: TTT
tgcagagtcgttgtgtcaag

SEQ ID NO: 212951 - DNA, 20 bp, Artificial Sequence
  Description of Artificial Sequence: Synthetic oligonucleotide
  Target: ATXN1; (-) strand; PAM type: YTN; PAM sequence: TTT
ttgcagagtcgttgtgtcaa

SEQ ID NO: 212952 - DNA, 20 bp, Artificial Sequence
  Description of Artificial Sequence: Synthetic oligonucleotide
  Target: ATXN1; (-) strand; PAM type: YTN; PAM sequence: TTG
tttttgcagagtcgttgtgt

SEQ ID NO: 212953 - DNA, 20 bp, Artificial Sequence
  Description of Artificial Sequence: Synthetic oligonucleotide
  Target: ATXN1; (-) strand; PAM type: YTN; PAM sequence: CTT
gtttttgcagagtcgttgtg

SEQ ID NO: 212954 - DNA, 20 bp, Artificial Sequence
  Description of Artificial Sequence: Synthetic oligonucleotide
  Target: ATXN1; (-) strand; PAM type: YTN; PAM sequence: TTA
agcccttgtttttgcagagt

SEQ ID NO: 212955 - DNA, 20 bp, Artificial Sequence
  Description of Artificial Sequence: Synthetic oligonucleotide
  Target: ATXN1; (-) strand; PAM type: YTN; PAM sequence: TTT
aagcccttgtttttgcagag

SEQ ID NO: 212956 - DNA, 20 bp, Artificial Sequence
  Description of Artificial Sequence: Synthetic oligonucleotide
  Target: ATXN1; (-) strand; PAM type: YTN; PAM sequence: TTA
aatttaagcccttgtttttg

SEQ ID NO: 212957 - DNA, 20 bp, Artificial Sequence
  Description of Artificial Sequence: Synthetic oligonucleotide
  Target: ATXN1; (-) strand; PAM type: YTN; PAM sequence: TTC
agttaaatttaagcccttgt

SEQ ID NO: 212958 - DNA, 20 bp, Artificial Sequence
  Description of Artificial Sequence: Synthetic oligonucleotide
  Target: ATXN1; (-) strand; PAM type: YTN; PAM sequence: TTG
tggcatattcagttaaattt

SEQ ID NO: 212959 - DNA, 20 bp, Artificial Sequence
  Description of Artificial Sequence: Synthetic oligonucleotide
  Target: ATXN1; (-) strand; PAM type: YTN; PAM sequence: CTG
aattgtggcatattcagtta

SEQ ID NO: 212960 - DNA, 20 bp, Artificial Sequence
  Description of Artificial Sequence: Synthetic oligonucleotide
  Target: ATXN1; (-) strand; PAM type: YTN; PAM sequence: TTC
tgaattgtggcatattcagt

SEQ ID NO: 212961 - DNA, 20 bp, Artificial Sequence
  Description of Artificial Sequence: Synthetic oligonucleotide
  Target: ATXN1; (-) strand; PAM type: YTN; PAM sequence: TTT
ctgaattgtggcatattcag

SEQ ID NO: 212962 - DNA, 20 bp, Artificial Sequence
  Description of Artificial Sequence: Synthetic oligonucleotide
  Target: ATXN1; (-) strand; PAM type: YTN; PAM sequence: TTT
tctgaattgtggcatattca

SEQ ID NO: 212963 - DNA, 20 bp, Artificial Sequence
  Description of Artificial Sequence: Synthetic oligonucleotide
  Target: ATXN1; (-) strand; PAM type: YTN; PAM sequence: CTC
gggcatatggtagtagcatt

SEQ ID NO: 212964 - DNA, 20 bp, Artificial Sequence
  Description of Artificial Sequence: Synthetic oligonucleotide
  Target: ATXN1; (-) strand; PAM type: YTN; PAM sequence: CTC
agtcccctcgggcatatggt

SEQ ID NO: 212965 - DNA, 20 bp, Artificial Sequence
  Description of Artificial Sequence: Synthetic oligonucleotide
  Target: ATXN1; (-) strand; PAM type: YTN; PAM sequence: CTG
caagtgtgactcagtcccct

SEQ ID NO: 212966 - DNA, 20 bp, Artificial Sequence
  Description of Artificial Sequence: Synthetic oligonucleotide
  Target: ATXN1; (-) strand; PAM type: YTN; PAM sequence: TTA
aactgcaagtgtgactcagt

SEQ ID NO: 212967 - DNA, 20 bp, Artificial Sequence
  Description of Artificial Sequence: Synthetic oligonucleotide
  Target: ATXN1; (-) strand; PAM type: YTN; PAM sequence: TTG
aagttaaactgcaagtgtga

SEQ ID NO: 212968 - DNA, 20 bp, Artificial Sequence
  Description of Artificial Sequence: Synthetic oligonucleotide
  Target: ATXN1; (-) strand; PAM type: YTN; PAM sequence: TTC
aggagttgaagttaaactgc

SEQ ID NO: 212969 - DNA, 20 bp, Artificial Sequence
  Description of Artificial Sequence: Synthetic oligonucleotide
  Target: ATXN1; (-) strand; PAM type: YTN; PAM sequence: TTA
aacatacagaagtcaaaaaa

SEQ ID NO: 212970 - DNA, 20 bp, Artificial Sequence
  Description of Artificial Sequence: Synthetic oligonucleotide
  Target: ATXN1; (-) strand; PAM type: YTN; PAM sequence: TTT
aaacatacagaagtcaaaaa

SEQ ID NO: 212971 - DNA, 20 bp, Artificial Sequence
  Description of Artificial Sequence: Synthetic oligonucleotide
  Target: ATXN1; (-) strand; PAM type: YTN; PAM sequence: TTG
atgagaatttaaacatacag

SEQ ID NO: 212972 - DNA, 20 bp, Artificial Sequence
  Description of Artificial Sequence: Synthetic oligonucleotide
  Target: ATXN1; (-) strand; PAM type: YTN; PAM sequence: TTT
gatgagaatttaaacataca

SEQ ID NO: 212973 - DNA, 20 bp, Artificial Sequence
  Description of Artificial Sequence: Synthetic oligonucleotide
  Target: ATXN1; (-) strand; PAM type: YTN; PAM sequence: CTG
cagtttgatgagaatttaaa

SEQ ID NO: 212974 - DNA, 20 bp, Artificial Sequence
  Description of Artificial Sequence: Synthetic oligonucleotide
  Target: ATXN1; (-) strand; PAM type: YTN; PAM sequence: TTG
aagctgcagtttgatgagaa

SEQ ID NO: 212975 - DNA, 20 bp, Artificial Sequence
  Description of Artificial Sequence: Synthetic oligonucleotide
  Target: ATXN1; (-) strand; PAM type: YTN; PAM sequence: CTG
cgatcagtggcagaaacaaa

SEQ ID NO: 212976 - DNA, 20 bp, Artificial Sequence
  Description of Artificial Sequence: Synthetic oligonucleotide
  Target: ATXN1; (-) strand; PAM type: YTN; PAM sequence: TTC
tgcgatcagtggcagaaaca

SEQ ID NO: 212977 - DNA, 20 bp, Artificial Sequence
  Description of Artificial Sequence: Synthetic oligonucleotide
  Target: ATXN1; (-) strand; PAM type: YTN; PAM sequence: TTA
cgtcaaatgataagcgatgc

SEQ ID NO: 212978 - DNA, 20 bp, Artificial Sequence
  Description of Artificial Sequence: Synthetic oligonucleotide
  Target: ATXN1; (-) strand; PAM type: YTN; PAM sequence: TTC
atggtagagattacgtcaaa

SEQ ID NO: 212979 - DNA, 20 bp, Artificial Sequence
  Description of Artificial Sequence: Synthetic oligonucleotide
  Target: ATXN1; (-) strand; PAM type: YTN; PAM sequence: TTT
catggtagagattacgtcaa

SEQ ID NO: 212980 - DNA, 20 bp, Artificial Sequence
  Description of Artificial Sequence: Synthetic oligonucleotide
  Target: ATXN1; (-) strand; PAM type: YTN; PAM sequence: TTC
aaaaacaagtatttcatggt

SEQ ID NO: 212981 - DNA, 20 bp, Artificial Sequence
  Description of Artificial Sequence: Synthetic oligonucleotide
  Target: ATXN1; (-) strand; PAM type: YTN; PAM sequence: CTG
ttcaaaaacaagtatttcat

SEQ ID NO: 212982 - DNA, 20 bp, Artificial Sequence
  Description of Artificial Sequence: Synthetic oligonucleotide
  Target: ATXN1; (-) strand; PAM type: YTN; PAM sequence: TTA
ggctgttcaaaaacaagtat

SEQ ID NO: 212983 - DNA, 20 bp, Artificial Sequence
  Description of Artificial Sequence: Synthetic oligonucleotide
  Target: ATXN1; (-) strand; PAM type: YTN; PAM sequence: CTT
aggctgttcaaaaacaagta

SEQ ID NO: 212984 - DNA, 20 bp, Artificial Sequence
  Description of Artificial Sequence: Synthetic oligonucleotide
  Target: ATXN1; (-) strand; PAM type: YTN; PAM sequence: CTC
cgaaccttaggctgttcaaa

SEQ ID NO: 212985 - DNA, 20 bp, Artificial Sequence
  Description of Artificial Sequence: Synthetic oligonucleotide
  Target: ATXN1; (-) strand; PAM type: YTN; PAM sequence: TTA
aaaaagtgtcctccgaacct

SEQ ID NO: 212986 - DNA, 20 bp, Artificial Sequence
  Description of Artificial Sequence: Synthetic oligonucleotide
  Target: ATXN1; (-) strand; PAM type: YTN; PAM sequence: TTT
aaaaaagtgtcctccgaacc

SEQ ID NO: 212987 - DNA, 20 bp, Artificial Sequence
  Description of Artificial Sequence: Synthetic oligonucleotide
  Target: ATXN1; (-) strand; PAM type: YTN; PAM sequence: TTA
acatttaaaaaagtgtcctc

SEQ ID NO: 212988 - DNA, 20 bp, Artificial Sequence
  Description of Artificial Sequence: Synthetic oligonucleotide
  Target: ATXN1; (-) strand; PAM type: YTN; PAM sequence: TTT
aacatttaaaaaagtgtcct

SEQ ID NO: 212989 - DNA, 20 bp, Artificial Sequence
  Description of Artificial Sequence: Synthetic oligonucleotide
  Target: ATXN1; (-) strand; PAM type: YTN; PAM sequence: TTA
tttaacatttaaaaaagtgt

SEQ ID NO: 212990 - DNA, 20 bp, Artificial Sequence
  Description of Artificial Sequence: Synthetic oligonucleotide
  Target: ATXN1; (-) strand; PAM type: YTN; PAM sequence: TTT
atttaacatttaaaaaagtg

SEQ ID NO: 212991 - DNA, 20 bp, Artificial Sequence
  Description of Artificial Sequence: Synthetic oligonucleotide
  Target: ATXN1; (-) strand; PAM type: YTN; PAM sequence: TTT
tatttaacatttaaaaaagt

SEQ ID NO: 212992 - DNA, 20 bp, Artificial Sequence
  Description of Artificial Sequence: Synthetic oligonucleotide
  Target: ATXN1; (-) strand; PAM type: YTN; PAM sequence: TTT
ttatttaacatttaaaaaag

SEQ ID NO: 212993 - DNA, 20 bp, Artificial Sequence
  Description of Artificial Sequence: Synthetic oligonucleotide
  Target: ATXN1; (-) strand; PAM type: YTN; PAM sequence: TTT
tttatttaacatttaaaaaa

SEQ ID NO: 212994 - DNA, 20 bp, Artificial Sequence
  Description of Artificial Sequence: Synthetic oligonucleotide
  Target: ATXN1; (-) strand; PAM type: YTN; PAM sequence: TTG
acagttttttatttaacatt

SEQ ID NO: 212995 - DNA, 20 bp, Artificial Sequence
  Description of Artificial Sequence: Synthetic oligonucleotide
  Target: ATXN1; (-) strand; PAM type: YTN; PAM sequence: TTC
ccagtaatcgttgacagttt

SEQ ID NO: 212996 - DNA, 20 bp, Artificial Sequence
  Description of Artificial Sequence: Synthetic oligonucleotide
  Target: ATXN1; (-) strand; PAM type: YTN; PAM sequence: TTC
cattcccagtaatcgttgac

SEQ ID NO: 212997 - DNA, 20 bp, Artificial Sequence
  Description of Artificial Sequence: Synthetic oligonucleotide
  Target: ATXN1; (-) strand; PAM type: YTN; PAM sequence: TTT
ccattcccagtaatcgttga

SEQ ID NO: 212998 - DNA, 20 bp, Artificial Sequence
  Description of Artificial Sequence: Synthetic oligonucleotide
  Target: ATXN1; (-) strand; PAM type: YTN; PAM sequence: TTT
tccattcccagtaatcgttg

SEQ ID NO: 212999 - DNA, 20 bp, Artificial Sequence
  Description of Artificial Sequence: Synthetic oligonucleotide
  Target: ATXN1; (-) strand; PAM type: YTN; PAM sequence: TTT
ttccattcccagtaatcgtt

SEQ ID NO: 213000 - DNA, 20 bp, Artificial Sequence
  Description of Artificial Sequence: Synthetic oligonucleotide
  Target: ATXN1; (-) strand; PAM type: YTN; PAM sequence: CTG
tttttccattcccagtaatc

SEQ ID NO: 213001 - DNA, 20 bp, Artificial Sequence
  Description of Artificial Sequence: Synthetic oligonucleotide
  Target: ATXN1; (-) strand; PAM type: YTN; PAM sequence: TTG
gctgtttttccattcccagt

SEQ ID NO: 213002 - DNA, 20 bp, Artificial Sequence
  Description of Artificial Sequence: Synthetic oligonucleotide
  Target: ATXN1; (-) strand; PAM type: YTN; PAM sequence: CTT
ggctgtttttccattcccag

SEQ ID NO: 213003 - DNA, 20 bp, Artificial Sequence
  Description of Artificial Sequence: Synthetic oligonucleotide
  Target: ATXN1; (-) strand; PAM type: YTN; PAM sequence: CTA
ggcataaggatggcatcaaa

SEQ ID NO: 213004 - DNA, 20 bp, Artificial Sequence
  Description of Artificial Sequence: Synthetic oligonucleotide
  Target: ATXN1; (-) strand; PAM type: YTN; PAM sequence: TTC
taggcataaggatggcatca

SEQ ID NO: 213005 - DNA, 20 bp, Artificial Sequence
  Description of Artificial Sequence: Synthetic oligonucleotide
  Target: ATXN1; (-) strand; PAM type: YTN; PAM sequence: TTT
ctaggcataaggatggcatc

SEQ ID NO: 213006 - DNA, 20 bp, Artificial Sequence
  Description of Artificial Sequence: Synthetic oligonucleotide
  Target: ATXN1; (-) strand; PAM type: YTN; PAM sequence: TTT
tctaggcataaggatggcat

SEQ ID NO: 213007 - DNA, 20 bp, Artificial Sequence
  Description of Artificial Sequence: Synthetic oligonucleotide
  Target: ATXN1; (-) strand; PAM type: YTN; PAM sequence: TTT
ttctaggcataaggatggca

SEQ ID NO: 213008 - DNA, 20 bp, Artificial Sequence
  Description of Artificial Sequence: Synthetic oligonucleotide
  Target: ATXN1; (-) strand; PAM type: YTN; PAM sequence: TTG
atcgatgtgggagtgggagt

SEQ ID NO: 213009 - DNA, 20 bp, Artificial Sequence
  Description of Artificial Sequence: Synthetic oligonucleotide
  Target: ATXN1; (-) strand; PAM type: YTN; PAM sequence: CTT
gatcgatgtgggagtgggag

SEQ ID NO: 213010 - DNA, 20 bp, Artificial Sequence
  Description of Artificial Sequence: Synthetic oligonucleotide
  Target: ATXN1; (-) strand; PAM type: YTN; PAM sequence: CTC
acttgatcgatgtgggagtg

SEQ ID NO: 213011 - DNA, 20 bp, Artificial Sequence
  Description of Artificial Sequence: Synthetic oligonucleotide
  Target: ATXN1; (-) strand; PAM type: YTN; PAM sequence: TTG
aaagaaggaagagatgcagc

SEQ ID NO: 213012 - DNA, 20 bp, Artificial Sequence
  Description of Artificial Sequence: Synthetic oligonucleotide
  Target: ATXN1; (-) strand; PAM type: YTN; PAM sequence: TTT
gaaagaaggaagagatgcag

SEQ ID NO: 213013 - DNA, 20 bp, Artificial Sequence
  Description of Artificial Sequence: Synthetic oligonucleotide
  Target: ATXN1; (-) strand; PAM type: YTN; PAM sequence: CTT
tgaaagaaggaagagatgca

SEQ ID NO: 213014 - DNA, 20 bp, Artificial Sequence
  Description of Artificial Sequence: Synthetic oligonucleotide
  Target: ATXN1; (-) strand; PAM type: YTN; PAM sequence: TTA
aggtgaactttgaaagaagg

SEQ ID NO: 213015 - DNA, 20 bp, Artificial Sequence
  Description of Artificial Sequence: Synthetic oligonucleotide
  Target: ATXN1; (-) strand; PAM type: YTN; PAM sequence: TTA
tagaatcatagagaagtgaa

SEQ ID NO: 213016 - DNA, 20 bp, Artificial Sequence
  Description of Artificial Sequence: Synthetic oligonucleotide
  Target: ATXN1; (-) strand; PAM type: YTN; PAM sequence: TTC
attatagaatcatagagaag

SEQ ID NO: 213017 - DNA, 20 bp, Artificial Sequence
  Description of Artificial Sequence: Synthetic oligonucleotide
  Target: ATXN1; (-) strand; PAM type: YTN; PAM sequence: CTT
cattatagaatcatagagaa

SEQ ID NO: 213018 - DNA, 20 bp, Artificial Sequence
  Description of Artificial Sequence: Synthetic oligonucleotide
  Target: ATXN1; (-) strand; PAM type: YTN; PAM sequence: CTG
ccttcattatagaatcatag

SEQ ID NO: 213019 - DNA, 20 bp, Artificial Sequence
  Description of Artificial Sequence: Synthetic oligonucleotide
  Target: ATXN1; (-) strand; PAM type: YTN; PAM sequence: CTG
taatcacagctgccttcatt

SEQ ID NO: 213020 - DNA, 20 bp, Artificial Sequence
  Description of Artificial Sequence: Synthetic oligonucleotide
  Target: ATXN1; (-) strand; PAM type: YTN; PAM sequence: CTG
ctgtaatcacagctgccttc

SEQ ID NO: 213021 - DNA, 20 bp, Artificial Sequence
  Description of Artificial Sequence: Synthetic oligonucleotide
  Target: ATXN1; (-) strand; PAM type: YTN; PAM sequence: TTC
tgctgtaatcacagctgcct

SEQ ID NO: 213022 - DNA, 20 bp, Artificial Sequence
  Description of Artificial Sequence: Synthetic oligonucleotide
  Target: ATXN1; (-) strand; PAM type: YTN; PAM sequence: CTT
ctgctgtaatcacagctgcc

SEQ ID NO: 213023 - DNA, 20 bp, Artificial Sequence
  Description of Artificial Sequence: Synthetic oligonucleotide
  Target: ATXN1; (-) strand; PAM type: YTN; PAM sequence: TTC
acttctgctgtaatcacagc

SEQ ID NO: 213024 - DNA, 20 bp, Artificial Sequence
  Description of Artificial Sequence: Synthetic oligonucleotide
  Target: ATXN1; (-) strand; PAM type: YTN; PAM sequence: CTT
cacttctgctgtaatcacag

SEQ ID NO: 213025 - DNA, 20 bp, Artificial Sequence
  Description of Artificial Sequence: Synthetic oligonucleotide
  Target: ATXN1; (-) strand; PAM type: YTN; PAM sequence: TTC
ttcacttctgctgtaatcac

SEQ ID NO: 213026 - DNA, 20 bp, Artificial Sequence
  Description of Artificial Sequence: Synthetic oligonucleotide
  Target: ATXN1; (-) strand; PAM type: YTN; PAM sequence: CTT
cttcacttctgctgtaatca

SEQ ID NO: 213027 - DNA, 20 bp, Artificial Sequence
  Description of Artificial Sequence: Synthetic oligonucleotide
  Target: ATXN1; (-) strand; PAM type: YTN; PAM sequence: CTC
ttcttcacttctgctgtaat

SEQ ID NO: 213028 - DNA, 20 bp, Artificial Sequence
  Description of Artificial Sequence: Synthetic oligonucleotide
  Target: ATXN1; (-) strand; PAM type: YTN; PAM sequence: CTC
tcttcttcacttctgctgta

SEQ ID NO: 213029 - DNA, 20 bp, Artificial Sequence
  Description of Artificial Sequence: Synthetic oligonucleotide
  Target: ATXN1; (-) strand; PAM type: YTN; PAM sequence: CTC
ccagggtaggtagtactctc

SEQ ID NO: 213030 - DNA, 20 bp, Artificial Sequence
  Description of Artificial Sequence: Synthetic oligonucleotide
  Target: ATXN1; (-) strand; PAM type: YTN; PAM sequence: TTG
ctcccagggtaggtagtact

SEQ ID NO: 213031 - DNA, 20 bp, Artificial Sequence
  Description of Artificial Sequence: Synthetic oligonucleotide
  Target: ATXN1; (-) strand; PAM type: YTN; PAM sequence: CTT
gctcccagggtaggtagtac

SEQ ID NO: 213032 - DNA, 20 bp, Artificial Sequence
  Description of Artificial Sequence: Synthetic oligonucleotide
  Target: ATXN1; (-) strand; PAM type: YTN; PAM sequence: TTA
acttgctcccagggtaggta

SEQ ID NO: 213033 - DNA, 20 bp, Artificial Sequence
  Description of Artificial Sequence: Synthetic oligonucleotide
  Target: ATXN1; (-) strand; PAM type: YTN; PAM sequence: CTA
tggccataaattaacttgct

SEQ ID NO: 213034 - DNA, 20 bp, Artificial Sequence
  Description of Artificial Sequence: Synthetic oligonucleotide
  Target: ATXN1; (-) strand; PAM type: YTN; PAM sequence: CTA
gtgggcctatggccataaat

SEQ ID NO: 213035 - DNA, 20 bp, Artificial Sequence
  Description of Artificial Sequence: Synthetic oligonucleotide
  Target: ATXN1; (-) strand; PAM type: YTN; PAM sequence: TTC
agtgtatccctagtgggcct

SEQ ID NO: 213036 - DNA, 20 bp, Artificial Sequence
  Description of Artificial Sequence: Synthetic oligonucleotide
  Target: ATXN1; (-) strand; PAM type: YTN; PAM sequence: TTC
gttcagtgtatccctagtgg

SEQ ID NO: 213037 - DNA, 20 bp, Artificial Sequence
  Description of Artificial Sequence: Synthetic oligonucleotide
  Target: ATXN1; (-) strand; PAM type: YTN; PAM sequence: TTA
aaaaatgtagttcgttcagt

SEQ ID NO: 213038 - DNA, 20 bp, Artificial Sequence
  Description of Artificial Sequence: Synthetic oligonucleotide
  Target: ATXN1; (-) strand; PAM type: YTN; PAM sequence: TTG
catagacatacattaaaaaa

SEQ ID NO: 213039 - DNA, 20 bp, Artificial Sequence
  Description of Artificial Sequence: Synthetic oligonucleotide
  Target: ATXN1; (-) strand; PAM type: YTN; PAM sequence: TTA
ttgcatagacatacattaaa

SEQ ID NO: 213040 - DNA, 20 bp, Artificial Sequence
  Description of Artificial Sequence: Synthetic oligonucleotide
  Target: ATXN1; (-) strand; PAM type: YTN; PAM sequence: TTA
atgatggaaaaatcatatac

SEQ ID NO: 213041 - DNA, 20 bp, Artificial Sequence
  Description of Artificial Sequence: Synthetic oligonucleotide
  Target: ATXN1; (-) strand; PAM type: YTN; PAM sequence: CTT
aatgatggaaaaatcatata

SEQ ID NO: 213042 - DNA, 20 bp, Artificial Sequence
  Description of Artificial Sequence: Synthetic oligonucleotide
  Target: ATXN1; (-) strand; PAM type: YTN; PAM sequence: TTC
ttaatgatggaaaaatcata

SEQ ID NO: 213043 - DNA, 20 bp, Artificial Sequence
  Description of Artificial Sequence: Synthetic oligonucleotide
  Target: ATXN1; (-) strand; PAM type: YTN; PAM sequence: TTG
aagattcttaatgatggaaa

SEQ ID NO: 213044 - DNA, 20 bp, Artificial Sequence
  Description of Artificial Sequence: Synthetic oligonucleotide
  Target: ATXN1; (-) strand; PAM type: YTN; PAM sequence: CTG
ttgaagattcttaatgatgg

SEQ ID NO: 213045 - DNA, 20 bp, Artificial Sequence
  Description of Artificial Sequence: Synthetic oligonucleotide
  Target: ATXN1; (-) strand; PAM type: YTN; PAM sequence: CTG
ggactgttgaagattcttaa

SEQ ID NO: 213046 - DNA, 20 bp, Artificial Sequence
  Description of Artificial Sequence: Synthetic oligonucleotide
  Target: ATXN1; (-) strand; PAM type: YTN; PAM sequence: TTG
catctgggactgttgaagat

SEQ ID NO: 213047 - DNA, 20 bp, Artificial Sequence
  Description of Artificial Sequence: Synthetic oligonucleotide
  Target: ATXN1; (-) strand; PAM type: YTN; PAM sequence: CTT
gcatctgggactgttgaaga

SEQ ID NO: 213048 - DNA, 20 bp, Artificial Sequence
  Description of Artificial Sequence: Synthetic oligonucleotide
  Target: ATXN1; (-) strand; PAM type: YTN; PAM sequence: TTC
cttgcatctgggactgttga

SEQ ID NO: 213049 - DNA, 20 bp, Artificial Sequence
  Description of Artificial Sequence: Synthetic oligonucleotide
  Target: ATXN1; (-) strand; PAM type: YTN; PAM sequence: CTT
ccttgcatctgggactgttg

SEQ ID NO: 213050 - DNA, 20 bp, Artificial Sequence
  Description of Artificial Sequence: Synthetic oligonucleotide
  Target: ATXN1; (-) strand; PAM type: YTN; PAM sequence: CTG
tcttccttgcatctgggact

SEQ ID NO: 213051 - DNA, 20 bp, Artificial Sequence
  Description of Artificial Sequence: Synthetic oligonucleotide
  Target: ATXN1; (-) strand; PAM type: YTN; PAM sequence: CTC
caggatggcctgtcttcctt

SEQ ID NO: 213052 - DNA, 20 bp, Artificial Sequence
  Description of Artificial Sequence: Synthetic oligonucleotide
  Target: ATXN1; (-) strand; PAM type: YTN; PAM sequence: CTA
gccccctccaggatggcctg

SEQ ID NO: 213053 - DNA, 20 bp, Artificial Sequence
  Description of Artificial Sequence: Synthetic oligonucleotide
  Target: ATXN1; (-) strand; PAM type: YTN; PAM sequence: CTA
aatccctagccccctccagg

SEQ ID NO: 213054 - DNA, 20 bp, Artificial Sequence
  Description of Artificial Sequence: Synthetic oligonucleotide
  Target: ATXN1; (-) strand; PAM type: YTN; PAM sequence: TTG
taaataataggaatgccatc

SEQ ID NO: 213055 - DNA, 20 bp, Artificial Sequence
  Description of Artificial Sequence: Synthetic oligonucleotide
  Target: ATXN1; (-) strand; PAM type: YTN; PAM sequence: CTT
gtaaataataggaatgccat

SEQ ID NO: 213056 - DNA, 20 bp, Artificial Sequence
  Description of Artificial Sequence: Synthetic oligonucleotide
  Target: ATXN1; (-) strand; PAM type: YTN; PAM sequence: CTC
agcgccttgtaaataatagg

SEQ ID NO: 213057 - DNA, 20 bp, Artificial Sequence
  Description of Artificial Sequence: Synthetic oligonucleotide
  Target: ATXN1; (-) strand; PAM type: YTN; PAM sequence: CTA
actcagcgccttgtaaataa

SEQ ID NO: 213058 - DNA, 20 bp, Artificial Sequence
  Description of Artificial Sequence: Synthetic oligonucleotide
  Target: ATXN1; (-) strand; PAM type: YTN; PAM sequence: CTG
tctaactcagcgccttgtaa

SEQ ID NO: 213059 - DNA, 20 bp, Artificial Sequence
  Description of Artificial Sequence: Synthetic oligonucleotide
  Target: ATXN1; (-) strand; PAM type: YTN; PAM sequence: CTG
agcaggaacaccatggtcac

SEQ ID NO: 213060 - DNA, 20 bp, Artificial Sequence
  Description of Artificial Sequence: Synthetic oligonucleotide
  Target: ATXN1; (-) strand; PAM type: YTN; PAM sequence: TTC
tgagcaggaacaccatggtc

SEQ ID NO: 213061 - DNA, 20 bp, Artificial Sequence
  Description of Artificial Sequence: Synthetic oligonucleotide
  Target: ATXN1; (-) strand; PAM type: YTN; PAM sequence: CTT
ctgagcaggaacaccatggt

SEQ ID NO: 213062 - DNA, 20 bp, Artificial Sequence
  Description of Artificial Sequence: Synthetic oligonucleotide
  Target: ATXN1; (-) strand; PAM type: YTN; PAM sequence: TTG
taagcttctgagcaggaaca

SEQ ID NO: 213063 - DNA, 20 bp, Artificial Sequence
  Description of Artificial Sequence: Synthetic oligonucleotide
  Target: ATXN1; (-) strand; PAM type: YTN; PAM sequence: CTC
caaagcgattgtaagcttct

SEQ ID NO: 213064 - DNA, 20 bp, Artificial Sequence
  Description of Artificial Sequence: Synthetic oligonucleotide
  Target: ATXN1; (-) strand; PAM type: YTN; PAM sequence: CTC
tccaaagcgattgtaagctt

SEQ ID NO: 213065 - DNA, 20 bp, Artificial Sequence
  Description of Artificial Sequence: Synthetic oligonucleotide
  Target: ATXN1; (-) strand; PAM type: YTN; PAM sequence: TTG
cctctccaaagcgattgtaa

SEQ ID NO: 213066 - DNA, 20 bp, Artificial Sequence
  Description of Artificial Sequence: Synthetic oligonucleotide
  Target: ATXN1; (-) strand; PAM type: YTN; PAM sequence: CTT
gcctctccaaagcgattgta

SEQ ID NO: 213067 - DNA, 20 bp, Artificial Sequence
  Description of Artificial Sequence: Synthetic oligonucleotide
  Target: ATXN1; (-) strand; PAM type: YTN; PAM sequence: CTG
tgcatgataaatgccttgcc

SEQ ID NO: 213068 - DNA, 20 bp, Artificial Sequence
  Description of Artificial Sequence: Synthetic oligonucleotide
  Target: ATXN1; (-) strand; PAM type: YTN; PAM sequence: CTC
tgtgcatgataaatgccttg

SEQ ID NO: 213069 - DNA, 20 bp, Artificial Sequence
  Description of Artificial Sequence: Synthetic oligonucleotide
  Target: ATXN1; (-) strand; PAM type: YTN; PAM sequence: CTC
tctgtgcatgataaatgcct

SEQ ID NO: 213070 - DNA, 20 bp, Artificial Sequence
  Description of Artificial Sequence: Synthetic oligonucleotide
  Target: ATXN1; (-) strand; PAM type: YTN; PAM sequence: TTA
tcagctctctgtgcatgata

SEQ ID NO: 213071 - DNA, 20 bp, Artificial Sequence
  Description of Artificial Sequence: Synthetic oligonucleotide
  Target: ATXN1; (-) strand; PAM type: YTN; PAM sequence: CTA
ttatcagctctctgtgcatg

SEQ ID NO: 213072 - DNA, 20 bp, Artificial Sequence
  Description of Artificial Sequence: Synthetic oligonucleotide
  Target: ATXN1; (-) strand; PAM type: YTN; PAM sequence: CTG
ctattatcagctctctgtgc

SEQ ID NO: 213073 - DNA, 20 bp, Artificial Sequence
  Description of Artificial Sequence: Synthetic oligonucleotide
  Target: ATXN1; (-) strand; PAM type: YTN; PAM sequence: TTG
cctgctattatcagctctct

SEQ ID NO: 213074 - DNA, 20 bp, Artificial Sequence
  Description of Artificial Sequence: Synthetic oligonucleotide
  Target: ATXN1; (-) strand; PAM type: YTN; PAM sequence: TTG
aaaaattgcctgctattatc

SEQ ID NO: 213075 - DNA, 20 bp, Artificial Sequence
  Description of Artificial Sequence: Synthetic oligonucleotide
  Target: ATXN1; (-) strand; PAM type: YTN; PAM sequence: CTG
attgaaaaattgcctgctat

SEQ ID NO: 213076 - DNA, 20 bp, Artificial Sequence
  Description of Artificial Sequence: Synthetic oligonucleotide
  Target: ATXN1; (-) strand; PAM type: YTN; PAM sequence: CTG
aataaatgtatgctgattga

SEQ ID NO: 213077 - DNA, 20 bp, Artificial Sequence
  Description of Artificial Sequence: Synthetic oligonucleotide
  Target: ATXN1; (-) strand; PAM type: YTN; PAM sequence: TTG
ctgaataaatgtatgctgat

SEQ ID NO: 213078 - DNA, 20 bp, Artificial Sequence
  Description of Artificial Sequence: Synthetic oligonucleotide
  Target: ATXN1; (-) strand; PAM type: YTN; PAM sequence: TTT
gctgaataaatgtatgctga

SEQ ID NO: 213079 - DNA, 20 bp, Artificial Sequence
  Description of Artificial Sequence: Synthetic oligonucleotide
  Target: ATXN1; (-) strand; PAM type: YTN; PAM sequence: TTC
agtaaatatttgctgaataa

SEQ ID NO: 213080 - DNA, 20 bp, Artificial Sequence
  Description of Artificial Sequence: Synthetic oligonucleotide
  Target: ATXN1; (-) strand; PAM type: YTN; PAM sequence: CTT
cagtaaatatttgctgaata

SEQ ID NO: 213081 - DNA, 20 bp, Artificial Sequence
  Description of Artificial Sequence: Synthetic oligonucleotide
  Target: ATXN1; (-) strand; PAM type: YTN; PAM sequence: TTA
gtaggtcttcagtaaatatt

SEQ ID NO: 213082 - DNA, 20 bp, Artificial Sequence
  Description of Artificial Sequence: Synthetic oligonucleotide
  Target: ATXN1; (-) strand; PAM type: YTN; PAM sequence: TTT
agtaggtcttcagtaaatat

SEQ ID NO: 213083 - DNA, 20 bp, Artificial Sequence
  Description of Artificial Sequence: Synthetic oligonucleotide
  Target: ATXN1; (-) strand; PAM type: YTN; PAM sequence: CTG
gcatttagtaggtcttcagt

SEQ ID NO: 213084 - DNA, 20 bp, Artificial Sequence
  Description of Artificial Sequence: Synthetic oligonucleotide
  Target: ATXN1; (-) strand; PAM type: YTN; PAM sequence: CTG
gcatcgtgcctggcatttag

SEQ ID NO: 213085 - DNA, 20 bp, Artificial Sequence
  Description of Artificial Sequence: Synthetic oligonucleotide
  Target: ATXN1; (-) strand; PAM type: YTN; PAM sequence: CTA
atgtctggcatcgtgcctgg

SEQ ID NO: 213086 - DNA, 20 bp, Artificial Sequence
  Description of Artificial Sequence: Synthetic oligonucleotide
  Target: ATXN1; (-) strand; PAM type: YTN; PAM sequence: TTG
tccctaatgtctggcatcgt

SEQ ID NO: 213087 - DNA, 20 bp, Artificial Sequence
  Description of Artificial Sequence: Synthetic oligonucleotide
  Target: ATXN1; (-) strand; PAM type: YTN; PAM sequence: TTT
gtccctaatgtctggcatcg

SEQ ID NO: 213088 - DNA, 20 bp, Artificial Sequence
  Description of Artificial Sequence: Synthetic oligonucleotide
  Target: ATXN1; (-) strand; PAM type: YTN; PAM sequence: TTT
tgtccctaatgtctggcatc

SEQ ID NO: 213089 - DNA, 20 bp, Artificial Sequence
  Description of Artificial Sequence: Synthetic oligonucleotide
  Target: ATXN1; (-) strand; PAM type: YTN; PAM sequence: TTT
ttgtccctaatgtctggcat

SEQ ID NO: 213090 - DNA, 20 bp, Artificial Sequence
  Description of Artificial Sequence: Synthetic oligonucleotide
  Target: ATXN1; (-) strand; PAM type: YTN; PAM sequence: TTA
gtcatatttttgtccctaat

SEQ ID NO: 213091 - DNA, 20 bp, Artificial Sequence
  Description of Artificial Sequence: Synthetic oligonucleotide
  Target: ATXN1; (-) strand; PAM type: YTN; PAM sequence: CTT
agtcatatttttgtccctaa

SEQ ID NO: 213092 - DNA, 20 bp, Artificial Sequence
  Description of Artificial Sequence: Synthetic oligonucleotide
  Target: ATXN1; (-) strand; PAM type: YTN; PAM sequence: CTG
ggaccacatcttagtcatat

SEQ ID NO: 213093 - DNA, 20 bp, Artificial Sequence
  Description of Artificial Sequence: Synthetic oligonucleotide
  Target: ATXN1; (-) strand; PAM type: YTN; PAM sequence: CTG
ctgggaccacatcttagtca

SEQ ID NO: 213094 - DNA, 20 bp, Artificial Sequence
  Description of Artificial Sequence: Synthetic oligonucleotide
  Target: ATXN1; (-) strand; PAM type: YTN; PAM sequence: CTC
tgctgggaccacatcttagt

SEQ ID NO: 213095 - DNA, 20 bp, Artificial Sequence
  Description of Artificial Sequence: Synthetic oligonucleotide
  Target: ATXN1; (-) strand; PAM type: YTN; PAM sequence: TTC
tctgctgggaccacatctta

SEQ ID NO: 213096 - DNA, 20 bp, Artificial Sequence
  Description of Artificial Sequence: Synthetic oligonucleotide
  Target: ATXN1; (-) strand; PAM type: YTN; PAM sequence: TTT
ctctgctgggaccacatctt

SEQ ID NO: 213097 - DNA, 20 bp, Artificial Sequence
  Description of Artificial Sequence: Synthetic oligonucleotide
  Target: ATXN1; (-) strand; PAM type: YTN; PAM sequence: CTG
tttctctgctgggaccacat

SEQ ID NO: 213098 - DNA, 20 bp, Artificial Sequence
  Description of Artificial Sequence: Synthetic oligonucleotide
  Target: ATXN1; (-) strand; PAM type: YTN; PAM sequence: CTA
tacggaaccccatctgtttc

SEQ ID NO: 213099 - DNA, 20 bp, Artificial Sequence
  Description of Artificial Sequence: Synthetic oligonucleotide
  Target: ATXN1; (-) strand; PAM type: YTN; PAM sequence: TTA
ctatacggaaccccatctgt

SEQ ID NO: 213100 - DNA, 20 bp, Artificial Sequence
  Description of Artificial Sequence: Synthetic oligonucleotide
  Target: ATXN1; (-) strand; PAM type: YTN; PAM sequence: TTG
ataacatggttactatacgg

SEQ ID NO: 213101 - DNA, 20 bp, Artificial Sequence
  Description of Artificial Sequence: Synthetic oligonucleotide
  Target: ATXN1; (-) strand; PAM type: YTN; PAM sequence: CTT
gataacatggttactatacg

SEQ ID NO: 213102 - DNA, 20 bp, Artificial Sequence
  Description of Artificial Sequence: Synthetic oligonucleotide
  Target: ATXN1; (-) strand; PAM type: YTN; PAM sequence: CTC
cttgataacatggttactat

SEQ ID NO: 213103 - DNA, 20 bp, Artificial Sequence
  Description of Artificial Sequence: Synthetic oligonucleotide
  Target: ATXN1; (-) strand; PAM type: YTN; PAM sequence: CTG
atgactccttgataacatgg

SEQ ID NO: 213104 - DNA, 20 bp, Artificial Sequence
  Description of Artificial Sequence: Synthetic oligonucleotide
  Target: ATXN1; (-) strand; PAM type: YTN; PAM sequence: TTC
tgatgactccttgataacat

SEQ ID NO: 213105 - DNA, 20 bp, Artificial Sequence
  Description of Artificial Sequence: Synthetic oligonucleotide
  Target: ATXN1; (-) strand; PAM type: YTN; PAM sequence: CTA
gtagcattctgatgactcct

SEQ ID NO: 213106 - DNA, 20 bp, Artificial Sequence
  Description of Artificial Sequence: Synthetic oligonucleotide
  Target: ATXN1; (-) strand; PAM type: YTN; PAM sequence: TTA
tcatctagtagcattctgat

SEQ ID NO: 213107 - DNA, 20 bp, Artificial Sequence
  Description of Artificial Sequence: Synthetic oligonucleotide
  Target: ATXN1; (-) strand; PAM type: YTN; PAM sequence: TTT
atcatctagtagcattctga

SEQ ID NO: 213108 - DNA, 20 bp, Artificial Sequence
  Description of Artificial Sequence: Synthetic oligonucleotide
  Target: ATXN1; (-) strand; PAM type: YTN; PAM sequence: TTT
tatcatctagtagcattctg

SEQ ID NO: 213109 - DNA, 20 bp, Artificial Sequence
  Description of Artificial Sequence: Synthetic oligonucleotide
  Target: ATXN1; (-) strand; PAM type: YTN; PAM sequence: TTT
ttatcatctagtagcattct

SEQ ID NO: 213110 - DNA, 20 bp, Artificial Sequence
  Description of Artificial Sequence: Synthetic oligonucleotide
  Target: ATXN1; (-) strand; PAM type: YTN; PAM sequence: CTA
tttttatcatctagtagcat

SEQ ID NO: 213111 - DNA, 20 bp, Artificial Sequence
  Description of Artificial Sequence: Synthetic oligonucleotide
  Target: ATXN1; (-) strand; PAM type: YTN; PAM sequence: CTG
ctatttttatcatctagtag

SEQ ID NO: 213112 - DNA, 20 bp, Artificial Sequence
  Description of Artificial Sequence: Synthetic oligonucleotide
  Target: ATXN1; (-) strand; PAM type: YTN; PAM sequence: TTC
gaagaggggaaagctgctat

SEQ ID NO: 213113 - DNA, 20 bp, Artificial Sequence
  Description of Artificial Sequence: Synthetic oligonucleotide
  Target: ATXN1; (-) strand; PAM type: YTN; PAM sequence: TTT
cgaagaggggaaagctgcta

SEQ ID NO: 213114 - DNA, 20 bp, Artificial Sequence
  Description of Artificial Sequence: Synthetic oligonucleotide
  Target: ATXN1; (-) strand; PAM type: YTN; PAM sequence: TTT
tcgaagaggggaaagctgct

SEQ ID NO: 213115 - DNA, 20 bp, Artificial Sequence
  Description of Artificial Sequence: Synthetic oligonucleotide
  Target: ATXN1; (-) strand; PAM type: YTN; PAM sequence: TTT
ttcgaagaggggaaagctgc

SEQ ID NO: 213116 - DNA, 20 bp, Artificial Sequence
  Description of Artificial Sequence: Synthetic oligonucleotide
  Target: ATXN1; (-) strand; PAM type: YTN; PAM sequence: CTG
catttttcgaagaggggaaa

SEQ ID NO: 213117 - DNA, 20 bp, Artificial Sequence
  Description of Artificial Sequence: Synthetic oligonucleotide
  Target: ATXN1; (-) strand; PAM type: YTN; PAM sequence: CTC
tgcatttttcgaagagggga

SEQ ID NO: 213118 - DNA, 20 bp, Artificial Sequence
  Description of Artificial Sequence: Synthetic oligonucleotide
  Target: ATXN1; (-) strand; PAM type: YTN; PAM sequence: TTA
tgtgtactctgcatttttcg

SEQ ID NO: 213119 - DNA, 20 bp, Artificial Sequence
  Description of Artificial Sequence: Synthetic oligonucleotide
  Target: ATXN1; (-) strand; PAM type: YTN; PAM sequence: TTA
gttatgtgtactctgcattt

SEQ ID NO: 213120 - DNA, 20 bp, Artificial Sequence
  Description of Artificial Sequence: Synthetic oligonucleotide
  Target: ATXN1; (-) strand; PAM type: YTN; PAM sequence: CTG
gattagttatgtgtactctg

SEQ ID NO: 213121 - DNA, 20 bp, Artificial Sequence
  Description of Artificial Sequence: Synthetic oligonucleotide
  Target: ATXN1; (-) strand; PAM type: YTN; PAM sequence: CTC
agtgactggattagttatgt

SEQ ID NO: 213122 - DNA, 20 bp, Artificial Sequence
  Description of Artificial Sequence: Synthetic oligonucleotide
  Target: ATXN1; (-) strand; PAM type: YTN; PAM sequence: CTC
actcagtgactggattagtt

SEQ ID NO: 213123 - DNA, 20 bp, Artificial Sequence
  Description of Artificial Sequence: Synthetic oligonucleotide
  Target: ATXN1; (-) strand; PAM type: YTN; PAM sequence: TTG
ccagaatgctcactcagtga

SEQ ID NO: 213124 - DNA, 20 bp, Artificial Sequence
  Description of Artificial Sequence: Synthetic oligonucleotide
  Target: ATXN1; (-) strand; PAM type: YTN; PAM sequence: TTC
attgccagaatgctcactca

SEQ ID NO: 213125 - DNA, 20 bp, Artificial Sequence
  Description of Artificial Sequence: Synthetic oligonucleotide
  Target: ATXN1; (-) strand; PAM type: YTN; PAM sequence: TTT
cattgccagaatgctcactc

SEQ ID NO: 213126 - DNA, 20 bp, Artificial Sequence
  Description of Artificial Sequence: Synthetic oligonucleotide
  Target: ATXN1; (-) strand; PAM type: YTN; PAM sequence: TTT
tcattgccagaatgctcact

SEQ ID NO: 213127 - DNA, 20 bp, Artificial Sequence
  Description of Artificial Sequence: Synthetic oligonucleotide
  Target: ATXN1; (-) strand; PAM type: YTN; PAM sequence: TTT
ttcattgccagaatgctcac

SEQ ID NO: 213128 - DNA, 20 bp, Artificial Sequence
  Description of Artificial Sequence: Synthetic oligonucleotide
  Target: ATXN1; (-) strand; PAM type: YTN; PAM sequence: TTT
tttcattgccagaatgctca

SEQ ID NO: 213129 - DNA, 20 bp, Artificial Sequence
  Description of Artificial Sequence: Synthetic oligonucleotide
  Target: ATXN1; (-) strand; PAM type: YTN; PAM sequence: TTC
caaatatgttttttcattgc

SEQ ID NO: 213130 - DNA, 20 bp, Artificial Sequence
  Description of Artificial Sequence: Synthetic oligonucleotide
  Target: ATXN1; (-) strand; PAM type: YTN; PAM sequence: CTC
attccaaatatgttttttca

SEQ ID NO: 213131 - DNA, 20 bp, Artificial Sequence
  Description of Artificial Sequence: Synthetic oligonucleotide
  Target: ATXN1; (-) strand; PAM type: YTN; PAM sequence: TTC
tcattccaaatatgtttttt

SEQ ID NO: 213132 - DNA, 20 bp, Artificial Sequence
  Description of Artificial Sequence: Synthetic oligonucleotide
  Target: ATXN1; (-) strand; PAM type: YTN; PAM sequence: CTA
ttctcattccaaatatgttt

SEQ ID NO: 213133 - DNA, 20 bp, Artificial Sequence
  Description of Artificial Sequence: Synthetic oligonucleotide
  Target: ATXN1; (-) strand; PAM type: YTN; PAM sequence: CTG
aagatcactattctcattcc

SEQ ID NO: 213134 - DNA, 20 bp, Artificial Sequence
  Description of Artificial Sequence: Synthetic oligonucleotide
  Target: ATXN1; (-) strand; PAM type: YTN; PAM sequence: TTC
tgaagatcactattctcatt

SEQ ID NO: 213135 - DNA, 20 bp, Artificial Sequence
  Description of Artificial Sequence: Synthetic oligonucleotide
  Target: ATXN1; (-) strand; PAM type: YTN; PAM sequence: CTA
gagttctgaagatcactatt

SEQ ID NO: 213136 - DNA, 20 bp, Artificial Sequence
  Description of Artificial Sequence: Synthetic oligonucleotide
  Target: ATXN1; (-) strand; PAM type: YTN; PAM sequence: TTG
gtacctagagttctgaagat

SEQ ID NO: 213137 - DNA, 20 bp, Artificial Sequence
  Description of Artificial Sequence: Synthetic oligonucleotide
  Target: ATXN1; (-) strand; PAM type: YTN; PAM sequence: CTT
ggtacctagagttctgaaga

SEQ ID NO: 213138 - DNA, 20 bp, Artificial Sequence
  Description of Artificial Sequence: Synthetic oligonucleotide
  Target: ATXN1; (-) strand; PAM type: YTN; PAM sequence: CTG
gaatgcttggtacctagagt

SEQ ID NO: 213139 - DNA, 20 bp, Artificial Sequence
  Description of Artificial Sequence: Synthetic oligonucleotide
  Target: ATXN1; (-) strand; PAM type: YTN; PAM sequence: TTA
tgtatctggaatgcttggta

SEQ ID NO: 213140 - DNA, 20 bp, Artificial Sequence
  Description of Artificial Sequence: Synthetic oligonucleotide
  Target: ATXN1; (-) strand; PAM type: YTN; PAM sequence: TTT
atgtatctggaatgcttggt

SEQ ID NO: 213141 - DNA, 20 bp, Artificial Sequence
  Description of Artificial Sequence: Synthetic oligonucleotide
  Target: ATXN1; (-) strand; PAM type: YTN; PAM sequence: CTC
aaggggatcagaacatttat

SEQ ID NO: 213142 - DNA, 20 bp, Artificial Sequence
  Description of Artificial Sequence: Synthetic oligonucleotide
  Target: ATXN1; (-) strand; PAM type: YTN; PAM sequence: TTG
ccactcaaggggatcagaac

SEQ ID NO: 213143 - DNA, 20 bp, Artificial Sequence
  Description of Artificial Sequence: Synthetic oligonucleotide
  Target: ATXN1; (-) strand; PAM type: YTN; PAM sequence: CTC
agtgtcagccggtcaattgc

SEQ ID NO: 213144 - DNA, 20 bp, Artificial Sequence
  Description of Artificial Sequence: Synthetic oligonucleotide
  Target: ATXN1; (-) strand; PAM type: YTN; PAM sequence: TTG
cctcagtgtcagccggtcaa

SEQ ID NO: 213145 - DNA, 20 bp, Artificial Sequence
  Description of Artificial Sequence: Synthetic oligonucleotide
  Target: ATXN1; (-) strand; PAM type: YTN; PAM sequence: TTT
gcctcagtgtcagccggtca

SEQ ID NO: 213146 - DNA, 20 bp, Artificial Sequence
  Description of Artificial Sequence: Synthetic oligonucleotide
  Target: ATXN1; (-) strand; PAM type: YTN; PAM sequence: TTC
catggtggcaagtttgcctc

SEQ ID NO: 213147 - DNA, 20 bp, Artificial Sequence
  Description of Artificial Sequence: Synthetic oligonucleotide
  Target: ATXN1; (-) strand; PAM type: YTN; PAM sequence: CTT
ccatggtggcaagtttgcct

SEQ ID NO: 213148 - DNA, 20 bp, Artificial Sequence
  Description of Artificial Sequence: Synthetic oligonucleotide
  Target: ATXN1; (-) strand; PAM type: YTN; PAM sequence: TTC
acatcttccatggtggcaag

SEQ ID NO: 213149 - DNA, 20 bp, Artificial Sequence
  Description of Artificial Sequence: Synthetic oligonucleotide
  Target: ATXN1; (-) strand; PAM type: YTN; PAM sequence: TTA
attcacatcttccatggtgg

SEQ ID NO: 213150 - DNA, 20 bp, Artificial Sequence
  Description of Artificial Sequence: Synthetic oligonucleotide
  Target: ATXN1; (-) strand; PAM type: YTN; PAM sequence: TTT
aattcacatcttccatggtg

SEQ ID NO: 213151 - DNA, 20 bp, Artificial Sequence
  Description of Artificial Sequence: Synthetic oligonucleotide
  Target: ATXN1; (-) strand; PAM type: YTN; PAM sequence: TTT
taattcacatcttccatggt

SEQ ID NO: 213152 - DNA, 20 bp, Artificial Sequence
  Description of Artificial Sequence: Synthetic oligonucleotide
  Target: ATXN1; (-) strand; PAM type: YTN; PAM sequence: CTC
gttttaattcacatcttcca

SEQ ID NO: 213153 - DNA, 20 bp, Artificial Sequence
  Description of Artificial Sequence: Synthetic oligonucleotide
  Target: ATXN1; (-) strand; PAM type: YTN; PAM sequence: TTA
gtacaatcactcgttttaat

SEQ ID NO: 213154 - DNA, 20 bp, Artificial Sequence
  Description of Artificial Sequence: Synthetic oligonucleotide
  Target: ATXN1; (-) strand; PAM type: YTN; PAM sequence: CTT
agtacaatcactcgttttaa

SEQ ID NO: 213155 - DNA, 20 bp, Artificial Sequence
  Description of Artificial Sequence: Synthetic oligonucleotide
  Target: ATXN1; (-) strand; PAM type: YTN; PAM sequence: CTA
taccttagtacaatcactcg

SEQ ID NO: 213156 - DNA, 20 bp, Artificial Sequence
  Description of Artificial Sequence: Synthetic oligonucleotide
  Target: ATXN1; (-) strand; PAM type: YTN; PAM sequence: TTC
tataccttagtacaatcact

SEQ ID NO: 213157 - DNA, 20 bp, Artificial Sequence
  Description of Artificial Sequence: Synthetic oligonucleotide
  Target: ATXN1; (-) strand; PAM type: YTN; PAM sequence: TTT
ctataccttagtacaatcac

SEQ ID NO: 213158 - DNA, 20 bp, Artificial Sequence
  Description of Artificial Sequence: Synthetic oligonucleotide
  Target: ATXN1; (-) strand; PAM type: YTN; PAM sequence: TTA
tgaaacaggaagtacgagtg

SEQ ID NO: 213159 - DNA, 20 bp, Artificial Sequence
  Description of Artificial Sequence: Synthetic oligonucleotide
  Target: ATXN1; (-) strand; PAM type: YTN; PAM sequence: CTG
ttatgaaacaggaagtacga

SEQ ID NO: 213160 - DNA, 20 bp, Artificial Sequence
  Description of Artificial Sequence: Synthetic oligonucleotide
  Target: ATXN1; (-) strand; PAM type: YTN; PAM sequence: TTG
tgaggactgttatgaaacag

SEQ ID NO: 213161 - DNA, 20 bp, Artificial Sequence
  Description of Artificial Sequence: Synthetic oligonucleotide
  Target: ATXN1; (-) strand; PAM type: YTN; PAM sequence: CTT
gtgaggactgttatgaaaca

SEQ ID NO: 213162 - DNA, 20 bp, Artificial Sequence
  Description of Artificial Sequence: Synthetic oligonucleotide
  Target: ATXN1; (-) strand; PAM type: YTN; PAM sequence: TTA
aaaagggtcttgtgaggact

SEQ ID NO: 213163 - DNA, 20 bp, Artificial Sequence
  Description of Artificial Sequence: Synthetic oligonucleotide
  Target: ATXN1; (-) strand; PAM type: YTN; PAM sequence: TTT
aaaaagggtcttgtgaggac

SEQ ID NO: 213164 - DNA, 20 bp, Artificial Sequence
  Description of Artificial Sequence: Synthetic oligonucleotide
  Target: ATXN1; (-) strand; PAM type: YTN; PAM sequence: CTA
tcaggaaaggcagacattta

SEQ ID NO: 213165 - DNA, 20 bp, Artificial Sequence
  Description of Artificial Sequence: Synthetic oligonucleotide
  Target: ATXN1; (-) strand; PAM type: YTN; PAM sequence: TTG
cagtctatcaggaaaggcag

SEQ ID NO: 213166 - DNA, 20 bp, Artificial Sequence
  Description of Artificial Sequence: Synthetic oligonucleotide
  Target: ATXN1; (-) strand; PAM type: YTN; PAM sequence: TTC
aggttgcagtctatcaggaa

SEQ ID NO: 213167 - DNA, 20 bp, Artificial Sequence
  Description of Artificial Sequence: Synthetic oligonucleotide
  Target: ATXN1; (-) strand; PAM type: YTN; PAM sequence: TTT
caggttgcagtctatcagga

SEQ ID NO: 213168 - DNA, 20 bp, Artificial Sequence
  Description of Artificial Sequence: Synthetic oligonucleotide
  Target: ATXN1; (-) strand; PAM type: YTN; PAM sequence: TTT
tcaggttgcagtctatcagg

SEQ ID NO: 213169 - DNA, 20 bp, Artificial Sequence
  Description of Artificial Sequence: Synthetic oligonucleotide
  Target: ATXN1; (-) strand; PAM type: YTN; PAM sequence: TTT
ttcaggttgcagtctatcag

SEQ ID NO: 213170 - DNA, 20 bp, Artificial Sequence
  Description of Artificial Sequence: Synthetic oligonucleotide
  Target: ATXN1; (-) strand; PAM type: YTN; PAM sequence: TTT
tttcaggttgcagtctatca

SEQ ID NO: 213171 - DNA, 20 bp, Artificial Sequence
  Description of Artificial Sequence: Synthetic oligonucleotide
  Target: ATXN1; (-) strand; PAM type: YTN; PAM sequence: TTT
ttttcaggttgcagtctatc

SEQ ID NO: 213172 - DNA, 20 bp, Artificial Sequence
  Description of Artificial Sequence: Synthetic oligonucleotide
  Target: ATXN1; (-) strand; PAM type: YTN; PAM sequence: CTT
tttttcaggttgcagtctat

SEQ ID NO: 213173 - DNA, 20 bp, Artificial Sequence
  Description of Artificial Sequence: Synthetic oligonucleotide
  Target: ATXN1; (-) strand; PAM type: YTN; PAM sequence: TTC
ctttttttcaggttgcagtc

SEQ ID NO: 213174 - DNA, 20 bp, Artificial Sequence
  Description of Artificial Sequence: Synthetic oligonucleotide
  Target: ATXN1; (-) strand; PAM type: YTN; PAM sequence: CTT
cctttttttcaggttgcagt

SEQ ID NO: 213175 - DNA, 20 bp, Artificial Sequence
  Description of Artificial Sequence: Synthetic oligonucleotide
  Target: ATXN1; (-) strand; PAM type: YTN; PAM sequence: TTC
cttcctttttttcaggttgc

SEQ ID NO: 213176 - DNA, 20 bp, Artificial Sequence
  Description of Artificial Sequence: Synthetic oligonucleotide
  Target: ATXN1; (-) strand; PAM type: YTN; PAM sequence: CTG
taaataaaagagacccagtt

SEQ ID NO: 213177 - DNA, 20 bp, Artificial Sequence
  Description of Artificial Sequence: Synthetic oligonucleotide
  Target: ATXN1; (-) strand; PAM type: YTN; PAM sequence: CTG
gggaaaactgtaaataaaag

SEQ ID NO: 213178 - DNA, 20 bp, Artificial Sequence
  Description of Artificial Sequence: Synthetic oligonucleotide
  Target: ATXN1; (-) strand; PAM type: YTN; PAM sequence: CTA
ggcactggggaaaactgtaa

SEQ ID NO: 213179 - DNA, 20 bp, Artificial Sequence
  Description of Artificial Sequence: Synthetic oligonucleotide
  Target: ATXN1; (-) strand; PAM type: YTN; PAM sequence: TTG
tactaggcactggggaaaac

SEQ ID NO: 213180 - DNA, 20 bp, Artificial Sequence
  Description of Artificial Sequence: Synthetic oligonucleotide
  Target: ATXN1; (-) strand; PAM type: YTN; PAM sequence: CTA
tgtgtcaggcgttgtactag

SEQ ID NO: 213181 - DNA, 20 bp, Artificial Sequence
  Description of Artificial Sequence: Synthetic oligonucleotide
  Target: ATXN1; (-) strand; PAM type: YTN; PAM sequence: TTA
ctatgtgtcaggcgttgtac

SEQ ID NO: 213182 - DNA, 20 bp, Artificial Sequence
  Description of Artificial Sequence: Synthetic oligonucleotide
  Target: ATXN1; (-) strand; PAM type: YTN; PAM sequence: CTT
actatgtgtcaggcgttgta

SEQ ID NO: 213183 - DNA, 20 bp, Artificial Sequence
  Description of Artificial Sequence: Synthetic oligonucleotide
  Target: ATXN1; (-) strand; PAM type: YTN; PAM sequence: TTG
cttactatgtgtcaggcgtt

SEQ ID NO: 213184 - DNA, 20 bp, Artificial Sequence
  Description of Artificial Sequence: Synthetic oligonucleotide
  Target: ATXN1; (-) strand; PAM type: YTN; PAM sequence: TTA
attgcttactatgtgtcagg

SEQ ID NO: 213185 - DNA, 20 bp, Artificial Sequence
  Description of Artificial Sequence: Synthetic oligonucleotide
  Target: ATXN1; (-) strand; PAM type: YTN; PAM sequence: TTT
aattgcttactatgtgtcag

SEQ ID NO: 213186 - DNA, 20 bp, Artificial Sequence
  Description of Artificial Sequence: Synthetic oligonucleotide
  Target: ATXN1; (-) strand; PAM type: YTN; PAM sequence: TTT
taattgcttactatgtgtca

SEQ ID NO: 213187 - DNA, 20 bp, Artificial Sequence
  Description of Artificial Sequence: Synthetic oligonucleotide
  Target: ATXN1; (-) strand; PAM type: YTN; PAM sequence: TTT
ttaattgcttactatgtgtc

SEQ ID NO: 213188 - DNA, 20 bp, Artificial Sequence
  Description of Artificial Sequence: Synthetic oligonucleotide
  Target: ATXN1; (-) strand; PAM type: YTN; PAM sequence: CTA
gtgccataaatgtttttaat

SEQ ID NO: 213189 - DNA, 20 bp, Artificial Sequence
  Description of Artificial Sequence: Synthetic oligonucleotide
  Target: ATXN1; (-) strand; PAM type: YTN; PAM sequence: TTC
tagtgccataaatgttttta

SEQ ID NO: 213190 - DNA, 20 bp, Artificial Sequence
  Description of Artificial Sequence: Synthetic oligonucleotide
  Target: ATXN1; (-) strand; PAM type: YTN; PAM sequence: TTG
aaaattctagtgccataaat

SEQ ID NO: 213191 - DNA, 20 bp, Artificial Sequence
  Description of Artificial Sequence: Synthetic oligonucleotide
  Target: ATXN1; (-) strand; PAM type: YTN; PAM sequence: CTA
attgaaaattctagtgccat

SEQ ID NO: 213192 - DNA, 20 bp, Artificial Sequence
  Description of Artificial Sequence: Synthetic oligonucleotide
  Target: ATXN1; (-) strand; PAM type: YTN; PAM sequence: TTG
caataatatgcagccagcta

SEQ ID NO: 213193 - DNA, 20 bp, Artificial Sequence
  Description of Artificial Sequence: Synthetic oligonucleotide
  Target: ATXN1; (-) strand; PAM type: YTN; PAM sequence: TTT
gcaataatatgcagccagct

SEQ ID NO: 213194 - DNA, 20 bp, Artificial Sequence
  Description of Artificial Sequence: Synthetic oligonucleotide
  Target: ATXN1; (-) strand; PAM type: YTN; PAM sequence: CTT
tgcaataatatgcagccagc

SEQ ID NO: 213195 - DNA, 20 bp, Artificial Sequence
  Description of Artificial Sequence: Synthetic oligonucleotide
  Target: ATXN1; (-) strand; PAM type: YTN; PAM sequence: TTA
actttgcaataatatgcagc

SEQ ID NO: 213196 - DNA, 20 bp, Artificial Sequence
  Description of Artificial Sequence: Synthetic oligonucleotide
  Target: ATXN1; (-) strand; PAM type: YTN; PAM sequence: TTC
agatgttaactttgcaataa

SEQ ID NO: 213197 - DNA, 20 bp, Artificial Sequence
  Description of Artificial Sequence: Synthetic oligonucleotide
  Target: ATXN1; (-) strand; PAM type: YTN; PAM sequence: TTT
cagatgttaactttgcaata

SEQ ID NO: 213198 - DNA, 20 bp, Artificial Sequence
  Description of Artificial Sequence: Synthetic oligonucleotide
  Target: ATXN1; (-) strand; PAM type: YTN; PAM sequence: TTT
tcagatgttaactttgcaat

SEQ ID NO: 213199 - DNA, 20 bp, Artificial Sequence
  Description of Artificial Sequence: Synthetic oligonucleotide
  Target: ATXN1; (-) strand; PAM type: YTN; PAM sequence: CTT
ttcagatgttaactttgcaa

SEQ ID NO: 213200 - DNA, 20 bp, Artificial Sequence
  Description of Artificial Sequence: Synthetic oligonucleotide
  Target: ATXN1; (-) strand; PAM type: YTN; PAM sequence: TTA
atagccttttcagatgttaa

SEQ ID NO: 213201 - DNA, 20 bp, Artificial Sequence
  Description of Artificial Sequence: Synthetic oligonucleotide
  Target: ATXN1; (-) strand; PAM type: YTN; PAM sequence: TTT
aatagccttttcagatgtta

SEQ ID NO: 213202 - DNA, 20 bp, Artificial Sequence
  Description of Artificial Sequence: Synthetic oligonucleotide
  Target: ATXN1; (-) strand; PAM type: YTN; PAM sequence: TTT
taatagccttttcagatgtt

SEQ ID NO: 213203 - DNA, 20 bp, Artificial Sequence
  Description of Artificial Sequence: Synthetic oligonucleotide
  Target: ATXN1; (-) strand; PAM type: YTN; PAM sequence: TTA
catgaccattttaatagcct

SEQ ID NO: 213204 - DNA, 20 bp, Artificial Sequence
  Description of Artificial Sequence: Synthetic oligonucleotide
  Target: ATXN1; (-) strand; PAM type: YTN; PAM sequence: TTT
acatgaccattttaatagcc

SEQ ID NO: 213205 - DNA, 20 bp, Artificial Sequence
  Description of Artificial Sequence: Synthetic oligonucleotide
  Target: ATXN1; (-) strand; PAM type: YTN; PAM sequence: CTT
tacatgaccattttaatagc

SEQ ID NO: 213206 - DNA, 20 bp, Artificial Sequence
  Description of Artificial Sequence: Synthetic oligonucleotide
  Target: ATXN1; (-) strand; PAM type: YTN; PAM sequence: TTA
ccaagtctttacatgaccat

SEQ ID NO: 213207 - DNA, 20 bp, Artificial Sequence
  Description of Artificial Sequence: Synthetic oligonucleotide
  Target: ATXN1; (-) strand; PAM type: YTN; PAM sequence: TTG
gttaccaagtctttacatga

SEQ ID NO: 213208 - DNA, 20 bp, Artificial Sequence
  Description of Artificial Sequence: Synthetic oligonucleotide
  Target: ATXN1; (-) strand; PAM type: YTN; PAM sequence: TTA
tattggttaccaagtcttta

SEQ ID NO: 213209 - DNA, 20 bp, Artificial Sequence
  Description of Artificial Sequence: Synthetic oligonucleotide
  Target: ATXN1; (-) strand; PAM type: YTN; PAM sequence: CTA
gattatattggttaccaagt

SEQ ID NO: 213210 - DNA, 20 bp, Artificial Sequence
  Description of Artificial Sequence: Synthetic oligonucleotide
  Target: ATXN1; (-) strand; PAM type: YTN; PAM sequence: TTA
aactagattatattggttac

SEQ ID NO: 213211 - DNA, 20 bp, Artificial Sequence
  Description of Artificial Sequence: Synthetic oligonucleotide
  Target: ATXN1; (-) strand; PAM type: YTN; PAM sequence: TTA
ttaaactagattatattggt

SEQ ID NO: 213212 - DNA, 20 bp, Artificial Sequence
  Description of Artificial Sequence: Synthetic oligonucleotide
  Target: ATXN1; (-) strand; PAM type: YTN; PAM sequence: CTC
aaaaacaagaaataaagtaa

SEQ ID NO: 213213 - DNA, 20 bp, Artificial Sequence
  Description of Artificial Sequence: Synthetic oligonucleotide
  Target: ATXN1; (-) strand; PAM type: YTN; PAM sequence: CTG
actcaaaaacaagaaataaa

SEQ ID NO: 213214 - DNA, 20 bp, Artificial Sequence
  Description of Artificial Sequence: Synthetic oligonucleotide
  Target: ATXN1; (-) strand; PAM type: YTN; PAM sequence: CTG
ggcaacagaggaagaccctg

SEQ ID NO: 213215 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcaacagaggaa

SEQ ID NO: 213216 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcaacag

SEQ ID NO: 213217 - DNA, 20 bp, Artificial Sequence
  Description of Artificial Sequence: Synthetic oligonucleotide
  Target: ATXN1; (-) strand; PAM type: YTN; PAM sequence: CTA
agatcacatgcaccactgca

SEQ ID NO: 213218 - DNA, 20 bp, Artificial Sequence
  Description of Artificial Sequence: Synthetic oligonucleotide
  Target: ATXN1; (-) strand; PAM type: YTN; PAM sequence: TTG
cagtgagctaagatcacatg

SEQ ID NO: 213219 - DNA, 20 bp, Artificial Sequence
  Description of Artificial Sequence: Synthetic oligonucleotide
  Target: ATXN1; (-) strand; PAM type: YTN; PAM sequence: CTG
ggaggcagagaggttgcagt

SEQ ID NO: 213220 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggcagagaggt

SEQ ID NO: 213221 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggcagagagg

SEQ ID NO: 213222 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcacttgaa

SEQ ID NO: 213223 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagaat

SEQ ID NO: 213224 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagaa

SEQ ID NO: 213225 - DNA, 20 bp, Artificial Sequence
  Description of Artificial Sequence: Synthetic oligonucleotide
  Target: ATXN1; (-) strand; PAM type: YTN; PAM sequence: CTG
cttgggaggctgaggcagga

SEQ ID NO: 213226 - DNA, 20 bp, Artificial Sequence
  Description of Artificial Sequence: Synthetic oligonucleotide
  Target: ATXN1; (-) strand; PAM type: YTN; PAM sequence: CTG
taatcccagctgcttgggag

SEQ ID NO: 213227 - DNA, 20 bp, Artificial Sequence
  Description of Artificial Sequence: Synthetic oligonucleotide
  Target: ATXN1; (-) strand; PAM type: YTN; PAM sequence: CTG
ggcatggtggtgcgtgcctg

SEQ ID NO: 213228 - DNA, 20 bp, Artificial Sequence
  Description of Artificial Sequence: Synthetic oligonucleotide
  Target: ATXN1; (-) strand; PAM type: YTN; PAM sequence: TTA
gctgggcatggtggtgcgtg

SEQ ID NO: 213229 - DNA, 20 bp, Artificial Sequence
  Description of Artificial Sequence: Synthetic oligonucleotide
  Target: ATXN1; (-) strand; PAM type: YTN; PAM sequence: CTA
aaaaaacaaaaattagctgg

SEQ ID NO: 213230 - DNA, 20 bp, Artificial Sequence
  Description of Artificial Sequence: Synthetic oligonucleotide
  Target: ATXN1; (-) strand; PAM type: YTN; PAM sequence: CTA
ctaaaaaaacaaaaattagc

SEQ ID NO: 213231 - DNA, 20 bp, Artificial Sequence
  Description of Artificial Sequence: Synthetic oligonucleotide
  Target: ATXN1; (-) strand; PAM type: YTN; PAM sequence: CTC
tactaaaaaaacaaaaatta

SEQ ID NO: 213232 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaaccccg

SEQ ID NO: 213233 - DNA, 20 bp, Artificial Sequence
  Description of Artificial Sequence: Synthetic oligonucleotide
  Target: ATXN1; (-) strand; PAM type: YTN; PAM sequence: TTC
gtgaacagcctggccaacat

SEQ ID NO: 213234 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcgtgaaca

SEQ ID NO: 213235 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggtgggtgggc

SEQ ID NO: 213236 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggtgggtggg

SEQ ID NO: 213237 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggtgggtgg

SEQ ID NO: 213238 - DNA, 20 bp, Artificial Sequence
  Description of Artificial Sequence: Synthetic oligonucleotide
  Target: ATXN1; (-) strand; PAM type: YTN; PAM sequence: CTC
agtactttgggaggccgagg

SEQ ID NO: 213239 - DNA, 20 bp, Artificial Sequence
  Description of Artificial Sequence: Synthetic oligonucleotide
  Target: ATXN1; (-) strand; PAM type: YTN; PAM sequence: CTG
taatctcagtactttgggag

SEQ ID NO: 213240 - DNA, 20 bp, Artificial Sequence
  Description of Artificial Sequence: Synthetic oligonucleotide
  Target: ATXN1; (-) strand; PAM type: YTN; PAM sequence: CTC
atgcctgtaatctcagtact

SEQ ID NO: 213241 - DNA, 20 bp, Artificial Sequence
  Description of Artificial Sequence: Synthetic oligonucleotide
  Target: ATXN1; (-) strand; PAM type: YTN; PAM sequence: CTG
ggcgcagtggctcatgcctg

SEQ ID NO: 213242 - DNA, 20 bp, Artificial Sequence
  Description of Artificial Sequence: Synthetic oligonucleotide
  Target: ATXN1; (-) strand; PAM type: YTN; PAM sequence: TTA
aaccagctgggcgcagtggc

SEQ ID NO: 213243 - DNA, 20 bp, Artificial Sequence
  Description of Artificial Sequence: Synthetic oligonucleotide
  Target: ATXN1; (-) strand; PAM type: YTN; PAM sequence: TTA
agtatgattaaaccagctgg

SEQ ID NO: 213244 - DNA, 20 bp, Artificial Sequence
  Description of Artificial Sequence: Synthetic oligonucleotide
  Target: ATXN1; (-) strand; PAM type: YTN; PAM sequence: TTG
attaagtatgattaaaccag

SEQ ID NO: 213245 - DNA, 20 bp, Artificial Sequence
  Description of Artificial Sequence: Synthetic oligonucleotide
  Target: ATXN1; (-) strand; PAM type: YTN; PAM sequence: TTA
gttgattaagtatgattaaa

SEQ ID NO: 213246 - DNA, 20 bp, Artificial Sequence
  Description of Artificial Sequence: Synthetic oligonucleotide
  Target: ATXN1; (-) strand; PAM type: YTN; PAM sequence: TTC
attagttgattaagtatgat

SEQ ID NO: 213247 - DNA, 20 bp, Artificial Sequence
  Description of Artificial Sequence: Synthetic oligonucleotide
  Target: ATXN1; (-) strand; PAM type: YTN; PAM sequence: TTG
attcattagttgattaagta

SEQ ID NO: 213248 - DNA, 20 bp, Artificial Sequence
  Description of Artificial Sequence: Synthetic oligonucleotide
  Target: ATXN1; (-) strand; PAM type: YTN; PAM sequence: CTT
gattcattagttgattaagt

SEQ ID NO: 213249 - DNA, 20 bp, Artificial Sequence
  Description of Artificial Sequence: Synthetic oligonucleotide
  Target: ATXN1; (-) strand; PAM type: YTN; PAM sequence: TTA
acttgattcattagttgatt

SEQ ID NO: 213250 - DNA, 20 bp, Artificial Sequence
  Description of Artificial Sequence: Synthetic oligonucleotide
  Target: ATXN1; (-) strand; PAM type: YTN; PAM sequence: TTC
agccagtaacagtatccata

SEQ ID NO: 213251 - DNA, 20 bp, Artificial Sequence
  Description of Artificial Sequence: Synthetic oligonucleotide
  Target: ATXN1; (-) strand; PAM type: YTN; PAM sequence: TTG
tggggggaaaaaattcagcc

SEQ ID NO: 213252 - DNA, 20 bp, Artificial Sequence
  Description of Artificial Sequence: Synthetic oligonucleotide
  Target: ATXN1; (-) strand; PAM type: YTN; PAM sequence: TTG
agtggttgtggggggaaaaa

SEQ ID NO: 213253 - DNA, 20 bp, Artificial Sequence
  Description of Artificial Sequence: Synthetic oligonucleotide
  Target: ATXN1; (-) strand; PAM type: YTN; PAM sequence: TTT
gagtggttgtggggggaaaa

SEQ ID NO: 213254 - DNA, 20 bp, Artificial Sequence
  Description of Artificial Sequence: Synthetic oligonucleotide
  Target: ATXN1; (-) strand; PAM type: YTN; PAM sequence: TTT
tgagtggttgtggggggaaa

SEQ ID NO: 213255 - DNA, 20 bp, Artificial Sequence
  Description of Artificial Sequence: Synthetic oligonucleotide
  Target: ATXN1; (-) strand; PAM type: YTN; PAM sequence: TTC
aacacatgaattttgagtgg

SEQ ID NO: 213256 - DNA, 20 bp, Artificial Sequence
  Description of Artificial Sequence: Synthetic oligonucleotide
  Target: ATXN1; (-) strand; PAM type: YTN; PAM sequence: CTT
caacacatgaattttgagtg

SEQ ID NO: 213257 - DNA, 20 bp, Artificial Sequence
  Description of Artificial Sequence: Synthetic oligonucleotide
  Target: ATXN1; (-) strand; PAM type: YTN; PAM sequence: TTA
gggcttcaacacatgaattt

SEQ ID NO: 213258 - DNA, 20 bp, Artificial Sequence
  Description of Artificial Sequence: Synthetic oligonucleotide
  Target: ATXN1; (-) strand; PAM type: YTN; PAM sequence: CTG
gaagttagggcttcaacaca

SEQ ID NO: 213259 - DNA, 20 bp, Artificial Sequence
  Description of Artificial Sequence: Synthetic oligonucleotide
  Target: ATXN1; (-) strand; PAM type: YTN; PAM sequence: CTG
agaaactggaagttagggct

SEQ ID NO: 213260 - DNA, 20 bp, Artificial Sequence
  Description of Artificial Sequence: Synthetic oligonucleotide
  Target: ATXN1; (-) strand; PAM type: YTN; PAM sequence: TTC
tgagaaactggaagttaggg

SEQ ID NO: 213261 - DNA, 20 bp, Artificial Sequence
  Description of Artificial Sequence: Synthetic oligonucleotide
  Target: ATXN1; (-) strand; PAM type: YTN; PAM sequence: TTA
tattctgagaaactggaagt

SEQ ID NO: 213262 - DNA, 20 bp, Artificial Sequence
  Description of Artificial Sequence: Synthetic oligonucleotide
  Target: ATXN1; (-) strand; PAM type: YTN; PAM sequence: TTC
caaatacagttatattctga

SEQ ID NO: 213263 - DNA, 20 bp, Artificial Sequence
  Description of Artificial Sequence: Synthetic oligonucleotide
  Target: ATXN1; (-) strand; PAM type: YTN; PAM sequence: TTT
ccaaatacagttatattctg

SEQ ID NO: 213264 - DNA, 20 bp, Artificial Sequence
  Description of Artificial Sequence: Synthetic oligonucleotide
  Target: ATXN1; (-) strand; PAM type: YTN; PAM sequence: CTC
aaaaggtccaatttccaaat

SEQ ID NO: 213265 - DNA, 20 bp, Artificial Sequence
  Description of Artificial Sequence: Synthetic oligonucleotide
  Target: ATXN1; (-) strand; PAM type: YTN; PAM sequence: CTC
tcaaaaggtccaatttccaa

SEQ ID NO: 213266 - DNA, 20 bp, Artificial Sequence
  Description of Artificial Sequence: Synthetic oligonucleotide
  Target: ATXN1; (-) strand; PAM type: YTN; PAM sequence: TTA
cctctcaaaaggtccaattt

SEQ ID NO: 213267 - DNA, 20 bp, Artificial Sequence
  Description of Artificial Sequence: Synthetic oligonucleotide
  Target: ATXN1; (-) strand; PAM type: YTN; PAM sequence: TTA
attacctctcaaaaggtcca

SEQ ID NO: 213268 - DNA, 20 bp, Artificial Sequence
  Description of Artificial Sequence: Synthetic oligonucleotide
  Target: ATXN1; (-) strand; PAM type: YTN; PAM sequence: TTT
aattacctctcaaaaggtcc

SEQ ID NO: 213269 - DNA, 20 bp, Artificial Sequence
  Description of Artificial Sequence: Synthetic oligonucleotide
  Target: ATXN1; (-) strand; PAM type: YTN; PAM sequence: TTT
taattacctctcaaaaggtc

SEQ ID NO: 213270 - DNA, 20 bp, Artificial Sequence
  Description of Artificial Sequence: Synthetic oligonucleotide
  Target: ATXN1; (-) strand; PAM type: YTN; PAM sequence: TTG
ttttaattacctctcaaaag

SEQ ID NO: 213271 - DNA, 20 bp, Artificial Sequence
  Description of Artificial Sequence: Synthetic oligonucleotide
  Target: ATXN1; (-) strand; PAM type: YTN; PAM sequence: TTT
gttttaattacctctcaaaa

SEQ ID NO: 213272 - DNA, 20 bp, Artificial Sequence
  Description of Artificial Sequence: Synthetic oligonucleotide
  Target: ATXN1; (-) strand; PAM type: YTN; PAM sequence: TTT
tgttttaattacctctcaaa

SEQ ID NO: 213273 - DNA, 20 bp, Artificial Sequence
  Description of Artificial Sequence: Synthetic oligonucleotide
  Target: ATXN1; (-) strand; PAM type: YTN; PAM sequence: TTA
ttttgttttaattacctctc

SEQ ID NO: 213274 - DNA, 20 bp, Artificial Sequence
  Description of Artificial Sequence: Synthetic oligonucleotide
  Target: ATXN1; (-) strand; PAM type: YTN; PAM sequence: CTT
attttgttttaattacctct

SEQ ID NO: 213275 - DNA, 20 bp, Artificial Sequence
  Description of Artificial Sequence: Synthetic oligonucleotide
  Target: ATXN1; (-) strand; PAM type: YTN; PAM sequence: TTC
atatgaccttattttgtttt

SEQ ID NO: 213276 - DNA, 20 bp, Artificial Sequence
  Description of Artificial Sequence: Synthetic oligonucleotide
  Target: ATXN1; (-) strand; PAM type: YTN; PAM sequence: TTT
catatgaccttattttgttt

SEQ ID NO: 213277 - DNA, 20 bp, Artificial Sequence
  Description of Artificial Sequence: Synthetic oligonucleotide
  Target: ATXN1; (-) strand; PAM type: YTN; PAM sequence: CTT
tcatatgaccttattttgtt

SEQ ID NO: 213278 - DNA, 20 bp, Artificial Sequence
  Description of Artificial Sequence: Synthetic oligonucleotide
  Target: ATXN1; (-) strand; PAM type: YTN; PAM sequence: TTA
caaggacaccagtcatagtg

SEQ ID NO: 213279 - DNA, 20 bp, Artificial Sequence
  Description of Artificial Sequence: Synthetic oligonucleotide
  Target: ATXN1; (-) strand; PAM type: YTN; PAM sequence: CTG
ttacaaggacaccagtcata

SEQ ID NO: 213280 - DNA, 20 bp, Artificial Sequence
  Description of Artificial Sequence: Synthetic oligonucleotide
  Target: ATXN1; (-) strand; PAM type: YTN; PAM sequence: CTC
ctgttacaaggacaccagtc

SEQ ID NO: 213281 - DNA, 20 bp, Artificial Sequence
  Description of Artificial Sequence: Synthetic oligonucleotide
  Target: ATXN1; (-) strand; PAM type: YTN; PAM sequence: CTG
tgtcccagtctcctgttaca

SEQ ID NO: 213282 - DNA, 20 bp, Artificial Sequence
  Description of Artificial Sequence: Synthetic oligonucleotide
  Target: ATXN1; (-) strand; PAM type: YTN; PAM sequence: CTC
caagtctgtgtcccagtctc

SEQ ID NO: 213283 - DNA, 20 bp, Artificial Sequence
  Description of Artificial Sequence: Synthetic oligonucleotide
  Target: ATXN1; (-) strand; PAM type: YTN; PAM sequence: TTC
cctccaagtctgtgtcccag

SEQ ID NO: 213284 - DNA, 20 bp, Artificial Sequence
  Description of Artificial Sequence: Synthetic oligonucleotide
  Target: ATXN1; (-) strand; PAM type: YTN; PAM sequence: CTT
ccctccaagtctgtgtccca

SEQ ID NO: 213285 - DNA, 20 bp, Artificial Sequence
  Description of Artificial Sequence: Synthetic oligonucleotide
  Target: ATXN1; (-) strand; PAM type: YTN; PAM sequence: CTC
gtgggcttccctccaagtct

SEQ ID NO: 213286 - DNA, 20 bp, Artificial Sequence
  Description of Artificial Sequence: Synthetic oligonucleotide
  Target: ATXN1; (-) strand; PAM type: YTN; PAM sequence: CTC
tcgtgggcttccctccaagt

SEQ ID NO: 213287 - DNA, 20 bp, Artificial Sequence
  Description of Artificial Sequence: Synthetic oligonucleotide
  Target: ATXN1; (-) strand; PAM type: YTN; PAM sequence: CTG
tgtcctctcgtgggcttccc

SEQ ID NO: 213288 - DNA, 20 bp, Artificial Sequence
  Description of Artificial Sequence: Synthetic oligonucleotide
  Target: ATXN1; (-) strand; PAM type: YTN; PAM sequence: TTC
cccctgtgtcctctcgtggg

SEQ ID NO: 213289 - DNA, 20 bp, Artificial Sequence
  Description of Artificial Sequence: Synthetic oligonucleotide
  Target: ATXN1; (-) strand; PAM type: YTN; PAM sequence: CTT
ccccctgtgtcctctcgtgg

SEQ ID NO: 213290 - DNA, 20 bp, Artificial Sequence
  Description of Artificial Sequence: Synthetic oligonucleotide
  Target: ATXN1; (-) strand; PAM type: YTN; PAM sequence: TTG
cagatggccatcttccccct

SEQ ID NO: 213291 - DNA, 20 bp, Artificial Sequence
  Description of Artificial Sequence: Synthetic oligonucleotide
  Target: ATXN1; (-) strand; PAM type: YTN; PAM sequence: CTT
gcagatggccatcttccccc

SEQ ID NO: 213292 - DNA, 20 bp, Artificial Sequence
  Description of Artificial Sequence: Synthetic oligonucleotide
  Target: ATXN1; (-) strand; PAM type: YTN; PAM sequence: TTG
gcttgcagatggccatcttc

SEQ ID NO: 213293 - DNA, 20 bp, Artificial Sequence
  Description of Artificial Sequence: Synthetic oligonucleotide
  Target: ATXN1; (-) strand; PAM type: YTN; PAM sequence: CTT
ggcttgcagatggccatctt

SEQ ID NO: 213294 - DNA, 20 bp, Artificial Sequence
  Description of Artificial Sequence: Synthetic oligonucleotide
  Target: ATXN1; (-) strand; PAM type: YTN; PAM sequence: CTC
cttggcttgcagatggccat

SEQ ID NO: 213295 - DNA, 20 bp, Artificial Sequence
  Description of Artificial Sequence: Synthetic oligonucleotide
  Target: ATXN1; (-) strand; PAM type: YTN; PAM sequence: TTC
tccttggcttgcagatggcc

SEQ ID NO: 213296 - DNA, 20 bp, Artificial Sequence
  Description of Artificial Sequence: Synthetic oligonucleotide
  Target: ATXN1; (-) strand; PAM type: YTN; PAM sequence: CTT
ctccttggcttgcagatggc

SEQ ID NO: 213297 - DNA, 20 bp, Artificial Sequence
  Description of Artificial Sequence: Synthetic oligonucleotide
  Target: ATXN1; (-) strand; PAM type: YTN; PAM sequence: CTG
aagtccttctccttggcttg

SEQ ID NO: 213298 - DNA, 20 bp, Artificial Sequence
  Description of Artificial Sequence: Synthetic oligonucleotide
  Target: ATXN1; (-) strand; PAM type: YTN; PAM sequence: TTC
tgaagtccttctccttggct

SEQ ID NO: 213299 - DNA, 20 bp, Artificial Sequence
  Description of Artificial Sequence: Synthetic oligonucleotide
  Target: ATXN1; (-) strand; PAM type: YTN; PAM sequence: CTT
ctgaagtccttctccttggc

SEQ ID NO: 213300 - DNA, 20 bp, Artificial Sequence
  Description of Artificial Sequence: Synthetic oligonucleotide
  Target: ATXN1; (-) strand; PAM type: YTN; PAM sequence: TTC
cttctgaagtccttctcctt

SEQ ID NO: 213301 - DNA, 20 bp, Artificial Sequence
  Description of Artificial Sequence: Synthetic oligonucleotide
  Target: ATXN1; (-) strand; PAM type: YTN; PAM sequence: TTG
gttccttctgaagtccttct

SEQ ID NO: 213302 - DNA, 20 bp, Artificial Sequence
  Description of Artificial Sequence: Synthetic oligonucleotide
  Target: ATXN1; (-) strand; PAM type: YTN; PAM sequence: TTG
aaatgaaagtgtcaggaaag

SEQ ID NO: 213303 - DNA, 20 bp, Artificial Sequence
  Description of Artificial Sequence: Synthetic oligonucleotide
  Target: ATXN1; (-) strand; PAM type: YTN; PAM sequence: TTT
gaaatgaaagtgtcaggaaa

SEQ ID NO: 213304 - DNA, 20 bp, Artificial Sequence
  Description of Artificial Sequence: Synthetic oligonucleotide
  Target: ATXN1; (-) strand; PAM type: YTN; PAM sequence: CTA
gagacagtaagtttgaaatg

SEQ ID NO: 213305 - DNA, 20 bp, Artificial Sequence
  Description of Artificial Sequence: Synthetic oligonucleotide
  Target: ATXN1; (-) strand; PAM type: YTN; PAM sequence: TTC
tagagacagtaagtttgaaa

SEQ ID NO: 213306 - DNA, 20 bp, Artificial Sequence
  Description of Artificial Sequence: Synthetic oligonucleotide
  Target: ATXN1; (-) strand; PAM type: YTN; PAM sequence: TTA
tgattctagagacagtaagt

SEQ ID NO: 213307 - DNA, 20 bp, Artificial Sequence
  Description of Artificial Sequence: Synthetic oligonucleotide
  Target: ATXN1; (-) strand; PAM type: YTN; PAM sequence: CTT
atgattctagagacagtaag

SEQ ID NO: 213308 - DNA, 20 bp, Artificial Sequence
  Description of Artificial Sequence: Synthetic oligonucleotide
  Target: ATXN1; (-) strand; PAM type: YTN; PAM sequence: TTC
ttatgattctagagacagta

SEQ ID NO: 213309 - DNA, 20 bp, Artificial Sequence
  Description of Artificial Sequence: Synthetic oligonucleotide
  Target: ATXN1; (-) strand; PAM type: YTN; PAM sequence: TTT
cttatgattctagagacagt

SEQ ID NO: 213310 - DNA, 20 bp, Artificial Sequence
  Description of Artificial Sequence: Synthetic oligonucleotide
  Target: ATXN1; (-) strand; PAM type: YTN; PAM sequence: TTT
tcttatgattctagagacag

SEQ ID NO: 213311 - DNA, 20 bp, Artificial Sequence
  Description of Artificial Sequence: Synthetic oligonucleotide
  Target: ATXN1; (-) strand; PAM type: YTN; PAM sequence: TTA
ttttcttatgattctagaga

SEQ ID NO: 213312 - DNA, 20 bp, Artificial Sequence
  Description of Artificial Sequence: Synthetic oligonucleotide
  Target: ATXN1; (-) strand; PAM type: YTN; PAM sequence: CTT
attttcttatgattctagag

SEQ ID NO: 213313 - DNA, 20 bp, Artificial Sequence
  Description of Artificial Sequence: Synthetic oligonucleotide
  Target: ATXN1; (-) strand; PAM type: YTN; PAM sequence: TTA
aacagcacaaacttattttc

SEQ ID NO: 213314 - DNA, 20 bp, Artificial Sequence
  Description of Artificial Sequence: Synthetic oligonucleotide
  Target: ATXN1; (-) strand; PAM type: YTN; PAM sequence: CTT
aaacagcacaaacttatttt

SEQ ID NO: 213315 - DNA, 20 bp, Artificial Sequence
  Description of Artificial Sequence: Synthetic oligonucleotide
  Target: ATXN1; (-) strand; PAM type: YTN; PAM sequence: CTG
agtggcttaaacagcacaaa

SEQ ID NO: 213316 - DNA, 20 bp, Artificial Sequence
  Description of Artificial Sequence: Synthetic oligonucleotide
  Target: ATXN1; (-) strand; PAM type: YTN; PAM sequence: CTA
ccataacaaagtaacccaga

SEQ ID NO: 213317 - DNA, 20 bp, Artificial Sequence
  Description of Artificial Sequence: Synthetic oligonucleotide
  Target: ATXN1; (-) strand; PAM type: YTN; PAM sequence: TTG
cgaggtctaccataacaaag

SEQ ID NO: 213318 - DNA, 20 bp, Artificial Sequence
  Description of Artificial Sequence: Synthetic oligonucleotide
  Target: ATXN1; (-) strand; PAM type: YTN; PAM sequence: TTT
gcgaggtctaccataacaaa

SEQ ID NO: 213319 - DNA, 20 bp, Artificial Sequence
  Description of Artificial Sequence: Synthetic oligonucleotide
  Target: ATXN1; (-) strand; PAM type: YTN; PAM sequence: CTG
tcagtttgcgaggtctacca

SEQ ID NO: 213320 - DNA, 20 bp, Artificial Sequence
  Description of Artificial Sequence: Synthetic oligonucleotide
  Target: ATXN1; (-) strand; PAM type: YTN; PAM sequence: TTA
gtatctgtcagtttgcgagg

SEQ ID NO: 213321 - DNA, 20 bp, Artificial Sequence
  Description of Artificial Sequence: Synthetic oligonucleotide
  Target: ATXN1; (-) strand; PAM type: YTN; PAM sequence: CTT
agtatctgtcagtttgcgag

SEQ ID NO: 213322 - DNA, 20 bp, Artificial Sequence
  Description of Artificial Sequence: Synthetic oligonucleotide
  Target: ATXN1; (-) strand; PAM type: YTN; PAM sequence: CTC
aaacaagggcttagtatctg

SEQ ID NO: 213323 - DNA, 20 bp, Artificial Sequence
  Description of Artificial Sequence: Synthetic oligonucleotide
  Target: ATXN1; (-) strand; PAM type: YTN; PAM sequence: CTC
catctcaaacaagggcttag

SEQ ID NO: 213324 - DNA, 20 bp, Artificial Sequence
  Description of Artificial Sequence: Synthetic oligonucleotide
  Target: ATXN1; (-) strand; PAM type: YTN; PAM sequence: TTA
tagggccacagctccatctc

SEQ ID NO: 213325 - DNA, 20 bp, Artificial Sequence
  Description of Artificial Sequence: Synthetic oligonucleotide
  Target: ATXN1; (-) strand; PAM type: YTN; PAM sequence: TTT
atagggccacagctccatct

SEQ ID NO: 213326 - DNA, 20 bp, Artificial Sequence
  Description of Artificial Sequence: Synthetic oligonucleotide
  Target: ATXN1; (-) strand; PAM type: YTN; PAM sequence: CTA
aaatagccatttatagggcc

SEQ ID NO: 213327 - DNA, 20 bp, Artificial Sequence
  Description of Artificial Sequence: Synthetic oligonucleotide
  Target: ATXN1; (-) strand; PAM type: YTN; PAM sequence: TTC
taaaatagccatttataggg

SEQ ID NO: 213328 - DNA, 20 bp, Artificial Sequence
  Description of Artificial Sequence: Synthetic oligonucleotide
  Target: ATXN1; (-) strand; PAM type: YTN; PAM sequence: TTT
ctaaaatagccatttatagg

SEQ ID NO: 213329 - DNA, 20 bp, Artificial Sequence
  Description of Artificial Sequence: Synthetic oligonucleotide
  Target: ATXN1; (-) strand; PAM type: YTN; PAM sequence: CTT
tctaaaatagccatttatag

SEQ ID NO: 213330 - DNA, 20 bp, Artificial Sequence
  Description of Artificial Sequence: Synthetic oligonucleotide
  Target: ATXN1; (-) strand; PAM type: YTN; PAM sequence: TTG
tctttctaaaatagccattt

SEQ ID NO: 213331 - DNA, 20 bp, Artificial Sequence
  Description of Artificial Sequence: Synthetic oligonucleotide
  Target: ATXN1; (-) strand; PAM type: YTN; PAM sequence: TTC
acattgtctttctaaaatag

SEQ ID NO: 213332 - DNA, 20 bp, Artificial Sequence
  Description of Artificial Sequence: Synthetic oligonucleotide
  Target: ATXN1; (-) strand; PAM type: YTN; PAM sequence: CTG
ccagttcacattgtctttct

SEQ ID NO: 213333 - DNA, 20 bp, Artificial Sequence
  Description of Artificial Sequence: Synthetic oligonucleotide
  Target: ATXN1; (-) strand; PAM type: YTN; PAM sequence: TTG
ctgccagttcacattgtctt

SEQ ID NO: 213334 - DNA, 20 bp, Artificial Sequence
  Description of Artificial Sequence: Synthetic oligonucleotide
  Target: ATXN1; (-) strand; PAM type: YTN; PAM sequence: TTC
cagtaccgttgctgccagtt

SEQ ID NO: 213335 - DNA, 20 bp, Artificial Sequence
  Description of Artificial Sequence: Synthetic oligonucleotide
  Target: ATXN1; (-) strand; PAM type: YTN; PAM sequence: CTG
ttccagtaccgttgctgcca

SEQ ID NO: 213336 - DNA, 20 bp, Artificial Sequence
  Description of Artificial Sequence: Synthetic oligonucleotide
  Target: ATXN1; (-) strand; PAM type: YTN; PAM sequence: TTC
ctgttccagtaccgttgctg

SEQ ID NO: 213337 - DNA, 20 bp, Artificial Sequence
  Description of Artificial Sequence: Synthetic oligonucleotide
  Target: ATXN1; (-) strand; PAM type: YTN; PAM sequence: CTC
attcctgttccagtaccgtt

SEQ ID NO: 213338 - DNA, 20 bp, Artificial Sequence
  Description of Artificial Sequence: Synthetic oligonucleotide
  Target: ATXN1; (-) strand; PAM type: YTN; PAM sequence: CTC
ctcattcctgttccagtacc

SEQ ID NO: 213339 - DNA, 20 bp, Artificial Sequence
  Description of Artificial Sequence: Synthetic oligonucleotide
  Target: ATXN1; (-) strand; PAM type: YTN; PAM sequence: CTG
gaaccagaagtggacatatg

SEQ ID NO: 213340 - DNA, 20 bp, Artificial Sequence
  Description of Artificial Sequence: Synthetic oligonucleotide
  Target: ATXN1; (-) strand; PAM type: YTN; PAM sequence: TTG
accaagaagtcagactggaa

SEQ ID NO: 213341 - DNA, 20 bp, Artificial Sequence
  Description of Artificial Sequence: Synthetic oligonucleotide
  Target: ATXN1; (-) strand; PAM type: YTN; PAM sequence: CTT
gaccaagaagtcagactgga

SEQ ID NO: 213342 - DNA, 20 bp, Artificial Sequence
  Description of Artificial Sequence: Synthetic oligonucleotide
  Target: ATXN1; (-) strand; PAM type: YTN; PAM sequence: CTC
agagaagtaaaaatggcttg

SEQ ID NO: 213343 - DNA, 20 bp, Artificial Sequence
  Description of Artificial Sequence: Synthetic oligonucleotide
  Target: ATXN1; (-) strand; PAM type: YTN; PAM sequence: TTA
aaggaggaaagagactcaga

SEQ ID NO: 213344 - DNA, 20 bp, Artificial Sequence
  Description of Artificial Sequence: Synthetic oligonucleotide
  Target: ATXN1; (-) strand; PAM type: YTN; PAM sequence: TTT
aaaggaggaaagagactcag

SEQ ID NO: 213345 - DNA, 20 bp, Artificial Sequence
  Description of Artificial Sequence: Synthetic oligonucleotide
  Target: ATXN1; (-) strand; PAM type: YTN; PAM sequence: CTA
tatttaaaggaggaaagaga

SEQ ID NO: 213346 - DNA, 20 bp, Artificial Sequence
  Description of Artificial Sequence: Synthetic oligonucleotide
  Target: ATXN1; (-) strand; PAM type: YTN; PAM sequence: TTC
tatatttaaaggaggaaaga

SEQ ID NO: 213347 - DNA, 20 bp, Artificial Sequence
  Description of Artificial Sequence: Synthetic oligonucleotide
  Target: ATXN1; (-) strand; PAM type: YTN; PAM sequence: CTT
ctatatttaaaggaggaaag

SEQ ID NO: 213348 - DNA, 20 bp, Artificial Sequence
  Description of Artificial Sequence: Synthetic oligonucleotide
  Target: ATXN1; (-) strand; PAM type: YTN; PAM sequence: CTA
aacttctatatttaaaggag

SEQ ID NO: 213349 - DNA, 20 bp, Artificial Sequence
  Description of Artificial Sequence: Synthetic oligonucleotide
  Target: ATXN1; (-) strand; PAM type: YTN; PAM sequence: CTC
atgtgatctaaacttctata

SEQ ID NO: 213350 - DNA, 20 bp, Artificial Sequence
  Description of Artificial Sequence: Synthetic oligonucleotide
  Target: ATXN1; (-) strand; PAM type: YTN; PAM sequence: CTC
agagctcatgtgatctaaac

SEQ ID NO: 213351 - DNA, 20 bp, Artificial Sequence
  Description of Artificial Sequence: Synthetic oligonucleotide
  Target: ATXN1; (-) strand; PAM type: YTN; PAM sequence: CTG
aaactcagagctcatgtgat

SEQ ID NO: 213352 - DNA, 20 bp, Artificial Sequence
  Description of Artificial Sequence: Synthetic oligonucleotide
  Target: ATXN1; (-) strand; PAM type: YTN; PAM sequence: CTA
ggtcacctgaaactcagagc

SEQ ID NO: 213353 - DNA, 20 bp, Artificial Sequence
  Description of Artificial Sequence: Synthetic oligonucleotide
  Target: ATXN1; (-) strand; PAM type: YTN; PAM sequence: TTC
taggtcacctgaaactcaga

SEQ ID NO: 213354 - DNA, 20 bp, Artificial Sequence
  Description of Artificial Sequence: Synthetic oligonucleotide
  Target: ATXN1; (-) strand; PAM type: YTN; PAM sequence: CTG
catagaaccatacagttcta

SEQ ID NO: 213355 - DNA, 20 bp, Artificial Sequence
  Description of Artificial Sequence: Synthetic oligonucleotide
  Target: ATXN1; (-) strand; PAM type: YTN; PAM sequence: TTG
ctgcatagaaccatacagtt

SEQ ID NO: 213356 - DNA, 20 bp, Artificial Sequence
  Description of Artificial Sequence: Synthetic oligonucleotide
  Target: ATXN1; (-) strand; PAM type: YTN; PAM sequence: TTT
gctgcatagaaccatacagt

SEQ ID NO: 213357 - DNA, 20 bp, Artificial Sequence
  Description of Artificial Sequence: Synthetic oligonucleotide
  Target: ATXN1; (-) strand; PAM type: YTN; PAM sequence: TTG
agtttgctgcatagaaccat

SEQ ID NO: 213358 - DNA, 20 bp, Artificial Sequence
  Description of Artificial Sequence: Synthetic oligonucleotide
  Target: ATXN1; (-) strand; PAM type: YTN; PAM sequence: TTA
gaaggtaacattgagtttgc

SEQ ID NO: 213359 - DNA, 20 bp, Artificial Sequence
  Description of Artificial Sequence: Synthetic oligonucleotide
  Target: ATXN1; (-) strand; PAM type: YTN; PAM sequence: CTT
agaaggtaacattgagtttg

SEQ ID NO: 213360 - DNA, 20 bp, Artificial Sequence
  Description of Artificial Sequence: Synthetic oligonucleotide
  Target: ATXN1; (-) strand; PAM type: YTN; PAM sequence: CTC
acatcttagaaggtaacatt

SEQ ID NO: 213361 - DNA, 20 bp, Artificial Sequence
  Description of Artificial Sequence: Synthetic oligonucleotide
  Target: ATXN1; (-) strand; PAM type: YTN; PAM sequence: CTC
tcacatcttagaaggtaaca

SEQ ID NO: 213362 - DNA, 20 bp, Artificial Sequence
  Description of Artificial Sequence: Synthetic oligonucleotide
  Target: ATXN1; (-) strand; PAM type: YTN; PAM sequence: CTG
tgccatctctcacatcttag

SEQ ID NO: 213363 - DNA, 20 bp, Artificial Sequence
  Description of Artificial Sequence: Synthetic oligonucleotide
  Target: ATXN1; (-) strand; PAM type: YTN; PAM sequence: CTC
tgtgccatctctcacatctt

SEQ ID NO: 213364 - DNA, 20 bp, Artificial Sequence
  Description of Artificial Sequence: Synthetic oligonucleotide
  Target: ATXN1; (-) strand; PAM type: YTN; PAM sequence: CTC
agtgtagccagggaaaaaca

SEQ ID NO: 213365 - DNA, 20 bp, Artificial Sequence
  Description of Artificial Sequence: Synthetic oligonucleotide
  Target: ATXN1; (-) strand; PAM type: YTN; PAM sequence: CTG
ccagtggctcagtgtagcca

SEQ ID NO: 213366 - DNA, 20 bp, Artificial Sequence
  Description of Artificial Sequence: Synthetic oligonucleotide
  Target: ATXN1; (-) strand; PAM type: YTN; PAM sequence: CTA
ctgccagtggctcagtgtag

SEQ ID NO: 213367 - DNA, 20 bp, Artificial Sequence
  Description of Artificial Sequence: Synthetic oligonucleotide
  Target: ATXN1; (-) strand; PAM type: YTN; PAM sequence: TTG
ggaggcctactgccagtggc

SEQ ID NO: 213368 - DNA, 20 bp, Artificial Sequence
  Description of Artificial Sequence: Synthetic oligonucleotide
  Target: ATXN1; (-) strand; PAM type: YTN; PAM sequence: TTT
gggaggcctactgccagtgg

SEQ ID NO: 213369 - DNA, 20 bp, Artificial Sequence
  Description of Artificial Sequence: Synthetic oligonucleotide
  Target: ATXN1; (-) strand; PAM type: YTN; PAM sequence: TTC
aagaagcagatgggaagtgt

SEQ ID NO: 213370 - DNA, 20 bp, Artificial Sequence
  Description of Artificial Sequence: Synthetic oligonucleotide
  Target: ATXN1; (-) strand; PAM type: YTN; PAM sequence: TTG
ggtgatatgtatgaaatggt

SEQ ID NO: 213371 - DNA, 20 bp, Artificial Sequence
  Description of Artificial Sequence: Synthetic oligonucleotide
  Target: ATXN1; (-) strand; PAM type: YTN; PAM sequence: TTA
atgggatgttgggtgatatg

SEQ ID NO: 213372 - DNA, 20 bp, Artificial Sequence
  Description of Artificial Sequence: Synthetic oligonucleotide
  Target: ATXN1; (-) strand; PAM type: YTN; PAM sequence: TTT
aatgggatgttgggtgatat

SEQ ID NO: 213373 - DNA, 20 bp, Artificial Sequence
  Description of Artificial Sequence: Synthetic oligonucleotide
  Target: ATXN1; (-) strand; PAM type: YTN; PAM sequence: CTT
taatgggatgttgggtgata

SEQ ID NO: 213374 - DNA, 20 bp, Artificial Sequence
  Description of Artificial Sequence: Synthetic oligonucleotide
  Target: ATXN1; (-) strand; PAM type: YTN; PAM sequence: CTG
tctttaatgggatgttgggt

SEQ ID NO: 213375 - DNA, 20 bp, Artificial Sequence
  Description of Artificial Sequence: Synthetic oligonucleotide
  Target: ATXN1; (-) strand; PAM type: YTN; PAM sequence: CTG
gccgaggaccctgtctttaa

SEQ ID NO: 213376 - DNA, 20 bp, Artificial Sequence
  Description of Artificial Sequence: Synthetic oligonucleotide
  Target: ATXN1; (-) strand; PAM type: YTN; PAM sequence: TTA
caagtgtgagccaccgcgcc

SEQ ID NO: 213377 - DNA, 20 bp, Artificial Sequence
  Description of Artificial Sequence: Synthetic oligonucleotide
  Target: ATXN1; (-) strand; PAM type: YTN; PAM sequence: CTG
ggattacaagtgtgagccac

SEQ ID NO: 213378 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacaa

SEQ ID NO: 213379 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 213380 - DNA, 20 bp, Artificial Sequence
  Description of Artificial Sequence: Synthetic oligonucleotide
  Target: ATXN1; (-) strand; PAM type: YTN; PAM sequence: CTC
gtgacccgcccacctcggcc

SEQ ID NO: 213381 - DNA, 20 bp, Artificial Sequence
  Description of Artificial Sequence: Synthetic oligonucleotide
  Target: ATXN1; (-) strand; PAM type: YTN; PAM sequence: CTG
acctcgtgacccgcccacct

SEQ ID NO: 213382 - DNA, 20 bp, Artificial Sequence
  Description of Artificial Sequence: Synthetic oligonucleotide
  Target: ATXN1; (-) strand; PAM type: YTN; PAM sequence: CTC
ctgacctcgtgacccgccca

SEQ ID NO: 213383 - DNA, 20 bp, Artificial Sequence
  Description of Artificial Sequence: Synthetic oligonucleotide
  Target: ATXN1; (-) strand; PAM type: YTN; PAM sequence: CTC
aaactcctgacctcgtgacc

SEQ ID NO: 213384 - DNA, 20 bp, Artificial Sequence
  Description of Artificial Sequence: Synthetic oligonucleotide
  Target: ATXN1; (-) strand; PAM type: YTN; PAM sequence: TTG
gccaggcaggtctcaaactc

SEQ ID NO: 213385 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggcaggt

SEQ ID NO: 213386 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggcagg

SEQ ID NO: 213387 - DNA, 20 bp, Artificial Sequence
  Description of Artificial Sequence: Synthetic oligonucleotide
  Target: ATXN1; (-) strand; PAM type: YTN; PAM sequence: TTA
gtagagatgggatttcacca

SEQ ID NO: 213388 - DNA, 20 bp, Artificial Sequence
  Description of Artificial Sequence: Synthetic oligonucleotide
  Target: ATXN1; (-) strand; PAM type: YTN; PAM sequence: TTT
agtagagatgggatttcacc

SEQ ID NO: 213389 - DNA, 20 bp, Artificial Sequence
  Description of Artificial Sequence: Synthetic oligonucleotide
  Target: ATXN1; (-) strand; PAM type: YTN; PAM sequence: TTT
tagtagagatgggatttcac

SEQ ID NO: 213390 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatgggatttca

SEQ ID NO: 213391 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatggga

SEQ ID NO: 213392 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 213393 - DNA, 20 bp, Artificial Sequence
  Description of Artificial Sequence: Synthetic oligonucleotide
  Target: ATXN1; (-) strand; PAM type: YTN; PAM sequence: CTA
atgtttgtatttttagtaga

SEQ ID NO: 213394 - DNA, 20 bp, Artificial Sequence
  Description of Artificial Sequence: Synthetic oligonucleotide
  Target: ATXN1; (-) strand; PAM type: YTN; PAM sequence: CTA
gtatgacaggcgtgagccac

SEQ ID NO: 213395 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctagtatgacag

SEQ ID NO: 213396 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctagta

SEQ ID NO: 213397 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 213398 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagta

SEQ ID NO: 213399 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgag

SEQ ID NO: 213400 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgcctcag

SEQ ID NO: 213401 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcgattctcc

SEQ ID NO: 213402 - DNA, 20 bp, Artificial Sequence
  Description of Artificial Sequence: Synthetic oligonucleotide
  Target: ATXN1; (-) strand; PAM type: YTN; PAM sequence: CTG
cctcccaggttcaagcgatt

SEQ ID NO: 213403 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaggttcaagcga

SEQ ID NO: 213404 - DNA, 20 bp, Artificial Sequence
  Description of Artificial Sequence: Synthetic oligonucleotide
  Target: ATXN1; (-) strand; PAM type: YTN; PAM sequence: CTG
cagcctctgcctcccaggtt

SEQ ID NO: 213405 - DNA, 20 bp, Artificial Sequence
  Description of Artificial Sequence: Synthetic oligonucleotide
  Target: ATXN1; (-) strand; PAM type: YTN; PAM sequence: CTC
actgcagcctctgcctccca

SEQ ID NO: 213406 - DNA, 20 bp, Artificial Sequence
  Description of Artificial Sequence: Synthetic oligonucleotide
  Target: ATXN1; (-) strand; PAM type: YTN; PAM sequence: CTC
agctcactgcagcctctgcc

SEQ ID NO: 213407 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcatgatctc

SEQ ID NO: 213408 - DNA, 20 bp, Artificial Sequence
  Description of Artificial Sequence: Synthetic oligonucleotide
  Target: ATXN1; (-) strand; PAM type: YTN; PAM sequence: CTG
ccacccaggctggagtgcag

SEQ ID NO: 213409 - DNA, 20 bp, Artificial Sequence
  Description of Artificial Sequence: Synthetic oligonucleotide
  Target: ATXN1; (-) strand; PAM type: YTN; PAM sequence: CTC
tgccacccaggctggagtgc

SEQ ID NO: 213410 - DNA, 20 bp, Artificial Sequence
  Description of Artificial Sequence: Synthetic oligonucleotide
  Target: ATXN1; (-) strand; PAM type: YTN; PAM sequence: TTG
ctctgccacccaggctggag

SEQ ID NO: 213411 - DNA, 20 bp, Artificial Sequence
  Description of Artificial Sequence: Synthetic oligonucleotide
  Target: ATXN1; (-) strand; PAM type: YTN; PAM sequence: CTT
gctctgccacccaggctgga

SEQ ID NO: 213412 - DNA, 20 bp, Artificial Sequence
  Description of Artificial Sequence: Synthetic oligonucleotide
  Target: ATXN1; (-) strand; PAM type: YTN; PAM sequence: TTG
agatggagtcttgctctgcc

SEQ ID NO: 213413 - DNA, 20 bp, Artificial Sequence
  Description of Artificial Sequence: Synthetic oligonucleotide
  Target: ATXN1; (-) strand; PAM type: YTN; PAM sequence: TTT
gagatggagtcttgctctgc

SEQ ID NO: 213414 - DNA, 20 bp, Artificial Sequence
  Description of Artificial Sequence: Synthetic oligonucleotide
  Target: ATXN1; (-) strand; PAM type: YTN; PAM sequence: CTT
tgagatggagtcttgctctg

SEQ ID NO: 213415 - DNA, 20 bp, Artificial Sequence
  Description of Artificial Sequence: Synthetic oligonucleotide
  Target: ATXN1; (-) strand; PAM type: YTN; PAM sequence: TTG
ctttgagatggagtcttgct

SEQ ID NO: 213416 - DNA, 20 bp, Artificial Sequence
  Description of Artificial Sequence: Synthetic oligonucleotide
  Target: ATXN1; (-) strand; PAM type: YTN; PAM sequence: TTT
gctttgagatggagtcttgc

SEQ ID NO: 213417 - DNA, 20 bp, Artificial Sequence
  Description of Artificial Sequence: Synthetic oligonucleotide
  Target: ATXN1; (-) strand; PAM type: YTN; PAM sequence: TTG
tttgctttgagatggagtct

SEQ ID NO: 213418 - DNA, 20 bp, Artificial Sequence
  Description of Artificial Sequence: Synthetic oligonucleotide
  Target: ATXN1; (-) strand; PAM type: YTN; PAM sequence: TTT
gtttgctttgagatggagtc

SEQ ID NO: 213419 - DNA, 20 bp, Artificial Sequence
  Description of Artificial Sequence: Synthetic oligonucleotide
  Target: ATXN1; (-) strand; PAM type: YTN; PAM sequence: TTG
tttgtttgctttgagatgga

SEQ ID NO: 213420 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgctttgagatgg

SEQ ID NO: 213421 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgctttgaga

SEQ ID NO: 213422 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgctttgag

SEQ ID NO: 213423 - DNA, 20 bp, Artificial Sequence
  Description of Artificial Sequence: Synthetic oligonucleotide
  Target: ATXN1; (-) strand; PAM type: YTN; PAM sequence: TTT
tgtttgtttgtttgctttga

SEQ ID NO: 213424 - DNA, 20 bp, Artificial Sequence
  Description of Artificial Sequence: Synthetic oligonucleotide
  Target: ATXN1; (-) strand; PAM type: YTN; PAM sequence: TTT
ttgtttgtttgtttgctttg

SEQ ID NO: 213425 - DNA, 20 bp, Artificial Sequence
  Description of Artificial Sequence: Synthetic oligonucleotide
  Target: ATXN1; (-) strand; PAM type: YTN; PAM sequence: TTT
tttgtttgtttgtttgcttt

SEQ ID NO: 213426 - DNA, 20 bp, Artificial Sequence
  Description of Artificial Sequence: Synthetic oligonucleotide
  Target: ATXN1; (-) strand; PAM type: YTN; PAM sequence: TTT
ttttgtttgtttgtttgctt

SEQ ID NO: 213427 - DNA, 20 bp, Artificial Sequence
  Description of Artificial Sequence: Synthetic oligonucleotide
  Target: ATXN1; (-) strand; PAM type: YTN; PAM sequence: CTG
tttttttgtttgtttgtttg

SEQ ID NO: 213428 - DNA, 20 bp, Artificial Sequence
  Description of Artificial Sequence: Synthetic oligonucleotide
  Target: ATXN1; (-) strand; PAM type: YTN; PAM sequence: CTG
agagaggatcctgttttttt

SEQ ID NO: 213429 - DNA, 20 bp, Artificial Sequence
  Description of Artificial Sequence: Synthetic oligonucleotide
  Target: ATXN1; (-) strand; PAM type: YTN; PAM sequence: TTG
ctgagagaggatcctgtttt

SEQ ID NO: 213430 - DNA, 20 bp, Artificial Sequence
  Description of Artificial Sequence: Synthetic oligonucleotide
  Target: ATXN1; (-) strand; PAM type: YTN; PAM sequence: CTT
gctgagagaggatcctgttt

SEQ ID NO: 213431 - DNA, 20 bp, Artificial Sequence
  Description of Artificial Sequence: Synthetic oligonucleotide
  Target: ATXN1; (-) strand; PAM type: YTN; PAM sequence: TTG
tgataggagacttgctgaga

SEQ ID NO: 213432 - DNA, 20 bp, Artificial Sequence
  Description of Artificial Sequence: Synthetic oligonucleotide
  Target: ATXN1; (-) strand; PAM type: YTN; PAM sequence: TTT
gtgataggagacttgctgag

SEQ ID NO: 213433 - DNA, 20 bp, Artificial Sequence
  Description of Artificial Sequence: Synthetic oligonucleotide
  Target: ATXN1; (-) strand; PAM type: YTN; PAM sequence: TTT
tgtgataggagacttgctga

SEQ ID NO: 213434 - DNA, 20 bp, Artificial Sequence
  Description of Artificial Sequence: Synthetic oligonucleotide
  Target: ATXN1; (-) strand; PAM type: YTN; PAM sequence: CTT
ttgtgataggagacttgctg

SEQ ID NO: 213435 - DNA, 20 bp, Artificial Sequence
  Description of Artificial Sequence: Synthetic oligonucleotide
  Target: ATXN1; (-) strand; PAM type: YTN; PAM sequence: TTC
cttttgtgataggagacttg

SEQ ID NO: 213436 - DNA, 20 bp, Artificial Sequence
  Description of Artificial Sequence: Synthetic oligonucleotide
  Target: ATXN1; (-) strand; PAM type: YTN; PAM sequence: TTG
tgatgtgtattccttttgtg

SEQ ID NO: 213437 - DNA, 20 bp, Artificial Sequence
  Description of Artificial Sequence: Synthetic oligonucleotide
  Target: ATXN1; (-) strand; PAM type: YTN; PAM sequence: CTG
cgttgtgatgtgtattcctt

SEQ ID NO: 213438 - DNA, 20 bp, Artificial Sequence
  Description of Artificial Sequence: Synthetic oligonucleotide
  Target: ATXN1; (-) strand; PAM type: YTN; PAM sequence: CTG
gggtggtccagcagggctgc

SEQ ID NO: 213439 - DNA, 20 bp, Artificial Sequence
  Description of Artificial Sequence: Synthetic oligonucleotide
  Target: ATXN1; (-) strand; PAM type: YTN; PAM sequence: TTA
gagctggggtggtccagcag

SEQ ID NO: 213440 - DNA, 20 bp, Artificial Sequence
  Description of Artificial Sequence: Synthetic oligonucleotide
  Target: ATXN1; (-) strand; PAM type: YTN; PAM sequence: CTT
agagctggggtggtccagca

SEQ ID NO: 213441 - DNA, 20 bp, Artificial Sequence
  Description of Artificial Sequence: Synthetic oligonucleotide
  Target: ATXN1; (-) strand; PAM type: YTN; PAM sequence: CTC
ccccttagagctggggtggt

SEQ ID NO: 213442 - DNA, 20 bp, Artificial Sequence
  Description of Artificial Sequence: Synthetic oligonucleotide
  Target: ATXN1; (-) strand; PAM type: YTN; PAM sequence: TTG
acctcccccttagagctggg

SEQ ID NO: 213443 - DNA, 20 bp, Artificial Sequence
  Description of Artificial Sequence: Synthetic oligonucleotide
  Target: ATXN1; (-) strand; PAM type: YTN; PAM sequence: CTC
acaagttgacctccccctta

SEQ ID NO: 213444 - DNA, 20 bp, Artificial Sequence
  Description of Artificial Sequence: Synthetic oligonucleotide
  Target: ATXN1; (-) strand; PAM type: YTN; PAM sequence: TTG
ctcacaagttgacctccccc

SEQ ID NO: 213445 - DNA, 20 bp, Artificial Sequence
  Description of Artificial Sequence: Synthetic oligonucleotide
  Target: ATXN1; (-) strand; PAM type: YTN; PAM sequence: TTA
ttgctcacaagttgacctcc

SEQ ID NO: 213446 - DNA, 20 bp, Artificial Sequence
  Description of Artificial Sequence: Synthetic oligonucleotide
  Target: ATXN1; (-) strand; PAM type: YTN; PAM sequence: CTT
attgctcacaagttgacctc

SEQ ID NO: 213447 - DNA, 20 bp, Artificial Sequence
  Description of Artificial Sequence: Synthetic oligonucleotide
  Target: ATXN1; (-) strand; PAM type: YTN; PAM sequence: TTC
gacttattgctcacaagttg

SEQ ID NO: 213448 - DNA, 20 bp, Artificial Sequence
  Description of Artificial Sequence: Synthetic oligonucleotide
  Target: ATXN1; (-) strand; PAM type: YTN; PAM sequence: CTT
cgacttattgctcacaagtt

SEQ ID NO: 213449 - DNA, 20 bp, Artificial Sequence
  Description of Artificial Sequence: Synthetic oligonucleotide
  Target: ATXN1; (-) strand; PAM type: YTN; PAM sequence: TTG
cttcgacttattgctcacaa

SEQ ID NO: 213450 - DNA, 20 bp, Artificial Sequence
  Description of Artificial Sequence: Synthetic oligonucleotide
  Target: ATXN1; (-) strand; PAM type: YTN; PAM sequence: TTC
atgttgcttcgacttattgc

SEQ ID NO: 213451 - DNA, 20 bp, Artificial Sequence
  Description of Artificial Sequence: Synthetic oligonucleotide
  Target: ATXN1; (-) strand; PAM type: YTN; PAM sequence: CTT
catgttgcttcgacttattg

SEQ ID NO: 213452 - DNA, 20 bp, Artificial Sequence
  Description of Artificial Sequence: Synthetic oligonucleotide
  Target: ATXN1; (-) strand; PAM type: YTN; PAM sequence: TTC
ttcatgttgcttcgacttat

SEQ ID NO: 213453 - DNA, 20 bp, Artificial Sequence
  Description of Artificial Sequence: Synthetic oligonucleotide
  Target: ATXN1; (-) strand; PAM type: YTN; PAM sequence: CTT
cttcatgttgcttcgactta

SEQ ID NO: 213454 - DNA, 20 bp, Artificial Sequence
  Description of Artificial Sequence: Synthetic oligonucleotide
  Target: ATXN1; (-) strand; PAM type: YTN; PAM sequence: TTC
ttcttcatgttgcttcgact

SEQ ID NO: 213455 - DNA, 20 bp, Artificial Sequence
  Description of Artificial Sequence: Synthetic oligonucleotide
  Target: ATXN1; (-) strand; PAM type: YTN; PAM sequence: TTT
cttcttcatgttgcttcgac

SEQ ID NO: 213456 - DNA, 20 bp, Artificial Sequence
  Description of Artificial Sequence: Synthetic oligonucleotide
  Target: ATXN1; (-) strand; PAM type: YTN; PAM sequence: TTG
tttcttcttcatgttgcttc

SEQ ID NO: 213457 - DNA, 20 bp, Artificial Sequence
  Description of Artificial Sequence: Synthetic oligonucleotide
  Target: ATXN1; (-) strand; PAM type: YTN; PAM sequence: CTT
gtttcttcttcatgttgctt

SEQ ID NO: 213458 - DNA, 20 bp, Artificial Sequence
  Description of Artificial Sequence: Synthetic oligonucleotide
  Target: ATXN1; (-) strand; PAM type: YTN; PAM sequence: TTG
tccttgtttcttcttcatgt

SEQ ID NO: 213459 - DNA, 20 bp, Artificial Sequence
  Description of Artificial Sequence: Synthetic oligonucleotide
  Target: ATXN1; (-) strand; PAM type: YTN; PAM sequence: CTT
gtccttgtttcttcttcatg

SEQ ID NO: 213460 - DNA, 20 bp, Artificial Sequence
  Description of Artificial Sequence: Synthetic oligonucleotide
  Target: ATXN1; (-) strand; PAM type: YTN; PAM sequence: TTC
accttgtccttgtttcttct

SEQ ID NO: 213461 - DNA, 20 bp, Artificial Sequence
  Description of Artificial Sequence: Synthetic oligonucleotide
  Target: ATXN1; (-) strand; PAM type: YTN; PAM sequence: CTT
caccttgtccttgtttcttc

SEQ ID NO: 213462 - DNA, 20 bp, Artificial Sequence
  Description of Artificial Sequence: Synthetic oligonucleotide
  Target: ATXN1; (-) strand; PAM type: YTN; PAM sequence: TTC
ttcaccttgtccttgtttct

SEQ ID NO: 213463 - DNA, 20 bp, Artificial Sequence
  Description of Artificial Sequence: Synthetic oligonucleotide
  Target: ATXN1; (-) strand; PAM type: YTN; PAM sequence: TTA
tacaatgtatggagccattc

SEQ ID NO: 213464 - DNA, 20 bp, Artificial Sequence
  Description of Artificial Sequence: Synthetic oligonucleotide
  Target: ATXN1; (-) strand; PAM type: YTN; PAM sequence: TTG
gaatagatgaaaattataca

SEQ ID NO: 213465 - DNA, 20 bp, Artificial Sequence
  Description of Artificial Sequence: Synthetic oligonucleotide
  Target: ATXN1; (-) strand; PAM type: YTN; PAM sequence: CTG
gttggaatagatgaaaatta

SEQ ID NO: 213466 - DNA, 20 bp, Artificial Sequence
  Description of Artificial Sequence: Synthetic oligonucleotide
  Target: ATXN1; (-) strand; PAM type: YTN; PAM sequence: TTC
tggttggaatagatgaaaat

SEQ ID NO: 213467 - DNA, 20 bp, Artificial Sequence
  Description of Artificial Sequence: Synthetic oligonucleotide
  Target: ATXN1; (-) strand; PAM type: YTN; PAM sequence: TTT
ctggttggaatagatgaaaa

SEQ ID NO: 213468 - DNA, 20 bp, Artificial Sequence
  Description of Artificial Sequence: Synthetic oligonucleotide
  Target: ATXN1; (-) strand; PAM type: YTN; PAM sequence: TTT
tctggttggaatagatgaaa

SEQ ID NO: 213469 - DNA, 20 bp, Artificial Sequence
  Description of Artificial Sequence: Synthetic oligonucleotide
  Target: ATXN1; (-) strand; PAM type: YTN; PAM sequence: CTT
ttctggttggaatagatgaa

SEQ ID NO: 213470 - DNA, 20 bp, Artificial Sequence
  Description of Artificial Sequence: Synthetic oligonucleotide
  Target: ATXN1; (-) strand; PAM type: YTN; PAM sequence: CTC
ttttctggttggaatagatg

SEQ ID NO: 213471 - DNA, 20 bp, Artificial Sequence
  Description of Artificial Sequence: Synthetic oligonucleotide
  Target: ATXN1; (-) strand; PAM type: YTN; PAM sequence: TTG
atcagaatgagcagctcttt

SEQ ID NO: 213472 - DNA, 20 bp, Artificial Sequence
  Description of Artificial Sequence: Synthetic oligonucleotide
  Target: ATXN1; (-) strand; PAM type: YTN; PAM sequence: TTT
gatcagaatgagcagctctt

SEQ ID NO: 213473 - DNA, 20 bp, Artificial Sequence
  Description of Artificial Sequence: Synthetic oligonucleotide
  Target: ATXN1; (-) strand; PAM type: YTN; PAM sequence: CTT
tgatcagaatgagcagctct

SEQ ID NO: 213474 - DNA, 20 bp, Artificial Sequence
  Description of Artificial Sequence: Synthetic oligonucleotide
  Target: ATXN1; (-) strand; PAM type: YTN; PAM sequence: TTA
acatctttgatcagaatgag

SEQ ID NO: 213475 - DNA, 20 bp, Artificial Sequence
  Description of Artificial Sequence: Synthetic oligonucleotide
  Target: ATXN1; (-) strand; PAM type: YTN; PAM sequence: CTC
attaacatctttgatcagaa

SEQ ID NO: 213476 - DNA, 20 bp, Artificial Sequence
  Description of Artificial Sequence: Synthetic oligonucleotide
  Target: ATXN1; (-) strand; PAM type: YTN; PAM sequence: TTG
cagggctcattaacatcttt

SEQ ID NO: 213477 - DNA, 20 bp, Artificial Sequence
  Description of Artificial Sequence: Synthetic oligonucleotide
  Target: ATXN1; (-) strand; PAM type: YTN; PAM sequence: TTT
gcagggctcattaacatctt

SEQ ID NO: 213478 - DNA, 20 bp, Artificial Sequence
  Description of Artificial Sequence: Synthetic oligonucleotide
  Target: ATXN1; (-) strand; PAM type: YTN; PAM sequence: CTG
tttgcagggctcattaacat

SEQ ID NO: 213479 - DNA, 20 bp, Artificial Sequence
  Description of Artificial Sequence: Synthetic oligonucleotide
  Target: ATXN1; (-) strand; PAM type: YTN; PAM sequence: TTC
tgtttgcagggctcattaac

SEQ ID NO: 213480 - DNA, 20 bp, Artificial Sequence
  Description of Artificial Sequence: Synthetic oligonucleotide
  Target: ATXN1; (-) strand; PAM type: YTN; PAM sequence: TTT
ctgtttgcagggctcattaa

SEQ ID NO: 213481 - DNA, 20 bp, Artificial Sequence
  Description of Artificial Sequence: Synthetic oligonucleotide
  Target: ATXN1; (-) strand; PAM type: YTN; PAM sequence: TTG
tagtaatttctgtttgcagg

SEQ ID NO: 213482 - DNA, 20 bp, Artificial Sequence
  Description of Artificial Sequence: Synthetic oligonucleotide
  Target: ATXN1; (-) strand; PAM type: YTN; PAM sequence: CTA
ttgtagtaatttctgtttgc

SEQ ID NO: 213483 - DNA, 20 bp, Artificial Sequence
  Description of Artificial Sequence: Synthetic oligonucleotide
  Target: ATXN1; (-) strand; PAM type: YTN; PAM sequence: TTC
tattgtagtaatttctgttt

SEQ ID NO: 213484 - DNA, 20 bp, Artificial Sequence
  Description of Artificial Sequence: Synthetic oligonucleotide
  Target: ATXN1; (-) strand; PAM type: YTN; PAM sequence: CTG
ttctattgtagtaatttctg

SEQ ID NO: 213485 - DNA, 20 bp, Artificial Sequence
  Description of Artificial Sequence: Synthetic oligonucleotide
  Target: ATXN1; (-) strand; PAM type: YTN; PAM sequence: CTA
ctgttctattgtagtaattt

SEQ ID NO: 213486 - DNA, 20 bp, Artificial Sequence
  Description of Artificial Sequence: Synthetic oligonucleotide
  Target: ATXN1; (-) strand; PAM type: YTN; PAM sequence: TTA
atgaaggtgtctactgttct

SEQ ID NO: 213487 - DNA, 20 bp, Artificial Sequence
  Description of Artificial Sequence: Synthetic oligonucleotide
  Target: ATXN1; (-) strand; PAM type: YTN; PAM sequence: TTG
caggagaaaataattaatga

SEQ ID NO: 213488 - DNA, 20 bp, Artificial Sequence
  Description of Artificial Sequence: Synthetic oligonucleotide
  Target: ATXN1; (-) strand; PAM type: YTN; PAM sequence: CTA
atattgcaggagaaaataat

SEQ ID NO: 213489 - DNA, 20 bp, Artificial Sequence
  Description of Artificial Sequence: Synthetic oligonucleotide
  Target: ATXN1; (-) strand; PAM type: YTN; PAM sequence: TTA
gtgctaatattgcaggagaa

SEQ ID NO: 213490 - DNA, 20 bp, Artificial Sequence
  Description of Artificial Sequence: Synthetic oligonucleotide
  Target: ATXN1; (-) strand; PAM type: YTN; PAM sequence: CTA
atcattagtgctaatattgc

SEQ ID NO: 213491 - DNA, 20 bp, Artificial Sequence
  Description of Artificial Sequence: Synthetic oligonucleotide
  Target: ATXN1; (-) strand; PAM type: YTN; PAM sequence: TTC
taatcattagtgctaatatt

SEQ ID NO: 213492 - DNA, 20 bp, Artificial Sequence
  Description of Artificial Sequence: Synthetic oligonucleotide
  Target: ATXN1; (-) strand; PAM type: YTN; PAM sequence: TTT
ctaatcattagtgctaatat

SEQ ID NO: 213493 - DNA, 20 bp, Artificial Sequence
  Description of Artificial Sequence: Synthetic oligonucleotide
  Target: ATXN1; (-) strand; PAM type: YTN; PAM sequence: TTT
tctaatcattagtgctaata

SEQ ID NO: 213494 - DNA, 20 bp, Artificial Sequence
  Description of Artificial Sequence: Synthetic oligonucleotide
  Target: ATXN1; (-) strand; PAM type: YTN; PAM sequence: TTG
aagattttctaatcattagt

SEQ ID NO: 213495 - DNA, 20 bp, Artificial Sequence
  Description of Artificial Sequence: Synthetic oligonucleotide
  Target: ATXN1; (-) strand; PAM type: YTN; PAM sequence: CTA
ttgaagattttctaatcatt

SEQ ID NO: 213496 - DNA, 20 bp, Artificial Sequence
  Description of Artificial Sequence: Synthetic oligonucleotide
  Target: ATXN1; (-) strand; PAM type: YTN; PAM sequence: CTG
ctattgaagattttctaatc

SEQ ID NO: 213497 - DNA, 20 bp, Artificial Sequence
  Description of Artificial Sequence: Synthetic oligonucleotide
  Target: ATXN1; (-) strand; PAM type: YTN; PAM sequence: TTG
tgctgctattgaagattttc

SEQ ID NO: 213498 - DNA, 20 bp, Artificial Sequence
  Description of Artificial Sequence: Synthetic oligonucleotide
  Target: ATXN1; (-) strand; PAM type: YTN; PAM sequence: TTT
gtgctgctattgaagatttt

SEQ ID NO: 213499 - DNA, 20 bp, Artificial Sequence
  Description of Artificial Sequence: Synthetic oligonucleotide
  Target: ATXN1; (-) strand; PAM type: YTN; PAM sequence: TTA
tttgtgctgctattgaagat

SEQ ID NO: 213500 - DNA, 20 bp, Artificial Sequence
  Description of Artificial Sequence: Synthetic oligonucleotide
  Target: ATXN1; (-) strand; PAM type: YTN; PAM sequence: TTT
atttgtgctgctattgaaga

SEQ ID NO: 213501 - DNA, 20 bp, Artificial Sequence
  Description of Artificial Sequence: Synthetic oligonucleotide
  Target: ATXN1; (-) strand; PAM type: YTN; PAM sequence: TTT
tatttgtgctgctattgaag

SEQ ID NO: 213502 - DNA, 20 bp, Artificial Sequence
  Description of Artificial Sequence: Synthetic oligonucleotide
  Target: ATXN1; (-) strand; PAM type: YTN; PAM sequence: TTT
ttatttgtgctgctattgaa

SEQ ID NO: 213503 - DNA, 20 bp, Artificial Sequence
  Description of Artificial Sequence: Synthetic oligonucleotide
  Target: ATXN1; (-) strand; PAM type: YTN; PAM sequence: TTA
tttttatttgtgctgctatt

SEQ ID NO: 213504 - DNA, 20 bp, Artificial Sequence
  Description of Artificial Sequence: Synthetic oligonucleotide
  Target: ATXN1; (-) strand; PAM type: YTN; PAM sequence: TTT
atttttatttgtgctgctat

SEQ ID NO: 213505 - DNA, 20 bp, Artificial Sequence
  Description of Artificial Sequence: Synthetic oligonucleotide
  Target: ATXN1; (-) strand; PAM type: YTN; PAM sequence: CTG
tttatttttatttgtgctgc

SEQ ID NO: 213506 - DNA, 20 bp, Artificial Sequence
  Description of Artificial Sequence: Synthetic oligonucleotide
  Target: ATXN1; (-) strand; PAM type: YTN; PAM sequence: TTG
gtgtctgtttatttttattt

SEQ ID NO: 213507 - DNA, 20 bp, Artificial Sequence
  Description of Artificial Sequence: Synthetic oligonucleotide
  Target: ATXN1; (-) strand; PAM type: YTN; PAM sequence: CTG
taccaaggattggtgtctgt

SEQ ID NO: 213508 - DNA, 20 bp, Artificial Sequence
  Description of Artificial Sequence: Synthetic oligonucleotide
  Target: ATXN1; (-) strand; PAM type: YTN; PAM sequence: CTG
tacggaggctgtaccaagga

SEQ ID NO: 213509 - DNA, 20 bp, Artificial Sequence
  Description of Artificial Sequence: Synthetic oligonucleotide
  Target: ATXN1; (-) strand; PAM type: YTN; PAM sequence: CTG
aatgaacagtccagtatgga

SEQ ID NO: 213510 - DNA, 20 bp, Artificial Sequence
  Description of Artificial Sequence: Synthetic oligonucleotide
  Target: ATXN1; (-) strand; PAM type: YTN; PAM sequence: CTG
ggtgctgaatgaacagtcca

SEQ ID NO: 213511 - DNA, 20 bp, Artificial Sequence
  Description of Artificial Sequence: Synthetic oligonucleotide
  Target: ATXN1; (-) strand; PAM type: YTN; PAM sequence: TTC
cagaatactgggtgctgaat

SEQ ID NO: 213512 - DNA, 20 bp, Artificial Sequence
  Description of Artificial Sequence: Synthetic oligonucleotide
  Target: ATXN1; (-) strand; PAM type: YTN; PAM sequence: TTA
ataggcaaattccagaatac

SEQ ID NO: 213513 - DNA, 20 bp, Artificial Sequence
  Description of Artificial Sequence: Synthetic oligonucleotide
  Target: ATXN1; (-) strand; PAM type: YTN; PAM sequence: CTG
cattaataggcaaattccag

SEQ ID NO: 213514 - DNA, 20 bp, Artificial Sequence
  Description of Artificial Sequence: Synthetic oligonucleotide
  Target: ATXN1; (-) strand; PAM type: YTN; PAM sequence: TTC
cacctgcattaataggcaaa

SEQ ID NO: 213515 - DNA, 20 bp, Artificial Sequence
  Description of Artificial Sequence: Synthetic oligonucleotide
  Target: ATXN1; (-) strand; PAM type: YTN; PAM sequence: CTT
ccacctgcattaataggcaa

SEQ ID NO: 213516 - DNA, 20 bp, Artificial Sequence
  Description of Artificial Sequence: Synthetic oligonucleotide
  Target: ATXN1; (-) strand; PAM type: YTN; PAM sequence: CTG
cttccacctgcattaatagg

SEQ ID NO: 213517 - DNA, 20 bp, Artificial Sequence
  Description of Artificial Sequence: Synthetic oligonucleotide
  Target: ATXN1; (-) strand; PAM type: YTN; PAM sequence: TTG
tatgaacaggactgcttcca

SEQ ID NO: 213518 - DNA, 20 bp, Artificial Sequence
  Description of Artificial Sequence: Synthetic oligonucleotide
  Target: ATXN1; (-) strand; PAM type: YTN; PAM sequence: TTG
ggtcatattgtatgaacagg

SEQ ID NO: 213519 - DNA, 20 bp, Artificial Sequence
  Description of Artificial Sequence: Synthetic oligonucleotide
  Target: ATXN1; (-) strand; PAM type: YTN; PAM sequence: TTT
gggtcatattgtatgaacag

SEQ ID NO: 213520 - DNA, 20 bp, Artificial Sequence
  Description of Artificial Sequence: Synthetic oligonucleotide
  Target: ATXN1; (-) strand; PAM type: YTN; PAM sequence: TTG
gagtttgggtcatattgtat

SEQ ID NO: 213521 - DNA, 20 bp, Artificial Sequence
  Description of Artificial Sequence: Synthetic oligonucleotide
  Target: ATXN1; (-) strand; PAM type: YTN; PAM sequence: TTT
ggagtttgggtcatattgta

SEQ ID NO: 213522 - DNA, 20 bp, Artificial Sequence
  Description of Artificial Sequence: Synthetic oligonucleotide
  Target: ATXN1; (-) strand; PAM type: YTN; PAM sequence: TTG
aatttggagtttgggtcata

SEQ ID NO: 213523 - DNA, 20 bp, Artificial Sequence
  Description of Artificial Sequence: Synthetic oligonucleotide
  Target: ATXN1; (-) strand; PAM type: YTN; PAM sequence: TTC
acattgaatttggagtttgg

SEQ ID NO: 213524 - DNA, 20 bp, Artificial Sequence
  Description of Artificial Sequence: Synthetic oligonucleotide
  Target: ATXN1; (-) strand; PAM type: YTN; PAM sequence: TTG
gggaaacaaaacaaaacaaa

SEQ ID NO: 213525 - DNA, 20 bp, Artificial Sequence
  Description of Artificial Sequence: Synthetic oligonucleotide
  Target: ATXN1; (-) strand; PAM type: YTN; PAM sequence: CTT
ggggaaacaaaacaaaacaa

SEQ ID NO: 213526 - DNA, 20 bp, Artificial Sequence
  Description of Artificial Sequence: Synthetic oligonucleotide
  Target: ATXN1; (-) strand; PAM type: YTN; PAM sequence: CTG
ggccttggggaaacaaaaca

SEQ ID NO: 213527 - DNA, 20 bp, Artificial Sequence
  Description of Artificial Sequence: Synthetic oligonucleotide
  Target: ATXN1; (-) strand; PAM type: YTN; PAM sequence: TTA
gggacgggcacggctgggcc

SEQ ID NO: 213528 - DNA, 20 bp, Artificial Sequence
  Description of Artificial Sequence: Synthetic oligonucleotide
  Target: ATXN1; (-) strand; PAM type: YTN; PAM sequence: TTT
agggacgggcacggctgggc

SEQ ID NO: 213529 - DNA, 20 bp, Artificial Sequence
  Description of Artificial Sequence: Synthetic oligonucleotide
  Target: ATXN1; (-) strand; PAM type: YTN; PAM sequence: TTT
tagggacgggcacggctggg

SEQ ID NO: 213530 - DNA, 20 bp, Artificial Sequence
  Description of Artificial Sequence: Synthetic oligonucleotide
  Target: ATXN1; (-) strand; PAM type: YTN; PAM sequence: TTG
atgagggcacgtggatatcc

SEQ ID NO: 213531 - DNA, 20 bp, Artificial Sequence
  Description of Artificial Sequence: Synthetic oligonucleotide
  Target: ATXN1; (-) strand; PAM type: YTN; PAM sequence: TTT
gatgagggcacgtggatatc

SEQ ID NO: 213532 - DNA, 20 bp, Artificial Sequence
  Description of Artificial Sequence: Synthetic oligonucleotide
  Target: ATXN1; (-) strand; PAM type: YTN; PAM sequence: TTT
tgatgagggcacgtggatat

SEQ ID NO: 213533 - DNA, 20 bp, Artificial Sequence
  Description of Artificial Sequence: Synthetic oligonucleotide
  Target: ATXN1; (-) strand; PAM type: YTN; PAM sequence: CTA
agaaacggggattttgatga

SEQ ID NO: 213534 - DNA, 20 bp, Artificial Sequence
  Description of Artificial Sequence: Synthetic oligonucleotide
  Target: ATXN1; (-) strand; PAM type: YTN; PAM sequence: TTC
taagaaacggggattttgat

SEQ ID NO: 213535 - DNA, 20 bp, Artificial Sequence
  Description of Artificial Sequence: Synthetic oligonucleotide
  Target: ATXN1; (-) strand; PAM type: YTN; PAM sequence: CTT
ctaagaaacggggattttga

SEQ ID NO: 213536 - DNA, 20 bp, Artificial Sequence
  Description of Artificial Sequence: Synthetic oligonucleotide
  Target: ATXN1; (-) strand; PAM type: YTN; PAM sequence: CTA
gagggagcttctaagaaacg

SEQ ID NO: 213537 - DNA, 20 bp, Artificial Sequence
  Description of Artificial Sequence: Synthetic oligonucleotide
  Target: ATXN1; (-) strand; PAM type: YTN; PAM sequence: CTC
actagagggagcttctaaga

SEQ ID NO: 213538 - DNA, 20 bp, Artificial Sequence
  Description of Artificial Sequence: Synthetic oligonucleotide
  Target: ATXN1; (-) strand; PAM type: YTN; PAM sequence: TTG
ccagtaaaagtaactcacta

SEQ ID NO: 213539 - DNA, 20 bp, Artificial Sequence
  Description of Artificial Sequence: Synthetic oligonucleotide
  Target: ATXN1; (-) strand; PAM type: YTN; PAM sequence: TTA
ttgccagtaaaagtaactca

SEQ ID NO: 213540 - DNA, 20 bp, Artificial Sequence
  Description of Artificial Sequence: Synthetic oligonucleotide
  Target: ATXN1; (-) strand; PAM type: YTN; PAM sequence: TTT
attgccagtaaaagtaactc

SEQ ID NO: 213541 - DNA, 20 bp, Artificial Sequence
  Description of Artificial Sequence: Synthetic oligonucleotide
  Target: ATXN1; (-) strand; PAM type: YTN; PAM sequence: CTT
tattgccagtaaaagtaact

SEQ ID NO: 213542 - DNA, 20 bp, Artificial Sequence
  Description of Artificial Sequence: Synthetic oligonucleotide
  Target: ATXN1; (-) strand; PAM type: YTN; PAM sequence: TTC
tttattgccagtaaaagtaa

SEQ ID NO: 213543 - DNA, 20 bp, Artificial Sequence
  Description of Artificial Sequence: Synthetic oligonucleotide
  Target: ATXN1; (-) strand; PAM type: YTN; PAM sequence: TTA
gtattctttattgccagtaa

SEQ ID NO: 213544 - DNA, 20 bp, Artificial Sequence
  Description of Artificial Sequence: Synthetic oligonucleotide
  Target: ATXN1; (-) strand; PAM type: YTN; PAM sequence: CTA
attagtattctttattgcca

SEQ ID NO: 213545 - DNA, 20 bp, Artificial Sequence
  Description of Artificial Sequence: Synthetic oligonucleotide
  Target: ATXN1; (-) strand; PAM type: YTN; PAM sequence: TTG
ctaattagtattctttattg

SEQ ID NO: 213546 - DNA, 20 bp, Artificial Sequence
  Description of Artificial Sequence: Synthetic oligonucleotide
  Target: ATXN1; (-) strand; PAM type: YTN; PAM sequence: TTT
gctaattagtattctttatt

SEQ ID NO: 213547 - DNA, 20 bp, Artificial Sequence
  Description of Artificial Sequence: Synthetic oligonucleotide
  Target: ATXN1; (-) strand; PAM type: YTN; PAM sequence: TTT
tgctaattagtattctttat

SEQ ID NO: 213548 - DNA, 20 bp, Artificial Sequence
  Description of Artificial Sequence: Synthetic oligonucleotide
  Target: ATXN1; (-) strand; PAM type: YTN; PAM sequence: TTG
tgtgtgaaatatggttttgc

SEQ ID NO: 213549 - DNA, 20 bp, Artificial Sequence
  Description of Artificial Sequence: Synthetic oligonucleotide
  Target: ATXN1; (-) strand; PAM type: YTN; PAM sequence: TTT
gtgtgtgaaatatggttttg

SEQ ID NO: 213550 - DNA, 20 bp, Artificial Sequence
  Description of Artificial Sequence: Synthetic oligonucleotide
  Target: ATXN1; (-) strand; PAM type: YTN; PAM sequence: TTG
tttgtgtgtgaaatatggtt

SEQ ID NO: 213551 - DNA, 20 bp, Artificial Sequence
  Description of Artificial Sequence: Synthetic oligonucleotide
  Target: ATXN1; (-) strand; PAM type: YTN; PAM sequence: TTT
gtttgtgtgtgaaatatggt

SEQ ID NO: 213552 - DNA, 20 bp, Artificial Sequence
  Description of Artificial Sequence: Synthetic oligonucleotide
  Target: ATXN1; (-) strand; PAM type: YTN; PAM sequence: CTA
atgcatttgtttgtgtgtga

SEQ ID NO: 213553 - DNA, 20 bp, Artificial Sequence
  Description of Artificial Sequence: Synthetic oligonucleotide
  Target: ATXN1; (-) strand; PAM type: YTN; PAM sequence: CTA
tcctaatgcatttgtttgtg

SEQ ID NO: 213554 - DNA, 20 bp, Artificial Sequence
  Description of Artificial Sequence: Synthetic oligonucleotide
  Target: ATXN1; (-) strand; PAM type: YTN; PAM sequence: TTA
aagactatcctaatgcattt

SEQ ID NO: 213555 - DNA, 20 bp, Artificial Sequence
  Description of Artificial Sequence: Synthetic oligonucleotide
  Target: ATXN1; (-) strand; PAM type: YTN; PAM sequence: TTT
aaagactatcctaatgcatt

SEQ ID NO: 213556 - DNA, 20 bp, Artificial Sequence
  Description of Artificial Sequence: Synthetic oligonucleotide
  Target: ATXN1; (-) strand; PAM type: YTN; PAM sequence: TTT
taaagactatcctaatgcat

SEQ ID NO: 213557 - DNA, 20 bp, Artificial Sequence
  Description of Artificial Sequence: Synthetic oligonucleotide
  Target: ATXN1; (-) strand; PAM type: YTN; PAM sequence: TTA
ttttaaagactatcctaatg

SEQ ID NO: 213558 - DNA, 20 bp, Artificial Sequence
  Description of Artificial Sequence: Synthetic oligonucleotide
  Target: ATXN1; (-) strand; PAM type: YTN; PAM sequence: TTA
agaaataggttattttaaag

SEQ ID NO: 213559 - DNA, 20 bp, Artificial Sequence
  Description of Artificial Sequence: Synthetic oligonucleotide
  Target: ATXN1; (-) strand; PAM type: YTN; PAM sequence: CTT
aagaaataggttattttaaa

SEQ ID NO: 213560 - DNA, 20 bp, Artificial Sequence
  Description of Artificial Sequence: Synthetic oligonucleotide
  Target: ATXN1; (-) strand; PAM type: YTN; PAM sequence: CTA
aaataaaagcttaagaaata

SEQ ID NO: 213561 - DNA, 20 bp, Artificial Sequence
  Description of Artificial Sequence: Synthetic oligonucleotide
  Target: ATXN1; (-) strand; PAM type: YTN; PAM sequence: CTG
aacctaaaataaaagcttaa

SEQ ID NO: 213562 - DNA, 20 bp, Artificial Sequence
  Description of Artificial Sequence: Synthetic oligonucleotide
  Target: ATXN1; (-) strand; PAM type: YTN; PAM sequence: CTG
cacatgtacccctgaaccta

SEQ ID NO: 213563 - DNA, 20 bp, Artificial Sequence
  Description of Artificial Sequence: Synthetic oligonucleotide
  Target: ATXN1; (-) strand; PAM type: YTN; PAM sequence: TTA
ataaacctgcacatgtaccc

SEQ ID NO: 213564 - DNA, 20 bp, Artificial Sequence
  Description of Artificial Sequence: Synthetic oligonucleotide
  Target: ATXN1; (-) strand; PAM type: YTN; PAM sequence: TTT
aataaacctgcacatgtacc

SEQ ID NO: 213565 - DNA, 20 bp, Artificial Sequence
  Description of Artificial Sequence: Synthetic oligonucleotide
  Target: ATXN1; (-) strand; PAM type: YTN; PAM sequence: CTA
tttaataaacctgcacatgt

SEQ ID NO: 213566 - DNA, 20 bp, Artificial Sequence
  Description of Artificial Sequence: Synthetic oligonucleotide
  Target: ATXN1; (-) strand; PAM type: YTN; PAM sequence: TTA
tctatttaataaacctgcac

SEQ ID NO: 213567 - DNA, 20 bp, Artificial Sequence
  Description of Artificial Sequence: Synthetic oligonucleotide
  Target: ATXN1; (-) strand; PAM type: YTN; PAM sequence: TTT
atctatttaataaacctgca

SEQ ID NO: 213568 - DNA, 20 bp, Artificial Sequence
  Description of Artificial Sequence: Synthetic oligonucleotide
  Target: ATXN1; (-) strand; PAM type: YTN; PAM sequence: CTG
tacaacaaacccccatggca

SEQ ID NO: 213569 - DNA, 20 bp, Artificial Sequence
  Description of Artificial Sequence: Synthetic oligonucleotide
  Target: ATXN1; (-) strand; PAM type: YTN; PAM sequence: CTG
ggtgacgaaaccatctgtac

SEQ ID NO: 213570 - DNA, 20 bp, Artificial Sequence
  Description of Artificial Sequence: Synthetic oligonucleotide
  Target: ATXN1; (-) strand; PAM type: YTN; PAM sequence: TTA
gtatctgggtgacgaaacca

SEQ ID NO: 213571 - DNA, 20 bp, Artificial Sequence
  Description of Artificial Sequence: Synthetic oligonucleotide
  Target: ATXN1; (-) strand; PAM type: YTN; PAM sequence: CTT
agtatctgggtgacgaaacc

SEQ ID NO: 213572 - DNA, 20 bp, Artificial Sequence
  Description of Artificial Sequence: Synthetic oligonucleotide
  Target: ATXN1; (-) strand; PAM type: YTN; PAM sequence: CTA
ggcttagtatctgggtgacg

SEQ ID NO: 213573 - DNA, 20 bp, Artificial Sequence
  Description of Artificial Sequence: Synthetic oligonucleotide
  Target: ATXN1; (-) strand; PAM type: YTN; PAM sequence: TTG
ggtactaggcttagtatctg

SEQ ID NO: 213574 - DNA, 20 bp, Artificial Sequence
  Description of Artificial Sequence: Synthetic oligonucleotide
  Target: ATXN1; (-) strand; PAM type: YTN; PAM sequence: TTA
ttgggtactaggcttagtat

SEQ ID NO: 213575 - DNA, 20 bp, Artificial Sequence
  Description of Artificial Sequence: Synthetic oligonucleotide
  Target: ATXN1; (-) strand; PAM type: YTN; PAM sequence: TTG
agggtagagggtggaggagg

SEQ ID NO: 213576 - DNA, 20 bp, Artificial Sequence
  Description of Artificial Sequence: Synthetic oligonucleotide
  Target: ATXN1; (-) strand; PAM type: YTN; PAM sequence: CTT
gagggtagagggtggaggag

SEQ ID NO: 213577 - DNA, 20 bp, Artificial Sequence
  Description of Artificial Sequence: Synthetic oligonucleotide
  Target: ATXN1; (-) strand; PAM type: YTN; PAM sequence: CTA
cttgagggtagagggtggag

SEQ ID NO: 213578 - DNA, 20 bp, Artificial Sequence
  Description of Artificial Sequence: Synthetic oligonucleotide
  Target: ATXN1; (-) strand; PAM type: YTN; PAM sequence: CTG
ggtcctacttgagggtagag

SEQ ID NO: 213579 - DNA, 20 bp, Artificial Sequence
  Description of Artificial Sequence: Synthetic oligonucleotide
  Target: ATXN1; (-) strand; PAM type: YTN; PAM sequence: CTC
atggacacaaagaagggaac

SEQ ID NO: 213580 - DNA, 20 bp, Artificial Sequence
  Description of Artificial Sequence: Synthetic oligonucleotide
  Target: ATXN1; (-) strand; PAM type: YTN; PAM sequence: CTA
aatgatgagaactcatggac

SEQ ID NO: 213581 - DNA, 20 bp, Artificial Sequence
  Description of Artificial Sequence: Synthetic oligonucleotide
  Target: ATXN1; (-) strand; PAM type: YTN; PAM sequence: TTA
caagtgggagctaaatgatg

SEQ ID NO: 213582 - DNA, 20 bp, Artificial Sequence
  Description of Artificial Sequence: Synthetic oligonucleotide
  Target: ATXN1; (-) strand; PAM type: YTN; PAM sequence: CTT
acaagtgggagctaaatgat

SEQ ID NO: 213583 - DNA, 20 bp, Artificial Sequence
  Description of Artificial Sequence: Synthetic oligonucleotide
  Target: ATXN1; (-) strand; PAM type: YTN; PAM sequence: CTC
acttacaagtgggagctaaa

SEQ ID NO: 213584 - DNA, 20 bp, Artificial Sequence
  Description of Artificial Sequence: Synthetic oligonucleotide
  Target: ATXN1; (-) strand; PAM type: YTN; PAM sequence: TTC
tcacttacaagtgggagcta

SEQ ID NO: 213585 - DNA, 20 bp, Artificial Sequence
  Description of Artificial Sequence: Synthetic oligonucleotide
  Target: ATXN1; (-) strand; PAM type: YTN; PAM sequence: CTG
catgttctcacttacaagtg

SEQ ID NO: 213586 - DNA, 20 bp, Artificial Sequence
  Description of Artificial Sequence: Synthetic oligonucleotide
  Target: ATXN1; (-) strand; PAM type: YTN; PAM sequence: CTA
aatactgcatgttctcactt

SEQ ID NO: 213587 - DNA, 20 bp, Artificial Sequence
  Description of Artificial Sequence: Synthetic oligonucleotide
  Target: ATXN1; (-) strand; PAM type: YTN; PAM sequence: CTA
tcacaggaacaaaaaactaa

SEQ ID NO: 213588 - DNA, 20 bp, Artificial Sequence
  Description of Artificial Sequence: Synthetic oligonucleotide
  Target: ATXN1; (-) strand; PAM type: YTN; PAM sequence: TTA
gcaaactatcacaggaacaa

SEQ ID NO: 213589 - DNA, 20 bp, Artificial Sequence
  Description of Artificial Sequence: Synthetic oligonucleotide
  Target: ATXN1; (-) strand; PAM type: YTN; PAM sequence: CTT
agcaaactatcacaggaaca

SEQ ID NO: 213590 - DNA, 20 bp, Artificial Sequence
  Description of Artificial Sequence: Synthetic oligonucleotide
  Target: ATXN1; (-) strand; PAM type: YTN; PAM sequence: TTA
tccttagcaaactatcacag

SEQ ID NO: 213591 - DNA, 20 bp, Artificial Sequence
  Description of Artificial Sequence: Synthetic oligonucleotide
  Target: ATXN1; (-) strand; PAM type: YTN; PAM sequence: CTG
gaggccattatccttagcaa

SEQ ID NO: 213592 - DNA, 20 bp, Artificial Sequence
  Description of Artificial Sequence: Synthetic oligonucleotide
  Target: ATXN1; (-) strand; PAM type: YTN; PAM sequence: TTG
caggagtatggaaggagctg

SEQ ID NO: 213593 - DNA, 20 bp, Artificial Sequence
  Description of Artificial Sequence: Synthetic oligonucleotide
  Target: ATXN1; (-) strand; PAM type: YTN; PAM sequence: TTT
gcaggagtatggaaggagct

SEQ ID NO: 213594 - DNA, 20 bp, Artificial Sequence
  Description of Artificial Sequence: Synthetic oligonucleotide
  Target: ATXN1; (-) strand; PAM type: YTN; PAM sequence: TTT
tgcaggagtatggaaggagc

SEQ ID NO: 213595 - DNA, 20 bp, Artificial Sequence
  Description of Artificial Sequence: Synthetic oligonucleotide
  Target: ATXN1; (-) strand; PAM type: YTN; PAM sequence: CTT
ttgcaggagtatggaaggag

SEQ ID NO: 213596 - DNA, 20 bp, Artificial Sequence
  Description of Artificial Sequence: Synthetic oligonucleotide
  Target: ATXN1; (-) strand; PAM type: YTN; PAM sequence: CTA
tgcagccataaaaaaggaat

SEQ ID NO: 213597 - DNA, 20 bp, Artificial Sequence
  Description of Artificial Sequence: Synthetic oligonucleotide
  Target: ATXN1; (-) strand; PAM type: YTN; PAM sequence: TTA
ccatggaatactatgcagcc

SEQ ID NO: 213598 - DNA, 20 bp, Artificial Sequence
  Description of Artificial Sequence: Synthetic oligonucleotide
  Target: ATXN1; (-) strand; PAM type: YTN; PAM sequence: TTG
gacaaaaaaaatgtggtaca

SEQ ID NO: 213599 - DNA, 20 bp, Artificial Sequence
  Description of Artificial Sequence: Synthetic oligonucleotide
  Target: ATXN1; (-) strand; PAM type: YTN; PAM sequence: CTA
aatgcccatcaatgacagat

SEQ ID NO: 213600 - DNA, 20 bp, Artificial Sequence
  Description of Artificial Sequence: Synthetic oligonucleotide
  Target: ATXN1; (-) strand; PAM type: YTN; PAM sequence: TTC
acagtagcaaagacacagaa

SEQ ID NO: 213601 - DNA, 20 bp, Artificial Sequence
  Description of Artificial Sequence: Synthetic oligonucleotide
  Target: ATXN1; (-) strand; PAM type: YTN; PAM sequence: CTA
ttcacagtagcaaagacaca

SEQ ID NO: 213602 - DNA, 20 bp, Artificial Sequence
  Description of Artificial Sequence: Synthetic oligonucleotide
  Target: ATXN1; (-) strand; PAM type: YTN; PAM sequence: TTG
cagcactattcacagtagca

SEQ ID NO: 213603 - DNA, 20 bp, Artificial Sequence
  Description of Artificial Sequence: Synthetic oligonucleotide
  Target: ATXN1; (-) strand; PAM type: YTN; PAM sequence: TTC
attgcagcactattcacagt

SEQ ID NO: 213604 - DNA, 20 bp, Artificial Sequence
  Description of Artificial Sequence: Synthetic oligonucleotide
  Target: ATXN1; (-) strand; PAM type: YTN; PAM sequence: TTA
gacacatgcacgcaaatgtt

SEQ ID NO: 213605 - DNA, 20 bp, Artificial Sequence
  Description of Artificial Sequence: Synthetic oligonucleotide
  Target: ATXN1; (-) strand; PAM type: YTN; PAM sequence: TTT
agacacatgcacgcaaatgt

SEQ ID NO: 213606 - DNA, 20 bp, Artificial Sequence
  Description of Artificial Sequence: Synthetic oligonucleotide
  Target: ATXN1; (-) strand; PAM type: YTN; PAM sequence: CTA
ccataaatttagacacatgc

SEQ ID NO: 213607 - DNA, 20 bp, Artificial Sequence
  Description of Artificial Sequence: Synthetic oligonucleotide
  Target: ATXN1; (-) strand; PAM type: YTN; PAM sequence: TTC
taccataaatttagacacat

SEQ ID NO: 213608 - DNA, 20 bp, Artificial Sequence
  Description of Artificial Sequence: Synthetic oligonucleotide
  Target: ATXN1; (-) strand; PAM type: YTN; PAM sequence: CTA
cccagaggaatataaatcat

SEQ ID NO: 213609 - DNA, 20 bp, Artificial Sequence
  Description of Artificial Sequence: Synthetic oligonucleotide
  Target: ATXN1; (-) strand; PAM type: YTN; PAM sequence: CTG
ggtatctacccagaggaata

SEQ ID NO: 213610 - DNA, 20 bp, Artificial Sequence
  Description of Artificial Sequence: Synthetic oligonucleotide
  Target: ATXN1; (-) strand; PAM type: YTN; PAM sequence: TTA
ctgggtatctacccagagga

SEQ ID NO: 213611 - DNA, 20 bp, Artificial Sequence
  Description of Artificial Sequence: Synthetic oligonucleotide
  Target: ATXN1; (-) strand; PAM type: YTN; PAM sequence: TTC
gacccagcaatcccattact

SEQ ID NO: 213612 - DNA, 20 bp, Artificial Sequence
  Description of Artificial Sequence: Synthetic oligonucleotide
  Target: ATXN1; (-) strand; PAM type: YTN; PAM sequence: CTA
ccattcgacccagcaatccc

SEQ ID NO: 213613 - DNA, 20 bp, Artificial Sequence
  Description of Artificial Sequence: Synthetic oligonucleotide
  Target: ATXN1; (-) strand; PAM type: YTN; PAM sequence: CTA
aaagcagaactaccattcga

SEQ ID NO: 213614 - DNA, 20 bp, Artificial Sequence
  Description of Artificial Sequence: Synthetic oligonucleotide
  Target: ATXN1; (-) strand; PAM type: YTN; PAM sequence: CTG
caaagagctaaaagcagaac

SEQ ID NO: 213615 - DNA, 20 bp, Artificial Sequence
  Description of Artificial Sequence: Synthetic oligonucleotide
  Target: ATXN1; (-) strand; PAM type: YTN; PAM sequence: TTC
tgcaaagagctaaaagcaga

SEQ ID NO: 213616 - DNA, 20 bp, Artificial Sequence
  Description of Artificial Sequence: Synthetic oligonucleotide
  Target: ATXN1; (-) strand; PAM type: YTN; PAM sequence: TTG
tggaaggcagtgtggcaatt

SEQ ID NO: 213617 - DNA, 20 bp, Artificial Sequence
  Description of Artificial Sequence: Synthetic oligonucleotide
  Target: ATXN1; (-) strand; PAM type: YTN; PAM sequence: TTC
agccattgtggaaggcagtg

SEQ ID NO: 213618 - DNA, 20 bp, Artificial Sequence
  Description of Artificial Sequence: Synthetic oligonucleotide
  Target: ATXN1; (-) strand; PAM type: YTN; PAM sequence: TTA
gttcagccattgtggaaggc

SEQ ID NO: 213619 - DNA, 20 bp, Artificial Sequence
  Description of Artificial Sequence: Synthetic oligonucleotide
  Target: ATXN1; (-) strand; PAM type: YTN; PAM sequence: TTG
gtgagtgtacaaattagttc

SEQ ID NO: 213620 - DNA, 20 bp, Artificial Sequence
  Description of Artificial Sequence: Synthetic oligonucleotide
  Target: ATXN1; (-) strand; PAM type: YTN; PAM sequence: CTG
ttggtgagtgtacaaattag

SEQ ID NO: 213621 - DNA, 20 bp, Artificial Sequence
  Description of Artificial Sequence: Synthetic oligonucleotide
  Target: ATXN1; (-) strand; PAM type: YTN; PAM sequence: TTA
tacactgttggtgagtgtac

SEQ ID NO: 213622 - DNA, 20 bp, Artificial Sequence
  Description of Artificial Sequence: Synthetic oligonucleotide
  Target: ATXN1; (-) strand; PAM type: YTN; PAM sequence: CTT
atacactgttggtgagtgta

SEQ ID NO: 213623 - DNA, 20 bp, Artificial Sequence
  Description of Artificial Sequence: Synthetic oligonucleotide
  Target: ATXN1; (-) strand; PAM type: YTN; PAM sequence: TTG
cggagaaagggaacacttat

SEQ ID NO: 213624 - DNA, 20 bp, Artificial Sequence
  Description of Artificial Sequence: Synthetic oligonucleotide
  Target: ATXN1; (-) strand; PAM type: YTN; PAM sequence: CTG
atgaggttgcggagaaaggg

SEQ ID NO: 213625 - DNA, 20 bp, Artificial Sequence
  Description of Artificial Sequence: Synthetic oligonucleotide
  Target: ATXN1; (-) strand; PAM type: YTN; PAM sequence: TTG
gatgctgatgaggttgcgga

SEQ ID NO: 213626 - DNA, 20 bp, Artificial Sequence
  Description of Artificial Sequence: Synthetic oligonucleotide
  Target: ATXN1; (-) strand; PAM type: YTN; PAM sequence: TTA
aaaagtcaaaaaataaccag

SEQ ID NO: 213627 - DNA, 20 bp, Artificial Sequence
  Description of Artificial Sequence: Synthetic oligonucleotide
  Target: ATXN1; (-) strand; PAM type: YTN; PAM sequence: TTG
ttaaaaagtcaaaaaataac

SEQ ID NO: 213628 - DNA, 20 bp, Artificial Sequence
  Description of Artificial Sequence: Synthetic oligonucleotide
  Target: ATXN1; (-) strand; PAM type: YTN; PAM sequence: CTG
ttgttaaaaagtcaaaaaat

SEQ ID NO: 213629 - DNA, 20 bp, Artificial Sequence
  Description of Artificial Sequence: Synthetic oligonucleotide
  Target: ATXN1; (-) strand; PAM type: YTN; PAM sequence: CTC
ataccagtcagaatggctgt

SEQ ID NO: 213630 - DNA, 20 bp, Artificial Sequence
  Description of Artificial Sequence: Synthetic oligonucleotide
  Target: ATXN1; (-) strand; PAM type: YTN; PAM sequence: CTA
tctcataccagtcagaatgg

SEQ ID NO: 213631 - DNA, 20 bp, Artificial Sequence
  Description of Artificial Sequence: Synthetic oligonucleotide
  Target: ATXN1; (-) strand; PAM type: YTN; PAM sequence: TTA
gagcaacgcaaatcaaaagc

SEQ ID NO: 213632 - DNA, 20 bp, Artificial Sequence
  Description of Artificial Sequence: Synthetic oligonucleotide
  Target: ATXN1; (-) strand; PAM type: YTN; PAM sequence: CTG
gtcattagagcaacgcaaat

SEQ ID NO: 213633 - DNA, 20 bp, Artificial Sequence
  Description of Artificial Sequence: Synthetic oligonucleotide
  Target: ATXN1; (-) strand; PAM type: YTN; PAM sequence: CTC
aatatcgctggtcattagag

SEQ ID NO: 213634 - DNA, 20 bp, Artificial Sequence
  Description of Artificial Sequence: Synthetic oligonucleotide
  Target: ATXN1; (-) strand; PAM type: YTN; PAM sequence: TTC
aaaagaagacatatggccaa

SEQ ID NO: 213635 - DNA, 20 bp, Artificial Sequence
  Description of Artificial Sequence: Synthetic oligonucleotide
  Target: ATXN1; (-) strand; PAM type: YTN; PAM sequence: TTT
caaaagaagacatatggcca

SEQ ID NO: 213636 - DNA, 20 bp, Artificial Sequence
  Description of Artificial Sequence: Synthetic oligonucleotide
  Target: ATXN1; (-) strand; PAM type: YTN; PAM sequence: TTT
tcaaaagaagacatatggcc

SEQ ID NO: 213637 - DNA, 20 bp, Artificial Sequence
  Description of Artificial Sequence: Synthetic oligonucleotide
  Target: ATXN1; (-) strand; PAM type: YTN; PAM sequence: CTT
ttcaaaagaagacatatggc

SEQ ID NO: 213638 - DNA, 20 bp, Artificial Sequence
  Description of Artificial Sequence: Synthetic oligonucleotide
  Target: ATXN1; (-) strand; PAM type: YTN; PAM sequence: TTC
aaccccatgaaaaagtgagc

SEQ ID NO: 213639 - DNA, 20 bp, Artificial Sequence
  Description of Artificial Sequence: Synthetic oligonucleotide
  Target: ATXN1; (-) strand; PAM type: YTN; PAM sequence: TTT
caaccccatgaaaaagtgag

SEQ ID NO: 213640 - DNA, 20 bp, Artificial Sequence
  Description of Artificial Sequence: Synthetic oligonucleotide
  Target: ATXN1; (-) strand; PAM type: YTN; PAM sequence: CTT
tcaaccccatgaaaaagtga

SEQ ID NO: 213641 - DNA, 20 bp, Artificial Sequence
  Description of Artificial Sequence: Synthetic oligonucleotide
  Target: ATXN1; (-) strand; PAM type: YTN; PAM sequence: TTA
ctttcaaccccatgaaaaag

SEQ ID NO: 213642 - DNA, 20 bp, Artificial Sequence
  Description of Artificial Sequence: Synthetic oligonucleotide
  Target: ATXN1; (-) strand; PAM type: YTN; PAM sequence: CTC
agggggaggcggggagaagg

SEQ ID NO: 213643 - DNA, 20 bp, Artificial Sequence
  Description of Artificial Sequence: Synthetic oligonucleotide
  Target: ATXN1; (-) strand; PAM type: YTN; PAM sequence: CTG
cctcagggggaggcggggag

SEQ ID NO: 213644 - DNA, 20 bp, Artificial Sequence
  Description of Artificial Sequence: Synthetic oligonucleotide
  Target: ATXN1; (-) strand; PAM type: YTN; PAM sequence: CTC
tgcctcagggggaggcgggg

SEQ ID NO: 213645 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagcatgactctg

SEQ ID NO: 213646 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagagcat

SEQ ID NO: 213647 - DNA, 20 bp, Artificial Sequence
  Description of Artificial Sequence: Synthetic oligonucleotide
  Target: ATXN1; (-) strand; PAM type: YTN; PAM sequence: CTA
tgctccagcctgggtgacag

SEQ ID NO: 213648 - DNA, 20 bp, Artificial Sequence
  Description of Artificial Sequence: Synthetic oligonucleotide
  Target: ATXN1; (-) strand; PAM type: YTN; PAM sequence: TTG
caccactatgctccagcctg

SEQ ID NO: 213649 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagattgcacc

SEQ ID NO: 213650 - DNA, 20 bp, Artificial Sequence
  Description of Artificial Sequence: Synthetic oligonucleotide
  Target: ATXN1; (-) strand; PAM type: YTN; PAM sequence: CTG
ggaggcgaaggttgcagtga

SEQ ID NO: 213651 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggcgaaggttg

SEQ ID NO: 213652 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggcgaaggtt

SEQ ID NO: 213653 - DNA, 20 bp, Artificial Sequence
  Description of Artificial Sequence: Synthetic oligonucleotide
  Target: ATXN1; (-) strand; PAM type: YTN; PAM sequence: TTG
cttgaacctgggaggcgaag

SEQ ID NO: 213654 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaattgcttgaa

SEQ ID NO: 213655 - DNA, 20 bp, Artificial Sequence
  Description of Artificial Sequence: Synthetic oligonucleotide
  Target: ATXN1; (-) strand; PAM type: YTN; PAM sequence: CTA
cgcgggaggctgaggcagga

SEQ ID NO: 213656 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacgcgggag

SEQ ID NO: 213657 - DNA, 20 bp, Artificial Sequence
  Description of Artificial Sequence: Synthetic oligonucleotide
  Target: ATXN1; (-) strand; PAM type: YTN; PAM sequence: CTG
gtggcgagtgcctgtaatcc

SEQ ID NO: 213658 - DNA, 20 bp, Artificial Sequence
  Description of Artificial Sequence: Synthetic oligonucleotide
  Target: ATXN1; (-) strand; PAM type: YTN; PAM sequence: CTG
ggctggtggcgagtgcctgt

SEQ ID NO: 213659 - DNA, 20 bp, Artificial Sequence
  Description of Artificial Sequence: Synthetic oligonucleotide
  Target: ATXN1; (-) strand; PAM type: YTN; PAM sequence: TTA
gctgggctggtggcgagtgc

SEQ ID NO: 213660 - DNA, 20 bp, Artificial Sequence
  Description of Artificial Sequence: Synthetic oligonucleotide
  Target: ATXN1; (-) strand; PAM type: YTN; PAM sequence: CTA
aaaaatacaaaaacaattag

SEQ ID NO: 213661 - DNA, 20 bp, Artificial Sequence
  Description of Artificial Sequence: Synthetic oligonucleotide
  Target: ATXN1; (-) strand; PAM type: YTN; PAM sequence: CTA
ctaaaaaatacaaaaacaat

SEQ ID NO: 213662 - DNA, 20 bp, Artificial Sequence
  Description of Artificial Sequence: Synthetic oligonucleotide
  Target: ATXN1; (-) strand; PAM type: YTN; PAM sequence: CTC
tactaaaaaatacaaaaaca

SEQ ID NO: 213663 - DNA, 20 bp, Artificial Sequence
  Description of Artificial Sequence: Synthetic oligonucleotide
  Target: ATXN1; (-) strand; PAM type: YTN; PAM sequence: TTG
caaacatggtgaaaccccat

SEQ ID NO: 213664 - DNA, 20 bp, Artificial Sequence
  Description of Artificial Sequence: Synthetic oligonucleotide
  Target: ATXN1; (-) strand; PAM type: YTN; PAM sequence: CTT
gcaaacatggtgaaacccca

SEQ ID NO: 213665 - DNA, 20 bp, Artificial Sequence
  Description of Artificial Sequence: Synthetic oligonucleotide
  Target: ATXN1; (-) strand; PAM type: YTN; PAM sequence: TTA
gagaccagccttgcaaacat

SEQ ID NO: 213666 - DNA, 20 bp, Artificial Sequence
  Description of Artificial Sequence: Synthetic oligonucleotide
  Target: ATXN1; (-) strand; PAM type: YTN; PAM sequence: TTG
aaaggccaaggtgggcagat

SEQ ID NO: 213667 - DNA, 20 bp, Artificial Sequence
  Description of Artificial Sequence: Synthetic oligonucleotide
  Target: ATXN1; (-) strand; PAM type: YTN; PAM sequence: TTT
gaaaggccaaggtgggcaga

SEQ ID NO: 213668 - DNA, 20 bp, Artificial Sequence
  Description of Artificial Sequence: Synthetic oligonucleotide
  Target: ATXN1; (-) strand; PAM type: YTN; PAM sequence: CTT
tgaaaggccaaggtgggcag

SEQ ID NO: 213669 - DNA, 20 bp, Artificial Sequence
  Description of Artificial Sequence: Synthetic oligonucleotide
  Target: ATXN1; (-) strand; PAM type: YTN; PAM sequence: TTC
atcccagcactttgaaaggc

SEQ ID NO: 213670 - DNA, 20 bp, Artificial Sequence
  Description of Artificial Sequence: Synthetic oligonucleotide
  Target: ATXN1; (-) strand; PAM type: YTN; PAM sequence: TTT
catcccagcactttgaaagg

SEQ ID NO: 213671 - DNA, 20 bp, Artificial Sequence
  Description of Artificial Sequence: Synthetic oligonucleotide
  Target: ATXN1; (-) strand; PAM type: YTN; PAM sequence: TTT
tcatcccagcactttgaaag

SEQ ID NO: 213672 - DNA, 20 bp, Artificial Sequence
  Description of Artificial Sequence: Synthetic oligonucleotide
  Target: ATXN1; (-) strand; PAM type: YTN; PAM sequence: TTA
ttttcatcccagcactttga

SEQ ID NO: 213673 - DNA, 20 bp, Artificial Sequence
  Description of Artificial Sequence: Synthetic oligonucleotide
  Target: ATXN1; (-) strand; PAM type: YTN; PAM sequence: TTA
aaaaggttattttcatccca

SEQ ID NO: 213674 - DNA, 20 bp, Artificial Sequence
  Description of Artificial Sequence: Synthetic oligonucleotide
  Target: ATXN1; (-) strand; PAM type: YTN; PAM sequence: TTT
aaaaaggttattttcatccc

SEQ ID NO: 213675 - DNA, 20 bp, Artificial Sequence
  Description of Artificial Sequence: Synthetic oligonucleotide
  Target: ATXN1; (-) strand; PAM type: YTN; PAM sequence: TTT
taaaaaggttattttcatcc

SEQ ID NO: 213676 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaggttattttcatc

SEQ ID NO: 213677 - DNA, 20 bp, Artificial Sequence
  Description of Artificial Sequence: Synthetic oligonucleotide
  Target: ATXN1; (-) strand; PAM type: YTN; PAM sequence: CTG
gccgaaatatatatattttt

SEQ ID NO: 213678 - DNA, 20 bp, Artificial Sequence
  Description of Artificial Sequence: Synthetic oligonucleotide
  Target: ATXN1; (-) strand; PAM type: YTN; PAM sequence: TTG
cctggccgaaatatatatat

SEQ ID NO: 213679 - DNA, 20 bp, Artificial Sequence
  Description of Artificial Sequence: Synthetic oligonucleotide
  Target: ATXN1; (-) strand; PAM type: YTN; PAM sequence: CTT
gcctggccgaaatatatata

SEQ ID NO: 213680 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccttgcc

SEQ ID NO: 213681 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgcagggattacag

SEQ ID NO: 213682 - DNA, 20 bp, Artificial Sequence
  Description of Artificial Sequence: Synthetic oligonucleotide
  Target: ATXN1; (-) strand; PAM type: YTN; PAM sequence: TTC
agcctcccaaagtgcaggga

SEQ ID NO: 213683 - DNA, 20 bp, Artificial Sequence
  Description of Artificial Sequence: Synthetic oligonucleotide
  Target: ATXN1; (-) strand; PAM type: YTN; PAM sequence: CTT
cagcctcccaaagtgcaggg

SEQ ID NO: 213684 - DNA, 20 bp, Artificial Sequence
  Description of Artificial Sequence: Synthetic oligonucleotide
  Target: ATXN1; (-) strand; PAM type: YTN; PAM sequence: CTC
aggggatccacccacttcag

SEQ ID NO: 213685 - DNA, 20 bp, Artificial Sequence
  Description of Artificial Sequence: Synthetic oligonucleotide
  Target: ATXN1; (-) strand; PAM type: YTN; PAM sequence: CTG
acctcaggggatccacccac

SEQ ID NO: 213686 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggggatccacc

SEQ ID NO: 213687 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcagggga

SEQ ID NO: 213688 - DNA, 20 bp, Artificial Sequence
  Description of Artificial Sequence: Synthetic oligonucleotide
  Target: ATXN1; (-) strand; PAM type: YTN; PAM sequence: TTG
gccaggatggtctcgaactc

SEQ ID NO: 213689 - DNA, 20 bp, Artificial Sequence
  Description of Artificial Sequence: Synthetic oligonucleotide
  Target: ATXN1; (-) strand; PAM type: YTN; PAM sequence: TTC
atcatgttggccaggatggt

SEQ ID NO: 213690 - DNA, 20 bp, Artificial Sequence
  Description of Artificial Sequence: Synthetic oligonucleotide
  Target: ATXN1; (-) strand; PAM type: YTN; PAM sequence: TTT
catcatgttggccaggatgg

SEQ ID NO: 213691 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcatca

SEQ ID NO: 213692 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcatc

SEQ ID NO: 213693 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcat

SEQ ID NO: 213694 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 213695 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacaggg

SEQ ID NO: 213696 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagg

SEQ ID NO: 213697 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 213698 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 213699 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagac

SEQ ID NO: 213700 - DNA, 20 bp, Artificial Sequence
  Description of Artificial Sequence: Synthetic oligonucleotide
  Target: ATXN1; (-) strand; PAM type: YTN; PAM sequence: CTA
gttttttgtatttttagtag

SEQ ID NO: 213701 - DNA, 20 bp, Artificial Sequence
  Description of Artificial Sequence: Synthetic oligonucleotide
  Target: ATXN1; (-) strand; PAM type: YTN; PAM sequence: TTA
caggcgcacaccaccacgtc

SEQ ID NO: 213702 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgcacaccac

SEQ ID NO: 213703 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 213704 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 213705 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 213706 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccaagta

SEQ ID NO: 213707 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccaag

SEQ ID NO: 213708 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgcctcag

SEQ ID NO: 213709 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcgattctcctgc

SEQ ID NO: 213710 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcgattctcc

SEQ ID NO: 213711 - DNA, 20 bp, Artificial Sequence
  Description of Artificial Sequence: Synthetic oligonucleotide
  Target: ATXN1; (-) strand; PAM type: YTN; PAM sequence: CTG
cctcctgggttcaagcgatt

SEQ ID NO: 213712 - DNA, 20 bp, Artificial Sequence
  Description of Artificial Sequence: Synthetic oligonucleotide
  Target: ATXN1; (-) strand; PAM type: YTN; PAM sequence: CTC
tgcctcctgggttcaagcga

SEQ ID NO: 213713 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcctgggtt

SEQ ID NO: 213714 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctgcctcctg

SEQ ID NO: 213715 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctctgcc

SEQ ID NO: 213716 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgtgatctc

SEQ ID NO: 213717 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcagtgg

SEQ ID NO: 213718 - DNA, 20 bp, Artificial Sequence
  Description of Artificial Sequence: Synthetic oligonucleotide
  Target: ATXN1; (-) strand; PAM type: YTN; PAM sequence: TTG
ttgcccaggctggagtgcag

SEQ ID NO: 213719 - DNA, 20 bp, Artificial Sequence
  Description of Artificial Sequence: Synthetic oligonucleotide
  Target: ATXN1; (-) strand; PAM type: YTN; PAM sequence: TTT
gttgcccaggctggagtgca

SEQ ID NO: 213720 - DNA, 20 bp, Artificial Sequence
  Description of Artificial Sequence: Synthetic oligonucleotide
  Target: ATXN1; (-) strand; PAM type: YTN; PAM sequence: TTT
tgttgcccaggctggagtgc

SEQ ID NO: 213721 - DNA, 20 bp, Artificial Sequence
  Description of Artificial Sequence: Synthetic oligonucleotide
  Target: ATXN1; (-) strand; PAM type: YTN; PAM sequence: CTT
ttgttgcccaggctggagtg

SEQ ID NO: 213722 - DNA, 20 bp, Artificial Sequence
  Description of Artificial Sequence: Synthetic oligonucleotide
  Target: ATXN1; (-) strand; PAM type: YTN; PAM sequence: TTG
cttttgttgcccaggctgga

SEQ ID NO: 213723 - DNA, 20 bp, Artificial Sequence
  Description of Artificial Sequence: Synthetic oligonucleotide
  Target: ATXN1; (-) strand; PAM type: YTN; PAM sequence: TTT
gcttttgttgcccaggctgg

SEQ ID NO: 213724 - DNA, 20 bp, Artificial Sequence
  Description of Artificial Sequence: Synthetic oligonucleotide
  Target: ATXN1; (-) strand; PAM type: YTN; PAM sequence: TTT
tgcttttgttgcccaggctg

SEQ ID NO: 213725 - DNA, 20 bp, Artificial Sequence
  Description of Artificial Sequence: Synthetic oligonucleotide
  Target: ATXN1; (-) strand; PAM type: YTN; PAM sequence: TTG
agatggagttttgcttttgt

SEQ ID NO: 213726 - DNA, 20 bp, Artificial Sequence
  Description of Artificial Sequence: Synthetic oligonucleotide
  Target: ATXN1; (-) strand; PAM type: YTN; PAM sequence: TTT
gagatggagttttgcttttg

SEQ ID NO: 213727 - DNA, 20 bp, Artificial Sequence
  Description of Artificial Sequence: Synthetic oligonucleotide
  Target: ATXN1; (-) strand; PAM type: YTN; PAM sequence: TTT
tgagatggagttttgctttt

SEQ ID NO: 213728 - DNA, 20 bp, Artificial Sequence
  Description of Artificial Sequence: Synthetic oligonucleotide
  Target: ATXN1; (-) strand; PAM type: YTN; PAM sequence: TTT
ttgagatggagttttgcttt

SEQ ID NO: 213729 - DNA, 20 bp, Artificial Sequence
  Description of Artificial Sequence: Synthetic oligonucleotide
  Target: ATXN1; (-) strand; PAM type: YTN; PAM sequence: TTT
tttgagatggagttttgctt

SEQ ID NO: 213730 - DNA, 20 bp, Artificial Sequence
  Description of Artificial Sequence: Synthetic oligonucleotide
  Target: ATXN1; (-) strand; PAM type: YTN; PAM sequence: TTT
ttttgagatggagttttgct

SEQ ID NO: 213731 - DNA, 20 bp, Artificial Sequence
  Description of Artificial Sequence: Synthetic oligonucleotide
  Target: ATXN1; (-) strand; PAM type: YTN; PAM sequence: TTT
tttttgagatggagttttgc

SEQ ID NO: 213732 - DNA, 20 bp, Artificial Sequence
  Description of Artificial Sequence: Synthetic oligonucleotide
  Target: ATXN1; (-) strand; PAM type: YTN; PAM sequence: TTT
ttttttgagatggagttttg

SEQ ID NO: 213733 - DNA, 20 bp, Artificial Sequence
  Description of Artificial Sequence: Synthetic oligonucleotide
  Target: ATXN1; (-) strand; PAM type: YTN; PAM sequence: TTT
tttttttgagatggagtttt

SEQ ID NO: 213734 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagatggagttt

SEQ ID NO: 213735 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagatggagtt

SEQ ID NO: 213736 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagatggagt

SEQ ID NO: 213737 - DNA, 20 bp, Artificial Sequence
  Description of Artificial Sequence: Synthetic oligonucleotide
  Target: ATXN1; (-) strand; PAM type: YTN; PAM sequence: TTG
aatttttttttttttgagat

SEQ ID NO: 213738 - DNA, 20 bp, Artificial Sequence
  Description of Artificial Sequence: Synthetic oligonucleotide
  Target: ATXN1; (-) strand; PAM type: YTN; PAM sequence: TTT
gaatttttttttttttgaga

SEQ ID NO: 213739 - DNA, 20 bp, Artificial Sequence
  Description of Artificial Sequence: Synthetic oligonucleotide
  Target: ATXN1; (-) strand; PAM type: YTN; PAM sequence: TTT
tgaatttttttttttttgag

SEQ ID NO: 213740 - DNA, 20 bp, Artificial Sequence
  Description of Artificial Sequence: Synthetic oligonucleotide
  Target: ATXN1; (-) strand; PAM type: YTN; PAM sequence: TTT
ttgaatttttttttttttga

SEQ ID NO: 213741 - DNA, 20 bp, Artificial Sequence
  Description of Artificial Sequence: Synthetic oligonucleotide
  Target: ATXN1; (-) strand; PAM type: YTN; PAM sequence: TTA
agaaatttttgaattttttt

SEQ ID NO: 213742 - DNA, 20 bp, Artificial Sequence
  Description of Artificial Sequence: Synthetic oligonucleotide
  Target: ATXN1; (-) strand; PAM type: YTN; PAM sequence: CTA
agaaggcaacattaagaaat

SEQ ID NO: 213743 - DNA, 20 bp, Artificial Sequence
  Description of Artificial Sequence: Synthetic oligonucleotide
  Target: ATXN1; (-) strand; PAM type: YTN; PAM sequence: CTC
taagaaggcaacattaagaa

SEQ ID NO: 213744 - DNA, 20 bp, Artificial Sequence
  Description of Artificial Sequence: Synthetic oligonucleotide
  Target: ATXN1; (-) strand; PAM type: YTN; PAM sequence: TTA
tacagactctaagaaggcaa

SEQ ID NO: 213745 - DNA, 20 bp, Artificial Sequence
  Description of Artificial Sequence: Synthetic oligonucleotide
  Target: ATXN1; (-) strand; PAM type: YTN; PAM sequence: TTC
cagaagaaggttatacagac

SEQ ID NO: 213746 - DNA, 20 bp, Artificial Sequence
  Description of Artificial Sequence: Synthetic oligonucleotide
  Target: ATXN1; (-) strand; PAM type: YTN; PAM sequence: TTT
ccagaagaaggttatacaga

SEQ ID NO: 213747 - DNA, 20 bp, Artificial Sequence
  Description of Artificial Sequence: Synthetic oligonucleotide
  Target: ATXN1; (-) strand; PAM type: YTN; PAM sequence: CTT
tccagaagaaggttatacag

SEQ ID NO: 213748 - DNA, 20 bp, Artificial Sequence
  Description of Artificial Sequence: Synthetic oligonucleotide
  Target: ATXN1; (-) strand; PAM type: YTN; PAM sequence: TTG
ccctttccagaagaaggtta

SEQ ID NO: 213749 - DNA, 20 bp, Artificial Sequence
  Description of Artificial Sequence: Synthetic oligonucleotide
  Target: ATXN1; (-) strand; PAM type: YTN; PAM sequence: TTA
aaaaaaattgccctttccag

SEQ ID NO: 213750 - DNA, 20 bp, Artificial Sequence
  Description of Artificial Sequence: Synthetic oligonucleotide
  Target: ATXN1; (-) strand; PAM type: YTN; PAM sequence: CTA
ataaatgggcaagatgttaa

SEQ ID NO: 213751 - DNA, 20 bp, Artificial Sequence
  Description of Artificial Sequence: Synthetic oligonucleotide
  Target: ATXN1; (-) strand; PAM type: YTN; PAM sequence: TTA
taatatctaataaatgggca

SEQ ID NO: 213752 - DNA, 20 bp, Artificial Sequence
  Description of Artificial Sequence: Synthetic oligonucleotide
  Target: ATXN1; (-) strand; PAM type: YTN; PAM sequence: TTT
ataatatctaataaatgggc

SEQ ID NO: 213753 - DNA, 20 bp, Artificial Sequence
  Description of Artificial Sequence: Synthetic oligonucleotide
  Target: ATXN1; (-) strand; PAM type: YTN; PAM sequence: CTT
tataatatctaataaatggg

SEQ ID NO: 213754 - DNA, 20 bp, Artificial Sequence
  Description of Artificial Sequence: Synthetic oligonucleotide
  Target: ATXN1; (-) strand; PAM type: YTN; PAM sequence: TTA
acctttataatatctaataa

SEQ ID NO: 213755 - DNA, 20 bp, Artificial Sequence
  Description of Artificial Sequence: Synthetic oligonucleotide
  Target: ATXN1; (-) strand; PAM type: YTN; PAM sequence: CTT
aacctttataatatctaata

SEQ ID NO: 213756 - DNA, 20 bp, Artificial Sequence
  Description of Artificial Sequence: Synthetic oligonucleotide
  Target: ATXN1; (-) strand; PAM type: YTN; PAM sequence: TTC
atcttaacctttataatatc

SEQ ID NO: 213757 - DNA, 20 bp, Artificial Sequence
  Description of Artificial Sequence: Synthetic oligonucleotide
  Target: ATXN1; (-) strand; PAM type: YTN; PAM sequence: TTT
catcttaacctttataatat

SEQ ID NO: 213758 - DNA, 20 bp, Artificial Sequence
  Description of Artificial Sequence: Synthetic oligonucleotide
  Target: ATXN1; (-) strand; PAM type: YTN; PAM sequence: TTT
tcatcttaacctttataata

SEQ ID NO: 213759 - DNA, 20 bp, Artificial Sequence
  Description of Artificial Sequence: Synthetic oligonucleotide
  Target: ATXN1; (-) strand; PAM type: YTN; PAM sequence: TTG
ggaagcattttcatcttaac

SEQ ID NO: 213760 - DNA, 20 bp, Artificial Sequence
  Description of Artificial Sequence: Synthetic oligonucleotide
  Target: ATXN1; (-) strand; PAM type: YTN; PAM sequence: CTT
gggaagcattttcatcttaa

SEQ ID NO: 213761 - DNA, 20 bp, Artificial Sequence
  Description of Artificial Sequence: Synthetic oligonucleotide
  Target: ATXN1; (-) strand; PAM type: YTN; PAM sequence: TTA
tatgacaggaaaaacatggc

SEQ ID NO: 213762 - DNA, 20 bp, Artificial Sequence
  Description of Artificial Sequence: Synthetic oligonucleotide
  Target: ATXN1; (-) strand; PAM type: YTN; PAM sequence: TTT
atatgacaggaaaaacatgg

SEQ ID NO: 213763 - DNA, 20 bp, Artificial Sequence
  Description of Artificial Sequence: Synthetic oligonucleotide
  Target: ATXN1; (-) strand; PAM type: YTN; PAM sequence: CTG
cccgtacagacatgatttat

SEQ ID NO: 213764 - DNA, 20 bp, Artificial Sequence
  Description of Artificial Sequence: Synthetic oligonucleotide
  Target: ATXN1; (-) strand; PAM type: YTN; PAM sequence: TTC
tgcccgtacagacatgattt

SEQ ID NO: 213765 - DNA, 20 bp, Artificial Sequence
  Description of Artificial Sequence: Synthetic oligonucleotide
  Target: ATXN1; (-) strand; PAM type: YTN; PAM sequence: TTG
tgattctgcccgtacagaca

SEQ ID NO: 213766 - DNA, 20 bp, Artificial Sequence
  Description of Artificial Sequence: Synthetic oligonucleotide
  Target: ATXN1; (-) strand; PAM type: YTN; PAM sequence: TTT
gtgattctgcccgtacagac

SEQ ID NO: 213767 - DNA, 20 bp, Artificial Sequence
  Description of Artificial Sequence: Synthetic oligonucleotide
  Target: ATXN1; (-) strand; PAM type: YTN; PAM sequence: CTT
tgtgattctgcccgtacaga

SEQ ID NO: 213768 - DNA, 20 bp, Artificial Sequence
  Description of Artificial Sequence: Synthetic oligonucleotide
  Target: ATXN1; (-) strand; PAM type: YTN; PAM sequence: CTA
gctttgtgattctgcccgta

SEQ ID NO: 213769 - DNA, 20 bp, Artificial Sequence
  Description of Artificial Sequence: Synthetic oligonucleotide
  Target: ATXN1; (-) strand; PAM type: YTN; PAM sequence: TTC
tagctttgtgattctgcccg

SEQ ID NO: 213770 - DNA, 20 bp, Artificial Sequence
  Description of Artificial Sequence: Synthetic oligonucleotide
  Target: ATXN1; (-) strand; PAM type: YTN; PAM sequence: CTC
agacccattctagctttgtg

SEQ ID NO: 213771 - DNA, 20 bp, Artificial Sequence
  Description of Artificial Sequence: Synthetic oligonucleotide
  Target: ATXN1; (-) strand; PAM type: YTN; PAM sequence: CTG
agaggaggagtcctcagacc

SEQ ID NO: 213772 - DNA, 20 bp, Artificial Sequence
  Description of Artificial Sequence: Synthetic oligonucleotide
  Target: ATXN1; (-) strand; PAM type: YTN; PAM sequence: TTG
cctgagaggaggagtcctca

SEQ ID NO: 213773 - DNA, 20 bp, Artificial Sequence
  Description of Artificial Sequence: Synthetic oligonucleotide
  Target: ATXN1; (-) strand; PAM type: YTN; PAM sequence: TTG
gaaggaagttgcctgagagg

SEQ ID NO: 213774 - DNA, 20 bp, Artificial Sequence
  Description of Artificial Sequence: Synthetic oligonucleotide
  Target: ATXN1; (-) strand; PAM type: YTN; PAM sequence: TTG
ggtgaatcagtgagtgtaag

SEQ ID NO: 213775 - DNA, 20 bp, Artificial Sequence
  Description of Artificial Sequence: Synthetic oligonucleotide
  Target: ATXN1; (-) strand; PAM type: YTN; PAM sequence: CTC
aagagagtcatacaatgcag

SEQ ID NO: 213776 - DNA, 20 bp, Artificial Sequence
  Description of Artificial Sequence: Synthetic oligonucleotide
  Target: ATXN1; (-) strand; PAM type: YTN; PAM sequence: TTG
cctcaagagagtcatacaat

SEQ ID NO: 213777 - DNA, 20 bp, Artificial Sequence
  Description of Artificial Sequence: Synthetic oligonucleotide
  Target: ATXN1; (-) strand; PAM type: YTN; PAM sequence: TTT
gcctcaagagagtcatacaa

SEQ ID NO: 213778 - DNA, 20 bp, Artificial Sequence
  Description of Artificial Sequence: Synthetic oligonucleotide
  Target: ATXN1; (-) strand; PAM type: YTN; PAM sequence: CTG
tttgcctcaagagagtcata

SEQ ID NO: 213779 - DNA, 20 bp, Artificial Sequence
  Description of Artificial Sequence: Synthetic oligonucleotide
  Target: ATXN1; (-) strand; PAM type: YTN; PAM sequence: TTC
ctgtttgcctcaagagagtc

SEQ ID NO: 213780 - DNA, 20 bp, Artificial Sequence
  Description of Artificial Sequence: Synthetic oligonucleotide
  Target: ATXN1; (-) strand; PAM type: YTN; PAM sequence: TTT
cctgtttgcctcaagagagt

SEQ ID NO: 213781 - DNA, 20 bp, Artificial Sequence
  Description of Artificial Sequence: Synthetic oligonucleotide
  Target: ATXN1; (-) strand; PAM type: YTN; PAM sequence: TTT
tcctgtttgcctcaagagag

SEQ ID NO: 213782 - DNA, 20 bp, Artificial Sequence
  Description of Artificial Sequence: Synthetic oligonucleotide
  Target: ATXN1; (-) strand; PAM type: YTN; PAM sequence: TTT
ttcctgtttgcctcaagaga

SEQ ID NO: 213783 - DNA, 20 bp, Artificial Sequence
  Description of Artificial Sequence: Synthetic oligonucleotide
  Target: ATXN1; (-) strand; PAM type: YTN; PAM sequence: TTG
agggcagatacaggtttttc

SEQ ID NO: 213784 - DNA, 20 bp, Artificial Sequence
  Description of Artificial Sequence: Synthetic oligonucleotide
  Target: ATXN1; (-) strand; PAM type: YTN; PAM sequence: CTT
gagggcagatacaggttttt

SEQ ID NO: 213785 - DNA, 20 bp, Artificial Sequence
  Description of Artificial Sequence: Synthetic oligonucleotide
  Target: ATXN1; (-) strand; PAM type: YTN; PAM sequence: CTC
cccttgagggcagatacagg

SEQ ID NO: 213786 - DNA, 20 bp, Artificial Sequence
  Description of Artificial Sequence: Synthetic oligonucleotide
  Target: ATXN1; (-) strand; PAM type: YTN; PAM sequence: CTA
ggagggactccccttgaggg

SEQ ID NO: 213787 - DNA, 20 bp, Artificial Sequence
  Description of Artificial Sequence: Synthetic oligonucleotide
  Target: ATXN1; (-) strand; PAM type: YTN; PAM sequence: CTC
taggagggactccccttgag

SEQ ID NO: 213788 - DNA, 20 bp, Artificial Sequence
  Description of Artificial Sequence: Synthetic oligonucleotide
  Target: ATXN1; (-) strand; PAM type: YTN; PAM sequence: CTC
ctctaggagggactcccctt

SEQ ID NO: 213789 - DNA, 20 bp, Artificial Sequence
  Description of Artificial Sequence: Synthetic oligonucleotide
  Target: ATXN1; (-) strand; PAM type: YTN; PAM sequence: CTA
gtgtcctcctctaggaggga

SEQ ID NO: 213790 - DNA, 20 bp, Artificial Sequence
  Description of Artificial Sequence: Synthetic oligonucleotide
  Target: ATXN1; (-) strand; PAM type: YTN; PAM sequence: TTC
agcataacaacggtatggct

SEQ ID NO: 213791 - DNA, 20 bp, Artificial Sequence
  Description of Artificial Sequence: Synthetic oligonucleotide
  Target: ATXN1; (-) strand; PAM type: YTN; PAM sequence: CTT
cagcataacaacggtatggc

SEQ ID NO: 213792 - DNA, 20 bp, Artificial Sequence
  Description of Artificial Sequence: Synthetic oligonucleotide
  Target: ATXN1; (-) strand; PAM type: YTN; PAM sequence: CTC
gcaacttcagcataacaacg

SEQ ID NO: 213793 - DNA, 20 bp, Artificial Sequence
  Description of Artificial Sequence: Synthetic oligonucleotide
  Target: ATXN1; (-) strand; PAM type: YTN; PAM sequence: CTG
taaatggacctcgcaacttc

SEQ ID NO: 213794 - DNA, 20 bp, Artificial Sequence
  Description of Artificial Sequence: Synthetic oligonucleotide
  Target: ATXN1; (-) strand; PAM type: YTN; PAM sequence: TTC
tgtaaatggacctcgcaact

SEQ ID NO: 213795 - DNA, 20 bp, Artificial Sequence
  Description of Artificial Sequence: Synthetic oligonucleotide
  Target: ATXN1; (-) strand; PAM type: YTN; PAM sequence: CTG
gttctgtaaatggacctcgc

SEQ ID NO: 213796 - DNA, 20 bp, Artificial Sequence
  Description of Artificial Sequence: Synthetic oligonucleotide
  Target: ATXN1; (-) strand; PAM type: YTN; PAM sequence: CTA
agtgataaggctggttctgt

SEQ ID NO: 213797 - DNA, 20 bp, Artificial Sequence
  Description of Artificial Sequence: Synthetic oligonucleotide
  Target: ATXN1; (-) strand; PAM type: YTN; PAM sequence: TTG
ctaagtgataaggctggttc

SEQ ID NO: 213798 - DNA, 20 bp, Artificial Sequence
  Description of Artificial Sequence: Synthetic oligonucleotide
  Target: ATXN1; (-) strand; PAM type: YTN; PAM sequence: CTA
tattgctaagtgataaggct

SEQ ID NO: 213799 - DNA, 20 bp, Artificial Sequence
  Description of Artificial Sequence: Synthetic oligonucleotide
  Target: ATXN1; (-) strand; PAM type: YTN; PAM sequence: TTA
tgggtatgtgggctatattg

SEQ ID NO: 213800 - DNA, 20 bp, Artificial Sequence
  Description of Artificial Sequence: Synthetic oligonucleotide
  Target: ATXN1; (-) strand; PAM type: YTN; PAM sequence: TTT
atgggtatgtgggctatatt

SEQ ID NO: 213801 - DNA, 20 bp, Artificial Sequence
  Description of Artificial Sequence: Synthetic oligonucleotide
  Target: ATXN1; (-) strand; PAM type: YTN; PAM sequence: TTT
tatgggtatgtgggctatat

SEQ ID NO: 213802 - DNA, 20 bp, Artificial Sequence
  Description of Artificial Sequence: Synthetic oligonucleotide
  Target: ATXN1; (-) strand; PAM type: YTN; PAM sequence: TTT
ttatgggtatgtgggctata

SEQ ID NO: 213803 - DNA, 20 bp, Artificial Sequence
  Description of Artificial Sequence: Synthetic oligonucleotide
  Target: ATXN1; (-) strand; PAM type: YTN; PAM sequence: TTT
tttatgggtatgtgggctat

SEQ ID NO: 213804 - DNA, 20 bp, Artificial Sequence
  Description of Artificial Sequence: Synthetic oligonucleotide
  Target: ATXN1; (-) strand; PAM type: YTN; PAM sequence: TTT
ttttatgggtatgtgggcta

SEQ ID NO: 213805 - DNA, 20 bp, Artificial Sequence
  Description of Artificial Sequence: Synthetic oligonucleotide
  Target: ATXN1; (-) strand; PAM type: YTN; PAM sequence: TTG
aatttttttatgggtatgtg

SEQ ID NO: 213806 - DNA, 20 bp, Artificial Sequence
  Description of Artificial Sequence: Synthetic oligonucleotide
  Target: ATXN1; (-) strand; PAM type: YTN; PAM sequence: CTT
gaatttttttatgggtatgt

SEQ ID NO: 213807 - DNA, 20 bp, Artificial Sequence
  Description of Artificial Sequence: Synthetic oligonucleotide
  Target: ATXN1; (-) strand; PAM type: YTN; PAM sequence: TTA
ggcccttgaatttttttatg

SEQ ID NO: 213808 - DNA, 20 bp, Artificial Sequence
  Description of Artificial Sequence: Synthetic oligonucleotide
  Target: ATXN1; (-) strand; PAM type: YTN; PAM sequence: CTT
aggcccttgaatttttttat

SEQ ID NO: 213809 - DNA, 20 bp, Artificial Sequence
  Description of Artificial Sequence: Synthetic oligonucleotide
  Target: ATXN1; (-) strand; PAM type: YTN; PAM sequence: CTC
acttaggcccttgaattttt

SEQ ID NO: 213810 - DNA, 20 bp, Artificial Sequence
  Description of Artificial Sequence: Synthetic oligonucleotide
  Target: ATXN1; (-) strand; PAM type: YTN; PAM sequence: TTA
tcatccactcacttaggccc

SEQ ID NO: 213811 - DNA, 20 bp, Artificial Sequence
  Description of Artificial Sequence: Synthetic oligonucleotide
  Target: ATXN1; (-) strand; PAM type: YTN; PAM sequence: TTG
gaccacattatcatccactc

SEQ ID NO: 213812 - DNA, 20 bp, Artificial Sequence
  Description of Artificial Sequence: Synthetic oligonucleotide
  Target: ATXN1; (-) strand; PAM type: YTN; PAM sequence: TTT
ggaccacattatcatccact

SEQ ID NO: 213813 - DNA, 20 bp, Artificial Sequence
  Description of Artificial Sequence: Synthetic oligonucleotide
  Target: ATXN1; (-) strand; PAM type: YTN; PAM sequence: CTT
tggaccacattatcatccac

SEQ ID NO: 213814 - DNA, 20 bp, Artificial Sequence
  Description of Artificial Sequence: Synthetic oligonucleotide
  Target: ATXN1; (-) strand; PAM type: YTN; PAM sequence: CTG
tgcacacctttggaccacat

SEQ ID NO: 213815 - DNA, 20 bp, Artificial Sequence
  Description of Artificial Sequence: Synthetic oligonucleotide
  Target: ATXN1; (-) strand; PAM type: YTN; PAM sequence: CTC
agcatatgtctgtgcacacc

SEQ ID NO: 213816 - DNA, 20 bp, Artificial Sequence
  Description of Artificial Sequence: Synthetic oligonucleotide
  Target: ATXN1; (-) strand; PAM type: YTN; PAM sequence: CTA
agtgactcagcatatgtctg

SEQ ID NO: 213817 - DNA, 20 bp, Artificial Sequence
  Description of Artificial Sequence: Synthetic oligonucleotide
  Target: ATXN1; (-) strand; PAM type: YTN; PAM sequence: TTG
atcagcccactaagtgactc

SEQ ID NO: 213818 - DNA, 20 bp, Artificial Sequence
  Description of Artificial Sequence: Synthetic oligonucleotide
  Target: ATXN1; (-) strand; PAM type: YTN; PAM sequence: CTG
ttgatcagcccactaagtga

SEQ ID NO: 213819 - DNA, 20 bp, Artificial Sequence
  Description of Artificial Sequence: Synthetic oligonucleotide
  Target: ATXN1; (-) strand; PAM type: YTN; PAM sequence: CTC
catgaatcccctgttgatca

SEQ ID NO: 213820 - DNA, 20 bp, Artificial Sequence
  Description of Artificial Sequence: Synthetic oligonucleotide
  Target: ATXN1; (-) strand; PAM type: YTN; PAM sequence: TTC
ctccatgaatcccctgttga

SEQ ID NO: 213821 - DNA, 20 bp, Artificial Sequence
  Description of Artificial Sequence: Synthetic oligonucleotide
  Target: ATXN1; (-) strand; PAM type: YTN; PAM sequence: TTT
cctccatgaatcccctgttg

SEQ ID NO: 213822 - DNA, 20 bp, Artificial Sequence
  Description of Artificial Sequence: Synthetic oligonucleotide
  Target: ATXN1; (-) strand; PAM type: YTN; PAM sequence: TTT
tcctccatgaatcccctgtt

SEQ ID NO: 213823 - DNA, 20 bp, Artificial Sequence
  Description of Artificial Sequence: Synthetic oligonucleotide
  Target: ATXN1; (-) strand; PAM type: YTN; PAM sequence: CTT
ttcctccatgaatcccctgt

SEQ ID NO: 213824 - DNA, 20 bp, Artificial Sequence
  Description of Artificial Sequence: Synthetic oligonucleotide
  Target: ATXN1; (-) strand; PAM type: YTN; PAM sequence: TTA
gcttttcctccatgaatccc

SEQ ID NO: 213825 - DNA, 20 bp, Artificial Sequence
  Description of Artificial Sequence: Synthetic oligonucleotide
  Target: ATXN1; (-) strand; PAM type: YTN; PAM sequence: CTG
ttagcttttcctccatgaat

SEQ ID NO: 213826 - DNA, 20 bp, Artificial Sequence
  Description of Artificial Sequence: Synthetic oligonucleotide
  Target: ATXN1; (-) strand; PAM type: YTN; PAM sequence: TTC
tgttagcttttcctccatga

SEQ ID NO: 213827 - DNA, 20 bp, Artificial Sequence
  Description of Artificial Sequence: Synthetic oligonucleotide
  Target: ATXN1; (-) strand; PAM type: YTN; PAM sequence: CTT
ctgttagcttttcctccatg

SEQ ID NO: 213828 - DNA, 20 bp, Artificial Sequence
  Description of Artificial Sequence: Synthetic oligonucleotide
  Target: ATXN1; (-) strand; PAM type: YTN; PAM sequence: TTG
gagtggtcacttctgttagc

SEQ ID NO: 213829 - DNA, 20 bp, Artificial Sequence
  Description of Artificial Sequence: Synthetic oligonucleotide
  Target: ATXN1; (-) strand; PAM type: YTN; PAM sequence: CTG
atatcatcaatgcattggag

SEQ ID NO: 213830 - DNA, 20 bp, Artificial Sequence
  Description of Artificial Sequence: Synthetic oligonucleotide
  Target: ATXN1; (-) strand; PAM type: YTN; PAM sequence: CTC
tgatatcatcaatgcattgg

SEQ ID NO: 213831 - DNA, 20 bp, Artificial Sequence
  Description of Artificial Sequence: Synthetic oligonucleotide
  Target: ATXN1; (-) strand; PAM type: YTN; PAM sequence: CTG
tcatgctctgatatcatcaa

SEQ ID NO: 213832 - DNA, 20 bp, Artificial Sequence
  Description of Artificial Sequence: Synthetic oligonucleotide
  Target: ATXN1; (-) strand; PAM type: YTN; PAM sequence: TTG
acctgtcatgctctgatatc

SEQ ID NO: 213833 - DNA, 20 bp, Artificial Sequence
  Description of Artificial Sequence: Synthetic oligonucleotide
  Target: ATXN1; (-) strand; PAM type: YTN; PAM sequence: CTT
gacctgtcatgctctgatat

SEQ ID NO: 213834 - DNA, 20 bp, Artificial Sequence
  Description of Artificial Sequence: Synthetic oligonucleotide
  Target: ATXN1; (-) strand; PAM type: YTN; PAM sequence: CTC
ttgacctgtcatgctctgat

SEQ ID NO: 213835 - DNA, 20 bp, Artificial Sequence
  Description of Artificial Sequence: Synthetic oligonucleotide
  Target: ATXN1; (-) strand; PAM type: YTN; PAM sequence: CTC
tcttgacctgtcatgctctg

SEQ ID NO: 213836 - DNA, 20 bp, Artificial Sequence
  Description of Artificial Sequence: Synthetic oligonucleotide
  Target: ATXN1; (-) strand; PAM type: YTN; PAM sequence: TTG
caggaggctctcttgacctg

SEQ ID NO: 213837 - DNA, 20 bp, Artificial Sequence
  Description of Artificial Sequence: Synthetic oligonucleotide
  Target: ATXN1; (-) strand; PAM type: YTN; PAM sequence: CTT
gcaggaggctctcttgacct

SEQ ID NO: 213838 - DNA, 20 bp, Artificial Sequence
  Description of Artificial Sequence: Synthetic oligonucleotide
  Target: ATXN1; (-) strand; PAM type: YTN; PAM sequence: TTG
agcagatgatgacttgcagg

SEQ ID NO: 213839 - DNA, 20 bp, Artificial Sequence
  Description of Artificial Sequence: Synthetic oligonucleotide
  Target: ATXN1; (-) strand; PAM type: YTN; PAM sequence: TTC
acagttgagcagatgatgac

SEQ ID NO: 213840 - DNA, 20 bp, Artificial Sequence
  Description of Artificial Sequence: Synthetic oligonucleotide
  Target: ATXN1; (-) strand; PAM type: YTN; PAM sequence: CTC
agatgccgattcacagttga

SEQ ID NO: 213841 - DNA, 20 bp, Artificial Sequence
  Description of Artificial Sequence: Synthetic oligonucleotide
  Target: ATXN1; (-) strand; PAM type: YTN; PAM sequence: TTC
tcagatgccgattcacagtt

SEQ ID NO: 213842 - DNA, 20 bp, Artificial Sequence
  Description of Artificial Sequence: Synthetic oligonucleotide
  Target: ATXN1; (-) strand; PAM type: YTN; PAM sequence: TTT
ctcagatgccgattcacagt

SEQ ID NO: 213843 - DNA, 20 bp, Artificial Sequence
  Description of Artificial Sequence: Synthetic oligonucleotide
  Target: ATXN1; (-) strand; PAM type: YTN; PAM sequence: TTT
tctcagatgccgattcacag

SEQ ID NO: 213844 - DNA, 20 bp, Artificial Sequence
  Description of Artificial Sequence: Synthetic oligonucleotide
  Target: ATXN1; (-) strand; PAM type: YTN; PAM sequence: TTA
ttttctcagatgccgattca

SEQ ID NO: 213845 - DNA, 20 bp, Artificial Sequence
  Description of Artificial Sequence: Synthetic oligonucleotide
  Target: ATXN1; (-) strand; PAM type: YTN; PAM sequence: CTT
attttctcagatgccgattc

SEQ ID NO: 213846 - DNA, 20 bp, Artificial Sequence
  Description of Artificial Sequence: Synthetic oligonucleotide
  Target: ATXN1; (-) strand; PAM type: YTN; PAM sequence: TTG
cttattttctcagatgccga

SEQ ID NO: 213847 - DNA, 20 bp, Artificial Sequence
  Description of Artificial Sequence: Synthetic oligonucleotide
  Target: ATXN1; (-) strand; PAM type: YTN; PAM sequence: TTG
ttgcttattttctcagatgc

SEQ ID NO: 213848 - DNA, 20 bp, Artificial Sequence
  Description of Artificial Sequence: Synthetic oligonucleotide
  Target: ATXN1; (-) strand; PAM type: YTN; PAM sequence: TTG
ggaggtaaggttgttgctta

SEQ ID NO: 213849 - DNA, 20 bp, Artificial Sequence
  Description of Artificial Sequence: Synthetic oligonucleotide
  Target: ATXN1; (-) strand; PAM type: YTN; PAM sequence: TTT
gggaggtaaggttgttgctt

SEQ ID NO: 213850 - DNA, 20 bp, Artificial Sequence
  Description of Artificial Sequence: Synthetic oligonucleotide
  Target: ATXN1; (-) strand; PAM type: YTN; PAM sequence: TTG
gtgtttgggaggtaaggttg

SEQ ID NO: 213851 - DNA, 20 bp, Artificial Sequence
  Description of Artificial Sequence: Synthetic oligonucleotide
  Target: ATXN1; (-) strand; PAM type: YTN; PAM sequence: TTA
atgttggtgtttgggaggta

SEQ ID NO: 213852 - DNA, 20 bp, Artificial Sequence
  Description of Artificial Sequence: Synthetic oligonucleotide
  Target: ATXN1; (-) strand; PAM type: YTN; PAM sequence: TTT
aatgttggtgtttgggaggt

SEQ ID NO: 213853 - DNA, 20 bp, Artificial Sequence
  Description of Artificial Sequence: Synthetic oligonucleotide
  Target: ATXN1; (-) strand; PAM type: YTN; PAM sequence: CTT
taatgttggtgtttgggagg

SEQ ID NO: 213854 - DNA, 20 bp, Artificial Sequence
  Description of Artificial Sequence: Synthetic oligonucleotide
  Target: ATXN1; (-) strand; PAM type: YTN; PAM sequence: TTG
ctttaatgttggtgtttggg

SEQ ID NO: 213855 - DNA, 20 bp, Artificial Sequence
  Description of Artificial Sequence: Synthetic oligonucleotide
  Target: ATXN1; (-) strand; PAM type: YTN; PAM sequence: TTA
ataatgcattgctttaatgt

SEQ ID NO: 213856 - DNA, 20 bp, Artificial Sequence
  Description of Artificial Sequence: Synthetic oligonucleotide
  Target: ATXN1; (-) strand; PAM type: YTN; PAM sequence: TTT
aataatgcattgctttaatg

SEQ ID NO: 213857 - DNA, 20 bp, Artificial Sequence
  Description of Artificial Sequence: Synthetic oligonucleotide
  Target: ATXN1; (-) strand; PAM type: YTN; PAM sequence: TTT
taataatgcattgctttaat

SEQ ID NO: 213858 - DNA, 20 bp, Artificial Sequence
  Description of Artificial Sequence: Synthetic oligonucleotide
  Target: ATXN1; (-) strand; PAM type: YTN; PAM sequence: CTC
cattttaataatgcattgct

SEQ ID NO: 213859 - DNA, 20 bp, Artificial Sequence
  Description of Artificial Sequence: Synthetic oligonucleotide
  Target: ATXN1; (-) strand; PAM type: YTN; PAM sequence: CTG
agaacctccattttaataat

SEQ ID NO: 213860 - DNA, 20 bp, Artificial Sequence
  Description of Artificial Sequence: Synthetic oligonucleotide
  Target: ATXN1; (-) strand; PAM type: YTN; PAM sequence: CTA
cctgagaacctccattttaa

SEQ ID NO: 213861 - DNA, 20 bp, Artificial Sequence
  Description of Artificial Sequence: Synthetic oligonucleotide
  Target: ATXN1; (-) strand; PAM type: YTN; PAM sequence: TTA
ctacctgagaacctccattt

SEQ ID NO: 213862 - DNA, 20 bp, Artificial Sequence
  Description of Artificial Sequence: Synthetic oligonucleotide
  Target: ATXN1; (-) strand; PAM type: YTN; PAM sequence: TTT
actacctgagaacctccatt

SEQ ID NO: 213863 - DNA, 20 bp, Artificial Sequence
  Description of Artificial Sequence: Synthetic oligonucleotide
  Target: ATXN1; (-) strand; PAM type: YTN; PAM sequence: TTC
atttactacctgagaacctc

SEQ ID NO: 213864 - DNA, 20 bp, Artificial Sequence
  Description of Artificial Sequence: Synthetic oligonucleotide
  Target: ATXN1; (-) strand; PAM type: YTN; PAM sequence: TTA
aagtgttcatttactacctg

SEQ ID NO: 213865 - DNA, 20 bp, Artificial Sequence
  Description of Artificial Sequence: Synthetic oligonucleotide
  Target: ATXN1; (-) strand; PAM type: YTN; PAM sequence: TTT
aaagtgttcatttactacct

SEQ ID NO: 213866 - DNA, 20 bp, Artificial Sequence
  Description of Artificial Sequence: Synthetic oligonucleotide
  Target: ATXN1; (-) strand; PAM type: YTN; PAM sequence: TTT
taaagtgttcatttactacc

SEQ ID NO: 213867 - DNA, 20 bp, Artificial Sequence
  Description of Artificial Sequence: Synthetic oligonucleotide
  Target: ATXN1; (-) strand; PAM type: YTN; PAM sequence: TTG
catgagttttaaagtgttca

SEQ ID NO: 213868 - DNA, 20 bp, Artificial Sequence
  Description of Artificial Sequence: Synthetic oligonucleotide
  Target: ATXN1; (-) strand; PAM type: YTN; PAM sequence: TTA
tgattgcatgagttttaaag

SEQ ID NO: 213869 - DNA, 20 bp, Artificial Sequence
  Description of Artificial Sequence: Synthetic oligonucleotide
  Target: ATXN1; (-) strand; PAM type: YTN; PAM sequence: TTT
atgattgcatgagttttaaa

SEQ ID NO: 213870 - DNA, 20 bp, Artificial Sequence
  Description of Artificial Sequence: Synthetic oligonucleotide
  Target: ATXN1; (-) strand; PAM type: YTN; PAM sequence: CTA
atgtttatgattgcatgagt

SEQ ID NO: 213871 - DNA, 20 bp, Artificial Sequence
  Description of Artificial Sequence: Synthetic oligonucleotide
  Target: ATXN1; (-) strand; PAM type: YTN; PAM sequence: TTC
taatgtttatgattgcatga

SEQ ID NO: 213872 - DNA, 20 bp, Artificial Sequence
  Description of Artificial Sequence: Synthetic oligonucleotide
  Target: ATXN1; (-) strand; PAM type: YTN; PAM sequence: CTG
catattctaatgtttatgat

SEQ ID NO: 213873 - DNA, 20 bp, Artificial Sequence
  Description of Artificial Sequence: Synthetic oligonucleotide
  Target: ATXN1; (-) strand; PAM type: YTN; PAM sequence: TTG
ctgcatattctaatgtttat

SEQ ID NO: 213874 - DNA, 20 bp, Artificial Sequence
  Description of Artificial Sequence: Synthetic oligonucleotide
  Target: ATXN1; (-) strand; PAM type: YTN; PAM sequence: TTT
gctgcatattctaatgttta

SEQ ID NO: 213875 - DNA, 20 bp, Artificial Sequence
  Description of Artificial Sequence: Synthetic oligonucleotide
  Target: ATXN1; (-) strand; PAM type: YTN; PAM sequence: CTT
tgctgcatattctaatgttt

SEQ ID NO: 213876 - DNA, 20 bp, Artificial Sequence
  Description of Artificial Sequence: Synthetic oligonucleotide
  Target: ATXN1; (-) strand; PAM type: YTN; PAM sequence: CTC
tttgctgcatattctaatgt

SEQ ID NO: 213877 - DNA, 20 bp, Artificial Sequence
  Description of Artificial Sequence: Synthetic oligonucleotide
  Target: ATXN1; (-) strand; PAM type: YTN; PAM sequence: TTA
tctctttgctgcatattcta

SEQ ID NO: 213878 - DNA, 20 bp, Artificial Sequence
  Description of Artificial Sequence: Synthetic oligonucleotide
  Target: ATXN1; (-) strand; PAM type: YTN; PAM sequence: CTG
acaagtatcattatctcttt

SEQ ID NO: 213879 - DNA, 20 bp, Artificial Sequence
  Description of Artificial Sequence: Synthetic oligonucleotide
  Target: ATXN1; (-) strand; PAM type: YTN; PAM sequence: TTC
tgacaagtatcattatctct

SEQ ID NO: 213880 - DNA, 20 bp, Artificial Sequence
  Description of Artificial Sequence: Synthetic oligonucleotide
  Target: ATXN1; (-) strand; PAM type: YTN; PAM sequence: CTT
ctgacaagtatcattatctc

SEQ ID NO: 213881 - DNA, 20 bp, Artificial Sequence
  Description of Artificial Sequence: Synthetic oligonucleotide
  Target: ATXN1; (-) strand; PAM type: YTN; PAM sequence: TTA
atatcttctgacaagtatca

SEQ ID NO: 213882 - DNA, 20 bp, Artificial Sequence
  Description of Artificial Sequence: Synthetic oligonucleotide
  Target: ATXN1; (-) strand; PAM type: YTN; PAM sequence: CTT
aatatcttctgacaagtatc

SEQ ID NO: 213883 - DNA, 20 bp, Artificial Sequence
  Description of Artificial Sequence: Synthetic oligonucleotide
  Target: ATXN1; (-) strand; PAM type: YTN; PAM sequence: TTG
ccatgtcgtcttaatatctt

SEQ ID NO: 213884 - DNA, 20 bp, Artificial Sequence
  Description of Artificial Sequence: Synthetic oligonucleotide
  Target: ATXN1; (-) strand; PAM type: YTN; PAM sequence: TTA
ttgccatgtcgtcttaatat

SEQ ID NO: 213885 - DNA, 20 bp, Artificial Sequence
  Description of Artificial Sequence: Synthetic oligonucleotide
  Target: ATXN1; (-) strand; PAM type: YTN; PAM sequence: TTT
attgccatgtcgtcttaata

SEQ ID NO: 213886 - DNA, 20 bp, Artificial Sequence
  Description of Artificial Sequence: Synthetic oligonucleotide
  Target: ATXN1; (-) strand; PAM type: YTN; PAM sequence: TTT
tattgccatgtcgtcttaat

SEQ ID NO: 213887 - DNA, 20 bp, Artificial Sequence
  Description of Artificial Sequence: Synthetic oligonucleotide
  Target: ATXN1; (-) strand; PAM type: YTN; PAM sequence: CTT
ttattgccatgtcgtcttaa

SEQ ID NO: 213888 - DNA, 20 bp, Artificial Sequence
  Description of Artificial Sequence: Synthetic oligonucleotide
  Target: ATXN1; (-) strand; PAM type: YTN; PAM sequence: TTC
cttttattgccatgtcgtct

SEQ ID NO: 213889 - DNA, 20 bp, Artificial Sequence
  Description of Artificial Sequence: Synthetic oligonucleotide
  Target: ATXN1; (-) strand; PAM type: YTN; PAM sequence: CTG
tgaacagattccttttattg

SEQ ID NO: 213890 - DNA, 20 bp, Artificial Sequence
  Description of Artificial Sequence: Synthetic oligonucleotide
  Target: ATXN1; (-) strand; PAM type: YTN; PAM sequence: CTC
tgtgaacagattccttttat

SEQ ID NO: 213891 - DNA, 20 bp, Artificial Sequence
  Description of Artificial Sequence: Synthetic oligonucleotide
  Target: ATXN1; (-) strand; PAM type: YTN; PAM sequence: CTC
tctgtgaacagattcctttt

SEQ ID NO: 213892 - DNA, 20 bp, Artificial Sequence
  Description of Artificial Sequence: Synthetic oligonucleotide
  Target: ATXN1; (-) strand; PAM type: YTN; PAM sequence: TTC
tctctgtgaacagattcctt

SEQ ID NO: 213893 - DNA, 20 bp, Artificial Sequence
  Description of Artificial Sequence: Synthetic oligonucleotide
  Target: ATXN1; (-) strand; PAM type: YTN; PAM sequence: TTA
gaatcattctctctgtgaac

SEQ ID NO: 213894 - DNA, 20 bp, Artificial Sequence
  Description of Artificial Sequence: Synthetic oligonucleotide
  Target: ATXN1; (-) strand; PAM type: YTN; PAM sequence: TTT
agaatcattctctctgtgaa

SEQ ID NO: 213895 - DNA, 20 bp, Artificial Sequence
  Description of Artificial Sequence: Synthetic oligonucleotide
  Target: ATXN1; (-) strand; PAM type: YTN; PAM sequence: TTG
tatttagaatcattctctct

SEQ ID NO: 213896 - DNA, 20 bp, Artificial Sequence
  Description of Artificial Sequence: Synthetic oligonucleotide
  Target: ATXN1; (-) strand; PAM type: YTN; PAM sequence: TTT
gtatttagaatcattctctc

SEQ ID NO: 213897 - DNA, 20 bp, Artificial Sequence
  Description of Artificial Sequence: Synthetic oligonucleotide
  Target: ATXN1; (-) strand; PAM type: YTN; PAM sequence: TTT
tgtatttagaatcattctct

SEQ ID NO: 213898 - DNA, 20 bp, Artificial Sequence
  Description of Artificial Sequence: Synthetic oligonucleotide
  Target: ATXN1; (-) strand; PAM type: YTN; PAM sequence: CTG
accattttgtatttagaatc

SEQ ID NO: 213899 - DNA, 20 bp, Artificial Sequence
  Description of Artificial Sequence: Synthetic oligonucleotide
  Target: ATXN1; (-) strand; PAM type: YTN; PAM sequence: CTG
agtatcaatctgaccatttt

SEQ ID NO: 213900 - DNA, 20 bp, Artificial Sequence
  Description of Artificial Sequence: Synthetic oligonucleotide
  Target: ATXN1; (-) strand; PAM type: YTN; PAM sequence: TTC
tgagtatcaatctgaccatt

SEQ ID NO: 213901 - DNA, 20 bp, Artificial Sequence
  Description of Artificial Sequence: Synthetic oligonucleotide
  Target: ATXN1; (-) strand; PAM type: YTN; PAM sequence: CTT
ctgagtatcaatctgaccat

SEQ ID NO: 213902 - DNA, 20 bp, Artificial Sequence
  Description of Artificial Sequence: Synthetic oligonucleotide
  Target: ATXN1; (-) strand; PAM type: YTN; PAM sequence: TTA
atagcaatacttctgagtat

SEQ ID NO: 213903 - DNA, 20 bp, Artificial Sequence
  Description of Artificial Sequence: Synthetic oligonucleotide
  Target: ATXN1; (-) strand; PAM type: YTN; PAM sequence: CTA
ttaatagcaatacttctgag

SEQ ID NO: 213904 - DNA, 20 bp, Artificial Sequence
  Description of Artificial Sequence: Synthetic oligonucleotide
  Target: ATXN1; (-) strand; PAM type: YTN; PAM sequence: TTC
tattaatagcaatacttctg

SEQ ID NO: 213905 - DNA, 20 bp, Artificial Sequence
  Description of Artificial Sequence: Synthetic oligonucleotide
  Target: ATXN1; (-) strand; PAM type: YTN; PAM sequence: TTT
ctattaatagcaatacttct

SEQ ID NO: 213906 - DNA, 20 bp, Artificial Sequence
  Description of Artificial Sequence: Synthetic oligonucleotide
  Target: ATXN1; (-) strand; PAM type: YTN; PAM sequence: TTA
tttctattaatagcaatact

SEQ ID NO: 213907 - DNA, 20 bp, Artificial Sequence
  Description of Artificial Sequence: Synthetic oligonucleotide
  Target: ATXN1; (-) strand; PAM type: YTN; PAM sequence: CTA
atattatttctattaatagc

SEQ ID NO: 213908 - DNA, 20 bp, Artificial Sequence
  Description of Artificial Sequence: Synthetic oligonucleotide
  Target: ATXN1; (-) strand; PAM type: YTN; PAM sequence: CTC
taatattatttctattaata

SEQ ID NO: 213909 - DNA, 20 bp, Artificial Sequence
  Description of Artificial Sequence: Synthetic oligonucleotide
  Target: ATXN1; (-) strand; PAM type: YTN; PAM sequence: CTC
tctaatattatttctattaa

SEQ ID NO: 213910 - DNA, 20 bp, Artificial Sequence
  Description of Artificial Sequence: Synthetic oligonucleotide
  Target: ATXN1; (-) strand; PAM type: YTN; PAM sequence: TTA
cataatgaaacctctctaat

SEQ ID NO: 213911 - DNA, 20 bp, Artificial Sequence
  Description of Artificial Sequence: Synthetic oligonucleotide
  Target: ATXN1; (-) strand; PAM type: YTN; PAM sequence: TTT
acataatgaaacctctctaa

SEQ ID NO: 213912 - DNA, 20 bp, Artificial Sequence
  Description of Artificial Sequence: Synthetic oligonucleotide
  Target: ATXN1; (-) strand; PAM type: YTN; PAM sequence: CTG
gcagacacatgagccattta

SEQ ID NO: 213913 - DNA, 20 bp, Artificial Sequence
  Description of Artificial Sequence: Synthetic oligonucleotide
  Target: ATXN1; (-) strand; PAM type: YTN; PAM sequence: TTC
tggcagacacatgagccatt

SEQ ID NO: 213914 - DNA, 20 bp, Artificial Sequence
  Description of Artificial Sequence: Synthetic oligonucleotide
  Target: ATXN1; (-) strand; PAM type: YTN; PAM sequence: TTT
ctggcagacacatgagccat

SEQ ID NO: 213915 - DNA, 20 bp, Artificial Sequence
  Description of Artificial Sequence: Synthetic oligonucleotide
  Target: ATXN1; (-) strand; PAM type: YTN; PAM sequence: CTG
ggtacatttctggcagacac

SEQ ID NO: 213916 - DNA, 20 bp, Artificial Sequence
  Description of Artificial Sequence: Synthetic oligonucleotide
  Target: ATXN1; (-) strand; PAM type: YTN; PAM sequence: TTA
ctgggtacatttctggcaga

SEQ ID NO: 213917 - DNA, 20 bp, Artificial Sequence
  Description of Artificial Sequence: Synthetic oligonucleotide
  Target: ATXN1; (-) strand; PAM type: YTN; PAM sequence: TTA
ttactgggtacatttctggc

SEQ ID NO: 213918 - DNA, 20 bp, Artificial Sequence
  Description of Artificial Sequence: Synthetic oligonucleotide
  Target: ATXN1; (-) strand; PAM type: YTN; PAM sequence: CTA
tagcagaaatgcaaattatt

SEQ ID NO: 213919 - DNA, 20 bp, Artificial Sequence
  Description of Artificial Sequence: Synthetic oligonucleotide
  Target: ATXN1; (-) strand; PAM type: YTN; PAM sequence: TTC
actatagcagaaatgcaaat

SEQ ID NO: 213920 - DNA, 20 bp, Artificial Sequence
  Description of Artificial Sequence: Synthetic oligonucleotide
  Target: ATXN1; (-) strand; PAM type: YTN; PAM sequence: TTT
cactatagcagaaatgcaaa

SEQ ID NO: 213921 - DNA, 20 bp, Artificial Sequence
  Description of Artificial Sequence: Synthetic oligonucleotide
  Target: ATXN1; (-) strand; PAM type: YTN; PAM sequence: TTT
tcactatagcagaaatgcaa

SEQ ID NO: 213922 - DNA, 20 bp, Artificial Sequence
  Description of Artificial Sequence: Synthetic oligonucleotide
  Target: ATXN1; (-) strand; PAM type: YTN; PAM sequence: CTG
aaattttcactatagcagaa

SEQ ID NO: 213923 - DNA, 20 bp, Artificial Sequence
  Description of Artificial Sequence: Synthetic oligonucleotide
  Target: ATXN1; (-) strand; PAM type: YTN; PAM sequence: TTC
ataagccaacaaagagacat

SEQ ID NO: 213924 - DNA, 20 bp, Artificial Sequence
  Description of Artificial Sequence: Synthetic oligonucleotide
  Target: ATXN1; (-) strand; PAM type: YTN; PAM sequence: CTT
cataagccaacaaagagaca

SEQ ID NO: 213925 - DNA, 20 bp, Artificial Sequence
  Description of Artificial Sequence: Synthetic oligonucleotide
  Target: ATXN1; (-) strand; PAM type: YTN; PAM sequence: TTA
ccaatgaaagggtccttcat

SEQ ID NO: 213926 - DNA, 20 bp, Artificial Sequence
  Description of Artificial Sequence: Synthetic oligonucleotide
  Target: ATXN1; (-) strand; PAM type: YTN; PAM sequence: CTT
accaatgaaagggtccttca

SEQ ID NO: 213927 - DNA, 20 bp, Artificial Sequence
  Description of Artificial Sequence: Synthetic oligonucleotide
  Target: ATXN1; (-) strand; PAM type: YTN; PAM sequence: CTG
tggcttaccaatgaaagggt

SEQ ID NO: 213928 - DNA, 20 bp, Artificial Sequence
  Description of Artificial Sequence: Synthetic oligonucleotide
  Target: ATXN1; (-) strand; PAM type: YTN; PAM sequence: TTA
taaaaactgtggcttaccaa

SEQ ID NO: 213929 - DNA, 20 bp, Artificial Sequence
  Description of Artificial Sequence: Synthetic oligonucleotide
  Target: ATXN1; (-) strand; PAM type: YTN; PAM sequence: TTA
tcatgattataaaaactgtg

SEQ ID NO: 213930 - DNA, 20 bp, Artificial Sequence
  Description of Artificial Sequence: Synthetic oligonucleotide
  Target: ATXN1; (-) strand; PAM type: YTN; PAM sequence: CTT
atcatgattataaaaactgt

SEQ ID NO: 213931 - DNA, 20 bp, Artificial Sequence
  Description of Artificial Sequence: Synthetic oligonucleotide
  Target: ATXN1; (-) strand; PAM type: YTN; PAM sequence: TTC
ttatcatgattataaaaact

SEQ ID NO: 213932 - DNA, 20 bp, Artificial Sequence
  Description of Artificial Sequence: Synthetic oligonucleotide
  Target: ATXN1; (-) strand; PAM type: YTN; PAM sequence: CTT
cttatcatgattataaaaac

SEQ ID NO: 213933 - DNA, 20 bp, Artificial Sequence
  Description of Artificial Sequence: Synthetic oligonucleotide
  Target: ATXN1; (-) strand; PAM type: YTN; PAM sequence: TTA
tcaacaaagagcataggtga

SEQ ID NO: 213934 - DNA, 20 bp, Artificial Sequence
  Description of Artificial Sequence: Synthetic oligonucleotide
  Target: ATXN1; (-) strand; PAM type: YTN; PAM sequence: TTA
ttatcaacaaagagcatagg

SEQ ID NO: 213935 - DNA, 20 bp, Artificial Sequence
  Description of Artificial Sequence: Synthetic oligonucleotide
  Target: ATXN1; (-) strand; PAM type: YTN; PAM sequence: TTA
ttattatcaacaaagagcat

SEQ ID NO: 213936 - DNA, 20 bp, Artificial Sequence
  Description of Artificial Sequence: Synthetic oligonucleotide
  Target: ATXN1; (-) strand; PAM type: YTN; PAM sequence: TTA
ttattattatcaacaaagag

SEQ ID NO: 213937 - DNA, 20 bp, Artificial Sequence
  Description of Artificial Sequence: Synthetic oligonucleotide
  Target: ATXN1; (-) strand; PAM type: YTN; PAM sequence: TTA
gttattattattatcaacaa

SEQ ID NO: 213938 - DNA, 20 bp, Artificial Sequence
  Description of Artificial Sequence: Synthetic oligonucleotide
  Target: ATXN1; (-) strand; PAM type: YTN; PAM sequence: TTA
ttagttattattattatcaa

SEQ ID NO: 213939 - DNA, 20 bp, Artificial Sequence
  Description of Artificial Sequence: Synthetic oligonucleotide
  Target: ATXN1; (-) strand; PAM type: YTN; PAM sequence: CTT
attagttattattattatca

SEQ ID NO: 213940 - DNA, 20 bp, Artificial Sequence
  Description of Artificial Sequence: Synthetic oligonucleotide
  Target: ATXN1; (-) strand; PAM type: YTN; PAM sequence: CTG
cacatacggcagtcagcgca

SEQ ID NO: 213941 - DNA, 20 bp, Artificial Sequence
  Description of Artificial Sequence: Synthetic oligonucleotide
  Target: ATXN1; (-) strand; PAM type: YTN; PAM sequence: CTG
ctgcacatacggcagtcagc

SEQ ID NO: 213942 - DNA, 20 bp, Artificial Sequence
  Description of Artificial Sequence: Synthetic oligonucleotide
  Target: ATXN1; (-) strand; PAM type: YTN; PAM sequence: CTC
acaggactgctgcacatacg

SEQ ID NO: 213943 - DNA, 20 bp, Artificial Sequence
  Description of Artificial Sequence: Synthetic oligonucleotide
  Target: ATXN1; (-) strand; PAM type: YTN; PAM sequence: CTG
cctcacaggactgctgcaca

SEQ ID NO: 213944 - DNA, 20 bp, Artificial Sequence
  Description of Artificial Sequence: Synthetic oligonucleotide
  Target: ATXN1; (-) strand; PAM type: YTN; PAM sequence: TTA
aaacatgaataataatcctg

SEQ ID NO: 213945 - DNA, 20 bp, Artificial Sequence
  Description of Artificial Sequence: Synthetic oligonucleotide
  Target: ATXN1; (-) strand; PAM type: YTN; PAM sequence: TTT
aaaacatgaataataatcct

SEQ ID NO: 213946 - DNA, 20 bp, Artificial Sequence
  Description of Artificial Sequence: Synthetic oligonucleotide
  Target: ATXN1; (-) strand; PAM type: YTN; PAM sequence: CTT
taaaacatgaataataatcc

SEQ ID NO: 213947 - DNA, 20 bp, Artificial Sequence
  Description of Artificial Sequence: Synthetic oligonucleotide
  Target: ATXN1; (-) strand; PAM type: YTN; PAM sequence: CTC
agctttaaaacatgaataat

SEQ ID NO: 213948 - DNA, 20 bp, Artificial Sequence
  Description of Artificial Sequence: Synthetic oligonucleotide
  Target: ATXN1; (-) strand; PAM type: YTN; PAM sequence: TTC
tcagctttaaaacatgaata

SEQ ID NO: 213949 - DNA, 20 bp, Artificial Sequence
  Description of Artificial Sequence: Synthetic oligonucleotide
  Target: ATXN1; (-) strand; PAM type: YTN; PAM sequence: TTT
ctcagctttaaaacatgaat

SEQ ID NO: 213950 - DNA, 20 bp, Artificial Sequence
  Description of Artificial Sequence: Synthetic oligonucleotide
  Target: ATXN1; (-) strand; PAM type: YTN; PAM sequence: TTT
tctcagctttaaaacatgaa

SEQ ID NO: 213951 - DNA, 20 bp, Artificial Sequence
  Description of Artificial Sequence: Synthetic oligonucleotide
  Target: ATXN1; (-) strand; PAM type: YTN; PAM sequence: CTG
ttttctcagctttaaaacat

SEQ ID NO: 213952 - DNA, 20 bp, Artificial Sequence
  Description of Artificial Sequence: Synthetic oligonucleotide
  Target: ATXN1; (-) strand; PAM type: YTN; PAM sequence: CTC
tgttttctcagctttaaaac

SEQ ID NO: 213953 - DNA, 20 bp, Artificial Sequence
  Description of Artificial Sequence: Synthetic oligonucleotide
  Target: ATXN1; (-) strand; PAM type: YTN; PAM sequence: CTA
agcctctgttttctcagctt

SEQ ID NO: 213954 - DNA, 20 bp, Artificial Sequence
  Description of Artificial Sequence: Synthetic oligonucleotide
  Target: ATXN1; (-) strand; PAM type: YTN; PAM sequence: TTG
acctaagcctctgttttctc

SEQ ID NO: 213955 - DNA, 20 bp, Artificial Sequence
  Description of Artificial Sequence: Synthetic oligonucleotide
  Target: ATXN1; (-) strand; PAM type: YTN; PAM sequence: CTG
ggaaagttgacctaagcctc

SEQ ID NO: 213956 - DNA, 20 bp, Artificial Sequence
  Description of Artificial Sequence: Synthetic oligonucleotide
  Target: ATXN1; (-) strand; PAM type: YTN; PAM sequence: TTA
agaccctgggaaagttgacc

SEQ ID NO: 213957 - DNA, 20 bp, Artificial Sequence
  Description of Artificial Sequence: Synthetic oligonucleotide
  Target: ATXN1; (-) strand; PAM type: YTN; PAM sequence: TTT
aagaccctgggaaagttgac

SEQ ID NO: 213958 - DNA, 20 bp, Artificial Sequence
  Description of Artificial Sequence: Synthetic oligonucleotide
  Target: ATXN1; (-) strand; PAM type: YTN; PAM sequence: CTT
taagaccctgggaaagttga

SEQ ID NO: 213959 - DNA, 20 bp, Artificial Sequence
  Description of Artificial Sequence: Synthetic oligonucleotide
  Target: ATXN1; (-) strand; PAM type: YTN; PAM sequence: TTA
tcgtctttaagaccctggga

SEQ ID NO: 213960 - DNA, 20 bp, Artificial Sequence
  Description of Artificial Sequence: Synthetic oligonucleotide
  Target: ATXN1; (-) strand; PAM type: YTN; PAM sequence: TTT
atcgtctttaagaccctggg

SEQ ID NO: 213961 - DNA, 20 bp, Artificial Sequence
  Description of Artificial Sequence: Synthetic oligonucleotide
  Target: ATXN1; (-) strand; PAM type: YTN; PAM sequence: CTC
cataatttatcgtctttaag

SEQ ID NO: 213962 - DNA, 20 bp, Artificial Sequence
  Description of Artificial Sequence: Synthetic oligonucleotide
  Target: ATXN1; (-) strand; PAM type: YTN; PAM sequence: TTC
aaatccagcctccataattt

SEQ ID NO: 213963 - DNA, 20 bp, Artificial Sequence
  Description of Artificial Sequence: Synthetic oligonucleotide
  Target: ATXN1; (-) strand; PAM type: YTN; PAM sequence: CTC
aagttcaaatccagcctcca

SEQ ID NO: 213964 - DNA, 20 bp, Artificial Sequence
  Description of Artificial Sequence: Synthetic oligonucleotide
  Target: ATXN1; (-) strand; PAM type: YTN; PAM sequence: CTG
caagtggaaggagagtgggc

SEQ ID NO: 213965 - DNA, 20 bp, Artificial Sequence
  Description of Artificial Sequence: Synthetic oligonucleotide
  Target: ATXN1; (-) strand; PAM type: YTN; PAM sequence: TTA
cgctgcaagtggaaggagag

SEQ ID NO: 213966 - DNA, 20 bp, Artificial Sequence
  Description of Artificial Sequence: Synthetic oligonucleotide
  Target: ATXN1; (-) strand; PAM type: YTN; PAM sequence: TTT
acgctgcaagtggaaggaga

SEQ ID NO: 213967 - DNA, 20 bp, Artificial Sequence
  Description of Artificial Sequence: Synthetic oligonucleotide
  Target: ATXN1; (-) strand; PAM type: YTN; PAM sequence: CTG
tgtttacgctgcaagtggaa

SEQ ID NO: 213968 - DNA, 20 bp, Artificial Sequence
  Description of Artificial Sequence: Synthetic oligonucleotide
  Target: ATXN1; (-) strand; PAM type: YTN; PAM sequence: TTG
agccactgtgtttacgctgc

SEQ ID NO: 213969 - DNA, 20 bp, Artificial Sequence
  Description of Artificial Sequence: Synthetic oligonucleotide
  Target: ATXN1; (-) strand; PAM type: YTN; PAM sequence: TTT
gagccactgtgtttacgctg

SEQ ID NO: 213970 - DNA, 20 bp, Artificial Sequence
  Description of Artificial Sequence: Synthetic oligonucleotide
  Target: ATXN1; (-) strand; PAM type: YTN; PAM sequence: TTC
atgaagccacagagtttgag

SEQ ID NO: 213971 - DNA, 20 bp, Artificial Sequence
  Description of Artificial Sequence: Synthetic oligonucleotide
  Target: ATXN1; (-) strand; PAM type: YTN; PAM sequence: TTA
tattcatgaagccacagagt

SEQ ID NO: 213972 - DNA, 20 bp, Artificial Sequence
  Description of Artificial Sequence: Synthetic oligonucleotide
  Target: ATXN1; (-) strand; PAM type: YTN; PAM sequence: CTG
tgaaacattatattcatgaa

SEQ ID NO: 213973 - DNA, 20 bp, Artificial Sequence
  Description of Artificial Sequence: Synthetic oligonucleotide
  Target: ATXN1; (-) strand; PAM type: YTN; PAM sequence: CTG
cataccctgtgaaacattat

SEQ ID NO: 213974 - DNA, 20 bp, Artificial Sequence
  Description of Artificial Sequence: Synthetic oligonucleotide
  Target: ATXN1; (-) strand; PAM type: YTN; PAM sequence: TTA
taagatcactgcataccctg

SEQ ID NO: 213975 - DNA, 20 bp, Artificial Sequence
  Description of Artificial Sequence: Synthetic oligonucleotide
  Target: ATXN1; (-) strand; PAM type: YTN; PAM sequence: CTT
ataagatcactgcataccct

SEQ ID NO: 213976 - DNA, 20 bp, Artificial Sequence
  Description of Artificial Sequence: Synthetic oligonucleotide
  Target: ATXN1; (-) strand; PAM type: YTN; PAM sequence: CTA
cttataagatcactgcatac

SEQ ID NO: 213977 - DNA, 20 bp, Artificial Sequence
  Description of Artificial Sequence: Synthetic oligonucleotide
  Target: ATXN1; (-) strand; PAM type: YTN; PAM sequence: TTC
tacttataagatcactgcat

SEQ ID NO: 213978 - DNA, 20 bp, Artificial Sequence
  Description of Artificial Sequence: Synthetic oligonucleotide
  Target: ATXN1; (-) strand; PAM type: YTN; PAM sequence: TTT
ctacttataagatcactgca

SEQ ID NO: 213979 - DNA, 20 bp, Artificial Sequence
  Description of Artificial Sequence: Synthetic oligonucleotide
  Target: ATXN1; (-) strand; PAM type: YTN; PAM sequence: CTA
gacccatttctacttataag

SEQ ID NO: 213980 - DNA, 20 bp, Artificial Sequence
  Description of Artificial Sequence: Synthetic oligonucleotide
  Target: ATXN1; (-) strand; PAM type: YTN; PAM sequence: TTC
tagacccatttctacttata

SEQ ID NO: 213981 - DNA, 20 bp, Artificial Sequence
  Description of Artificial Sequence: Synthetic oligonucleotide
  Target: ATXN1; (-) strand; PAM type: YTN; PAM sequence: TTT
ctagacccatttctacttat

SEQ ID NO: 213982 - DNA, 20 bp, Artificial Sequence
  Description of Artificial Sequence: Synthetic oligonucleotide
  Target: ATXN1; (-) strand; PAM type: YTN; PAM sequence: CTT
tctagacccatttctactta

SEQ ID NO: 213983 - DNA, 20 bp, Artificial Sequence
  Description of Artificial Sequence: Synthetic oligonucleotide
  Target: ATXN1; (-) strand; PAM type: YTN; PAM sequence: TTG
caatgcagtgtccaggagtg

SEQ ID NO: 213984 - DNA, 20 bp, Artificial Sequence
  Description of Artificial Sequence: Synthetic oligonucleotide
  Target: ATXN1; (-) strand; PAM type: YTN; PAM sequence: TTT
gcaatgcagtgtccaggagt

SEQ ID NO: 213985 - DNA, 20 bp, Artificial Sequence
  Description of Artificial Sequence: Synthetic oligonucleotide
  Target: ATXN1; (-) strand; PAM type: YTN; PAM sequence: CTC
aaggggcaaatataggtgtc

SEQ ID NO: 213986 - DNA, 20 bp, Artificial Sequence
  Description of Artificial Sequence: Synthetic oligonucleotide
  Target: ATXN1; (-) strand; PAM type: YTN; PAM sequence: TTC
aagggactcaaggggcaaat

SEQ ID NO: 213987 - DNA, 20 bp, Artificial Sequence
  Description of Artificial Sequence: Synthetic oligonucleotide
  Target: ATXN1; (-) strand; PAM type: YTN; PAM sequence: CTG
agcagagtgtggcaccaata

SEQ ID NO: 213988 - DNA, 20 bp, Artificial Sequence
  Description of Artificial Sequence: Synthetic oligonucleotide
  Target: ATXN1; (-) strand; PAM type: YTN; PAM sequence: TTG
caccatatcaagagctgagc

SEQ ID NO: 213989 - DNA, 20 bp, Artificial Sequence
  Description of Artificial Sequence: Synthetic oligonucleotide
  Target: ATXN1; (-) strand; PAM type: YTN; PAM sequence: TTT
gcaccatatcaagagctgag

SEQ ID NO: 213990 - DNA, 20 bp, Artificial Sequence
  Description of Artificial Sequence: Synthetic oligonucleotide
  Target: ATXN1; (-) strand; PAM type: YTN; PAM sequence: CTT
tgcaccatatcaagagctga

SEQ ID NO: 213991 - DNA, 20 bp, Artificial Sequence
  Description of Artificial Sequence: Synthetic oligonucleotide
  Target: ATXN1; (-) strand; PAM type: YTN; PAM sequence: TTA
gtgctttgcaccatatcaag

SEQ ID NO: 213992 - DNA, 20 bp, Artificial Sequence
  Description of Artificial Sequence: Synthetic oligonucleotide
  Target: ATXN1; (-) strand; PAM type: YTN; PAM sequence: TTT
agtgctttgcaccatatcaa

SEQ ID NO: 213993 - DNA, 20 bp, Artificial Sequence
  Description of Artificial Sequence: Synthetic oligonucleotide
  Target: ATXN1; (-) strand; PAM type: YTN; PAM sequence: TTT
tagtgctttgcaccatatca

SEQ ID NO: 213994 - DNA, 20 bp, Artificial Sequence
  Description of Artificial Sequence: Synthetic oligonucleotide
  Target: ATXN1; (-) strand; PAM type: YTN; PAM sequence: CTG
tgtgattttagtgctttgca

SEQ ID NO: 213995 - DNA, 20 bp, Artificial Sequence
  Description of Artificial Sequence: Synthetic oligonucleotide
  Target: ATXN1; (-) strand; PAM type: YTN; PAM sequence: CTG
tgacacctgtgtgattttag

SEQ ID NO: 213996 - DNA, 20 bp, Artificial Sequence
  Description of Artificial Sequence: Synthetic oligonucleotide
  Target: ATXN1; (-) strand; PAM type: YTN; PAM sequence: TTG
gctgtgacacctgtgtgatt

SEQ ID NO: 213997 - DNA, 20 bp, Artificial Sequence
  Description of Artificial Sequence: Synthetic oligonucleotide
  Target: ATXN1; (-) strand; PAM type: YTN; PAM sequence: TTT
ggctgtgacacctgtgtgat

SEQ ID NO: 213998 - DNA, 20 bp, Artificial Sequence
  Description of Artificial Sequence: Synthetic oligonucleotide
  Target: ATXN1; (-) strand; PAM type: YTN; PAM sequence: TTT
tggctgtgacacctgtgtga

SEQ ID NO: 213999 - DNA, 20 bp, Artificial Sequence
  Description of Artificial Sequence: Synthetic oligonucleotide
  Target: ATXN1; (-) strand; PAM type: YTN; PAM sequence: TTT
ttggctgtgacacctgtgtg

SEQ ID NO: 214000 - DNA, 20 bp, Artificial Sequence
  Description of Artificial Sequence: Synthetic oligonucleotide
  Target: ATXN1; (-) strand; PAM type: YTN; PAM sequence: TTG
gaatgatacagaatttttgg

SEQ ID NO: 214001 - DNA, 20 bp, Artificial Sequence
  Description of Artificial Sequence: Synthetic oligonucleotide
  Target: ATXN1; (-) strand; PAM type: YTN; PAM sequence: TTT
ggaatgatacagaatttttg

SEQ ID NO: 214002 - DNA, 20 bp, Artificial Sequence
  Description of Artificial Sequence: Synthetic oligonucleotide
  Target: ATXN1; (-) strand; PAM type: YTN; PAM sequence: CTT
tggaatgatacagaattttt

SEQ ID NO: 214003 - DNA, 20 bp, Artificial Sequence
  Description of Artificial Sequence: Synthetic oligonucleotide
  Target: ATXN1; (-) strand; PAM type: YTN; PAM sequence: CTG
atgggggacaagtcagcttt

SEQ ID NO: 214004 - DNA, 20 bp, Artificial Sequence
  Description of Artificial Sequence: Synthetic oligonucleotide
  Target: ATXN1; (-) strand; PAM type: YTN; PAM sequence: TTG
ggactgatgggggacaagtc

SEQ ID NO: 214005 - DNA, 20 bp, Artificial Sequence
  Description of Artificial Sequence: Synthetic oligonucleotide
  Target: ATXN1; (-) strand; PAM type: YTN; PAM sequence: CTG
gggcagagttgggactgatg

SEQ ID NO: 214006 - DNA, 20 bp, Artificial Sequence
  Description of Artificial Sequence: Synthetic oligonucleotide
  Target: ATXN1; (-) strand; PAM type: YTN; PAM sequence: TTC
tggggcagagttgggactga

SEQ ID NO: 214007 - DNA, 20 bp, Artificial Sequence
  Description of Artificial Sequence: Synthetic oligonucleotide
  Target: ATXN1; (-) strand; PAM type: YTN; PAM sequence: CTT
ctggggcagagttgggactg

SEQ ID NO: 214008 - DNA, 20 bp, Artificial Sequence
  Description of Artificial Sequence: Synthetic oligonucleotide
  Target: ATXN1; (-) strand; PAM type: YTN; PAM sequence: TTC
agtgagacttctggggcaga

SEQ ID NO: 214009 - DNA, 20 bp, Artificial Sequence
  Description of Artificial Sequence: Synthetic oligonucleotide
  Target: ATXN1; (-) strand; PAM type: YTN; PAM sequence: TTT
cagtgagacttctggggcag

SEQ ID NO: 214010 - DNA, 20 bp, Artificial Sequence
  Description of Artificial Sequence: Synthetic oligonucleotide
  Target: ATXN1; (-) strand; PAM type: YTN; PAM sequence: TTA
tttcagtgagacttctgggg

SEQ ID NO: 214011 - DNA, 20 bp, Artificial Sequence
  Description of Artificial Sequence: Synthetic oligonucleotide
  Target: ATXN1; (-) strand; PAM type: YTN; PAM sequence: TTT
atttcagtgagacttctggg

SEQ ID NO: 214012 - DNA, 20 bp, Artificial Sequence
  Description of Artificial Sequence: Synthetic oligonucleotide
  Target: ATXN1; (-) strand; PAM type: YTN; PAM sequence: CTT
tatttcagtgagacttctgg

SEQ ID NO: 214013 - DNA, 20 bp, Artificial Sequence
  Description of Artificial Sequence: Synthetic oligonucleotide
  Target: ATXN1; (-) strand; PAM type: YTN; PAM sequence: CTG
gagactttatttcagtgaga

SEQ ID NO: 214014 - DNA, 20 bp, Artificial Sequence
  Description of Artificial Sequence: Synthetic oligonucleotide
  Target: ATXN1; (-) strand; PAM type: YTN; PAM sequence: CTA
tagaagtgtgggtcataaaa

SEQ ID NO: 214015 - DNA, 20 bp, Artificial Sequence
  Description of Artificial Sequence: Synthetic oligonucleotide
  Target: ATXN1; (-) strand; PAM type: YTN; PAM sequence: CTA
aagaagggagagtcctatag

SEQ ID NO: 214016 - DNA, 20 bp, Artificial Sequence
  Description of Artificial Sequence: Synthetic oligonucleotide
  Target: ATXN1; (-) strand; PAM type: YTN; PAM sequence: TTA
gaactaaagaagggagagtc

SEQ ID NO: 214017 - DNA, 20 bp, Artificial Sequence
  Description of Artificial Sequence: Synthetic oligonucleotide
  Target: ATXN1; (-) strand; PAM type: YTN; PAM sequence: TTA
ataattagaactaaagaagg

SEQ ID NO: 214018 - DNA, 20 bp, Artificial Sequence
  Description of Artificial Sequence: Synthetic oligonucleotide
  Target: ATXN1; (-) strand; PAM type: YTN; PAM sequence: TTT
aataattagaactaaagaag

SEQ ID NO: 214019 - DNA, 20 bp, Artificial Sequence
  Description of Artificial Sequence: Synthetic oligonucleotide
  Target: ATXN1; (-) strand; PAM type: YTN; PAM sequence: TTT
taataattagaactaaagaa

SEQ ID NO: 214020 - DNA, 20 bp, Artificial Sequence
  Description of Artificial Sequence: Synthetic oligonucleotide
  Target: ATXN1; (-) strand; PAM type: YTN; PAM sequence: CTT
ttaataattagaactaaaga

SEQ ID NO: 214021 - DNA, 20 bp, Artificial Sequence
  Description of Artificial Sequence: Synthetic oligonucleotide
  Target: ATXN1; (-) strand; PAM type: YTN; PAM sequence: CTG
cttttaataattagaactaa

SEQ ID NO: 214022 - DNA, 20 bp, Artificial Sequence
  Description of Artificial Sequence: Synthetic oligonucleotide
  Target: ATXN1; (-) strand; PAM type: YTN; PAM sequence: TTC
agaaccctgcttttaataat

SEQ ID NO: 214023 - DNA, 20 bp, Artificial Sequence
  Description of Artificial Sequence: Synthetic oligonucleotide
  Target: ATXN1; (-) strand; PAM type: YTN; PAM sequence: TTT
cagaaccctgcttttaataa

SEQ ID NO: 214024 - DNA, 20 bp, Artificial Sequence
  Description of Artificial Sequence: Synthetic oligonucleotide
  Target: ATXN1; (-) strand; PAM type: YTN; PAM sequence: TTG
ggatttcagaaccctgcttt

SEQ ID NO: 214025 - DNA, 20 bp, Artificial Sequence
  Description of Artificial Sequence: Synthetic oligonucleotide
  Target: ATXN1; (-) strand; PAM type: YTN; PAM sequence: CTT
gggatttcagaaccctgctt

SEQ ID NO: 214026 - DNA, 20 bp, Artificial Sequence
  Description of Artificial Sequence: Synthetic oligonucleotide
  Target: ATXN1; (-) strand; PAM type: YTN; PAM sequence: TTG
caatcaccttgggatttcag

SEQ ID NO: 214027 - DNA, 20 bp, Artificial Sequence
  Description of Artificial Sequence: Synthetic oligonucleotide
  Target: ATXN1; (-) strand; PAM type: YTN; PAM sequence: TTT
gcaatcaccttgggatttca

SEQ ID NO: 214028 - DNA, 20 bp, Artificial Sequence
  Description of Artificial Sequence: Synthetic oligonucleotide
  Target: ATXN1; (-) strand; PAM type: YTN; PAM sequence: TTT
tgcaatcaccttgggatttc

SEQ ID NO: 214029 - DNA, 20 bp, Artificial Sequence
  Description of Artificial Sequence: Synthetic oligonucleotide
  Target: ATXN1; (-) strand; PAM type: YTN; PAM sequence: CTG
agatgggagttttgcaatca

SEQ ID NO: 214030 - DNA, 20 bp, Artificial Sequence
  Description of Artificial Sequence: Synthetic oligonucleotide
  Target: ATXN1; (-) strand; PAM type: YTN; PAM sequence: TTG
tggctgagatgggagttttg

SEQ ID NO: 214031 - DNA, 20 bp, Artificial Sequence
  Description of Artificial Sequence: Synthetic oligonucleotide
  Target: ATXN1; (-) strand; PAM type: YTN; PAM sequence: TTT
gtggctgagatgggagtttt

SEQ ID NO: 214032 - DNA, 20 bp, Artificial Sequence
  Description of Artificial Sequence: Synthetic oligonucleotide
  Target: ATXN1; (-) strand; PAM type: YTN; PAM sequence: CTA
atgaagatttgtggctgaga

SEQ ID NO: 214033 - DNA, 20 bp, Artificial Sequence
  Description of Artificial Sequence: Synthetic oligonucleotide
  Target: ATXN1; (-) strand; PAM type: YTN; PAM sequence: TTC
taatgaagatttgtggctga

SEQ ID NO: 214034 - DNA, 20 bp, Artificial Sequence
  Description of Artificial Sequence: Synthetic oligonucleotide
  Target: ATXN1; (-) strand; PAM type: YTN; PAM sequence: TTA
gccattctaatgaagatttg

SEQ ID NO: 214035 - DNA, 20 bp, Artificial Sequence
  Description of Artificial Sequence: Synthetic oligonucleotide
  Target: ATXN1; (-) strand; PAM type: YTN; PAM sequence: TTG
attagccattctaatgaaga

SEQ ID NO: 214036 - DNA, 20 bp, Artificial Sequence
  Description of Artificial Sequence: Synthetic oligonucleotide
  Target: ATXN1; (-) strand; PAM type: YTN; PAM sequence: TTA
ttgattagccattctaatga

SEQ ID NO: 214037 - DNA, 20 bp, Artificial Sequence
  Description of Artificial Sequence: Synthetic oligonucleotide
  Target: ATXN1; (-) strand; PAM type: YTN; PAM sequence: CTT
attgattagccattctaatg

SEQ ID NO: 214038 - DNA, 20 bp, Artificial Sequence
  Description of Artificial Sequence: Synthetic oligonucleotide
  Target: ATXN1; (-) strand; PAM type: YTN; PAM sequence: CTC
ttattgattagccattctaa

SEQ ID NO: 214039 - DNA, 20 bp, Artificial Sequence
  Description of Artificial Sequence: Synthetic oligonucleotide
  Target: ATXN1; (-) strand; PAM type: YTN; PAM sequence: CTG
aaacaaaactcttattgatt

SEQ ID NO: 214040 - DNA, 20 bp, Artificial Sequence
  Description of Artificial Sequence: Synthetic oligonucleotide
  Target: ATXN1; (-) strand; PAM type: YTN; PAM sequence: TTC
aaaaaacatacagaggaaat

SEQ ID NO: 214041 - DNA, 20 bp, Artificial Sequence
  Description of Artificial Sequence: Synthetic oligonucleotide
  Target: ATXN1; (-) strand; PAM type: YTN; PAM sequence: CTT
caaaaaacatacagaggaaa

SEQ ID NO: 214042 - DNA, 20 bp, Artificial Sequence
  Description of Artificial Sequence: Synthetic oligonucleotide
  Target: ATXN1; (-) strand; PAM type: YTN; PAM sequence: TTC
ttcaaaaaacatacagagga

SEQ ID NO: 214043 - DNA, 20 bp, Artificial Sequence
  Description of Artificial Sequence: Synthetic oligonucleotide
  Target: ATXN1; (-) strand; PAM type: YTN; PAM sequence: TTG
aaaaattcttcaaaaaacat

SEQ ID NO: 214044 - DNA, 20 bp, Artificial Sequence
  Description of Artificial Sequence: Synthetic oligonucleotide
  Target: ATXN1; (-) strand; PAM type: YTN; PAM sequence: TTA
tatcatggcaaattgaaaaa

SEQ ID NO: 214045 - DNA, 20 bp, Artificial Sequence
  Description of Artificial Sequence: Synthetic oligonucleotide
  Target: ATXN1; (-) strand; PAM type: YTN; PAM sequence: TTA
gttatatcatggcaaattga

SEQ ID NO: 214046 - DNA, 20 bp, Artificial Sequence
  Description of Artificial Sequence: Synthetic oligonucleotide
  Target: ATXN1; (-) strand; PAM type: YTN; PAM sequence: TTT
agttatatcatggcaaattg

SEQ ID NO: 214047 - DNA, 20 bp, Artificial Sequence
  Description of Artificial Sequence: Synthetic oligonucleotide
  Target: ATXN1; (-) strand; PAM type: YTN; PAM sequence: TTT
tagttatatcatggcaaatt

SEQ ID NO: 214048 - DNA, 20 bp, Artificial Sequence
  Description of Artificial Sequence: Synthetic oligonucleotide
  Target: ATXN1; (-) strand; PAM type: YTN; PAM sequence: TTG
agttttagttatatcatggc

SEQ ID NO: 214049 - DNA, 20 bp, Artificial Sequence
  Description of Artificial Sequence: Synthetic oligonucleotide
  Target: ATXN1; (-) strand; PAM type: YTN; PAM sequence: CTT
gagttttagttatatcatgg

SEQ ID NO: 214050 - DNA, 20 bp, Artificial Sequence
  Description of Artificial Sequence: Synthetic oligonucleotide
  Target: ATXN1; (-) strand; PAM type: YTN; PAM sequence: TTG
atgcttgagttttagttata

SEQ ID NO: 214051 - DNA, 20 bp, Artificial Sequence
  Description of Artificial Sequence: Synthetic oligonucleotide
  Target: ATXN1; (-) strand; PAM type: YTN; PAM sequence: CTG
ttgatgcttgagttttagtt

SEQ ID NO: 214052 - DNA, 20 bp, Artificial Sequence
  Description of Artificial Sequence: Synthetic oligonucleotide
  Target: ATXN1; (-) strand; PAM type: YTN; PAM sequence: TTC
ctgttgatgcttgagtttta

SEQ ID NO: 214053 - DNA, 20 bp, Artificial Sequence
  Description of Artificial Sequence: Synthetic oligonucleotide
  Target: ATXN1; (-) strand; PAM type: YTN; PAM sequence: TTT
cctgttgatgcttgagtttt

SEQ ID NO: 214054 - DNA, 20 bp, Artificial Sequence
  Description of Artificial Sequence: Synthetic oligonucleotide
  Target: ATXN1; (-) strand; PAM type: YTN; PAM sequence: CTT
tcctgttgatgcttgagttt

SEQ ID NO: 214055 - DNA, 20 bp, Artificial Sequence
  Description of Artificial Sequence: Synthetic oligonucleotide
  Target: ATXN1; (-) strand; PAM type: YTN; PAM sequence: CTC
tttcctgttgatgcttgagt

SEQ ID NO: 214056 - DNA, 20 bp, Artificial Sequence
  Description of Artificial Sequence: Synthetic oligonucleotide
  Target: ATXN1; (-) strand; PAM type: YTN; PAM sequence: TTC
ctctttcctgttgatgcttg

SEQ ID NO: 214057 - DNA, 20 bp, Artificial Sequence
  Description of Artificial Sequence: Synthetic oligonucleotide
  Target: ATXN1; (-) strand; PAM type: YTN; PAM sequence: CTT
cctctttcctgttgatgctt

SEQ ID NO: 214058 - DNA, 20 bp, Artificial Sequence
  Description of Artificial Sequence: Synthetic oligonucleotide
  Target: ATXN1; (-) strand; PAM type: YTN; PAM sequence: CTC
ttcctctttcctgttgatgc

SEQ ID NO: 214059 - DNA, 20 bp, Artificial Sequence
  Description of Artificial Sequence: Synthetic oligonucleotide
  Target: ATXN1; (-) strand; PAM type: YTN; PAM sequence: TTC
tcttcctctttcctgttgat

SEQ ID NO: 214060 - DNA, 20 bp, Artificial Sequence
  Description of Artificial Sequence: Synthetic oligonucleotide
  Target: ATXN1; (-) strand; PAM type: YTN; PAM sequence: CTT
ctcttcctctttcctgttga

SEQ ID NO: 214061 - DNA, 20 bp, Artificial Sequence
  Description of Artificial Sequence: Synthetic oligonucleotide
  Target: ATXN1; (-) strand; PAM type: YTN; PAM sequence: CTC
ttctcttcctctttcctgtt

SEQ ID NO: 214062 - DNA, 20 bp, Artificial Sequence
  Description of Artificial Sequence: Synthetic oligonucleotide
  Target: ATXN1; (-) strand; PAM type: YTN; PAM sequence: CTG
agctcttctcttcctctttc

SEQ ID NO: 214063 - DNA, 20 bp, Artificial Sequence
  Description of Artificial Sequence: Synthetic oligonucleotide
  Target: ATXN1; (-) strand; PAM type: YTN; PAM sequence: TTC
tgagctcttctcttcctctt

SEQ ID NO: 214064 - DNA, 20 bp, Artificial Sequence
  Description of Artificial Sequence: Synthetic oligonucleotide
  Target: ATXN1; (-) strand; PAM type: YTN; PAM sequence: TTT
ctgagctcttctcttcctct

SEQ ID NO: 214065 - DNA, 20 bp, Artificial Sequence
  Description of Artificial Sequence: Synthetic oligonucleotide
  Target: ATXN1; (-) strand; PAM type: YTN; PAM sequence: TTA
tttctgagctcttctcttcc

SEQ ID NO: 214066 - DNA, 20 bp, Artificial Sequence
  Description of Artificial Sequence: Synthetic oligonucleotide
  Target: ATXN1; (-) strand; PAM type: YTN; PAM sequence: CTT
atttctgagctcttctcttc

SEQ ID NO: 214067 - DNA, 20 bp, Artificial Sequence
  Description of Artificial Sequence: Synthetic oligonucleotide
  Target: ATXN1; (-) strand; PAM type: YTN; PAM sequence: CTA
gtggcttatttctgagctct

SEQ ID NO: 214068 - DNA, 20 bp, Artificial Sequence
  Description of Artificial Sequence: Synthetic oligonucleotide
  Target: ATXN1; (-) strand; PAM type: YTN; PAM sequence: TTC
gagcactagtggcttatttc

SEQ ID NO: 214069 - DNA, 20 bp, Artificial Sequence
  Description of Artificial Sequence: Synthetic oligonucleotide
  Target: ATXN1; (-) strand; PAM type: YTN; PAM sequence: TTT
cgagcactagtggcttattt

SEQ ID NO: 214070 - DNA, 20 bp, Artificial Sequence
  Description of Artificial Sequence: Synthetic oligonucleotide
  Target: ATXN1; (-) strand; PAM type: YTN; PAM sequence: TTT
tcgagcactagtggcttatt

SEQ ID NO: 214071 - DNA, 20 bp, Artificial Sequence
  Description of Artificial Sequence: Synthetic oligonucleotide
  Target: ATXN1; (-) strand; PAM type: YTN; PAM sequence: CTA
ttttcgagcactagtggctt

SEQ ID NO: 214072 - DNA, 20 bp, Artificial Sequence
  Description of Artificial Sequence: Synthetic oligonucleotide
  Target: ATXN1; (-) strand; PAM type: YTN; PAM sequence: CTA
acatcacatgccctattttc

SEQ ID NO: 214073 - DNA, 20 bp, Artificial Sequence
  Description of Artificial Sequence: Synthetic oligonucleotide
  Target: ATXN1; (-) strand; PAM type: YTN; PAM sequence: CTC
taacatcacatgccctattt

SEQ ID NO: 214074 - DNA, 20 bp, Artificial Sequence
  Description of Artificial Sequence: Synthetic oligonucleotide
  Target: ATXN1; (-) strand; PAM type: YTN; PAM sequence: CTA
aaccagctctaacatcacat

SEQ ID NO: 214075 - DNA, 20 bp, Artificial Sequence
  Description of Artificial Sequence: Synthetic oligonucleotide
  Target: ATXN1; (-) strand; PAM type: YTN; PAM sequence: TTC
taaaccagctctaacatcac

SEQ ID NO: 214076 - DNA, 20 bp, Artificial Sequence
  Description of Artificial Sequence: Synthetic oligonucleotide
  Target: ATXN1; (-) strand; PAM type: YTN; PAM sequence: CTA
cgatgcagtggagcatggat

SEQ ID NO: 214077 - DNA, 20 bp, Artificial Sequence
  Description of Artificial Sequence: Synthetic oligonucleotide
  Target: ATXN1; (-) strand; PAM type: YTN; PAM sequence: TTA
ataataagaatccatgcccc

SEQ ID NO: 214078 - DNA, 20 bp, Artificial Sequence
  Description of Artificial Sequence: Synthetic oligonucleotide
  Target: ATXN1; (-) strand; PAM type: YTN; PAM sequence: CTA
attaataataagaatccatg

SEQ ID NO: 214079 - DNA, 20 bp, Artificial Sequence
  Description of Artificial Sequence: Synthetic oligonucleotide
  Target: ATXN1; (-) strand; PAM type: YTN; PAM sequence: TTA
caggtggtgtgagacaaaag

SEQ ID NO: 214080 - DNA, 20 bp, Artificial Sequence
  Description of Artificial Sequence: Synthetic oligonucleotide
  Target: ATXN1; (-) strand; PAM type: YTN; PAM sequence: TTT
acaggtggtgtgagacaaaa

SEQ ID NO: 214081 - DNA, 20 bp, Artificial Sequence
  Description of Artificial Sequence: Synthetic oligonucleotide
  Target: ATXN1; (-) strand; PAM type: YTN; PAM sequence: TTT
tacaggtggtgtgagacaaa

SEQ ID NO: 214082 - DNA, 20 bp, Artificial Sequence
  Description of Artificial Sequence: Synthetic oligonucleotide
  Target: ATXN1; (-) strand; PAM type: YTN; PAM sequence: TTG
ttttacaggtggtgtgagac

SEQ ID NO: 214083 - DNA, 20 bp, Artificial Sequence
  Description of Artificial Sequence: Synthetic oligonucleotide
  Target: ATXN1; (-) strand; PAM type: YTN; PAM sequence: TTT
gttttacaggtggtgtgaga

SEQ ID NO: 214084 - DNA, 20 bp, Artificial Sequence
  Description of Artificial Sequence: Synthetic oligonucleotide
  Target: ATXN1; (-) strand; PAM type: YTN; PAM sequence: TTT
tgttttacaggtggtgtgag

SEQ ID NO: 214085 - DNA, 20 bp, Artificial Sequence
  Description of Artificial Sequence: Synthetic oligonucleotide
  Target: ATXN1; (-) strand; PAM type: YTN; PAM sequence: CTT
ttgttttacaggtggtgtga

SEQ ID NO: 214086 - DNA, 20 bp, Artificial Sequence
  Description of Artificial Sequence: Synthetic oligonucleotide
  Target: ATXN1; (-) strand; PAM type: YTN; PAM sequence: TTG
cttttgttttacaggtggtg

SEQ ID NO: 214087 - DNA, 20 bp, Artificial Sequence
  Description of Artificial Sequence: Synthetic oligonucleotide
  Target: ATXN1; (-) strand; PAM type: YTN; PAM sequence: TTA
ttgcttttgttttacaggtg

SEQ ID NO: 214088 - DNA, 20 bp, Artificial Sequence
  Description of Artificial Sequence: Synthetic oligonucleotide
  Target: ATXN1; (-) strand; PAM type: YTN; PAM sequence: CTA
ccccatgaagtaagcattat

SEQ ID NO: 214089 - DNA, 20 bp, Artificial Sequence
  Description of Artificial Sequence: Synthetic oligonucleotide
  Target: ATXN1; (-) strand; PAM type: YTN; PAM sequence: CTC
actaccccatgaagtaagca

SEQ ID NO: 214090 - DNA, 20 bp, Artificial Sequence
  Description of Artificial Sequence: Synthetic oligonucleotide
  Target: ATXN1; (-) strand; PAM type: YTN; PAM sequence: CTC
ctcactaccccatgaagtaa

SEQ ID NO: 214091 - DNA, 20 bp, Artificial Sequence
  Description of Artificial Sequence: Synthetic oligonucleotide
  Target: ATXN1; (-) strand; PAM type: YTN; PAM sequence: TTA
aacctcctcactaccccatg

SEQ ID NO: 214092 - DNA, 20 bp, Artificial Sequence
  Description of Artificial Sequence: Synthetic oligonucleotide
  Target: ATXN1; (-) strand; PAM type: YTN; PAM sequence: TTT
aaacctcctcactaccccat

SEQ ID NO: 214093 - DNA, 20 bp, Artificial Sequence
  Description of Artificial Sequence: Synthetic oligonucleotide
  Target: ATXN1; (-) strand; PAM type: YTN; PAM sequence: CTC
atttaaacctcctcactacc

SEQ ID NO: 214094 - DNA, 20 bp, Artificial Sequence
  Description of Artificial Sequence: Synthetic oligonucleotide
  Target: ATXN1; (-) strand; PAM type: YTN; PAM sequence: CTC
tcatttaaacctcctcacta

SEQ ID NO: 214095 - DNA, 20 bp, Artificial Sequence
  Description of Artificial Sequence: Synthetic oligonucleotide
  Target: ATXN1; (-) strand; PAM type: YTN; PAM sequence: CTG
tagcctctcatttaaacctc

SEQ ID NO: 214096 - DNA, 20 bp, Artificial Sequence
  Description of Artificial Sequence: Synthetic oligonucleotide
  Target: ATXN1; (-) strand; PAM type: YTN; PAM sequence: TTA
gctgtagcctctcatttaaa

SEQ ID NO: 214097 - DNA, 20 bp, Artificial Sequence
  Description of Artificial Sequence: Synthetic oligonucleotide
  Target: ATXN1; (-) strand; PAM type: YTN; PAM sequence: TTA
agagcattagctgtagcctc

SEQ ID NO: 214098 - DNA, 20 bp, Artificial Sequence
  Description of Artificial Sequence: Synthetic oligonucleotide
  Target: ATXN1; (-) strand; PAM type: YTN; PAM sequence: CTC
attaagagcattagctgtag

SEQ ID NO: 214099 - DNA, 20 bp, Artificial Sequence
  Description of Artificial Sequence: Synthetic oligonucleotide
  Target: ATXN1; (-) strand; PAM type: YTN; PAM sequence: CTG
gccagagaggaaaaggaagg

SEQ ID NO: 214100 - DNA, 20 bp, Artificial Sequence
  Description of Artificial Sequence: Synthetic oligonucleotide
  Target: ATXN1; (-) strand; PAM type: YTN; PAM sequence: CTC
actggccagagaggaaaagg

SEQ ID NO: 214101 - DNA, 20 bp, Artificial Sequence
  Description of Artificial Sequence: Synthetic oligonucleotide
  Target: ATXN1; (-) strand; PAM type: YTN; PAM sequence: TTA
catgatccacccctcactgg

SEQ ID NO: 214102 - DNA, 20 bp, Artificial Sequence
  Description of Artificial Sequence: Synthetic oligonucleotide
  Target: ATXN1; (-) strand; PAM type: YTN; PAM sequence: TTG
ttacatgatccacccctcac

SEQ ID NO: 214103 - DNA, 20 bp, Artificial Sequence
  Description of Artificial Sequence: Synthetic oligonucleotide
  Target: ATXN1; (-) strand; PAM type: YTN; PAM sequence: TTG
gggaagaagagtgaataggg

SEQ ID NO: 214104 - DNA, 20 bp, Artificial Sequence
  Description of Artificial Sequence: Synthetic oligonucleotide
  Target: ATXN1; (-) strand; PAM type: YTN; PAM sequence: TTA
gttggggaagaagagtgaat

SEQ ID NO: 214105 - DNA, 20 bp, Artificial Sequence
  Description of Artificial Sequence: Synthetic oligonucleotide
  Target: ATXN1; (-) strand; PAM type: YTN; PAM sequence: CTG
aggggattagttggggaaga

SEQ ID NO: 214106 - DNA, 20 bp, Artificial Sequence
  Description of Artificial Sequence: Synthetic oligonucleotide
  Target: ATXN1; (-) strand; PAM type: YTN; PAM sequence: CTA
acatgcggaacatggtgcca

SEQ ID NO: 214107 - DNA, 20 bp, Artificial Sequence
  Description of Artificial Sequence: Synthetic oligonucleotide
  Target: ATXN1; (-) strand; PAM type: YTN; PAM sequence: CTC
taacatgcggaacatggtgc

SEQ ID NO: 214108 - DNA, 20 bp, Artificial Sequence
  Description of Artificial Sequence: Synthetic oligonucleotide
  Target: ATXN1; (-) strand; PAM type: YTN; PAM sequence: CTG
ccccaggaaggatgcctcta

SEQ ID NO: 214109 - DNA, 20 bp, Artificial Sequence
  Description of Artificial Sequence: Synthetic oligonucleotide
  Target: ATXN1; (-) strand; PAM type: YTN; PAM sequence: CTC
actgccccaggaaggatgcc

SEQ ID NO: 214110 - DNA, 20 bp, Artificial Sequence
  Description of Artificial Sequence: Synthetic oligonucleotide
  Target: ATXN1; (-) strand; PAM type: YTN; PAM sequence: TTC
aggatgtgtctcactgcccc

SEQ ID NO: 214111 - DNA, 20 bp, Artificial Sequence
  Description of Artificial Sequence: Synthetic oligonucleotide
  Target: ATXN1; (-) strand; PAM type: YTN; PAM sequence: CTG
attcaggatgtgtctcactg

SEQ ID NO: 214112 - DNA, 20 bp, Artificial Sequence
  Description of Artificial Sequence: Synthetic oligonucleotide
  Target: ATXN1; (-) strand; PAM type: YTN; PAM sequence: TTA
gggtgacaaggctgattcag

SEQ ID NO: 214113 - DNA, 20 bp, Artificial Sequence
  Description of Artificial Sequence: Synthetic oligonucleotide
  Target: ATXN1; (-) strand; PAM type: YTN; PAM sequence: TTT
agggtgacaaggctgattca

SEQ ID NO: 214114 - DNA, 20 bp, Artificial Sequence
  Description of Artificial Sequence: Synthetic oligonucleotide
  Target: ATXN1; (-) strand; PAM type: YTN; PAM sequence: CTT
tagggtgacaaggctgattc

SEQ ID NO: 214115 - DNA, 20 bp, Artificial Sequence
  Description of Artificial Sequence: Synthetic oligonucleotide
  Target: ATXN1; (-) strand; PAM type: YTN; PAM sequence: TTG
caaggtcccctttagggtga

SEQ ID NO: 214116 - DNA, 20 bp, Artificial Sequence
  Description of Artificial Sequence: Synthetic oligonucleotide
  Target: ATXN1; (-) strand; PAM type: YTN; PAM sequence: TTG
tcgacccacgagcaaacgtt

SEQ ID NO: 214117 - DNA, 20 bp, Artificial Sequence
  Description of Artificial Sequence: Synthetic oligonucleotide
  Target: ATXN1; (-) strand; PAM type: YTN; PAM sequence: CTG
tgtggtgttgtcgacccacg

SEQ ID NO: 214118 - DNA, 20 bp, Artificial Sequence
  Description of Artificial Sequence: Synthetic oligonucleotide
  Target: ATXN1; (-) strand; PAM type: YTN; PAM sequence: CTC
tgtgtggtgttgtcgaccca

SEQ ID NO: 214119 - DNA, 20 bp, Artificial Sequence
  Description of Artificial Sequence: Synthetic oligonucleotide
  Target: ATXN1; (-) strand; PAM type: YTN; PAM sequence: CTC
atgtcagctctgtgtggtgt

SEQ ID NO: 214120 - DNA, 20 bp, Artificial Sequence
  Description of Artificial Sequence: Synthetic oligonucleotide
  Target: ATXN1; (-) strand; PAM type: YTN; PAM sequence: TTG
tcacatgtcatcctcatgtc

SEQ ID NO: 214121 - DNA, 20 bp, Artificial Sequence
  Description of Artificial Sequence: Synthetic oligonucleotide
  Target: ATXN1; (-) strand; PAM type: YTN; PAM sequence: CTT
gtcacatgtcatcctcatgt

SEQ ID NO: 214122 - DNA, 20 bp, Artificial Sequence
  Description of Artificial Sequence: Synthetic oligonucleotide
  Target: ATXN1; (-) strand; PAM type: YTN; PAM sequence: CTA
agtcatcttgtcacatgtca

SEQ ID NO: 214123 - DNA, 20 bp, Artificial Sequence
  Description of Artificial Sequence: Synthetic oligonucleotide
  Target: ATXN1; (-) strand; PAM type: YTN; PAM sequence: CTC
taagtcatcttgtcacatgt

SEQ ID NO: 214124 - DNA, 20 bp, Artificial Sequence
  Description of Artificial Sequence: Synthetic oligonucleotide
  Target: ATXN1; (-) strand; PAM type: YTN; PAM sequence: TTA
gcaggctctaagtcatcttg

SEQ ID NO: 214125 - DNA, 20 bp, Artificial Sequence
  Description of Artificial Sequence: Synthetic oligonucleotide
  Target: ATXN1; (-) strand; PAM type: YTN; PAM sequence: TTT
agcaggctctaagtcatctt

SEQ ID NO: 214126 - DNA, 20 bp, Artificial Sequence
  Description of Artificial Sequence: Synthetic oligonucleotide
  Target: ATXN1; (-) strand; PAM type: YTN; PAM sequence: TTC
atttagcaggctctaagtca

SEQ ID NO: 214127 - DNA, 20 bp, Artificial Sequence
  Description of Artificial Sequence: Synthetic oligonucleotide
  Target: ATXN1; (-) strand; PAM type: YTN; PAM sequence: CTC
atgtgttcatttagcaggct

SEQ ID NO: 214128 - DNA, 20 bp, Artificial Sequence
  Description of Artificial Sequence: Synthetic oligonucleotide
  Target: ATXN1; (-) strand; PAM type: YTN; PAM sequence: TTA
gctcatgtgttcatttagca

SEQ ID NO: 214129 - DNA, 20 bp, Artificial Sequence
  Description of Artificial Sequence: Synthetic oligonucleotide
  Target: ATXN1; (-) strand; PAM type: YTN; PAM sequence: TTT
agctcatgtgttcatttagc

SEQ ID NO: 214130 - DNA, 20 bp, Artificial Sequence
  Description of Artificial Sequence: Synthetic oligonucleotide
  Target: ATXN1; (-) strand; PAM type: YTN; PAM sequence: CTA
gcatttagctcatgtgttca

SEQ ID NO: 214131 - DNA, 20 bp, Artificial Sequence
  Description of Artificial Sequence: Synthetic oligonucleotide
  Target: ATXN1; (-) strand; PAM type: YTN; PAM sequence: CTC
atggaaagcacagtggtacc

SEQ ID NO: 214132 - DNA, 20 bp, Artificial Sequence
  Description of Artificial Sequence: Synthetic oligonucleotide
  Target: ATXN1; (-) strand; PAM type: YTN; PAM sequence: CTA
acaatctcatggaaagcaca

SEQ ID NO: 214133 - DNA, 20 bp, Artificial Sequence
  Description of Artificial Sequence: Synthetic oligonucleotide
  Target: ATXN1; (-) strand; PAM type: YTN; PAM sequence: CTG
cctaacaatctcatggaaag

SEQ ID NO: 214134 - DNA, 20 bp, Artificial Sequence
  Description of Artificial Sequence: Synthetic oligonucleotide
  Target: ATXN1; (-) strand; PAM type: YTN; PAM sequence: TTC
tgcctaacaatctcatggaa

SEQ ID NO: 214135 - DNA, 20 bp, Artificial Sequence
  Description of Artificial Sequence: Synthetic oligonucleotide
  Target: ATXN1; (-) strand; PAM type: YTN; PAM sequence: CTT
ctgcctaacaatctcatgga

SEQ ID NO: 214136 - DNA, 20 bp, Artificial Sequence
  Description of Artificial Sequence: Synthetic oligonucleotide
  Target: ATXN1; (-) strand; PAM type: YTN; PAM sequence: TTC
cttctgcctaacaatctcat

SEQ ID NO: 214137 - DNA, 20 bp, Artificial Sequence
  Description of Artificial Sequence: Synthetic oligonucleotide
  Target: ATXN1; (-) strand; PAM type: YTN; PAM sequence: TTT
ccttctgcctaacaatctca

SEQ ID NO: 214138 - DNA, 20 bp, Artificial Sequence
  Description of Artificial Sequence: Synthetic oligonucleotide
  Target: ATXN1; (-) strand; PAM type: YTN; PAM sequence: TTT
tccttctgcctaacaatctc

SEQ ID NO: 214139 - DNA, 20 bp, Artificial Sequence
  Description of Artificial Sequence: Synthetic oligonucleotide
  Target: ATXN1; (-) strand; PAM type: YTN; PAM sequence: TTC
agtgttttccttctgcctaa

SEQ ID NO: 214140 - DNA, 20 bp, Artificial Sequence
  Description of Artificial Sequence: Synthetic oligonucleotide
  Target: ATXN1; (-) strand; PAM type: YTN; PAM sequence: TTG
gagagcaaagattcagtgtt

SEQ ID NO: 214141 - DNA, 20 bp, Artificial Sequence
  Description of Artificial Sequence: Synthetic oligonucleotide
  Target: ATXN1; (-) strand; PAM type: YTN; PAM sequence: TTT
ggagagcaaagattcagtgt

SEQ ID NO: 214142 - DNA, 20 bp, Artificial Sequence
  Description of Artificial Sequence: Synthetic oligonucleotide
  Target: ATXN1; (-) strand; PAM type: YTN; PAM sequence: CTT
tggagagcaaagattcagtg

SEQ ID NO: 214143 - DNA, 20 bp, Artificial Sequence
  Description of Artificial Sequence: Synthetic oligonucleotide
  Target: ATXN1; (-) strand; PAM type: YTN; PAM sequence: TTC
aaatcaaaactttggagagc

SEQ ID NO: 214144 - DNA, 20 bp, Artificial Sequence
  Description of Artificial Sequence: Synthetic oligonucleotide
  Target: ATXN1; (-) strand; PAM type: YTN; PAM sequence: CTG
tgtgaattcaaatcaaaact

SEQ ID NO: 214145 - DNA, 20 bp, Artificial Sequence
  Description of Artificial Sequence: Synthetic oligonucleotide
  Target: ATXN1; (-) strand; PAM type: YTN; PAM sequence: TTG
cctgtgtgaattcaaatcaa

SEQ ID NO: 214146 - DNA, 20 bp, Artificial Sequence
  Description of Artificial Sequence: Synthetic oligonucleotide
  Target: ATXN1; (-) strand; PAM type: YTN; PAM sequence: CTT
gcctgtgtgaattcaaatca

SEQ ID NO: 214147 - DNA, 20 bp, Artificial Sequence
  Description of Artificial Sequence: Synthetic oligonucleotide
  Target: ATXN1; (-) strand; PAM type: YTN; PAM sequence: TTG
acaagaatcttgcctgtgtg

SEQ ID NO: 214148 - DNA, 20 bp, Artificial Sequence
  Description of Artificial Sequence: Synthetic oligonucleotide
  Target: ATXN1; (-) strand; PAM type: YTN; PAM sequence: CTG
ggtcattgacaagaatcttg

SEQ ID NO: 214149 - DNA, 20 bp, Artificial Sequence
  Description of Artificial Sequence: Synthetic oligonucleotide
  Target: ATXN1; (-) strand; PAM type: YTN; PAM sequence: TTC
tgggtcattgacaagaatct

SEQ ID NO: 214150 - DNA, 20 bp, Artificial Sequence
  Description of Artificial Sequence: Synthetic oligonucleotide
  Target: ATXN1; (-) strand; PAM type: YTN; PAM sequence: TTA
agtgattctgggtcattgac

SEQ ID NO: 214151 - DNA, 20 bp, Artificial Sequence
  Description of Artificial Sequence: Synthetic oligonucleotide
  Target: ATXN1; (-) strand; PAM type: YTN; PAM sequence: CTT
aagtgattctgggtcattga

SEQ ID NO: 214152 - DNA, 20 bp, Artificial Sequence
  Description of Artificial Sequence: Synthetic oligonucleotide
  Target: ATXN1; (-) strand; PAM type: YTN; PAM sequence: CTC
ggggcttaagtgattctggg

SEQ ID NO: 214153 - DNA, 20 bp, Artificial Sequence
  Description of Artificial Sequence: Synthetic oligonucleotide
  Target: ATXN1; (-) strand; PAM type: YTN; PAM sequence: CTG
gtggcatggccccctcgggg

SEQ ID NO: 214154 - DNA, 20 bp, Artificial Sequence
  Description of Artificial Sequence: Synthetic oligonucleotide
  Target: ATXN1; (-) strand; PAM type: YTN; PAM sequence: CTG
tgctggtggcatggccccct

SEQ ID NO: 214155 - DNA, 20 bp, Artificial Sequence
  Description of Artificial Sequence: Synthetic oligonucleotide
  Target: ATXN1; (-) strand; PAM type: YTN; PAM sequence: CTG
ctgtgctggtggcatggccc

SEQ ID NO: 214156 - DNA, 20 bp, Artificial Sequence
  Description of Artificial Sequence: Synthetic oligonucleotide
  Target: ATXN1; (-) strand; PAM type: YTN; PAM sequence: CTG
gccctgctgtgctggtggca

SEQ ID NO: 214157 - DNA, 20 bp, Artificial Sequence
  Description of Artificial Sequence: Synthetic oligonucleotide
  Target: ATXN1; (-) strand; PAM type: YTN; PAM sequence: TTC
atgatctggccctgctgtgc

SEQ ID NO: 214158 - DNA, 20 bp, Artificial Sequence
  Description of Artificial Sequence: Synthetic oligonucleotide
  Target: ATXN1; (-) strand; PAM type: YTN; PAM sequence: CTT
catgatctggccctgctgtg

SEQ ID NO: 214159 - DNA, 20 bp, Artificial Sequence
  Description of Artificial Sequence: Synthetic oligonucleotide
  Target: ATXN1; (-) strand; PAM type: YTN; PAM sequence: TTA
cagcccccaaccccgcatcc

SEQ ID NO: 214160 - DNA, 20 bp, Artificial Sequence
  Description of Artificial Sequence: Synthetic oligonucleotide
  Target: ATXN1; (-) strand; PAM type: YTN; PAM sequence: CTT
acagcccccaaccccgcatc

SEQ ID NO: 214161 - DNA, 20 bp, Artificial Sequence
  Description of Artificial Sequence: Synthetic oligonucleotide
  Target: ATXN1; (-) strand; PAM type: YTN; PAM sequence: TTG
acagcgagacccttacagcc

SEQ ID NO: 214162 - DNA, 20 bp, Artificial Sequence
  Description of Artificial Sequence: Synthetic oligonucleotide
  Target: ATXN1; (-) strand; PAM type: YTN; PAM sequence: CTT
gacagcgagacccttacagc

SEQ ID NO: 214163 - DNA, 20 bp, Artificial Sequence
  Description of Artificial Sequence: Synthetic oligonucleotide
  Target: ATXN1; (-) strand; PAM type: YTN; PAM sequence: CTG
gtggggccacatcttgacag

SEQ ID NO: 214164 - DNA, 20 bp, Artificial Sequence
  Description of Artificial Sequence: Synthetic oligonucleotide
  Target: ATXN1; (-) strand; PAM type: YTN; PAM sequence: TTA
gcactggtggggccacatct

SEQ ID NO: 214165 - DNA, 20 bp, Artificial Sequence
  Description of Artificial Sequence: Synthetic oligonucleotide
  Target: ATXN1; (-) strand; PAM type: YTN; PAM sequence: CTT
agcactggtggggccacatc

SEQ ID NO: 214166 - DNA, 20 bp, Artificial Sequence
  Description of Artificial Sequence: Synthetic oligonucleotide
  Target: ATXN1; (-) strand; PAM type: YTN; PAM sequence: CTA
taaacttagcactggtgggg

SEQ ID NO: 214167 - DNA, 20 bp, Artificial Sequence
  Description of Artificial Sequence: Synthetic oligonucleotide
  Target: ATXN1; (-) strand; PAM type: YTN; PAM sequence: TTG
gagcactataaacttagcac

SEQ ID NO: 214168 - DNA, 20 bp, Artificial Sequence
  Description of Artificial Sequence: Synthetic oligonucleotide
  Target: ATXN1; (-) strand; PAM type: YTN; PAM sequence: TTT
ggagcactataaacttagca

SEQ ID NO: 214169 - DNA, 20 bp, Artificial Sequence
  Description of Artificial Sequence: Synthetic oligonucleotide
  Target: ATXN1; (-) strand; PAM type: YTN; PAM sequence: TTT
tggagcactataaacttagc

SEQ ID NO: 214170 - DNA, 20 bp, Artificial Sequence
  Description of Artificial Sequence: Synthetic oligonucleotide
  Target: ATXN1; (-) strand; PAM type: YTN; PAM sequence: CTT
ttggagcactataaacttag

SEQ ID NO: 214171 - DNA, 20 bp, Artificial Sequence
  Description of Artificial Sequence: Synthetic oligonucleotide
  Target: ATXN1; (-) strand; PAM type: YTN; PAM sequence: CTG
gcttttggagcactataaac

SEQ ID NO: 214172 - DNA, 20 bp, Artificial Sequence
  Description of Artificial Sequence: Synthetic oligonucleotide
  Target: ATXN1; (-) strand; PAM type: YTN; PAM sequence: CTC
ctggcttttggagcactata

SEQ ID NO: 214173 - DNA, 20 bp, Artificial Sequence
  Description of Artificial Sequence: Synthetic oligonucleotide
  Target: ATXN1; (-) strand; PAM type: YTN; PAM sequence: TTA
acccccctcctggcttttgg

SEQ ID NO: 214174 - DNA, 20 bp, Artificial Sequence
  Description of Artificial Sequence: Synthetic oligonucleotide
  Target: ATXN1; (-) strand; PAM type: YTN; PAM sequence: CTT
aacccccctcctggcttttg

SEQ ID NO: 214175 - DNA, 20 bp, Artificial Sequence
  Description of Artificial Sequence: Synthetic oligonucleotide
  Target: ATXN1; (-) strand; PAM type: YTN; PAM sequence: TTC
ttaacccccctcctggcttt

SEQ ID NO: 214176 - DNA, 20 bp, Artificial Sequence
  Description of Artificial Sequence: Synthetic oligonucleotide
  Target: ATXN1; (-) strand; PAM type: YTN; PAM sequence: TTT
cttaacccccctcctggctt

SEQ ID NO: 214177 - DNA, 20 bp, Artificial Sequence
  Description of Artificial Sequence: Synthetic oligonucleotide
  Target: ATXN1; (-) strand; PAM type: YTN; PAM sequence: TTT
tcttaacccccctcctggct

SEQ ID NO: 214178 - DNA, 20 bp, Artificial Sequence
  Description of Artificial Sequence: Synthetic oligonucleotide
  Target: ATXN1; (-) strand; PAM type: YTN; PAM sequence: TTT
ttcttaacccccctcctggc

SEQ ID NO: 214179 - DNA, 20 bp, Artificial Sequence
  Description of Artificial Sequence: Synthetic oligonucleotide
  Target: ATXN1; (-) strand; PAM type: YTN; PAM sequence: TTT
tttcttaacccccctcctgg

SEQ ID NO: 214180 - DNA, 20 bp, Artificial Sequence
  Description of Artificial Sequence: Synthetic oligonucleotide
  Target: ATXN1; (-) strand; PAM type: YTN; PAM sequence: TTT
ttttcttaacccccctcctg

SEQ ID NO: 214181 - DNA, 20 bp, Artificial Sequence
  Description of Artificial Sequence: Synthetic oligonucleotide
  Target: ATXN1; (-) strand; PAM type: YTN; PAM sequence: TTT
tttttcttaacccccctcct

SEQ ID NO: 214182 - DNA, 20 bp, Artificial Sequence
  Description of Artificial Sequence: Synthetic oligonucleotide
  Target: ATXN1; (-) strand; PAM type: YTN; PAM sequence: TTT
ttttttcttaacccccctcc

SEQ ID NO: 214183 - DNA, 20 bp, Artificial Sequence
  Description of Artificial Sequence: Synthetic oligonucleotide
  Target: ATXN1; (-) strand; PAM type: YTN; PAM sequence: TTT
tttttttcttaacccccctc

SEQ ID NO: 214184 - DNA, 20 bp, Artificial Sequence
  Description of Artificial Sequence: Synthetic oligonucleotide
  Target: ATXN1; (-) strand; PAM type: YTN; PAM sequence: TTG
cattttttttttcttaaccc

SEQ ID NO: 214185 - DNA, 20 bp, Artificial Sequence
  Description of Artificial Sequence: Synthetic oligonucleotide
  Target: ATXN1; (-) strand; PAM type: YTN; PAM sequence: TTT
gcattttttttttcttaacc

SEQ ID NO: 214186 - DNA, 20 bp, Artificial Sequence
  Description of Artificial Sequence: Synthetic oligonucleotide
  Target: ATXN1; (-) strand; PAM type: YTN; PAM sequence: TTT
tgcattttttttttcttaac

SEQ ID NO: 214187 - DNA, 20 bp, Artificial Sequence
  Description of Artificial Sequence: Synthetic oligonucleotide
  Target: ATXN1; (-) strand; PAM type: YTN; PAM sequence: TTT
ttgcattttttttttcttaa

SEQ ID NO: 214188 - DNA, 20 bp, Artificial Sequence
  Description of Artificial Sequence: Synthetic oligonucleotide
  Target: ATXN1; (-) strand; PAM type: YTN; PAM sequence: TTT
tttgcattttttttttctta

SEQ ID NO: 214189 - DNA, 20 bp, Artificial Sequence
  Description of Artificial Sequence: Synthetic oligonucleotide
  Target: ATXN1; (-) strand; PAM type: YTN; PAM sequence: TTG
ttttttgcattttttttttc

SEQ ID NO: 214190 - DNA, 20 bp, Artificial Sequence
  Description of Artificial Sequence: Synthetic oligonucleotide
  Target: ATXN1; (-) strand; PAM type: YTN; PAM sequence: CTT
gttttttgcatttttttttt

SEQ ID NO: 214191 - DNA, 20 bp, Artificial Sequence
  Description of Artificial Sequence: Synthetic oligonucleotide
  Target: ATXN1; (-) strand; PAM type: YTN; PAM sequence: TTC
ttgttttttgcatttttttt

SEQ ID NO: 214192 - DNA, 20 bp, Artificial Sequence
  Description of Artificial Sequence: Synthetic oligonucleotide
  Target: ATXN1; (-) strand; PAM type: YTN; PAM sequence: TTG
tggcatggtaattcttgttt

SEQ ID NO: 214193 - DNA, 20 bp, Artificial Sequence
  Description of Artificial Sequence: Synthetic oligonucleotide
  Target: ATXN1; (-) strand; PAM type: YTN; PAM sequence: TTT
gtggcatggtaattcttgtt

SEQ ID NO: 214194 - DNA, 20 bp, Artificial Sequence
  Description of Artificial Sequence: Synthetic oligonucleotide
  Target: ATXN1; (-) strand; PAM type: YTN; PAM sequence: TTC
atgtttgtggcatggtaatt

SEQ ID NO: 214195 - DNA, 20 bp, Artificial Sequence
  Description of Artificial Sequence: Synthetic oligonucleotide
  Target: ATXN1; (-) strand; PAM type: YTN; PAM sequence: CTG
tagaggttcatgtttgtggc

SEQ ID NO: 214196 - DNA, 20 bp, Artificial Sequence
  Description of Artificial Sequence: Synthetic oligonucleotide
  Target: ATXN1; (-) strand; PAM type: YTN; PAM sequence: TTC
tgtagaggttcatgtttgtg

SEQ ID NO: 214197 - DNA, 20 bp, Artificial Sequence
  Description of Artificial Sequence: Synthetic oligonucleotide
  Target: ATXN1; (-) strand; PAM type: YTN; PAM sequence: CTA
ggttctgtagaggttcatgt

SEQ ID NO: 214198 - DNA, 20 bp, Artificial Sequence
  Description of Artificial Sequence: Synthetic oligonucleotide
  Target: ATXN1; (-) strand; PAM type: YTN; PAM sequence: TTC
taggttctgtagaggttcat

SEQ ID NO: 214199 - DNA, 20 bp, Artificial Sequence
  Description of Artificial Sequence: Synthetic oligonucleotide
  Target: ATXN1; (-) strand; PAM type: YTN; PAM sequence: TTT
ctaggttctgtagaggttca

SEQ ID NO: 214200 - DNA, 20 bp, Artificial Sequence
  Description of Artificial Sequence: Synthetic oligonucleotide
  Target: ATXN1; (-) strand; PAM type: YTN; PAM sequence: TTT
tctaggttctgtagaggttc

SEQ ID NO: 214201 - DNA, 20 bp, Artificial Sequence
  Description of Artificial Sequence: Synthetic oligonucleotide
  Target: ATXN1; (-) strand; PAM type: YTN; PAM sequence: TTC
acattttctaggttctgtag

SEQ ID NO: 214202 - DNA, 20 bp, Artificial Sequence
  Description of Artificial Sequence: Synthetic oligonucleotide
  Target: ATXN1; (-) strand; PAM type: YTN; PAM sequence: TTT
cacattttctaggttctgta

SEQ ID NO: 214203 - DNA, 20 bp, Artificial Sequence
  Description of Artificial Sequence: Synthetic oligonucleotide
  Target: ATXN1; (-) strand; PAM type: YTN; PAM sequence: CTG
gcccaatttcacattttcta

SEQ ID NO: 214204 - DNA, 20 bp, Artificial Sequence
  Description of Artificial Sequence: Synthetic oligonucleotide
  Target: ATXN1; (-) strand; PAM type: YTN; PAM sequence: CTA
cagatgtgagcctggcccaa

SEQ ID NO: 214205 - DNA, 20 bp, Artificial Sequence
  Description of Artificial Sequence: Synthetic oligonucleotide
  Target: ATXN1; (-) strand; PAM type: YTN; PAM sequence: CTG
ggactacagatgtgagcctg

SEQ ID NO: 214206 - DNA, 20 bp, Artificial Sequence
  Description of Artificial Sequence: Synthetic oligonucleotide
  Target: ATXN1; (-) strand; PAM type: YTN; PAM sequence: CTA
aagtgctgggactacagatg

SEQ ID NO: 214207 - DNA, 20 bp, Artificial Sequence
  Description of Artificial Sequence: Synthetic oligonucleotide
  Target: ATXN1; (-) strand; PAM type: YTN; PAM sequence: CTC
ctaaagtgctgggactacag

SEQ ID NO: 214208 - DNA, 20 bp, Artificial Sequence
  Description of Artificial Sequence: Synthetic oligonucleotide
  Target: ATXN1; (-) strand; PAM type: YTN; PAM sequence: CTG
cctcctaaagtgctgggact

SEQ ID NO: 214209 - DNA, 20 bp, Artificial Sequence
  Description of Artificial Sequence: Synthetic oligonucleotide
  Target: ATXN1; (-) strand; PAM type: YTN; PAM sequence: CTC
tgcctcctaaagtgctggga

SEQ ID NO: 214210 - DNA, 20 bp, Artificial Sequence
  Description of Artificial Sequence: Synthetic oligonucleotide
  Target: ATXN1; (-) strand; PAM type: YTN; PAM sequence: TTC
acctctgcctcctaaagtgc

SEQ ID NO: 214211 - DNA, 20 bp, Artificial Sequence
  Description of Artificial Sequence: Synthetic oligonucleotide
  Target: ATXN1; (-) strand; PAM type: YTN; PAM sequence: CTC
aggtgatccattcacctctg

SEQ ID NO: 214212 - DNA, 20 bp, Artificial Sequence
  Description of Artificial Sequence: Synthetic oligonucleotide
  Target: ATXN1; (-) strand; PAM type: YTN; PAM sequence: CTC
cagacctcaggtgatccatt

SEQ ID NO: 214213 - DNA, 20 bp, Artificial Sequence
  Description of Artificial Sequence: Synthetic oligonucleotide
  Target: ATXN1; (-) strand; PAM type: YTN; PAM sequence: CTC
gaactccagacctcaggtga

SEQ ID NO: 214214 - DNA, 20 bp, Artificial Sequence
  Description of Artificial Sequence: Synthetic oligonucleotide
  Target: ATXN1; (-) strand; PAM type: YTN; PAM sequence: TTA
gtagcgacgaggtctcgaac

SEQ ID NO: 214215 - DNA, 20 bp, Artificial Sequence
  Description of Artificial Sequence: Synthetic oligonucleotide
  Target: ATXN1; (-) strand; PAM type: YTN; PAM sequence: TTA
ttagtagcgacgaggtctcg

SEQ ID NO: 214216 - DNA, 20 bp, Artificial Sequence
  Description of Artificial Sequence: Synthetic oligonucleotide
  Target: ATXN1; (-) strand; PAM type: YTN; PAM sequence: TTG
tgttattagtagcgacgagg

SEQ ID NO: 214217 - DNA, 20 bp, Artificial Sequence
  Description of Artificial Sequence: Synthetic oligonucleotide
  Target: ATXN1; (-) strand; PAM type: YTN; PAM sequence: TTT
gtgttattagtagcgacgag

SEQ ID NO: 214218 - DNA, 20 bp, Artificial Sequence
  Description of Artificial Sequence: Synthetic oligonucleotide
  Target: ATXN1; (-) strand; PAM type: YTN; PAM sequence: TTT
tgtgttattagtagcgacga

SEQ ID NO: 214219 - DNA, 20 bp, Artificial Sequence
  Description of Artificial Sequence: Synthetic oligonucleotide
  Target: ATXN1; (-) strand; PAM type: YTN; PAM sequence: TTT
ttgtgttattagtagcgacg

SEQ ID NO: 214220 - DNA, 20 bp, Artificial Sequence
  Description of Artificial Sequence: Synthetic oligonucleotide
  Target: ATXN1; (-) strand; PAM type: YTN; PAM sequence: TTT
tttgtgttattagtagcgac

SEQ ID NO: 214221 - DNA, 20 bp, Artificial Sequence
  Description of Artificial Sequence: Synthetic oligonucleotide
  Target: ATXN1; (-) strand; PAM type: YTN; PAM sequence: TTT
ttttgtgttattagtagcga

SEQ ID NO: 214222 - DNA, 20 bp, Artificial Sequence
  Description of Artificial Sequence: Synthetic oligonucleotide
  Target: ATXN1; (-) strand; PAM type: YTN; PAM sequence: CTA
atttttttgtgttattagta

SEQ ID NO: 214223 - DNA, 20 bp, Artificial Sequence
  Description of Artificial Sequence: Synthetic oligonucleotide
  Target: ATXN1; (-) strand; PAM type: YTN; PAM sequence: TTA
caggcgcatgccaccacacc

SEQ ID NO: 214224 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgcatgccac

SEQ ID NO: 214225 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 214226 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 214227 - DNA, 20 bp, Artificial Sequence
  Description of Artificial Sequence: Synthetic oligonucleotide
  Target: ATXN1; (-) strand; PAM type: YTN; PAM sequence: CTG
tctcagcctcccaagtagct

SEQ ID NO: 214228 - DNA, 20 bp, Artificial Sequence
  Description of Artificial Sequence: Synthetic oligonucleotide
  Target: ATXN1; (-) strand; PAM type: YTN; PAM sequence: CTC
ctgtctcagcctcccaagta

SEQ ID NO: 214229 - DNA, 20 bp, Artificial Sequence
  Description of Artificial Sequence: Synthetic oligonucleotide
  Target: ATXN1; (-) strand; PAM type: YTN; PAM sequence: TTC
tcctgtctcagcctcccaag

SEQ ID NO: 214230 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgtctcag

SEQ ID NO: 214231 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcgattctcc

SEQ ID NO: 214232 - DNA, 20 bp, Artificial Sequence
  Description of Artificial Sequence: Synthetic oligonucleotide
  Target: ATXN1; (-) strand; PAM type: YTN; PAM sequence: CTC
cacctcccaggttcaagcga

SEQ ID NO: 214233 - DNA, 20 bp, Artificial Sequence
  Description of Artificial Sequence: Synthetic oligonucleotide
  Target: ATXN1; (-) strand; PAM type: YTN; PAM sequence: CTG
caacctccacctcccaggtt

SEQ ID NO: 214234 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccacctccca

SEQ ID NO: 214235 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacctccacct

SEQ ID NO: 214236 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacctccacc

SEQ ID NO: 214237 - DNA, 20 bp, Artificial Sequence
  Description of Artificial Sequence: Synthetic oligonucleotide
  Target: ATXN1; (-) strand; PAM type: YTN; PAM sequence: CTA
gagagcaatgacgtgatctt

SEQ ID NO: 214238 - DNA, 20 bp, Artificial Sequence
  Description of Artificial Sequence: Synthetic oligonucleotide
  Target: ATXN1; (-) strand; PAM type: YTN; PAM sequence: TTG
cccaggctagagagcaatga

SEQ ID NO: 214239 - DNA, 20 bp, Artificial Sequence
  Description of Artificial Sequence: Synthetic oligonucleotide
  Target: ATXN1; (-) strand; PAM type: YTN; PAM sequence: TTG
ttgcccaggctagagagcaa

SEQ ID NO: 214240 - DNA, 20 bp, Artificial Sequence
  Description of Artificial Sequence: Synthetic oligonucleotide
  Target: ATXN1; (-) strand; PAM type: YTN; PAM sequence: CTT
gttgcccaggctagagagca

SEQ ID NO: 214241 - DNA, 20 bp, Artificial Sequence
  Description of Artificial Sequence: Synthetic oligonucleotide
  Target: ATXN1; (-) strand; PAM type: YTN; PAM sequence: CTC
ttgttgcccaggctagagag

SEQ ID NO: 214242 - DNA, 20 bp, Artificial Sequence
  Description of Artificial Sequence: Synthetic oligonucleotide
  Target: ATXN1; (-) strand; PAM type: YTN; PAM sequence: TTG
ctcttgttgcccaggctaga

SEQ ID NO: 214243 - DNA, 20 bp, Artificial Sequence
  Description of Artificial Sequence: Synthetic oligonucleotide
  Target: ATXN1; (-) strand; PAM type: YTN; PAM sequence: TTT
gctcttgttgcccaggctag

SEQ ID NO: 214244 - DNA, 20 bp, Artificial Sequence
  Description of Artificial Sequence: Synthetic oligonucleotide
  Target: ATXN1; (-) strand; PAM type: YTN; PAM sequence: TTT
tgctcttgttgcccaggcta

SEQ ID NO: 214245 - DNA, 20 bp, Artificial Sequence
  Description of Artificial Sequence: Synthetic oligonucleotide
  Target: ATXN1; (-) strand; PAM type: YTN; PAM sequence: TTG
aggcggagttttgctcttgt

SEQ ID NO: 214246 - DNA, 20 bp, Artificial Sequence
  Description of Artificial Sequence: Synthetic oligonucleotide
  Target: ATXN1; (-) strand; PAM type: YTN; PAM sequence: TTT
gaggcggagttttgctcttg

SEQ ID NO: 214247 - DNA, 20 bp, Artificial Sequence
  Description of Artificial Sequence: Synthetic oligonucleotide
  Target: ATXN1; (-) strand; PAM type: YTN; PAM sequence: TTT
tgaggcggagttttgctctt

SEQ ID NO: 214248 - DNA, 20 bp, Artificial Sequence
  Description of Artificial Sequence: Synthetic oligonucleotide
  Target: ATXN1; (-) strand; PAM type: YTN; PAM sequence: TTT
ttgaggcggagttttgctct

SEQ ID NO: 214249 - DNA, 20 bp, Artificial Sequence
  Description of Artificial Sequence: Synthetic oligonucleotide
  Target: ATXN1; (-) strand; PAM type: YTN; PAM sequence: TTT
tttgaggcggagttttgctc

SEQ ID NO: 214250 - DNA, 20 bp, Artificial Sequence
  Description of Artificial Sequence: Synthetic oligonucleotide
  Target: ATXN1; (-) strand; PAM type: YTN; PAM sequence: TTT
ttttgaggcggagttttgct

SEQ ID NO: 214251 - DNA, 20 bp, Artificial Sequence
  Description of Artificial Sequence: Synthetic oligonucleotide
  Target: ATXN1; (-) strand; PAM type: YTN; PAM sequence: TTT
tttttgaggcggagttttgc

SEQ ID NO: 214252 - DNA, 20 bp, Artificial Sequence
  Description of Artificial Sequence: Synthetic oligonucleotide
  Target: ATXN1; (-) strand; PAM type: YTN; PAM sequence: TTT
ttttttgaggcggagttttg

SEQ ID NO: 214253 - DNA, 20 bp, Artificial Sequence
  Description of Artificial Sequence: Synthetic oligonucleotide
  Target: ATXN1; (-) strand; PAM type: YTN; PAM sequence: TTT
tttttttgaggcggagtttt

SEQ ID NO: 214254 - DNA, 20 bp, Artificial Sequence
  Description of Artificial Sequence: Synthetic oligonucleotide
  Target: ATXN1; (-) strand; PAM type: YTN; PAM sequence: TTT
ttttttttgaggcggagttt

SEQ ID NO: 214255 - DNA, 20 bp, Artificial Sequence
  Description of Artificial Sequence: Synthetic oligonucleotide
  Target: ATXN1; (-) strand; PAM type: YTN; PAM sequence: TTT
tttttttttgaggcggagtt

SEQ ID NO: 214256 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgaggcggagt

SEQ ID NO: 214257 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgaggcggag

SEQ ID NO: 214258 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttgaggcgga

SEQ ID NO: 214259 - DNA, 20 bp, Artificial Sequence
  Description of Artificial Sequence: Synthetic oligonucleotide
  Target: ATXN1; (-) strand; PAM type: YTN; PAM sequence: TTC
ttttttttttttttgaggcg

SEQ ID NO: 214260 - DNA, 20 bp, Artificial Sequence
  Description of Artificial Sequence: Synthetic oligonucleotide
  Target: ATXN1; (-) strand; PAM type: YTN; PAM sequence: TTT
cttttttttttttttgaggc

SEQ ID NO: 214261 - DNA, 20 bp, Artificial Sequence
  Description of Artificial Sequence: Synthetic oligonucleotide
  Target: ATXN1; (-) strand; PAM type: YTN; PAM sequence: TTT
tcttttttttttttttgagg

SEQ ID NO: 214262 - DNA, 20 bp, Artificial Sequence
  Description of Artificial Sequence: Synthetic oligonucleotide
  Target: ATXN1; (-) strand; PAM type: YTN; PAM sequence: CTT
ttcttttttttttttttgag

SEQ ID NO: 214263 - DNA, 20 bp, Artificial Sequence
  Description of Artificial Sequence: Synthetic oligonucleotide
  Target: ATXN1; (-) strand; PAM type: YTN; PAM sequence: TTC
ttttcttttttttttttttg

SEQ ID NO: 214264 - DNA, 20 bp, Artificial Sequence
  Description of Artificial Sequence: Synthetic oligonucleotide
  Target: ATXN1; (-) strand; PAM type: YTN; PAM sequence: TTT
cttttctttttttttttttt

SEQ ID NO: 214265 - DNA, 20 bp, Artificial Sequence
  Description of Artificial Sequence: Synthetic oligonucleotide
  Target: ATXN1; (-) strand; PAM type: YTN; PAM sequence: CTT
tcttttcttttttttttttt

SEQ ID NO: 214266 - DNA, 20 bp, Artificial Sequence
  Description of Artificial Sequence: Synthetic oligonucleotide
  Target: ATXN1; (-) strand; PAM type: YTN; PAM sequence: TTC
tttcttttcttttttttttt

SEQ ID NO: 214267 - DNA, 20 bp, Artificial Sequence
  Description of Artificial Sequence: Synthetic oligonucleotide
  Target: ATXN1; (-) strand; PAM type: YTN; PAM sequence: TTT
ctttcttttctttttttttt

SEQ ID NO: 214268 - DNA, 20 bp, Artificial Sequence
  Description of Artificial Sequence: Synthetic oligonucleotide
  Target: ATXN1; (-) strand; PAM type: YTN; PAM sequence: TTC
atttctttcttttctttttt

SEQ ID NO: 214269 - DNA, 20 bp, Artificial Sequence
  Description of Artificial Sequence: Synthetic oligonucleotide
  Target: ATXN1; (-) strand; PAM type: YTN; PAM sequence: TTT
catttctttcttttcttttt

SEQ ID NO: 214270 - DNA, 20 bp, Artificial Sequence
  Description of Artificial Sequence: Synthetic oligonucleotide
  Target: ATXN1; (-) strand; PAM type: YTN; PAM sequence: TTT
tcatttctttcttttctttt

SEQ ID NO: 214271 - DNA, 20 bp, Artificial Sequence
  Description of Artificial Sequence: Synthetic oligonucleotide
  Target: ATXN1; (-) strand; PAM type: YTN; PAM sequence: TTC
acattttcatttctttcttt

SEQ ID NO: 214272 - DNA, 20 bp, Artificial Sequence
  Description of Artificial Sequence: Synthetic oligonucleotide
  Target: ATXN1; (-) strand; PAM type: YTN; PAM sequence: TTT
cacattttcatttctttctt

SEQ ID NO: 214273 - DNA, 20 bp, Artificial Sequence
  Description of Artificial Sequence: Synthetic oligonucleotide
  Target: ATXN1; (-) strand; PAM type: YTN; PAM sequence: TTA
acaatttcacattttcattt

SEQ ID NO: 214274 - DNA, 20 bp, Artificial Sequence
  Description of Artificial Sequence: Synthetic oligonucleotide
  Target: ATXN1; (-) strand; PAM type: YTN; PAM sequence: CTT
aacaatttcacattttcatt

SEQ ID NO: 214275 - DNA, 20 bp, Artificial Sequence
  Description of Artificial Sequence: Synthetic oligonucleotide
  Target: ATXN1; (-) strand; PAM type: YTN; PAM sequence: TTG
tcttaacaatttcacatttt

SEQ ID NO: 214276 - DNA, 20 bp, Artificial Sequence
  Description of Artificial Sequence: Synthetic oligonucleotide
  Target: ATXN1; (-) strand; PAM type: YTN; PAM sequence: CTC
caaattgtcttaacaatttc

SEQ ID NO: 214277 - DNA, 20 bp, Artificial Sequence
  Description of Artificial Sequence: Synthetic oligonucleotide
  Target: ATXN1; (-) strand; PAM type: YTN; PAM sequence: TTA
aactccaaattgtcttaaca

SEQ ID NO: 214278 - DNA, 20 bp, Artificial Sequence
  Description of Artificial Sequence: Synthetic oligonucleotide
  Target: ATXN1; (-) strand; PAM type: YTN; PAM sequence: CTT
aaactccaaattgtcttaac

SEQ ID NO: 214279 - DNA, 20 bp, Artificial Sequence
  Description of Artificial Sequence: Synthetic oligonucleotide
  Target: ATXN1; (-) strand; PAM type: YTN; PAM sequence: TTC
ccttaaactccaaattgtct

SEQ ID NO: 214280 - DNA, 20 bp, Artificial Sequence
  Description of Artificial Sequence: Synthetic oligonucleotide
  Target: ATXN1; (-) strand; PAM type: YTN; PAM sequence: TTT
cccttaaactccaaattgtc

SEQ ID NO: 214281 - DNA, 20 bp, Artificial Sequence
  Description of Artificial Sequence: Synthetic oligonucleotide
  Target: ATXN1; (-) strand; PAM type: YTN; PAM sequence: TTT
tcccttaaactccaaattgt

SEQ ID NO: 214282 - DNA, 20 bp, Artificial Sequence
  Description of Artificial Sequence: Synthetic oligonucleotide
  Target: ATXN1; (-) strand; PAM type: YTN; PAM sequence: CTT
ttcccttaaactccaaattg

SEQ ID NO: 214283 - DNA, 20 bp, Artificial Sequence
  Description of Artificial Sequence: Synthetic oligonucleotide
  Target: ATXN1; (-) strand; PAM type: YTN; PAM sequence: TTC
aaaaatgtgcttttccctta

SEQ ID NO: 214284 - DNA, 20 bp, Artificial Sequence
  Description of Artificial Sequence: Synthetic oligonucleotide
  Target: ATXN1; (-) strand; PAM type: YTN; PAM sequence: TTT
caaaaatgtgcttttccctt

SEQ ID NO: 214285 - DNA, 20 bp, Artificial Sequence
  Description of Artificial Sequence: Synthetic oligonucleotide
  Target: ATXN1; (-) strand; PAM type: YTN; PAM sequence: CTT
tcaaaaatgtgcttttccct

SEQ ID NO: 214286 - DNA, 20 bp, Artificial Sequence
  Description of Artificial Sequence: Synthetic oligonucleotide
  Target: ATXN1; (-) strand; PAM type: YTN; PAM sequence: TTC
cactttcaaaaatgtgcttt

SEQ ID NO: 214287 - DNA, 20 bp, Artificial Sequence
  Description of Artificial Sequence: Synthetic oligonucleotide
  Target: ATXN1; (-) strand; PAM type: YTN; PAM sequence: TTT
ccactttcaaaaatgtgctt

SEQ ID NO: 214288 - DNA, 20 bp, Artificial Sequence
  Description of Artificial Sequence: Synthetic oligonucleotide
  Target: ATXN1; (-) strand; PAM type: YTN; PAM sequence: TTT
tccactttcaaaaatgtgct

SEQ ID NO: 214289 - DNA, 20 bp, Artificial Sequence
  Description of Artificial Sequence: Synthetic oligonucleotide
  Target: ATXN1; (-) strand; PAM type: YTN; PAM sequence: CTA
ttttccactttcaaaaatgt

SEQ ID NO: 214290 - DNA, 20 bp, Artificial Sequence
  Description of Artificial Sequence: Synthetic oligonucleotide
  Target: ATXN1; (-) strand; PAM type: YTN; PAM sequence: CTC
atctattttccactttcaaa

SEQ ID NO: 214291 - DNA, 20 bp, Artificial Sequence
  Description of Artificial Sequence: Synthetic oligonucleotide
  Target: ATXN1; (-) strand; PAM type: YTN; PAM sequence: TTC
tcatctattttccactttca

SEQ ID NO: 214292 - DNA, 20 bp, Artificial Sequence
  Description of Artificial Sequence: Synthetic oligonucleotide
  Target: ATXN1; (-) strand; PAM type: YTN; PAM sequence: TTT
ctcatctattttccactttc

SEQ ID NO: 214293 - DNA, 20 bp, Artificial Sequence
  Description of Artificial Sequence: Synthetic oligonucleotide
  Target: ATXN1; (-) strand; PAM type: YTN; PAM sequence: TTA
tgtttctcatctattttcca

SEQ ID NO: 214294 - DNA, 20 bp, Artificial Sequence
  Description of Artificial Sequence: Synthetic oligonucleotide
  Target: ATXN1; (-) strand; PAM type: YTN; PAM sequence: TTT
atgtttctcatctattttcc

SEQ ID NO: 214295 - DNA, 20 bp, Artificial Sequence
  Description of Artificial Sequence: Synthetic oligonucleotide
  Target: ATXN1; (-) strand; PAM type: YTN; PAM sequence: CTG
taacaatgcgtagcaaatgt

SEQ ID NO: 214296 - DNA, 20 bp, Artificial Sequence
  Description of Artificial Sequence: Synthetic oligonucleotide
  Target: ATXN1; (-) strand; PAM type: YTN; PAM sequence: TTA
taacaaaatgaccatatatc

SEQ ID NO: 214297 - DNA, 20 bp, Artificial Sequence
  Description of Artificial Sequence: Synthetic oligonucleotide
  Target: ATXN1; (-) strand; PAM type: YTN; PAM sequence: TTT
ataacaaaatgaccatatat

SEQ ID NO: 214298 - DNA, 20 bp, Artificial Sequence
  Description of Artificial Sequence: Synthetic oligonucleotide
  Target: ATXN1; (-) strand; PAM type: YTN; PAM sequence: CTT
tataacaaaatgaccatata

SEQ ID NO: 214299 - DNA, 20 bp, Artificial Sequence
  Description of Artificial Sequence: Synthetic oligonucleotide
  Target: ATXN1; (-) strand; PAM type: YTN; PAM sequence: TTC
tttataacaaaatgaccata

SEQ ID NO: 214300 - DNA, 20 bp, Artificial Sequence
  Description of Artificial Sequence: Synthetic oligonucleotide
  Target: ATXN1; (-) strand; PAM type: YTN; PAM sequence: TTT
ctttataacaaaatgaccat

SEQ ID NO: 214301 - DNA, 20 bp, Artificial Sequence
  Description of Artificial Sequence: Synthetic oligonucleotide
  Target: ATXN1; (-) strand; PAM type: YTN; PAM sequence: TTA
aatgtttctttataacaaaa

SEQ ID NO: 214302 - DNA, 20 bp, Artificial Sequence
  Description of Artificial Sequence: Synthetic oligonucleotide
  Target: ATXN1; (-) strand; PAM type: YTN; PAM sequence: TTT
aaatgtttctttataacaaa

SEQ ID NO: 214303 - DNA, 20 bp, Artificial Sequence
  Description of Artificial Sequence: Synthetic oligonucleotide
  Target: ATXN1; (-) strand; PAM type: YTN; PAM sequence: TTT
taaatgtttctttataacaa

SEQ ID NO: 214304 - DNA, 20 bp, Artificial Sequence
  Description of Artificial Sequence: Synthetic oligonucleotide
  Target: ATXN1; (-) strand; PAM type: YTN; PAM sequence: CTT
ttaaatgtttctttataaca

SEQ ID NO: 214305 - DNA, 20 bp, Artificial Sequence
  Description of Artificial Sequence: Synthetic oligonucleotide
  Target: ATXN1; (-) strand; PAM type: YTN; PAM sequence: CTC
cttttaaatgtttctttata

SEQ ID NO: 214306 - DNA, 20 bp, Artificial Sequence
  Description of Artificial Sequence: Synthetic oligonucleotide
  Target: ATXN1; (-) strand; PAM type: YTN; PAM sequence: TTA
acaggtgaaacatgcctcct

SEQ ID NO: 214307 - DNA, 20 bp, Artificial Sequence
  Description of Artificial Sequence: Synthetic oligonucleotide
  Target: ATXN1; (-) strand; PAM type: YTN; PAM sequence: TTA
tgaagtaaacaagttaacag

SEQ ID NO: 214308 - DNA, 20 bp, Artificial Sequence
  Description of Artificial Sequence: Synthetic oligonucleotide
  Target: ATXN1; (-) strand; PAM type: YTN; PAM sequence: CTT
atgaagtaaacaagttaaca

SEQ ID NO: 214309 - DNA, 20 bp, Artificial Sequence
  Description of Artificial Sequence: Synthetic oligonucleotide
  Target: ATXN1; (-) strand; PAM type: YTN; PAM sequence: CTA
cccaacaagagaatcttatg

SEQ ID NO: 214310 - DNA, 20 bp, Artificial Sequence
  Description of Artificial Sequence: Synthetic oligonucleotide
  Target: ATXN1; (-) strand; PAM type: YTN; PAM sequence: CTG
taaatctacccaacaagaga

SEQ ID NO: 214311 - DNA, 20 bp, Artificial Sequence
  Description of Artificial Sequence: Synthetic oligonucleotide
  Target: ATXN1; (-) strand; PAM type: YTN; PAM sequence: TTA
aatctgtaaatctacccaac

SEQ ID NO: 214312 - DNA, 20 bp, Artificial Sequence
  Description of Artificial Sequence: Synthetic oligonucleotide
  Target: ATXN1; (-) strand; PAM type: YTN; PAM sequence: CTT
aaatctgtaaatctacccaa

SEQ ID NO: 214313 - DNA, 20 bp, Artificial Sequence
  Description of Artificial Sequence: Synthetic oligonucleotide
  Target: ATXN1; (-) strand; PAM type: YTN; PAM sequence: TTA
tggcagtgccttaaatctgt

SEQ ID NO: 214314 - DNA, 20 bp, Artificial Sequence
  Description of Artificial Sequence: Synthetic oligonucleotide
  Target: ATXN1; (-) strand; PAM type: YTN; PAM sequence: TTT
atggcagtgccttaaatctg

SEQ ID NO: 214315 - DNA, 20 bp, Artificial Sequence
  Description of Artificial Sequence: Synthetic oligonucleotide
  Target: ATXN1; (-) strand; PAM type: YTN; PAM sequence: TTG
aaaagatttatggcagtgcc

SEQ ID NO: 214316 - DNA, 20 bp, Artificial Sequence
  Description of Artificial Sequence: Synthetic oligonucleotide
  Target: ATXN1; (-) strand; PAM type: YTN; PAM sequence: TTT
gaaaagatttatggcagtgc

SEQ ID NO: 214317 - DNA, 20 bp, Artificial Sequence
  Description of Artificial Sequence: Synthetic oligonucleotide
  Target: ATXN1; (-) strand; PAM type: YTN; PAM sequence: TTT
tgaaaagatttatggcagtg

SEQ ID NO: 214318 - DNA, 20 bp, Artificial Sequence
  Description of Artificial Sequence: Synthetic oligonucleotide
  Target: ATXN1; (-) strand; PAM type: YTN; PAM sequence: TTG
ttttgaaaagatttatggca

SEQ ID NO: 214319 - DNA, 20 bp, Artificial Sequence
  Description of Artificial Sequence: Synthetic oligonucleotide
  Target: ATXN1; (-) strand; PAM type: YTN; PAM sequence: CTT
gttttgaaaagatttatggc

SEQ ID NO: 214320 - DNA, 20 bp, Artificial Sequence
  Description of Artificial Sequence: Synthetic oligonucleotide
  Target: ATXN1; (-) strand; PAM type: YTN; PAM sequence: TTC
cttgttttgaaaagatttat

SEQ ID NO: 214321 - DNA, 20 bp, Artificial Sequence
  Description of Artificial Sequence: Synthetic oligonucleotide
  Target: ATXN1; (-) strand; PAM type: YTN; PAM sequence: CTT
ccttgttttgaaaagattta

SEQ ID NO: 214322 - DNA, 20 bp, Artificial Sequence
  Description of Artificial Sequence: Synthetic oligonucleotide
  Target: ATXN1; (-) strand; PAM type: YTN; PAM sequence: TTA
taatcttccttgttttgaaa

SEQ ID NO: 214323 - DNA, 20 bp, Artificial Sequence
  Description of Artificial Sequence: Synthetic oligonucleotide
  Target: ATXN1; (-) strand; PAM type: YTN; PAM sequence: TTT
ataatcttccttgttttgaa

SEQ ID NO: 214324 - DNA, 20 bp, Artificial Sequence
  Description of Artificial Sequence: Synthetic oligonucleotide
  Target: ATXN1; (-) strand; PAM type: YTN; PAM sequence: TTG
tttataatcttccttgtttt

SEQ ID NO: 214325 - DNA, 20 bp, Artificial Sequence
  Description of Artificial Sequence: Synthetic oligonucleotide
  Target: ATXN1; (-) strand; PAM type: YTN; PAM sequence: CTT
gtttataatcttccttgttt

SEQ ID NO: 214326 - DNA, 20 bp, Artificial Sequence
  Description of Artificial Sequence: Synthetic oligonucleotide
  Target: ATXN1; (-) strand; PAM type: YTN; PAM sequence: TTA
ccttgtttataatcttcctt

SEQ ID NO: 214327 - DNA, 20 bp, Artificial Sequence
  Description of Artificial Sequence: Synthetic oligonucleotide
  Target: ATXN1; (-) strand; PAM type: YTN; PAM sequence: TTA
attaccttgtttataatctt

SEQ ID NO: 214328 - DNA, 20 bp, Artificial Sequence
  Description of Artificial Sequence: Synthetic oligonucleotide
  Target: ATXN1; (-) strand; PAM type: YTN; PAM sequence: TTA
attaattaccttgtttataa

SEQ ID NO: 214329 - DNA, 20 bp, Artificial Sequence
  Description of Artificial Sequence: Synthetic oligonucleotide
  Target: ATXN1; (-) strand; PAM type: YTN; PAM sequence: TTA
aataattaattaattacctt

SEQ ID NO: 214330 - DNA, 20 bp, Artificial Sequence
  Description of Artificial Sequence: Synthetic oligonucleotide
  Target: ATXN1; (-) strand; PAM type: YTN; PAM sequence: TTA
attaaataattaattaatta

SEQ ID NO: 214331 - DNA, 20 bp, Artificial Sequence
  Description of Artificial Sequence: Synthetic oligonucleotide
  Target: ATXN1; (-) strand; PAM type: YTN; PAM sequence: TTG
ccgaattaattaaataatta

SEQ ID NO: 214332 - DNA, 20 bp, Artificial Sequence
  Description of Artificial Sequence: Synthetic oligonucleotide
  Target: ATXN1; (-) strand; PAM type: YTN; PAM sequence: TTT
gccgaattaattaaataatt

SEQ ID NO: 214333 - DNA, 20 bp, Artificial Sequence
  Description of Artificial Sequence: Synthetic oligonucleotide
  Target: ATXN1; (-) strand; PAM type: YTN; PAM sequence: TTG
tttgccgaattaattaaata

SEQ ID NO: 214334 - DNA, 20 bp, Artificial Sequence
  Description of Artificial Sequence: Synthetic oligonucleotide
  Target: ATXN1; (-) strand; PAM type: YTN; PAM sequence: CTT
gtttgccgaattaattaaat

SEQ ID NO: 214335 - DNA, 20 bp, Artificial Sequence
  Description of Artificial Sequence: Synthetic oligonucleotide
  Target: ATXN1; (-) strand; PAM type: YTN; PAM sequence: TTG
tcaatgggtgacttgtttgc

SEQ ID NO: 214336 - DNA, 20 bp, Artificial Sequence
  Description of Artificial Sequence: Synthetic oligonucleotide
  Target: ATXN1; (-) strand; PAM type: YTN; PAM sequence: CTT
gtcaatgggtgacttgtttg

SEQ ID NO: 214337 - DNA, 20 bp, Artificial Sequence
  Description of Artificial Sequence: Synthetic oligonucleotide
  Target: ATXN1; (-) strand; PAM type: YTN; PAM sequence: CTA
ggcttgtcaatgggtgactt

SEQ ID NO: 214338 - DNA, 20 bp, Artificial Sequence
  Description of Artificial Sequence: Synthetic oligonucleotide
  Target: ATXN1; (-) strand; PAM type: YTN; PAM sequence: TTC
taggcttgtcaatgggtgac

SEQ ID NO: 214339 - DNA, 20 bp, Artificial Sequence
  Description of Artificial Sequence: Synthetic oligonucleotide
  Target: ATXN1; (-) strand; PAM type: YTN; PAM sequence: TTT
ctaggcttgtcaatgggtga

SEQ ID NO: 214340 - DNA, 20 bp, Artificial Sequence
  Description of Artificial Sequence: Synthetic oligonucleotide
  Target: ATXN1; (-) strand; PAM type: YTN; PAM sequence: TTT
tctaggcttgtcaatgggtg

SEQ ID NO: 214341 - DNA, 20 bp, Artificial Sequence
  Description of Artificial Sequence: Synthetic oligonucleotide
  Target: ATXN1; (-) strand; PAM type: YTN; PAM sequence: TTT
ttctaggcttgtcaatgggt

SEQ ID NO: 214342 - DNA, 20 bp, Artificial Sequence
  Description of Artificial Sequence: Synthetic oligonucleotide
  Target: ATXN1; (-) strand; PAM type: YTN; PAM sequence: TTT
tttctaggcttgtcaatggg

SEQ ID NO: 214343 - DNA, 20 bp, Artificial Sequence
  Description of Artificial Sequence: Synthetic oligonucleotide
  Target: ATXN1; (-) strand; PAM type: YTN; PAM sequence: TTT
ttttctaggcttgtcaatgg

SEQ ID NO: 214344 - DNA, 20 bp, Artificial Sequence
  Description of Artificial Sequence: Synthetic oligonucleotide
  Target: ATXN1; (-) strand; PAM type: YTN; PAM sequence: TTG
ggtggcatttttttctaggc

SEQ ID NO: 214345 - DNA, 20 bp, Artificial Sequence
  Description of Artificial Sequence: Synthetic oligonucleotide
  Target: ATXN1; (-) strand; PAM type: YTN; PAM sequence: CTG
ataaaacaaacattgggtgg

SEQ ID NO: 214346 - DNA, 20 bp, Artificial Sequence
  Description of Artificial Sequence: Synthetic oligonucleotide
  Target: ATXN1; (-) strand; PAM type: YTN; PAM sequence: CTG
gaaaagaaaactgataaaac

SEQ ID NO: 214347 - DNA, 20 bp, Artificial Sequence
  Description of Artificial Sequence: Synthetic oligonucleotide
  Target: ATXN1; (-) strand; PAM type: YTN; PAM sequence: TTC
caaaactggaaaagaaaact

SEQ ID NO: 214348 - DNA, 20 bp, Artificial Sequence
  Description of Artificial Sequence: Synthetic oligonucleotide
  Target: ATXN1; (-) strand; PAM type: YTN; PAM sequence: CTT
ccaaaactggaaaagaaaac

SEQ ID NO: 214349 - DNA, 20 bp, Artificial Sequence
  Description of Artificial Sequence: Synthetic oligonucleotide
  Target: ATXN1; (-) strand; PAM type: YTN; PAM sequence: TTC
ccttccaaaactggaaaaga

SEQ ID NO: 214350 - DNA, 20 bp, Artificial Sequence
  Description of Artificial Sequence: Synthetic oligonucleotide
  Target: ATXN1; (-) strand; PAM type: YTN; PAM sequence: TTT
cccttccaaaactggaaaag

SEQ ID NO: 214351 - DNA, 20 bp, Artificial Sequence
  Description of Artificial Sequence: Synthetic oligonucleotide
  Target: ATXN1; (-) strand; PAM type: YTN; PAM sequence: CTT
tcccttccaaaactggaaaa

SEQ ID NO: 214352 - DNA, 20 bp, Artificial Sequence
  Description of Artificial Sequence: Synthetic oligonucleotide
  Target: ATXN1; (-) strand; PAM type: YTN; PAM sequence: TTC
aagggctttcccttccaaaa

SEQ ID NO: 214353 - DNA, 20 bp, Artificial Sequence
  Description of Artificial Sequence: Synthetic oligonucleotide
  Target: ATXN1; (-) strand; PAM type: YTN; PAM sequence: TTT
caagggctttcccttccaaa

SEQ ID NO: 214354 - DNA, 20 bp, Artificial Sequence
  Description of Artificial Sequence: Synthetic oligonucleotide
  Target: ATXN1; (-) strand; PAM type: YTN; PAM sequence: TTG
tttcaagggctttcccttcc

SEQ ID NO: 214355 - DNA, 20 bp, Artificial Sequence
  Description of Artificial Sequence: Synthetic oligonucleotide
  Target: ATXN1; (-) strand; PAM type: YTN; PAM sequence: TTT
gtttcaagggctttcccttc

SEQ ID NO: 214356 - DNA, 20 bp, Artificial Sequence
  Description of Artificial Sequence: Synthetic oligonucleotide
  Target: ATXN1; (-) strand; PAM type: YTN; PAM sequence: CTC
atatgggtcgtgtggtcatg

SEQ ID NO: 214357 - DNA, 20 bp, Artificial Sequence
  Description of Artificial Sequence: Synthetic oligonucleotide
  Target: ATXN1; (-) strand; PAM type: YTN; PAM sequence: TTA
caatgaggactcatatgggt

SEQ ID NO: 214358 - DNA, 20 bp, Artificial Sequence
  Description of Artificial Sequence: Synthetic oligonucleotide
  Target: ATXN1; (-) strand; PAM type: YTN; PAM sequence: TTG
gggaaaaacattacaatgag

SEQ ID NO: 214359 - DNA, 20 bp, Artificial Sequence
  Description of Artificial Sequence: Synthetic oligonucleotide
  Target: ATXN1; (-) strand; PAM type: YTN; PAM sequence: CTT
ggggaaaaacattacaatga

SEQ ID NO: 214360 - DNA, 20 bp, Artificial Sequence
  Description of Artificial Sequence: Synthetic oligonucleotide
  Target: ATXN1; (-) strand; PAM type: YTN; PAM sequence: TTG
tgggtgcttggggaaaaaca

SEQ ID NO: 214361 - DNA, 20 bp, Artificial Sequence
  Description of Artificial Sequence: Synthetic oligonucleotide
  Target: ATXN1; (-) strand; PAM type: YTN; PAM sequence: CTG
gaattgtgggtgcttgggga

SEQ ID NO: 214362 - DNA, 20 bp, Artificial Sequence
  Description of Artificial Sequence: Synthetic oligonucleotide
  Target: ATXN1; (-) strand; PAM type: YTN; PAM sequence: TTG
ggaggacctggaattgtggg

SEQ ID NO: 214363 - DNA, 20 bp, Artificial Sequence
  Description of Artificial Sequence: Synthetic oligonucleotide
  Target: ATXN1; (-) strand; PAM type: YTN; PAM sequence: CTG
gaagcaaattgggaggacct

SEQ ID NO: 214364 - DNA, 20 bp, Artificial Sequence
  Description of Artificial Sequence: Synthetic oligonucleotide
  Target: ATXN1; (-) strand; PAM type: YTN; PAM sequence: TTG
ggcaagaactggaagcaaat

SEQ ID NO: 214365 - DNA, 20 bp, Artificial Sequence
  Description of Artificial Sequence: Synthetic oligonucleotide
  Target: ATXN1; (-) strand; PAM type: YTN; PAM sequence: CTT
gggcaagaactggaagcaaa

SEQ ID NO: 214366 - DNA, 20 bp, Artificial Sequence
  Description of Artificial Sequence: Synthetic oligonucleotide
  Target: ATXN1; (-) strand; PAM type: YTN; PAM sequence: TTA
aacttgggcaagaactggaa

SEQ ID NO: 214367 - DNA, 20 bp, Artificial Sequence
  Description of Artificial Sequence: Synthetic oligonucleotide
  Target: ATXN1; (-) strand; PAM type: YTN; PAM sequence: TTT
aaacttgggcaagaactgga

SEQ ID NO: 214368 - DNA, 20 bp, Artificial Sequence
  Description of Artificial Sequence: Synthetic oligonucleotide
  Target: ATXN1; (-) strand; PAM type: YTN; PAM sequence: TTA
agagtttaaacttgggcaag

SEQ ID NO: 214369 - DNA, 20 bp, Artificial Sequence
  Description of Artificial Sequence: Synthetic oligonucleotide
  Target: ATXN1; (-) strand; PAM type: YTN; PAM sequence: TTG
gttaagagtttaaacttggg

SEQ ID NO: 214370 - DNA, 20 bp, Artificial Sequence
  Description of Artificial Sequence: Synthetic oligonucleotide
  Target: ATXN1; (-) strand; PAM type: YTN; PAM sequence: CTG
cagatagtaggcattggtta

SEQ ID NO: 214371 - DNA, 20 bp, Artificial Sequence
  Description of Artificial Sequence: Synthetic oligonucleotide
  Target: ATXN1; (-) strand; PAM type: YTN; PAM sequence: TTG
aggctgcagatagtaggcat

SEQ ID NO: 214372 - DNA, 20 bp, Artificial Sequence
  Description of Artificial Sequence: Synthetic oligonucleotide
  Target: ATXN1; (-) strand; PAM type: YTN; PAM sequence: TTT
gaggctgcagatagtaggca

SEQ ID NO: 214373 - DNA, 20 bp, Artificial Sequence
  Description of Artificial Sequence: Synthetic oligonucleotide
  Target: ATXN1; (-) strand; PAM type: YTN; PAM sequence: CTT
tgaggctgcagatagtaggc

SEQ ID NO: 214374 - DNA, 20 bp, Artificial Sequence
  Description of Artificial Sequence: Synthetic oligonucleotide
  Target: ATXN1; (-) strand; PAM type: YTN; PAM sequence: CTC
cctttgaggctgcagatagt

SEQ ID NO: 214375 - DNA, 20 bp, Artificial Sequence
  Description of Artificial Sequence: Synthetic oligonucleotide
  Target: ATXN1; (-) strand; PAM type: YTN; PAM sequence: CTC
agctccctttgaggctgcag

SEQ ID NO: 214376 - DNA, 20 bp, Artificial Sequence
  Description of Artificial Sequence: Synthetic oligonucleotide
  Target: ATXN1; (-) strand; PAM type: YTN; PAM sequence: TTG
gcaagtactcagctcccttt

SEQ ID NO: 214377 - DNA, 20 bp, Artificial Sequence
  Description of Artificial Sequence: Synthetic oligonucleotide
  Target: ATXN1; (-) strand; PAM type: YTN; PAM sequence: CTG
ttggcaagtactcagctccc

SEQ ID NO: 214378 - DNA, 20 bp, Artificial Sequence
  Description of Artificial Sequence: Synthetic oligonucleotide
  Target: ATXN1; (-) strand; PAM type: YTN; PAM sequence: CTC
agggaggggaggtggcggtg

SEQ ID NO: 214379 - DNA, 20 bp, Artificial Sequence
  Description of Artificial Sequence: Synthetic oligonucleotide
  Target: ATXN1; (-) strand; PAM type: YTN; PAM sequence: CTC
gcaaggcaggaacctcaggg

SEQ ID NO: 214380 - DNA, 20 bp, Artificial Sequence
  Description of Artificial Sequence: Synthetic oligonucleotide
  Target: ATXN1; (-) strand; PAM type: YTN; PAM sequence: CTC
tcgcaaggcaggaacctcag

SEQ ID NO: 214381 - DNA, 20 bp, Artificial Sequence
  Description of Artificial Sequence: Synthetic oligonucleotide
  Target: ATXN1; (-) strand; PAM type: YTN; PAM sequence: CTG
gcagccacatgacacactct

SEQ ID NO: 214382 - DNA, 20 bp, Artificial Sequence
  Description of Artificial Sequence: Synthetic oligonucleotide
  Target: ATXN1; (-) strand; PAM type: YTN; PAM sequence: TTG
ccctggcagccacatgacac

SEQ ID NO: 214383 - DNA, 20 bp, Artificial Sequence
  Description of Artificial Sequence: Synthetic oligonucleotide
  Target: ATXN1; (-) strand; PAM type: YTN; PAM sequence: CTT
gccctggcagccacatgaca

SEQ ID NO: 214384 - DNA, 20 bp, Artificial Sequence
  Description of Artificial Sequence: Synthetic oligonucleotide
  Target: ATXN1; (-) strand; PAM type: YTN; PAM sequence: CTG
ccttgccctggcagccacat

SEQ ID NO: 214385 - DNA, 20 bp, Artificial Sequence
  Description of Artificial Sequence: Synthetic oligonucleotide
  Target: ATXN1; (-) strand; PAM type: YTN; PAM sequence: TTC
tgccttgccctggcagccac

SEQ ID NO: 214386 - DNA, 20 bp, Artificial Sequence
  Description of Artificial Sequence: Synthetic oligonucleotide
  Target: ATXN1; (-) strand; PAM type: YTN; PAM sequence: CTT
ctgccttgccctggcagcca

SEQ ID NO: 214387 - DNA, 20 bp, Artificial Sequence
  Description of Artificial Sequence: Synthetic oligonucleotide
  Target: ATXN1; (-) strand; PAM type: YTN; PAM sequence: CTA
cacttctgccttgccctggc

SEQ ID NO: 214388 - DNA, 20 bp, Artificial Sequence
  Description of Artificial Sequence: Synthetic oligonucleotide
  Target: ATXN1; (-) strand; PAM type: YTN; PAM sequence: TTC
ctacacttctgccttgccct

SEQ ID NO: 214389 - DNA, 20 bp, Artificial Sequence
  Description of Artificial Sequence: Synthetic oligonucleotide
  Target: ATXN1; (-) strand; PAM type: YTN; PAM sequence: TTT
cctacacttctgccttgccc

SEQ ID NO: 214390 - DNA, 20 bp, Artificial Sequence
  Description of Artificial Sequence: Synthetic oligonucleotide
  Target: ATXN1; (-) strand; PAM type: YTN; PAM sequence: TTT
tcctacacttctgccttgcc

SEQ ID NO: 214391 - DNA, 20 bp, Artificial Sequence
  Description of Artificial Sequence: Synthetic oligonucleotide
  Target: ATXN1; (-) strand; PAM type: YTN; PAM sequence: CTT
ttcctacacttctgccttgc

SEQ ID NO: 214392 - DNA, 20 bp, Artificial Sequence
  Description of Artificial Sequence: Synthetic oligonucleotide
  Target: ATXN1; (-) strand; PAM type: YTN; PAM sequence: CTG
tgagatgtgccttttcctac

SEQ ID NO: 214393 - DNA, 20 bp, Artificial Sequence
  Description of Artificial Sequence: Synthetic oligonucleotide
  Target: ATXN1; (-) strand; PAM type: YTN; PAM sequence: CTG
gacaacctgtgagatgtgcc

SEQ ID NO: 214394 - DNA, 20 bp, Artificial Sequence
  Description of Artificial Sequence: Synthetic oligonucleotide
  Target: ATXN1; (-) strand; PAM type: YTN; PAM sequence: CTC
ctggacaacctgtgagatgt

SEQ ID NO: 214395 - DNA, 20 bp, Artificial Sequence
  Description of Artificial Sequence: Synthetic oligonucleotide
  Target: ATXN1; (-) strand; PAM type: YTN; PAM sequence: CTA
atcctcctggacaacctgtg

SEQ ID NO: 214396 - DNA, 20 bp, Artificial Sequence
  Description of Artificial Sequence: Synthetic oligonucleotide
  Target: ATXN1; (-) strand; PAM type: YTN; PAM sequence: CTC
taatcctcctggacaacctg

SEQ ID NO: 214397 - DNA, 20 bp, Artificial Sequence
  Description of Artificial Sequence: Synthetic oligonucleotide
  Target: ATXN1; (-) strand; PAM type: YTN; PAM sequence: TTG
ctctaatcctcctggacaac

SEQ ID NO: 214398 - DNA, 20 bp, Artificial Sequence
  Description of Artificial Sequence: Synthetic oligonucleotide
  Target: ATXN1; (-) strand; PAM type: YTN; PAM sequence: TTT
gctctaatcctcctggacaa

SEQ ID NO: 214399 - DNA, 20 bp, Artificial Sequence
  Description of Artificial Sequence: Synthetic oligonucleotide
  Target: ATXN1; (-) strand; PAM type: YTN; PAM sequence: CTG
gacatatttgctctaatcct

SEQ ID NO: 214400 - DNA, 20 bp, Artificial Sequence
  Description of Artificial Sequence: Synthetic oligonucleotide
  Target: ATXN1; (-) strand; PAM type: YTN; PAM sequence: CTC
tggacatatttgctctaatc

SEQ ID NO: 214401 - DNA, 20 bp, Artificial Sequence
  Description of Artificial Sequence: Synthetic oligonucleotide
  Target: ATXN1; (-) strand; PAM type: YTN; PAM sequence: CTG
ctctggacatatttgctcta

SEQ ID NO: 214402 - DNA, 20 bp, Artificial Sequence
  Description of Artificial Sequence: Synthetic oligonucleotide
  Target: ATXN1; (-) strand; PAM type: YTN; PAM sequence: TTG
aaactgctctggacatattt

SEQ ID NO: 214403 - DNA, 20 bp, Artificial Sequence
  Description of Artificial Sequence: Synthetic oligonucleotide
  Target: ATXN1; (-) strand; PAM type: YTN; PAM sequence: CTT
gaaactgctctggacatatt

SEQ ID NO: 214404 - DNA, 20 bp, Artificial Sequence
  Description of Artificial Sequence: Synthetic oligonucleotide
  Target: ATXN1; (-) strand; PAM type: YTN; PAM sequence: CTA
tagtcaacttgaaactgctc

SEQ ID NO: 214405 - DNA, 20 bp, Artificial Sequence
  Description of Artificial Sequence: Synthetic oligonucleotide
  Target: ATXN1; (-) strand; PAM type: YTN; PAM sequence: TTC
tatagtcaacttgaaactgc

SEQ ID NO: 214406 - DNA, 20 bp, Artificial Sequence
  Description of Artificial Sequence: Synthetic oligonucleotide
  Target: ATXN1; (-) strand; PAM type: YTN; PAM sequence: TTG
gttctatagtcaacttgaaa

SEQ ID NO: 214407 - DNA, 20 bp, Artificial Sequence
  Description of Artificial Sequence: Synthetic oligonucleotide
  Target: ATXN1; (-) strand; PAM type: YTN; PAM sequence: CTT
ggttctatagtcaacttgaa

SEQ ID NO: 214408 - DNA, 20 bp, Artificial Sequence
  Description of Artificial Sequence: Synthetic oligonucleotide
  Target: ATXN1; (-) strand; PAM type: YTN; PAM sequence: CTC
ggagccttggttctatagtc

SEQ ID NO: 214409 - DNA, 20 bp, Artificial Sequence
  Description of Artificial Sequence: Synthetic oligonucleotide
  Target: ATXN1; (-) strand; PAM type: YTN; PAM sequence: TTA
gctcggagccttggttctat

SEQ ID NO: 214410 - DNA, 20 bp, Artificial Sequence
  Description of Artificial Sequence: Synthetic oligonucleotide
  Target: ATXN1; (-) strand; PAM type: YTN; PAM sequence: TTA
attagctcggagccttggtt

SEQ ID NO: 214411 - DNA, 20 bp, Artificial Sequence
  Description of Artificial Sequence: Synthetic oligonucleotide
  Target: ATXN1; (-) strand; PAM type: YTN; PAM sequence: CTA
ttaattagctcggagccttg

SEQ ID NO: 214412 - DNA, 20 bp, Artificial Sequence
  Description of Artificial Sequence: Synthetic oligonucleotide
  Target: ATXN1; (-) strand; PAM type: YTN; PAM sequence: TTC
tattaattagctcggagcct

SEQ ID NO: 214413 - DNA, 20 bp, Artificial Sequence
  Description of Artificial Sequence: Synthetic oligonucleotide
  Target: ATXN1; (-) strand; PAM type: YTN; PAM sequence: TTT
ctattaattagctcggagcc

SEQ ID NO: 214414 - DNA, 20 bp, Artificial Sequence
  Description of Artificial Sequence: Synthetic oligonucleotide
  Target: ATXN1; (-) strand; PAM type: YTN; PAM sequence: CTT
tctattaattagctcggagc

SEQ ID NO: 214415 - DNA, 20 bp, Artificial Sequence
  Description of Artificial Sequence: Synthetic oligonucleotide
  Target: ATXN1; (-) strand; PAM type: YTN; PAM sequence: TTC
actttctattaattagctcg

SEQ ID NO: 214416 - DNA, 20 bp, Artificial Sequence
  Description of Artificial Sequence: Synthetic oligonucleotide
  Target: ATXN1; (-) strand; PAM type: YTN; PAM sequence: CTT
cactttctattaattagctc

SEQ ID NO: 214417 - DNA, 20 bp, Artificial Sequence
  Description of Artificial Sequence: Synthetic oligonucleotide
  Target: ATXN1; (-) strand; PAM type: YTN; PAM sequence: TTG
cttcactttctattaattag

SEQ ID NO: 214418 - DNA, 20 bp, Artificial Sequence
  Description of Artificial Sequence: Synthetic oligonucleotide
  Target: ATXN1; (-) strand; PAM type: YTN; PAM sequence: CTA
tcattgcttcactttctatt

SEQ ID NO: 214419 - DNA, 20 bp, Artificial Sequence
  Description of Artificial Sequence: Synthetic oligonucleotide
  Target: ATXN1; (-) strand; PAM type: YTN; PAM sequence: CTG
tcactatcattgcttcactt

SEQ ID NO: 214420 - DNA, 20 bp, Artificial Sequence
  Description of Artificial Sequence: Synthetic oligonucleotide
  Target: ATXN1; (-) strand; PAM type: YTN; PAM sequence: TTG
agctgtcactatcattgctt

SEQ ID NO: 214421 - DNA, 20 bp, Artificial Sequence
  Description of Artificial Sequence: Synthetic oligonucleotide
  Target: ATXN1; (-) strand; PAM type: YTN; PAM sequence: CTT
gagctgtcactatcattgct

SEQ ID NO: 214422 - DNA, 20 bp, Artificial Sequence
  Description of Artificial Sequence: Synthetic oligonucleotide
  Target: ATXN1; (-) strand; PAM type: YTN; PAM sequence: TTG
ccttgagctgtcactatcat

SEQ ID NO: 214423 - DNA, 20 bp, Artificial Sequence
  Description of Artificial Sequence: Synthetic oligonucleotide
  Target: ATXN1; (-) strand; PAM type: YTN; PAM sequence: CTT
gccttgagctgtcactatca

SEQ ID NO: 214424 - DNA, 20 bp, Artificial Sequence
  Description of Artificial Sequence: Synthetic oligonucleotide
  Target: ATXN1; (-) strand; PAM type: YTN; PAM sequence: TTC
acacccttgccttgagctgt

SEQ ID NO: 214425 - DNA, 20 bp, Artificial Sequence
  Description of Artificial Sequence: Synthetic oligonucleotide
  Target: ATXN1; (-) strand; PAM type: YTN; PAM sequence: CTT
cacacccttgccttgagctg

SEQ ID NO: 214426 - DNA, 20 bp, Artificial Sequence
  Description of Artificial Sequence: Synthetic oligonucleotide
  Target: ATXN1; (-) strand; PAM type: YTN; PAM sequence: TTA
ccgaatgacatgagcttcac

SEQ ID NO: 214427 - DNA, 20 bp, Artificial Sequence
  Description of Artificial Sequence: Synthetic oligonucleotide
  Target: ATXN1; (-) strand; PAM type: YTN; PAM sequence: TTT
accgaatgacatgagcttca

SEQ ID NO: 214428 - DNA, 20 bp, Artificial Sequence
  Description of Artificial Sequence: Synthetic oligonucleotide
  Target: ATXN1; (-) strand; PAM type: YTN; PAM sequence: CTT
taccgaatgacatgagcttc

SEQ ID NO: 214429 - DNA, 20 bp, Artificial Sequence
  Description of Artificial Sequence: Synthetic oligonucleotide
  Target: ATXN1; (-) strand; PAM type: YTN; PAM sequence: CTG
tctttaccgaatgacatgag

SEQ ID NO: 214430 - DNA, 20 bp, Artificial Sequence
  Description of Artificial Sequence: Synthetic oligonucleotide
  Target: ATXN1; (-) strand; PAM type: YTN; PAM sequence: TTG
gactgtctttaccgaatgac

SEQ ID NO: 214431 - DNA, 20 bp, Artificial Sequence
  Description of Artificial Sequence: Synthetic oligonucleotide
  Target: ATXN1; (-) strand; PAM type: YTN; PAM sequence: CTT
ggactgtctttaccgaatga

SEQ ID NO: 214432 - DNA, 20 bp, Artificial Sequence
  Description of Artificial Sequence: Synthetic oligonucleotide
  Target: ATXN1; (-) strand; PAM type: YTN; PAM sequence: TTC
cttggactgtctttaccgaa

SEQ ID NO: 214433 - DNA, 20 bp, Artificial Sequence
  Description of Artificial Sequence: Synthetic oligonucleotide
  Target: ATXN1; (-) strand; PAM type: YTN; PAM sequence: TTT
ccttggactgtctttaccga

SEQ ID NO: 214434 - DNA, 20 bp, Artificial Sequence
  Description of Artificial Sequence: Synthetic oligonucleotide
  Target: ATXN1; (-) strand; PAM type: YTN; PAM sequence: TTT
tccttggactgtctttaccg

SEQ ID NO: 214435 - DNA, 20 bp, Artificial Sequence
  Description of Artificial Sequence: Synthetic oligonucleotide
  Target: ATXN1; (-) strand; PAM type: YTN; PAM sequence: TTT
ttccttggactgtctttacc

SEQ ID NO: 214436 - DNA, 20 bp, Artificial Sequence
  Description of Artificial Sequence: Synthetic oligonucleotide
  Target: ATXN1; (-) strand; PAM type: YTN; PAM sequence: CTT
tttccttggactgtctttac

SEQ ID NO: 214437 - DNA, 20 bp, Artificial Sequence
  Description of Artificial Sequence: Synthetic oligonucleotide
  Target: ATXN1; (-) strand; PAM type: YTN; PAM sequence: CTG
caaagcaaataaggtgcaag

SEQ ID NO: 214438 - DNA, 20 bp, Artificial Sequence
  Description of Artificial Sequence: Synthetic oligonucleotide
  Target: ATXN1; (-) strand; PAM type: YTN; PAM sequence: TTA
gtctgcaaagcaaataaggt

SEQ ID NO: 214439 - DNA, 20 bp, Artificial Sequence
  Description of Artificial Sequence: Synthetic oligonucleotide
  Target: ATXN1; (-) strand; PAM type: YTN; PAM sequence: CTA
acagaaatgtgttagtctgc

SEQ ID NO: 214440 - DNA, 20 bp, Artificial Sequence
  Description of Artificial Sequence: Synthetic oligonucleotide
  Target: ATXN1; (-) strand; PAM type: YTN; PAM sequence: TTC
taacagaaatgtgttagtct

SEQ ID NO: 214441 - DNA, 20 bp, Artificial Sequence
  Description of Artificial Sequence: Synthetic oligonucleotide
  Target: ATXN1; (-) strand; PAM type: YTN; PAM sequence: TTT
ctaacagaaatgtgttagtc

SEQ ID NO: 214442 - DNA, 20 bp, Artificial Sequence
  Description of Artificial Sequence: Synthetic oligonucleotide
  Target: ATXN1; (-) strand; PAM type: YTN; PAM sequence: CTG
gagtgtaaagacatatttct

SEQ ID NO: 214443 - DNA, 20 bp, Artificial Sequence
  Description of Artificial Sequence: Synthetic oligonucleotide
  Target: ATXN1; (-) strand; PAM type: YTN; PAM sequence: CTC
tggagtgtaaagacatattt

SEQ ID NO: 214444 - DNA, 20 bp, Artificial Sequence
  Description of Artificial Sequence: Synthetic oligonucleotide
  Target: ATXN1; (-) strand; PAM type: YTN; PAM sequence: CTC
tctggagtgtaaagacatat

SEQ ID NO: 214445 - DNA, 20 bp, Artificial Sequence
  Description of Artificial Sequence: Synthetic oligonucleotide
  Target: ATXN1; (-) strand; PAM type: YTN; PAM sequence: TTG
taacatctctctggagtgta

SEQ ID NO: 214446 - DNA, 20 bp, Artificial Sequence
  Description of Artificial Sequence: Synthetic oligonucleotide
  Target: ATXN1; (-) strand; PAM type: YTN; PAM sequence: CTT
gtaacatctctctggagtgt

SEQ ID NO: 214447 - DNA, 20 bp, Artificial Sequence
  Description of Artificial Sequence: Synthetic oligonucleotide
  Target: ATXN1; (-) strand; PAM type: YTN; PAM sequence: TTA
gtagcaggccgacaccttgt

SEQ ID NO: 214448 - DNA, 20 bp, Artificial Sequence
  Description of Artificial Sequence: Synthetic oligonucleotide
  Target: ATXN1; (-) strand; PAM type: YTN; PAM sequence: CTG
taattagtagcaggccgaca

SEQ ID NO: 214449 - DNA, 20 bp, Artificial Sequence
  Description of Artificial Sequence: Synthetic oligonucleotide
  Target: ATXN1; (-) strand; PAM type: YTN; PAM sequence: TTG
ctgtaattagtagcaggccg

SEQ ID NO: 214450 - DNA, 20 bp, Artificial Sequence
  Description of Artificial Sequence: Synthetic oligonucleotide
  Target: ATXN1; (-) strand; PAM type: YTN; PAM sequence: CTT
gctgtaattagtagcaggcc

SEQ ID NO: 214451 - DNA, 20 bp, Artificial Sequence
  Description of Artificial Sequence: Synthetic oligonucleotide
  Target: ATXN1; (-) strand; PAM type: YTN; PAM sequence: CTG
tagtgcgggcttgctgtaat

SEQ ID NO: 214452 - DNA, 20 bp, Artificial Sequence
  Description of Artificial Sequence: Synthetic oligonucleotide
  Target: ATXN1; (-) strand; PAM type: YTN; PAM sequence: TTA
gctgtagtgcgggcttgctg

SEQ ID NO: 214453 - DNA, 20 bp, Artificial Sequence
  Description of Artificial Sequence: Synthetic oligonucleotide
  Target: ATXN1; (-) strand; PAM type: YTN; PAM sequence: TTG
ttagctgtagtgcgggcttg

SEQ ID NO: 214454 - DNA, 20 bp, Artificial Sequence
  Description of Artificial Sequence: Synthetic oligonucleotide
  Target: ATXN1; (-) strand; PAM type: YTN; PAM sequence: TTA
tattgttagctgtagtgcgg

SEQ ID NO: 214455 - DNA, 20 bp, Artificial Sequence
  Description of Artificial Sequence: Synthetic oligonucleotide
  Target: ATXN1; (-) strand; PAM type: YTN; PAM sequence: TTA
gagttatattgttagctgta

SEQ ID NO: 214456 - DNA, 20 bp, Artificial Sequence
  Description of Artificial Sequence: Synthetic oligonucleotide
  Target: ATXN1; (-) strand; PAM type: YTN; PAM sequence: TTT
agagttatattgttagctgt

SEQ ID NO: 214457 - DNA, 20 bp, Artificial Sequence
  Description of Artificial Sequence: Synthetic oligonucleotide
  Target: ATXN1; (-) strand; PAM type: YTN; PAM sequence: TTC
atatgacaggtaggtaatca

SEQ ID NO: 214458 - DNA, 20 bp, Artificial Sequence
  Description of Artificial Sequence: Synthetic oligonucleotide
  Target: ATXN1; (-) strand; PAM type: YTN; PAM sequence: TTT
catatgacaggtaggtaatc

SEQ ID NO: 214459 - DNA, 20 bp, Artificial Sequence
  Description of Artificial Sequence: Synthetic oligonucleotide
  Target: ATXN1; (-) strand; PAM type: YTN; PAM sequence: CTT
tcatatgacaggtaggtaat

SEQ ID NO: 214460 - DNA, 20 bp, Artificial Sequence
  Description of Artificial Sequence: Synthetic oligonucleotide
  Target: ATXN1; (-) strand; PAM type: YTN; PAM sequence: CTG
gagtgaagaatagcctttca

SEQ ID NO: 214461 - DNA, 20 bp, Artificial Sequence
  Description of Artificial Sequence: Synthetic oligonucleotide
  Target: ATXN1; (-) strand; PAM type: YTN; PAM sequence: TTC
aactggagtgaagaatagcc

SEQ ID NO: 214462 - DNA, 20 bp, Artificial Sequence
  Description of Artificial Sequence: Synthetic oligonucleotide
  Target: ATXN1; (-) strand; PAM type: YTN; PAM sequence: TTG
ttcaactggagtgaagaata

SEQ ID NO: 214463 - DNA, 20 bp, Artificial Sequence
  Description of Artificial Sequence: Synthetic oligonucleotide
  Target: ATXN1; (-) strand; PAM type: YTN; PAM sequence: TTT
gttcaactggagtgaagaat

SEQ ID NO: 214464 - DNA, 20 bp, Artificial Sequence
  Description of Artificial Sequence: Synthetic oligonucleotide
  Target: ATXN1; (-) strand; PAM type: YTN; PAM sequence: CTA
ataggtttgttcaactggag

SEQ ID NO: 214465 - DNA, 20 bp, Artificial Sequence
  Description of Artificial Sequence: Synthetic oligonucleotide
  Target: ATXN1; (-) strand; PAM type: YTN; PAM sequence: TTA
aacatcaagaaaccagacat

SEQ ID NO: 214466 - DNA, 20 bp, Artificial Sequence
  Description of Artificial Sequence: Synthetic oligonucleotide
  Target: ATXN1; (-) strand; PAM type: YTN; PAM sequence: TTG
tgagagttaaacatcaagaa

SEQ ID NO: 214467 - DNA, 20 bp, Artificial Sequence
  Description of Artificial Sequence: Synthetic oligonucleotide
  Target: ATXN1; (-) strand; PAM type: YTN; PAM sequence: CTT
gtgagagttaaacatcaaga

SEQ ID NO: 214468 - DNA, 20 bp, Artificial Sequence
  Description of Artificial Sequence: Synthetic oligonucleotide
  Target: ATXN1; (-) strand; PAM type: YTN; PAM sequence: TTG
cttgtgagagttaaacatca

SEQ ID NO: 214469 - DNA, 20 bp, Artificial Sequence
  Description of Artificial Sequence: Synthetic oligonucleotide
  Target: ATXN1; (-) strand; PAM type: YTN; PAM sequence: CTG
gagataattgcttgtgagag

SEQ ID NO: 214470 - DNA, 20 bp, Artificial Sequence
  Description of Artificial Sequence: Synthetic oligonucleotide
  Target: ATXN1; (-) strand; PAM type: YTN; PAM sequence: TTC
aagctggagataattgcttg

SEQ ID NO: 214471 - DNA, 20 bp, Artificial Sequence
  Description of Artificial Sequence: Synthetic oligonucleotide
  Target: ATXN1; (-) strand; PAM type: YTN; PAM sequence: TTT
caagctggagataattgctt

SEQ ID NO: 214472 - DNA, 20 bp, Artificial Sequence
  Description of Artificial Sequence: Synthetic oligonucleotide
  Target: ATXN1; (-) strand; PAM type: YTN; PAM sequence: TTG
tataaagaagacaaaagggc

SEQ ID NO: 214473 - DNA, 20 bp, Artificial Sequence
  Description of Artificial Sequence: Synthetic oligonucleotide
  Target: ATXN1; (-) strand; PAM type: YTN; PAM sequence: CTA
agaagaaagagtagtgattg

SEQ ID NO: 214474 - DNA, 20 bp, Artificial Sequence
  Description of Artificial Sequence: Synthetic oligonucleotide
  Target: ATXN1; (-) strand; PAM type: YTN; PAM sequence: TTC
taagaagaaagagtagtgat

SEQ ID NO: 214475 - DNA, 20 bp, Artificial Sequence
  Description of Artificial Sequence: Synthetic oligonucleotide
  Target: ATXN1; (-) strand; PAM type: YTN; PAM sequence: TTT
ctaagaagaaagagtagtga

SEQ ID NO: 214476 - DNA, 20 bp, Artificial Sequence
  Description of Artificial Sequence: Synthetic oligonucleotide
  Target: ATXN1; (-) strand; PAM type: YTN; PAM sequence: TTT
tctaagaagaaagagtagtg

SEQ ID NO: 214477 - DNA, 20 bp, Artificial Sequence
  Description of Artificial Sequence: Synthetic oligonucleotide
  Target: ATXN1; (-) strand; PAM type: YTN; PAM sequence: CTG
tgttttctaagaagaaagag

SEQ ID NO: 214478 - DNA, 20 bp, Artificial Sequence
  Description of Artificial Sequence: Synthetic oligonucleotide
  Target: ATXN1; (-) strand; PAM type: YTN; PAM sequence: TTA
aactgtgttttctaagaaga

SEQ ID NO: 214479 - DNA, 20 bp, Artificial Sequence
  Description of Artificial Sequence: Synthetic oligonucleotide
  Target: ATXN1; (-) strand; PAM type: YTN; PAM sequence: TTT
aaactgtgttttctaagaag

SEQ ID NO: 214480 - DNA, 20 bp, Artificial Sequence
  Description of Artificial Sequence: Synthetic oligonucleotide
  Target: ATXN1; (-) strand; PAM type: YTN; PAM sequence: TTA
agggaggaagtggtttaaac

SEQ ID NO: 214481 - DNA, 20 bp, Artificial Sequence
  Description of Artificial Sequence: Synthetic oligonucleotide
  Target: ATXN1; (-) strand; PAM type: YTN; PAM sequence: TTA
gatggattaagggaggaagt

SEQ ID NO: 214482 - DNA, 20 bp, Artificial Sequence
  Description of Artificial Sequence: Synthetic oligonucleotide
  Target: ATXN1; (-) strand; PAM type: YTN; PAM sequence: TTT
agatggattaagggaggaag

SEQ ID NO: 214483 - DNA, 20 bp, Artificial Sequence
  Description of Artificial Sequence: Synthetic oligonucleotide
  Target: ATXN1; (-) strand; PAM type: YTN; PAM sequence: TTA
gtttagatggattaagggag

SEQ ID NO: 214484 - DNA, 20 bp, Artificial Sequence
  Description of Artificial Sequence: Synthetic oligonucleotide
  Target: ATXN1; (-) strand; PAM type: YTN; PAM sequence: CTA
gatggggttagtttagatgg

SEQ ID NO: 214485 - DNA, 20 bp, Artificial Sequence
  Description of Artificial Sequence: Synthetic oligonucleotide
  Target: ATXN1; (-) strand; PAM type: YTN; PAM sequence: TTG
catggatgccagaactagat

SEQ ID NO: 214486 - DNA, 20 bp, Artificial Sequence
  Description of Artificial Sequence: Synthetic oligonucleotide
  Target: ATXN1; (-) strand; PAM type: YTN; PAM sequence: TTG
attgcatggatgccagaact

SEQ ID NO: 214487 - DNA, 20 bp, Artificial Sequence
  Description of Artificial Sequence: Synthetic oligonucleotide
  Target: ATXN1; (-) strand; PAM type: YTN; PAM sequence: CTA
ttgattgcatggatgccaga

SEQ ID NO: 214488 - DNA, 20 bp, Artificial Sequence
  Description of Artificial Sequence: Synthetic oligonucleotide
  Target: ATXN1; (-) strand; PAM type: YTN; PAM sequence: CTA
aatctattgattgcatggat

SEQ ID NO: 214489 - DNA, 20 bp, Artificial Sequence
  Description of Artificial Sequence: Synthetic oligonucleotide
  Target: ATXN1; (-) strand; PAM type: YTN; PAM sequence: CTA
agtaaatgctaaatctattg

SEQ ID NO: 214490 - DNA, 20 bp, Artificial Sequence
  Description of Artificial Sequence: Synthetic oligonucleotide
  Target: ATXN1; (-) strand; PAM type: YTN; PAM sequence: TTG
ctaagtaaatgctaaatcta

SEQ ID NO: 214491 - DNA, 20 bp, Artificial Sequence
  Description of Artificial Sequence: Synthetic oligonucleotide
  Target: ATXN1; (-) strand; PAM type: YTN; PAM sequence: CTT
gctaagtaaatgctaaatct

SEQ ID NO: 214492 - DNA, 20 bp, Artificial Sequence
  Description of Artificial Sequence: Synthetic oligonucleotide
  Target: ATXN1; (-) strand; PAM type: YTN; PAM sequence: TTA
cagagaaatccatggtagtg

SEQ ID NO: 214493 - DNA, 20 bp, Artificial Sequence
  Description of Artificial Sequence: Synthetic oligonucleotide
  Target: ATXN1; (-) strand; PAM type: YTN; PAM sequence: TTC
attacagagaaatccatggt

SEQ ID NO: 214494 - DNA, 20 bp, Artificial Sequence
  Description of Artificial Sequence: Synthetic oligonucleotide
  Target: ATXN1; (-) strand; PAM type: YTN; PAM sequence: TTT
cattacagagaaatccatgg

SEQ ID NO: 214495 - DNA, 20 bp, Artificial Sequence
  Description of Artificial Sequence: Synthetic oligonucleotide
  Target: ATXN1; (-) strand; PAM type: YTN; PAM sequence: TTT
tcattacagagaaatccatg

SEQ ID NO: 214496 - DNA, 20 bp, Artificial Sequence
  Description of Artificial Sequence: Synthetic oligonucleotide
  Target: ATXN1; (-) strand; PAM type: YTN; PAM sequence: TTT
ttcattacagagaaatccat

SEQ ID NO: 214497 - DNA, 20 bp, Artificial Sequence
  Description of Artificial Sequence: Synthetic oligonucleotide
  Target: ATXN1; (-) strand; PAM type: YTN; PAM sequence: CTT
tttcattacagagaaatcca

SEQ ID NO: 214498 - DNA, 20 bp, Artificial Sequence
  Description of Artificial Sequence: Synthetic oligonucleotide
  Target: ATXN1; (-) strand; PAM type: YTN; PAM sequence: TTA
actttttcattacagagaaa

SEQ ID NO: 214499 - DNA, 20 bp, Artificial Sequence
  Description of Artificial Sequence: Synthetic oligonucleotide
  Target: ATXN1; (-) strand; PAM type: YTN; PAM sequence: TTA
catataaggcatatgtagga

SEQ ID NO: 214500 - DNA, 20 bp, Artificial Sequence
  Description of Artificial Sequence: Synthetic oligonucleotide
  Target: ATXN1; (-) strand; PAM type: YTN; PAM sequence: CTC
aagattacatataaggcata

SEQ ID NO: 214501 - DNA, 20 bp, Artificial Sequence
  Description of Artificial Sequence: Synthetic oligonucleotide
  Target: ATXN1; (-) strand; PAM type: YTN; PAM sequence: CTG
ctcaagattacatataaggc

SEQ ID NO: 214502 - DNA, 20 bp, Artificial Sequence
  Description of Artificial Sequence: Synthetic oligonucleotide
  Target: ATXN1; (-) strand; PAM type: YTN; PAM sequence: CTA
cagatgagaaaaccgaggcc

SEQ ID NO: 214503 - DNA, 20 bp, Artificial Sequence
  Description of Artificial Sequence: Synthetic oligonucleotide
  Target: ATXN1; (-) strand; PAM type: YTN; PAM sequence: CTC
ctacagatgagaaaaccgag

SEQ ID NO: 214504 - DNA, 20 bp, Artificial Sequence
  Description of Artificial Sequence: Synthetic oligonucleotide
  Target: ATXN1; (-) strand; PAM type: YTN; PAM sequence: TTA
tcctcctacagatgagaaaa

SEQ ID NO: 214505 - DNA, 20 bp, Artificial Sequence
  Description of Artificial Sequence: Synthetic oligonucleotide
  Target: ATXN1; (-) strand; PAM type: YTN; PAM sequence: CTA
tgaggtagggagtattatcc

SEQ ID NO: 214506 - DNA, 20 bp, Artificial Sequence
  Description of Artificial Sequence: Synthetic oligonucleotide
  Target: ATXN1; (-) strand; PAM type: YTN; PAM sequence: CTC
agaaacaaccctatgaggta

SEQ ID NO: 214507 - DNA, 20 bp, Artificial Sequence
  Description of Artificial Sequence: Synthetic oligonucleotide
  Target: ATXN1; (-) strand; PAM type: YTN; PAM sequence: TTC
tcagaaacaaccctatgagg

SEQ ID NO: 214508 - DNA, 20 bp, Artificial Sequence
  Description of Artificial Sequence: Synthetic oligonucleotide
  Target: ATXN1; (-) strand; PAM type: YTN; PAM sequence: TTA
attctcagaaacaaccctat

SEQ ID NO: 214509 - DNA, 20 bp, Artificial Sequence
  Description of Artificial Sequence: Synthetic oligonucleotide
  Target: ATXN1; (-) strand; PAM type: YTN; PAM sequence: TTT
aattctcagaaacaacccta

SEQ ID NO: 214510 - DNA, 20 bp, Artificial Sequence
  Description of Artificial Sequence: Synthetic oligonucleotide
  Target: ATXN1; (-) strand; PAM type: YTN; PAM sequence: TTA
aaaataaatgtttaattctc

SEQ ID NO: 214511 - DNA, 20 bp, Artificial Sequence
  Description of Artificial Sequence: Synthetic oligonucleotide
  Target: ATXN1; (-) strand; PAM type: YTN; PAM sequence: TTT
aaaaataaatgtttaattct

SEQ ID NO: 214512 - DNA, 20 bp, Artificial Sequence
  Description of Artificial Sequence: Synthetic oligonucleotide
  Target: ATXN1; (-) strand; PAM type: YTN; PAM sequence: TTT
taaaaataaatgtttaattc

SEQ ID NO: 214513 - DNA, 20 bp, Artificial Sequence
  Description of Artificial Sequence: Synthetic oligonucleotide
  Target: ATXN1; (-) strand; PAM type: YTN; PAM sequence: TTT
ttaaaaataaatgtttaatt

SEQ ID NO: 214514 - DNA, 20 bp, Artificial Sequence
  Description of Artificial Sequence: Synthetic oligonucleotide
  Target: ATXN1; (-) strand; PAM type: YTN; PAM sequence: TTT
tttaaaaataaatgtttaat

SEQ ID NO: 214515 - DNA, 20 bp, Artificial Sequence
  Description of Artificial Sequence: Synthetic oligonucleotide
  Target: ATXN1; (-) strand; PAM type: YTN; PAM sequence: TTT
ttttaaaaataaatgtttaa

SEQ ID NO: 214516 - DNA, 20 bp, Artificial Sequence
  Description of Artificial Sequence: Synthetic oligonucleotide
  Target: ATXN1; (-) strand; PAM type: YTN; PAM sequence: CTG
tttttttaaaaataaatgtt

SEQ ID NO: 214517 - DNA, 20 bp, Artificial Sequence
  Description of Artificial Sequence: Synthetic oligonucleotide
  Target: ATXN1; (-) strand; PAM type: YTN; PAM sequence: TTA
ataaagctgtttttttaaaa

SEQ ID NO: 214518 - DNA, 20 bp, Artificial Sequence
  Description of Artificial Sequence: Synthetic oligonucleotide
  Target: ATXN1; (-) strand; PAM type: YTN; PAM sequence: CTT
aataaagctgtttttttaaa

SEQ ID NO: 214519 - DNA, 20 bp, Artificial Sequence
  Description of Artificial Sequence: Synthetic oligonucleotide
  Target: ATXN1; (-) strand; PAM type: YTN; PAM sequence: TTA
aatcttaataaagctgtttt

SEQ ID NO: 214520 - DNA, 20 bp, Artificial Sequence
  Description of Artificial Sequence: Synthetic oligonucleotide
  Target: ATXN1; (-) strand; PAM type: YTN; PAM sequence: TTA
tatgtaaattaaatcttaat

SEQ ID NO: 214521 - DNA, 20 bp, Artificial Sequence
  Description of Artificial Sequence: Synthetic oligonucleotide
  Target: ATXN1; (-) strand; PAM type: YTN; PAM sequence: TTG
agttatatgtaaattaaatc

SEQ ID NO: 214522 - DNA, 20 bp, Artificial Sequence
  Description of Artificial Sequence: Synthetic oligonucleotide
  Target: ATXN1; (-) strand; PAM type: YTN; PAM sequence: CTT
gagttatatgtaaattaaat

SEQ ID NO: 214523 - DNA, 20 bp, Artificial Sequence
  Description of Artificial Sequence: Synthetic oligonucleotide
  Target: ATXN1; (-) strand; PAM type: YTN; PAM sequence: TTA
tacacttgagttatatgtaa

SEQ ID NO: 214524 - DNA, 20 bp, Artificial Sequence
  Description of Artificial Sequence: Synthetic oligonucleotide
  Target: ATXN1; (-) strand; PAM type: YTN; PAM sequence: TTG
agttatacacttgagttata

SEQ ID NO: 214525 - DNA, 20 bp, Artificial Sequence
  Description of Artificial Sequence: Synthetic oligonucleotide
  Target: ATXN1; (-) strand; PAM type: YTN; PAM sequence: TTT
gagttatacacttgagttat

SEQ ID NO: 214526 - DNA, 20 bp, Artificial Sequence
  Description of Artificial Sequence: Synthetic oligonucleotide
  Target: ATXN1; (-) strand; PAM type: YTN; PAM sequence: CTA
aaaaacatttgagttataca

SEQ ID NO: 214527 - DNA, 20 bp, Artificial Sequence
  Description of Artificial Sequence: Synthetic oligonucleotide
  Target: ATXN1; (-) strand; PAM type: YTN; PAM sequence: CTA
tactaaaaaacatttgagtt

SEQ ID NO: 214528 - DNA, 20 bp, Artificial Sequence
  Description of Artificial Sequence: Synthetic oligonucleotide
  Target: ATXN1; (-) strand; PAM type: YTN; PAM sequence: TTA
caaaacagtgactatactaa

SEQ ID NO: 214529 - DNA, 20 bp, Artificial Sequence
  Description of Artificial Sequence: Synthetic oligonucleotide
  Target: ATXN1; (-) strand; PAM type: YTN; PAM sequence: TTT
acaaaacagtgactatacta

SEQ ID NO: 214530 - DNA, 20 bp, Artificial Sequence
  Description of Artificial Sequence: Synthetic oligonucleotide
  Target: ATXN1; (-) strand; PAM type: YTN; PAM sequence: TTT
tacaaaacagtgactatact

SEQ ID NO: 214531 - DNA, 20 bp, Artificial Sequence
  Description of Artificial Sequence: Synthetic oligonucleotide
  Target: ATXN1; (-) strand; PAM type: YTN; PAM sequence: TTG
gttttacaaaacagtgacta

SEQ ID NO: 214532 - DNA, 20 bp, Artificial Sequence
  Description of Artificial Sequence: Synthetic oligonucleotide
  Target: ATXN1; (-) strand; PAM type: YTN; PAM sequence: TTG
tgatgttggttttacaaaac

SEQ ID NO: 214533 - DNA, 20 bp, Artificial Sequence
  Description of Artificial Sequence: Synthetic oligonucleotide
  Target: ATXN1; (-) strand; PAM type: YTN; PAM sequence: TTA
gattgtgatgttggttttac

SEQ ID NO: 214534 - DNA, 20 bp, Artificial Sequence
  Description of Artificial Sequence: Synthetic oligonucleotide
  Target: ATXN1; (-) strand; PAM type: YTN; PAM sequence: CTA
aaattagattgtgatgttgg

SEQ ID NO: 214535 - DNA, 20 bp, Artificial Sequence
  Description of Artificial Sequence: Synthetic oligonucleotide
  Target: ATXN1; (-) strand; PAM type: YTN; PAM sequence: TTG
gagaagaaaatctaaaatta

SEQ ID NO: 214536 - DNA, 20 bp, Artificial Sequence
  Description of Artificial Sequence: Synthetic oligonucleotide
  Target: ATXN1; (-) strand; PAM type: YTN; PAM sequence: TTT
ggagaagaaaatctaaaatt

SEQ ID NO: 214537 - DNA, 20 bp, Artificial Sequence
  Description of Artificial Sequence: Synthetic oligonucleotide
  Target: ATXN1; (-) strand; PAM type: YTN; PAM sequence: TTT
tggagaagaaaatctaaaat

SEQ ID NO: 214538 - DNA, 20 bp, Artificial Sequence
  Description of Artificial Sequence: Synthetic oligonucleotide
  Target: ATXN1; (-) strand; PAM type: YTN; PAM sequence: TTT
ttggagaagaaaatctaaaa

SEQ ID NO: 214539 - DNA, 20 bp, Artificial Sequence
  Description of Artificial Sequence: Synthetic oligonucleotide
  Target: ATXN1; (-) strand; PAM type: YTN; PAM sequence: TTT
tttggagaagaaaatctaaa

SEQ ID NO: 214540 - DNA, 20 bp, Artificial Sequence
  Description of Artificial Sequence: Synthetic oligonucleotide
  Target: ATXN1; (-) strand; PAM type: YTN; PAM sequence: CTT
ttttggagaagaaaatctaa

SEQ ID NO: 214541 - DNA, 20 bp, Artificial Sequence
  Description of Artificial Sequence: Synthetic oligonucleotide
  Target: ATXN1; (-) strand; PAM type: YTN; PAM sequence: TTC
ttttttggagaagaaaatct

SEQ ID NO: 214542 - DNA, 20 bp, Artificial Sequence
  Description of Artificial Sequence: Synthetic oligonucleotide
  Target: ATXN1; (-) strand; PAM type: YTN; PAM sequence: TTT
cttttttggagaagaaaatc

SEQ ID NO: 214543 - DNA, 20 bp, Artificial Sequence
  Description of Artificial Sequence: Synthetic oligonucleotide
  Target: ATXN1; (-) strand; PAM type: YTN; PAM sequence: CTA
atgtacacagggtttctttt

SEQ ID NO: 214544 - DNA, 20 bp, Artificial Sequence
  Description of Artificial Sequence: Synthetic oligonucleotide
  Target: ATXN1; (-) strand; PAM type: YTN; PAM sequence: CTG
ctaatgtacacagggtttct

SEQ ID NO: 214545 - DNA, 20 bp, Artificial Sequence
  Description of Artificial Sequence: Synthetic oligonucleotide
  Target: ATXN1; (-) strand; PAM type: YTN; PAM sequence: TTG
cagaggccggaggtgggaga

SEQ ID NO: 214546 - DNA, 20 bp, Artificial Sequence
  Description of Artificial Sequence: Synthetic oligonucleotide
  Target: ATXN1; (-) strand; PAM type: YTN; PAM sequence: TTG
ggggttgcagaggccggagg

SEQ ID NO: 214547 - DNA, 20 bp, Artificial Sequence
  Description of Artificial Sequence: Synthetic oligonucleotide
  Target: ATXN1; (-) strand; PAM type: YTN; PAM sequence: TTT
gggggttgcagaggccggag

SEQ ID NO: 214548 - DNA, 20 bp, Artificial Sequence
  Description of Artificial Sequence: Synthetic oligonucleotide
  Target: ATXN1; (-) strand; PAM type: YTN; PAM sequence: TTA
gtttgggggttgcagaggcc

SEQ ID NO: 214549 - DNA, 20 bp, Artificial Sequence
  Description of Artificial Sequence: Synthetic oligonucleotide
  Target: ATXN1; (-) strand; PAM type: YTN; PAM sequence: TTA
tatgaaaggtccagaataga

SEQ ID NO: 214550 - DNA, 20 bp, Artificial Sequence
  Description of Artificial Sequence: Synthetic oligonucleotide
  Target: ATXN1; (-) strand; PAM type: YTN; PAM sequence: TTT
atatgaaaggtccagaatag

SEQ ID NO: 214551 - DNA, 20 bp, Artificial Sequence
  Description of Artificial Sequence: Synthetic oligonucleotide
  Target: ATXN1; (-) strand; PAM type: YTN; PAM sequence: TTC
atttatatgaaaggtccaga

SEQ ID NO: 214552 - DNA, 20 bp, Artificial Sequence
  Description of Artificial Sequence: Synthetic oligonucleotide
  Target: ATXN1; (-) strand; PAM type: YTN; PAM sequence: TTT
catttatatgaaaggtccag

SEQ ID NO: 214553 - DNA, 20 bp, Artificial Sequence
  Description of Artificial Sequence: Synthetic oligonucleotide
  Target: ATXN1; (-) strand; PAM type: YTN; PAM sequence: TTC
aatttcatttatatgaaagg

SEQ ID NO: 214554 - DNA, 20 bp, Artificial Sequence
  Description of Artificial Sequence: Synthetic oligonucleotide
  Target: ATXN1; (-) strand; PAM type: YTN; PAM sequence: CTT
caatttcatttatatgaaag

SEQ ID NO: 214555 - DNA, 20 bp, Artificial Sequence
  Description of Artificial Sequence: Synthetic oligonucleotide
  Target: ATXN1; (-) strand; PAM type: YTN; PAM sequence: TTG
agagaccacatacttcaatt

SEQ ID NO: 214556 - DNA, 20 bp, Artificial Sequence
  Description of Artificial Sequence: Synthetic oligonucleotide
  Target: ATXN1; (-) strand; PAM type: YTN; PAM sequence: CTC
aaaacatcatgtgaattgag

SEQ ID NO: 214557 - DNA, 20 bp, Artificial Sequence
  Description of Artificial Sequence: Synthetic oligonucleotide
  Target: ATXN1; (-) strand; PAM type: YTN; PAM sequence: CTA
caacatagatgaacctcaaa

SEQ ID NO: 214558 - DNA, 20 bp, Artificial Sequence
  Description of Artificial Sequence: Synthetic oligonucleotide
  Target: ATXN1; (-) strand; PAM type: YTN; PAM sequence: TTA
atacatgctacaacatagat

SEQ ID NO: 214559 - DNA, 20 bp, Artificial Sequence
  Description of Artificial Sequence: Synthetic oligonucleotide
  Target: ATXN1; (-) strand; PAM type: YTN; PAM sequence: TTG
atcaggaaaaaaacaaccag

SEQ ID NO: 214560 - DNA, 20 bp, Artificial Sequence
  Description of Artificial Sequence: Synthetic oligonucleotide
  Target: ATXN1; (-) strand; PAM type: YTN; PAM sequence: TTA
atggaatattgatcaggaaa

SEQ ID NO: 214561 - DNA, 20 bp, Artificial Sequence
  Description of Artificial Sequence: Synthetic oligonucleotide
  Target: ATXN1; (-) strand; PAM type: YTN; PAM sequence: TTT
aatggaatattgatcaggaa

SEQ ID NO: 214562 - DNA, 20 bp, Artificial Sequence
  Description of Artificial Sequence: Synthetic oligonucleotide
  Target: ATXN1; (-) strand; PAM type: YTN; PAM sequence: CTC
acacacacacacgcaaaata

SEQ ID NO: 214563 - DNA, 20 bp, Artificial Sequence
  Description of Artificial Sequence: Synthetic oligonucleotide
  Target: ATXN1; (-) strand; PAM type: YTN; PAM sequence: CTC
ctcacacacacacacgcaaa

SEQ ID NO: 214564 - DNA, 20 bp, Artificial Sequence
  Description of Artificial Sequence: Synthetic oligonucleotide
  Target: ATXN1; (-) strand; PAM type: YTN; PAM sequence: CTC
atgaaatatgtatcctcctc

SEQ ID NO: 214565 - DNA, 20 bp, Artificial Sequence
  Description of Artificial Sequence: Synthetic oligonucleotide
  Target: ATXN1; (-) strand; PAM type: YTN; PAM sequence: CTG
cactcatgaaatatgtatcc

SEQ ID NO: 214566 - DNA, 20 bp, Artificial Sequence
  Description of Artificial Sequence: Synthetic oligonucleotide
  Target: ATXN1; (-) strand; PAM type: YTN; PAM sequence: CTC
tgcactcatgaaatatgtat

SEQ ID NO: 214567 - DNA, 20 bp, Artificial Sequence
  Description of Artificial Sequence: Synthetic oligonucleotide
  Target: ATXN1; (-) strand; PAM type: YTN; PAM sequence: CTG
agcactctgcactcatgaaa

SEQ ID NO: 214568 - DNA, 20 bp, Artificial Sequence
  Description of Artificial Sequence: Synthetic oligonucleotide
  Target: ATXN1; (-) strand; PAM type: YTN; PAM sequence: CTG
agctgagcactctgcactca

SEQ ID NO: 214569 - DNA, 20 bp, Artificial Sequence
  Description of Artificial Sequence: Synthetic oligonucleotide
  Target: ATXN1; (-) strand; PAM type: YTN; PAM sequence: CTC
caagtactgagctgagcact

SEQ ID NO: 214570 - DNA, 20 bp, Artificial Sequence
  Description of Artificial Sequence: Synthetic oligonucleotide
  Target: ATXN1; (-) strand; PAM type: YTN; PAM sequence: CTG
tgtctccaagtactgagctg

SEQ ID NO: 214571 - DNA, 20 bp, Artificial Sequence
  Description of Artificial Sequence: Synthetic oligonucleotide
  Target: ATXN1; (-) strand; PAM type: YTN; PAM sequence: TTC
agagtgctgtgtctccaagt

SEQ ID NO: 214572 - DNA, 20 bp, Artificial Sequence
  Description of Artificial Sequence: Synthetic oligonucleotide
  Target: ATXN1; (-) strand; PAM type: YTN; PAM sequence: TTT
cagagtgctgtgtctccaag

SEQ ID NO: 214573 - DNA, 20 bp, Artificial Sequence
  Description of Artificial Sequence: Synthetic oligonucleotide
  Target: ATXN1; (-) strand; PAM type: YTN; PAM sequence: TTT
tcagagtgctgtgtctccaa

SEQ ID NO: 214574 - DNA, 20 bp, Artificial Sequence
  Description of Artificial Sequence: Synthetic oligonucleotide
  Target: ATXN1; (-) strand; PAM type: YTN; PAM sequence: CTA
cagacattttcagagtgctg

SEQ ID NO: 214575 - DNA, 20 bp, Artificial Sequence
  Description of Artificial Sequence: Synthetic oligonucleotide
  Target: ATXN1; (-) strand; PAM type: YTN; PAM sequence: TTG
taaacaaaagtgacaaaacg

SEQ ID NO: 214576 - DNA, 20 bp, Artificial Sequence
  Description of Artificial Sequence: Synthetic oligonucleotide
  Target: ATXN1; (-) strand; PAM type: YTN; PAM sequence: CTG
gtggagaccagtgcaattgt

SEQ ID NO: 214577 - DNA, 20 bp, Artificial Sequence
  Description of Artificial Sequence: Synthetic oligonucleotide
  Target: ATXN1; (-) strand; PAM type: YTN; PAM sequence: TTA
ataatcaactggtggagacc

SEQ ID NO: 214578 - DNA, 20 bp, Artificial Sequence
  Description of Artificial Sequence: Synthetic oligonucleotide
  Target: ATXN1; (-) strand; PAM type: YTN; PAM sequence: CTT
aataatcaactggtggagac

SEQ ID NO: 214579 - DNA, 20 bp, Artificial Sequence
  Description of Artificial Sequence: Synthetic oligonucleotide
  Target: ATXN1; (-) strand; PAM type: YTN; PAM sequence: CTA
gagcttaataatcaactggt

SEQ ID NO: 214580 - DNA, 20 bp, Artificial Sequence
  Description of Artificial Sequence: Synthetic oligonucleotide
  Target: ATXN1; (-) strand; PAM type: YTN; PAM sequence: CTC
tagagcttaataatcaactg

SEQ ID NO: 214581 - DNA, 20 bp, Artificial Sequence
  Description of Artificial Sequence: Synthetic oligonucleotide
  Target: ATXN1; (-) strand; PAM type: YTN; PAM sequence: CTG
ctctagagcttaataatcaa

SEQ ID NO: 214582 - DNA, 20 bp, Artificial Sequence
  Description of Artificial Sequence: Synthetic oligonucleotide
  Target: ATXN1; (-) strand; PAM type: YTN; PAM sequence: TTG
ggaacccctgctctagagct

SEQ ID NO: 214583 - DNA, 20 bp, Artificial Sequence
  Description of Artificial Sequence: Synthetic oligonucleotide
  Target: ATXN1; (-) strand; PAM type: YTN; PAM sequence: CTG
tagcccaggggttgggaacc

SEQ ID NO: 214584 - DNA, 20 bp, Artificial Sequence
  Description of Artificial Sequence: Synthetic oligonucleotide
  Target: ATXN1; (-) strand; PAM type: YTN; PAM sequence: TTG
tgcaggaggtctgtagccca

SEQ ID NO: 214585 - DNA, 20 bp, Artificial Sequence
  Description of Artificial Sequence: Synthetic oligonucleotide
  Target: ATXN1; (-) strand; PAM type: YTN; PAM sequence: CTG
ttgtgcaggaggtctgtagc

SEQ ID NO: 214586 - DNA, 20 bp, Artificial Sequence
  Description of Artificial Sequence: Synthetic oligonucleotide
  Target: ATXN1; (-) strand; PAM type: YTN; PAM sequence: CTC
ctgttgtgcaggaggtctgt

SEQ ID NO: 214587 - DNA, 20 bp, Artificial Sequence
  Description of Artificial Sequence: Synthetic oligonucleotide
  Target: ATXN1; (-) strand; PAM type: YTN; PAM sequence: CTC
acctcctgttgtgcaggagg

SEQ ID NO: 214588 - DNA, 20 bp, Artificial Sequence
  Description of Artificial Sequence: Synthetic oligonucleotide
  Target: ATXN1; (-) strand; PAM type: YTN; PAM sequence: CTG
ctcacctcctgttgtgcagg

SEQ ID NO: 214589 - DNA, 20 bp, Artificial Sequence
  Description of Artificial Sequence: Synthetic oligonucleotide
  Target: ATXN1; (-) strand; PAM type: YTN; PAM sequence: CTA
ctgctcacctcctgttgtgc

SEQ ID NO: 214590 - DNA, 20 bp, Artificial Sequence
  Description of Artificial Sequence: Synthetic oligonucleotide
  Target: ATXN1; (-) strand; PAM type: YTN; PAM sequence: TTC
gcctactgctcacctcctgt

SEQ ID NO: 214591 - DNA, 20 bp, Artificial Sequence
  Description of Artificial Sequence: Synthetic oligonucleotide
  Target: ATXN1; (-) strand; PAM type: YTN; PAM sequence: CTC
attcgcctactgctcacctc

SEQ ID NO: 214592 - DNA, 20 bp, Artificial Sequence
  Description of Artificial Sequence: Synthetic oligonucleotide
  Target: ATXN1; (-) strand; PAM type: YTN; PAM sequence: TTG
ctcattcgcctactgctcac

SEQ ID NO: 214593 - DNA, 20 bp, Artificial Sequence
  Description of Artificial Sequence: Synthetic oligonucleotide
  Target: ATXN1; (-) strand; PAM type: YTN; PAM sequence: TTT
gctcattcgcctactgctca

SEQ ID NO: 214594 - DNA, 20 bp, Artificial Sequence
  Description of Artificial Sequence: Synthetic oligonucleotide
  Target: ATXN1; (-) strand; PAM type: YTN; PAM sequence: CTT
tgctcattcgcctactgctc

SEQ ID NO: 214595 - DNA, 20 bp, Artificial Sequence
  Description of Artificial Sequence: Synthetic oligonucleotide
  Target: ATXN1; (-) strand; PAM type: YTN; PAM sequence: CTG
taaatacagatgaagctttg

SEQ ID NO: 214596 - DNA, 20 bp, Artificial Sequence
  Description of Artificial Sequence: Synthetic oligonucleotide
  Target: ATXN1; (-) strand; PAM type: YTN; PAM sequence: TTG
aacaatggggagtggctgta

SEQ ID NO: 214597 - DNA, 20 bp, Artificial Sequence
  Description of Artificial Sequence: Synthetic oligonucleotide
  Target: ATXN1; (-) strand; PAM type: YTN; PAM sequence: TTT
gaacaatggggagtggctgt

SEQ ID NO: 214598 - DNA, 20 bp, Artificial Sequence
  Description of Artificial Sequence: Synthetic oligonucleotide
  Target: ATXN1; (-) strand; PAM type: YTN; PAM sequence: CTC
aggtggtaatttgaacaatg

SEQ ID NO: 214599 - DNA, 20 bp, Artificial Sequence
  Description of Artificial Sequence: Synthetic oligonucleotide
  Target: ATXN1; (-) strand; PAM type: YTN; PAM sequence: CTG
acaggaggcagagctcaggt

SEQ ID NO: 214600 - DNA, 20 bp, Artificial Sequence
  Description of Artificial Sequence: Synthetic oligonucleotide
  Target: ATXN1; (-) strand; PAM type: YTN; PAM sequence: CTG
acctgacaggaggcagagct

SEQ ID NO: 214601 - DNA, 20 bp, Artificial Sequence
  Description of Artificial Sequence: Synthetic oligonucleotide
  Target: ATXN1; (-) strand; PAM type: YTN; PAM sequence: TTG
ctgacctgacaggaggcaga

SEQ ID NO: 214602 - DNA, 20 bp, Artificial Sequence
  Description of Artificial Sequence: Synthetic oligonucleotide
  Target: ATXN1; (-) strand; PAM type: YTN; PAM sequence: CTC
atgccgttgctgacctgaca

SEQ ID NO: 214603 - DNA, 20 bp, Artificial Sequence
  Description of Artificial Sequence: Synthetic oligonucleotide
  Target: ATXN1; (-) strand; PAM type: YTN; PAM sequence: CTA
tgagaatctcatgccgttgc

SEQ ID NO: 214604 - DNA, 20 bp, Artificial Sequence
  Description of Artificial Sequence: Synthetic oligonucleotide
  Target: ATXN1; (-) strand; PAM type: YTN; PAM sequence: CTC
ctatgagaatctcatgccgt

SEQ ID NO: 214605 - DNA, 20 bp, Artificial Sequence
  Description of Artificial Sequence: Synthetic oligonucleotide
  Target: ATXN1; (-) strand; PAM type: YTN; PAM sequence: TTC
acgctcctatgagaatctca

SEQ ID NO: 214606 - DNA, 20 bp, Artificial Sequence
  Description of Artificial Sequence: Synthetic oligonucleotide
  Target: ATXN1; (-) strand; PAM type: YTN; PAM sequence: TTC
acaatagggttcacgctcct

SEQ ID NO: 214607 - DNA, 20 bp, Artificial Sequence
  Description of Artificial Sequence: Synthetic oligonucleotide
  Target: ATXN1; (-) strand; PAM type: YTN; PAM sequence: CTC
acatgtgcagttcacaatag

SEQ ID NO: 214608 - DNA, 20 bp, Artificial Sequence
  Description of Artificial Sequence: Synthetic oligonucleotide
  Target: ATXN1; (-) strand; PAM type: YTN; PAM sequence: CTA
catccctcacatgtgcagtt

SEQ ID NO: 214609 - DNA, 20 bp, Artificial Sequence
  Description of Artificial Sequence: Synthetic oligonucleotide
  Target: ATXN1; (-) strand; PAM type: YTN; PAM sequence: CTC
ataaagagggtgcaacctac

SEQ ID NO: 214610 - DNA, 20 bp, Artificial Sequence
  Description of Artificial Sequence: Synthetic oligonucleotide
  Target: ATXN1; (-) strand; PAM type: YTN; PAM sequence: TTC
tcataaagagggtgcaacct

SEQ ID NO: 214611 - DNA, 20 bp, Artificial Sequence
  Description of Artificial Sequence: Synthetic oligonucleotide
  Target: ATXN1; (-) strand; PAM type: YTN; PAM sequence: TTA
gattctcataaagagggtgc

SEQ ID NO: 214612 - DNA, 20 bp, Artificial Sequence
  Description of Artificial Sequence: Synthetic oligonucleotide
  Target: ATXN1; (-) strand; PAM type: YTN; PAM sequence: CTA
ggggtgatgggagacagtga

SEQ ID NO: 214613 - DNA, 20 bp, Artificial Sequence
  Description of Artificial Sequence: Synthetic oligonucleotide
  Target: ATXN1; (-) strand; PAM type: YTN; PAM sequence: CTG
caacaaaacggtcccatcta

SEQ ID NO: 214614 - DNA, 20 bp, Artificial Sequence
  Description of Artificial Sequence: Synthetic oligonucleotide
  Target: ATXN1; (-) strand; PAM type: YTN; PAM sequence: TTC
ctgcaacaaaacggtcccat

SEQ ID NO: 214615 - DNA, 20 bp, Artificial Sequence
  Description of Artificial Sequence: Synthetic oligonucleotide
  Target: ATXN1; (-) strand; PAM type: YTN; PAM sequence: TTT
cctgcaacaaaacggtccca

SEQ ID NO: 214616 - DNA, 20 bp, Artificial Sequence
  Description of Artificial Sequence: Synthetic oligonucleotide
  Target: ATXN1; (-) strand; PAM type: YTN; PAM sequence: TTT
tcctgcaacaaaacggtccc

SEQ ID NO: 214617 - DNA, 20 bp, Artificial Sequence
  Description of Artificial Sequence: Synthetic oligonucleotide
  Target: ATXN1; (-) strand; PAM type: YTN; PAM sequence: TTG
ttttcctgcaacaaaacggt

SEQ ID NO: 214618 - DNA, 20 bp, Artificial Sequence
  Description of Artificial Sequence: Synthetic oligonucleotide
  Target: ATXN1; (-) strand; PAM type: YTN; PAM sequence: CTT
gttttcctgcaacaaaacgg

SEQ ID NO: 214619 - DNA, 20 bp, Artificial Sequence
  Description of Artificial Sequence: Synthetic oligonucleotide
  Target: ATXN1; (-) strand; PAM type: YTN; PAM sequence: TTG
agcttgttttcctgcaacaa

SEQ ID NO: 214620 - DNA, 20 bp, Artificial Sequence
  Description of Artificial Sequence: Synthetic oligonucleotide
  Target: ATXN1; (-) strand; PAM type: YTN; PAM sequence: CTT
gagcttgttttcctgcaaca

SEQ ID NO: 214621 - DNA, 20 bp, Artificial Sequence
  Description of Artificial Sequence: Synthetic oligonucleotide
  Target: ATXN1; (-) strand; PAM type: YTN; PAM sequence: CTC
accataatgtagaatcagtg

SEQ ID NO: 214622 - DNA, 20 bp, Artificial Sequence
  Description of Artificial Sequence: Synthetic oligonucleotide
  Target: ATXN1; (-) strand; PAM type: YTN; PAM sequence: TTA
tgcaactcaccataatgtag

SEQ ID NO: 214623 - DNA, 20 bp, Artificial Sequence
  Description of Artificial Sequence: Synthetic oligonucleotide
  Target: ATXN1; (-) strand; PAM type: YTN; PAM sequence: TTG
taatatataatgaaataatt

SEQ ID NO: 214624 - DNA, 20 bp, Artificial Sequence
  Description of Artificial Sequence: Synthetic oligonucleotide
  Target: ATXN1; (-) strand; PAM type: YTN; PAM sequence: TTA
tgttgtaatatataatgaaa

SEQ ID NO: 214625 - DNA, 20 bp, Artificial Sequence
  Description of Artificial Sequence: Synthetic oligonucleotide
  Target: ATXN1; (-) strand; PAM type: YTN; PAM sequence: TTA
ttatgttgtaatatataatg

SEQ ID NO: 214626 - DNA, 20 bp, Artificial Sequence
  Description of Artificial Sequence: Synthetic oligonucleotide
  Target: ATXN1; (-) strand; PAM type: YTN; PAM sequence: TTA
tattattatgttgtaatata

SEQ ID NO: 214627 - DNA, 20 bp, Artificial Sequence
  Description of Artificial Sequence: Synthetic oligonucleotide
  Target: ATXN1; (-) strand; PAM type: YTN; PAM sequence: TTT
atattattatgttgtaatat

SEQ ID NO: 214628 - DNA, 20 bp, Artificial Sequence
  Description of Artificial Sequence: Synthetic oligonucleotide
  Target: ATXN1; (-) strand; PAM type: YTN; PAM sequence: TTA
tttatattattatgttgtaa

SEQ ID NO: 214629 - DNA, 20 bp, Artificial Sequence
  Description of Artificial Sequence: Synthetic oligonucleotide
  Target: ATXN1; (-) strand; PAM type: YTN; PAM sequence: TTT
atttatattattatgttgta

SEQ ID NO: 214630 - DNA, 20 bp, Artificial Sequence
  Description of Artificial Sequence: Synthetic oligonucleotide
  Target: ATXN1; (-) strand; PAM type: YTN; PAM sequence: CTT
tatttatattattatgttgt

SEQ ID NO: 214631 - DNA, 20 bp, Artificial Sequence
  Description of Artificial Sequence: Synthetic oligonucleotide
  Target: ATXN1; (-) strand; PAM type: YTN; PAM sequence: TTG
tgcactttatttatattatt

SEQ ID NO: 214632 - DNA, 20 bp, Artificial Sequence
  Description of Artificial Sequence: Synthetic oligonucleotide
  Target: ATXN1; (-) strand; PAM type: YTN; PAM sequence: TTC
attgtgcactttatttatat

SEQ ID NO: 214633 - DNA, 20 bp, Artificial Sequence
  Description of Artificial Sequence: Synthetic oligonucleotide
  Target: ATXN1; (-) strand; PAM type: YTN; PAM sequence: TTA
tattcattgtgcactttatt

SEQ ID NO: 214634 - DNA, 20 bp, Artificial Sequence
  Description of Artificial Sequence: Synthetic oligonucleotide
  Target: ATXN1; (-) strand; PAM type: YTN; PAM sequence: TTT
atattcattgtgcactttat

SEQ ID NO: 214635 - DNA, 20 bp, Artificial Sequence
  Description of Artificial Sequence: Synthetic oligonucleotide
  Target: ATXN1; (-) strand; PAM type: YTN; PAM sequence: TTC
aaatgcatttatattcattg

SEQ ID NO: 214636 - DNA, 20 bp, Artificial Sequence
  Description of Artificial Sequence: Synthetic oligonucleotide
  Target: ATXN1; (-) strand; PAM type: YTN; PAM sequence: TTG
ggatgattcaaatgcattta

SEQ ID NO: 214637 - DNA, 20 bp, Artificial Sequence
  Description of Artificial Sequence: Synthetic oligonucleotide
  Target: ATXN1; (-) strand; PAM type: YTN; PAM sequence: TTT
gggatgattcaaatgcattt

SEQ ID NO: 214638 - DNA, 20 bp, Artificial Sequence
  Description of Artificial Sequence: Synthetic oligonucleotide
  Target: ATXN1; (-) strand; PAM type: YTN; PAM sequence: TTT
tgggatgattcaaatgcatt

SEQ ID NO: 214639 - DNA, 20 bp, Artificial Sequence
  Description of Artificial Sequence: Synthetic oligonucleotide
  Target: ATXN1; (-) strand; PAM type: YTN; PAM sequence: CTA
gggtggagcgggggatggtt

SEQ ID NO: 214640 - DNA, 20 bp, Artificial Sequence
  Description of Artificial Sequence: Synthetic oligonucleotide
  Target: ATXN1; (-) strand; PAM type: YTN; PAM sequence: TTC
cacagactagggtggagcgg

SEQ ID NO: 214641 - DNA, 20 bp, Artificial Sequence
  Description of Artificial Sequence: Synthetic oligonucleotide
  Target: ATXN1; (-) strand; PAM type: YTN; PAM sequence: TTT
ccacagactagggtggagcg

SEQ ID NO: 214642 - DNA, 20 bp, Artificial Sequence
  Description of Artificial Sequence: Synthetic oligonucleotide
  Target: ATXN1; (-) strand; PAM type: YTN; PAM sequence: TTT
tccacagactagggtggagc

SEQ ID NO: 214643 - DNA, 20 bp, Artificial Sequence
  Description of Artificial Sequence: Synthetic oligonucleotide
  Target: ATXN1; (-) strand; PAM type: YTN; PAM sequence: TTT
ttccacagactagggtggag

SEQ ID NO: 214644 - DNA, 20 bp, Artificial Sequence
  Description of Artificial Sequence: Synthetic oligonucleotide
  Target: ATXN1; (-) strand; PAM type: YTN; PAM sequence: TTC
atggaagacagtttttccac

SEQ ID NO: 214645 - DNA, 20 bp, Artificial Sequence
  Description of Artificial Sequence: Synthetic oligonucleotide
  Target: ATXN1; (-) strand; PAM type: YTN; PAM sequence: TTT
catggaagacagtttttcca

SEQ ID NO: 214646 - DNA, 20 bp, Artificial Sequence
  Description of Artificial Sequence: Synthetic oligonucleotide
  Target: ATXN1; (-) strand; PAM type: YTN; PAM sequence: CTG
gtttcatggaagacagtttt

SEQ ID NO: 214647 - DNA, 20 bp, Artificial Sequence
  Description of Artificial Sequence: Synthetic oligonucleotide
  Target: ATXN1; (-) strand; PAM type: YTN; PAM sequence: TTG
gcaccagggactggtttcat

SEQ ID NO: 214648 - DNA, 20 bp, Artificial Sequence
  Description of Artificial Sequence: Synthetic oligonucleotide
  Target: ATXN1; (-) strand; PAM type: YTN; PAM sequence: TTT
ggcaccagggactggtttca

SEQ ID NO: 214649 - DNA, 20 bp, Artificial Sequence
  Description of Artificial Sequence: Synthetic oligonucleotide
  Target: ATXN1; (-) strand; PAM type: YTN; PAM sequence: TTT
tggcaccagggactggtttc

SEQ ID NO: 214650 - DNA, 20 bp, Artificial Sequence
  Description of Artificial Sequence: Synthetic oligonucleotide
  Target: ATXN1; (-) strand; PAM type: YTN; PAM sequence: TTT
ttggcaccagggactggttt

SEQ ID NO: 214651 - DNA, 20 bp, Artificial Sequence
  Description of Artificial Sequence: Synthetic oligonucleotide
  Target: ATXN1; (-) strand; PAM type: YTN; PAM sequence: CTT
tttggcaccagggactggtt

SEQ ID NO: 214652 - DNA, 20 bp, Artificial Sequence
  Description of Artificial Sequence: Synthetic oligonucleotide
  Target: ATXN1; (-) strand; PAM type: YTN; PAM sequence: CTA
acctttttggcaccagggac

SEQ ID NO: 214653 - DNA, 20 bp, Artificial Sequence
  Description of Artificial Sequence: Synthetic oligonucleotide
  Target: ATXN1; (-) strand; PAM type: YTN; PAM sequence: CTA
gaccagtggtccctaacctt

SEQ ID NO: 214654 - DNA, 20 bp, Artificial Sequence
  Description of Artificial Sequence: Synthetic oligonucleotide
  Target: ATXN1; (-) strand; PAM type: YTN; PAM sequence: CTC
tagaccagtggtccctaacc

SEQ ID NO: 214655 - DNA, 20 bp, Artificial Sequence
  Description of Artificial Sequence: Synthetic oligonucleotide
  Target: ATXN1; (-) strand; PAM type: YTN; PAM sequence: CTC
tctagaccagtggtccctaa

SEQ ID NO: 214656 - DNA, 20 bp, Artificial Sequence
  Description of Artificial Sequence: Synthetic oligonucleotide
  Target: ATXN1; (-) strand; PAM type: YTN; PAM sequence: TTC
tctctagaccagtggtccct

SEQ ID NO: 214657 - DNA, 20 bp, Artificial Sequence
  Description of Artificial Sequence: Synthetic oligonucleotide
  Target: ATXN1; (-) strand; PAM type: YTN; PAM sequence: CTT
ctctctagaccagtggtccc

SEQ ID NO: 214658 - DNA, 20 bp, Artificial Sequence
  Description of Artificial Sequence: Synthetic oligonucleotide
  Target: ATXN1; (-) strand; PAM type: YTN; PAM sequence: CTC
cttctctctagaccagtggt

SEQ ID NO: 214659 - DNA, 20 bp, Artificial Sequence
  Description of Artificial Sequence: Synthetic oligonucleotide
  Target: ATXN1; (-) strand; PAM type: YTN; PAM sequence: CTG
ggcagtgtgtaagaagagct

SEQ ID NO: 214660 - DNA, 20 bp, Artificial Sequence
  Description of Artificial Sequence: Synthetic oligonucleotide
  Target: ATXN1; (-) strand; PAM type: YTN; PAM sequence: TTC
tgggcagtgtgtaagaagag

SEQ ID NO: 214661 - DNA, 20 bp, Artificial Sequence
  Description of Artificial Sequence: Synthetic oligonucleotide
  Target: ATXN1; (-) strand; PAM type: YTN; PAM sequence: TTT
ctgggcagtgtgtaagaaga

SEQ ID NO: 214662 - DNA, 20 bp, Artificial Sequence
  Description of Artificial Sequence: Synthetic oligonucleotide
  Target: ATXN1; (-) strand; PAM type: YTN; PAM sequence: CTC
agtttctgggcagtgtgtaa

SEQ ID NO: 214663 - DNA, 20 bp, Artificial Sequence
  Description of Artificial Sequence: Synthetic oligonucleotide
  Target: ATXN1; (-) strand; PAM type: YTN; PAM sequence: CTG
tcacatcctcagtttctggg

SEQ ID NO: 214664 - DNA, 20 bp, Artificial Sequence
  Description of Artificial Sequence: Synthetic oligonucleotide
  Target: ATXN1; (-) strand; PAM type: YTN; PAM sequence: TTC
tgtcacatcctcagtttctg

SEQ ID NO: 214665 - DNA, 20 bp, Artificial Sequence
  Description of Artificial Sequence: Synthetic oligonucleotide
  Target: ATXN1; (-) strand; PAM type: YTN; PAM sequence: CTT
ctgtcacatcctcagtttct

SEQ ID NO: 214666 - DNA, 20 bp, Artificial Sequence
  Description of Artificial Sequence: Synthetic oligonucleotide
  Target: ATXN1; (-) strand; PAM type: YTN; PAM sequence: TTG
aacttctgtcacatcctcag

SEQ ID NO: 214667 - DNA, 20 bp, Artificial Sequence
  Description of Artificial Sequence: Synthetic oligonucleotide
  Target: ATXN1; (-) strand; PAM type: YTN; PAM sequence: CTC
gttgaacttctgtcacatcc

SEQ ID NO: 214668 - DNA, 20 bp, Artificial Sequence
  Description of Artificial Sequence: Synthetic oligonucleotide
  Target: ATXN1; (-) strand; PAM type: YTN; PAM sequence: CTC
tcgttgaacttctgtcacat

SEQ ID NO: 214669 - DNA, 20 bp, Artificial Sequence
  Description of Artificial Sequence: Synthetic oligonucleotide
  Target: ATXN1; (-) strand; PAM type: YTN; PAM sequence: TTA
gctctcgttgaacttctgtc

SEQ ID NO: 214670 - DNA, 20 bp, Artificial Sequence
  Description of Artificial Sequence: Synthetic oligonucleotide
  Target: ATXN1; (-) strand; PAM type: YTN; PAM sequence: TTA
gttagctctcgttgaacttc

SEQ ID NO: 214671 - DNA, 20 bp, Artificial Sequence
  Description of Artificial Sequence: Synthetic oligonucleotide
  Target: ATXN1; (-) strand; PAM type: YTN; PAM sequence: TTT
agttagctctcgttgaactt

SEQ ID NO: 214672 - DNA, 20 bp, Artificial Sequence
  Description of Artificial Sequence: Synthetic oligonucleotide
  Target: ATXN1; (-) strand; PAM type: YTN; PAM sequence: TTG
tttagttagctctcgttgaa

SEQ ID NO: 214673 - DNA, 20 bp, Artificial Sequence
  Description of Artificial Sequence: Synthetic oligonucleotide
  Target: ATXN1; (-) strand; PAM type: YTN; PAM sequence: TTA
gttgtttagttagctctcgt

SEQ ID NO: 214674 - DNA, 20 bp, Artificial Sequence
  Description of Artificial Sequence: Synthetic oligonucleotide
  Target: ATXN1; (-) strand; PAM type: YTN; PAM sequence: CTT
agttgtttagttagctctcg

SEQ ID NO: 214675 - DNA, 20 bp, Artificial Sequence
  Description of Artificial Sequence: Synthetic oligonucleotide
  Target: ATXN1; (-) strand; PAM type: YTN; PAM sequence: CTA
cttagttgtttagttagctc

SEQ ID NO: 214676 - DNA, 20 bp, Artificial Sequence
  Description of Artificial Sequence: Synthetic oligonucleotide
  Target: ATXN1; (-) strand; PAM type: YTN; PAM sequence: TTG
ctacttagttgtttagttag

SEQ ID NO: 214677 - DNA, 20 bp, Artificial Sequence
  Description of Artificial Sequence: Synthetic oligonucleotide
  Target: ATXN1; (-) strand; PAM type: YTN; PAM sequence: TTG
tcaggttgctacttagttgt

SEQ ID NO: 214678 - DNA, 20 bp, Artificial Sequence
  Description of Artificial Sequence: Synthetic oligonucleotide
  Target: ATXN1; (-) strand; PAM type: YTN; PAM sequence: CTT
gtcaggttgctacttagttg

SEQ ID NO: 214679 - DNA, 20 bp, Artificial Sequence
  Description of Artificial Sequence: Synthetic oligonucleotide
  Target: ATXN1; (-) strand; PAM type: YTN; PAM sequence: CTG
agcccttgtcaggttgctac

SEQ ID NO: 214680 - DNA, 20 bp, Artificial Sequence
  Description of Artificial Sequence: Synthetic oligonucleotide
  Target: ATXN1; (-) strand; PAM type: YTN; PAM sequence: CTG
tctgagcccttgtcaggttg

SEQ ID NO: 214681 - DNA, 20 bp, Artificial Sequence
  Description of Artificial Sequence: Synthetic oligonucleotide
  Target: ATXN1; (-) strand; PAM type: YTN; PAM sequence: TTG
gagctgtctgagcccttgtc

SEQ ID NO: 214682 - DNA, 20 bp, Artificial Sequence
  Description of Artificial Sequence: Synthetic oligonucleotide
  Target: ATXN1; (-) strand; PAM type: YTN; PAM sequence: TTA
gttggagctgtctgagccct

SEQ ID NO: 214683 - DNA, 20 bp, Artificial Sequence
  Description of Artificial Sequence: Synthetic oligonucleotide
  Target: ATXN1; (-) strand; PAM type: YTN; PAM sequence: TTT
agttggagctgtctgagccc

SEQ ID NO: 214684 - DNA, 20 bp, Artificial Sequence
  Description of Artificial Sequence: Synthetic oligonucleotide
  Target: ATXN1; (-) strand; PAM type: YTN; PAM sequence: TTG
taagcggcagcagcagtgta

SEQ ID NO: 214685 - DNA, 20 bp, Artificial Sequence
  Description of Artificial Sequence: Synthetic oligonucleotide
  Target: ATXN1; (-) strand; PAM type: YTN; PAM sequence: TTT
gtaagcggcagcagcagtgt

SEQ ID NO: 214686 - DNA, 20 bp, Artificial Sequence
  Description of Artificial Sequence: Synthetic oligonucleotide
  Target: ATXN1; (-) strand; PAM type: YTN; PAM sequence: TTT
tgtaagcggcagcagcagtg

SEQ ID NO: 214687 - DNA, 20 bp, Artificial Sequence
  Description of Artificial Sequence: Synthetic oligonucleotide
  Target: ATXN1; (-) strand; PAM type: YTN; PAM sequence: CTT
ttgtaagcggcagcagcagt

SEQ ID NO: 214688 - DNA, 20 bp, Artificial Sequence
  Description of Artificial Sequence: Synthetic oligonucleotide
  Target: ATXN1; (-) strand; PAM type: YTN; PAM sequence: CTC
acacatatgaatgagctttt

SEQ ID NO: 214689 - DNA, 20 bp, Artificial Sequence
  Description of Artificial Sequence: Synthetic oligonucleotide
  Target: ATXN1; (-) strand; PAM type: YTN; PAM sequence: CTG
aactcacacatatgaatgag

SEQ ID NO: 214690 - DNA, 20 bp, Artificial Sequence
  Description of Artificial Sequence: Synthetic oligonucleotide
  Target: ATXN1; (-) strand; PAM type: YTN; PAM sequence: TTG
cctgaactcacacatatgaa

SEQ ID NO: 214691 - DNA, 20 bp, Artificial Sequence
  Description of Artificial Sequence: Synthetic oligonucleotide
  Target: ATXN1; (-) strand; PAM type: YTN; PAM sequence: TTT
gcctgaactcacacatatga

SEQ ID NO: 214692 - DNA, 20 bp, Artificial Sequence
  Description of Artificial Sequence: Synthetic oligonucleotide
  Target: ATXN1; (-) strand; PAM type: YTN; PAM sequence: TTT
tgcctgaactcacacatatg

SEQ ID NO: 214693 - DNA, 20 bp, Artificial Sequence
  Description of Artificial Sequence: Synthetic oligonucleotide
  Target: ATXN1; (-) strand; PAM type: YTN; PAM sequence: TTT
ttgcctgaactcacacatat

SEQ ID NO: 214694 - DNA, 20 bp, Artificial Sequence
  Description of Artificial Sequence: Synthetic oligonucleotide
  Target: ATXN1; (-) strand; PAM type: YTN; PAM sequence: CTG
tgtttttgcctgaactcaca

SEQ ID NO: 214695 - DNA, 20 bp, Artificial Sequence
  Description of Artificial Sequence: Synthetic oligonucleotide
  Target: ATXN1; (-) strand; PAM type: YTN; PAM sequence: CTA
aagaatcagataacgactgt

SEQ ID NO: 214696 - DNA, 20 bp, Artificial Sequence
  Description of Artificial Sequence: Synthetic oligonucleotide
  Target: ATXN1; (-) strand; PAM type: YTN; PAM sequence: CTG
cctaaagaatcagataacga

SEQ ID NO: 214697 - DNA, 20 bp, Artificial Sequence
  Description of Artificial Sequence: Synthetic oligonucleotide
  Target: ATXN1; (-) strand; PAM type: YTN; PAM sequence: CTG
gtcaatgtcctgcctaaaga

SEQ ID NO: 214698 - DNA, 20 bp, Artificial Sequence
  Description of Artificial Sequence: Synthetic oligonucleotide
  Target: ATXN1; (-) strand; PAM type: YTN; PAM sequence: TTA
tctggtcaatgtcctgccta

SEQ ID NO: 214699 - DNA, 20 bp, Artificial Sequence
  Description of Artificial Sequence: Synthetic oligonucleotide
  Target: ATXN1; (-) strand; PAM type: YTN; PAM sequence: TTT
atctggtcaatgtcctgcct

SEQ ID NO: 214700 - DNA, 20 bp, Artificial Sequence
  Description of Artificial Sequence: Synthetic oligonucleotide
  Target: ATXN1; (-) strand; PAM type: YTN; PAM sequence: TTA
tttatctggtcaatgtcctg

SEQ ID NO: 214701 - DNA, 20 bp, Artificial Sequence
  Description of Artificial Sequence: Synthetic oligonucleotide
  Target: ATXN1; (-) strand; PAM type: YTN; PAM sequence: TTT
atttatctggtcaatgtcct

SEQ ID NO: 214702 - DNA, 20 bp, Artificial Sequence
  Description of Artificial Sequence: Synthetic oligonucleotide
  Target: ATXN1; (-) strand; PAM type: YTN; PAM sequence: TTC
agacatatttatttatctgg

SEQ ID NO: 214703 - DNA, 20 bp, Artificial Sequence
  Description of Artificial Sequence: Synthetic oligonucleotide
  Target: ATXN1; (-) strand; PAM type: YTN; PAM sequence: CTG
cagattcagacatatttatt

SEQ ID NO: 214704 - DNA, 20 bp, Artificial Sequence
  Description of Artificial Sequence: Synthetic oligonucleotide
  Target: ATXN1; (-) strand; PAM type: YTN; PAM sequence: CTC
tgcagattcagacatattta

SEQ ID NO: 214705 - DNA, 20 bp, Artificial Sequence
  Description of Artificial Sequence: Synthetic oligonucleotide
  Target: ATXN1; (-) strand; PAM type: YTN; PAM sequence: TTC
tctgcagattcagacatatt

SEQ ID NO: 214706 - DNA, 20 bp, Artificial Sequence
  Description of Artificial Sequence: Synthetic oligonucleotide
  Target: ATXN1; (-) strand; PAM type: YTN; PAM sequence: TTT
ctctgcagattcagacatat

SEQ ID NO: 214707 - DNA, 20 bp, Artificial Sequence
  Description of Artificial Sequence: Synthetic oligonucleotide
  Target: ATXN1; (-) strand; PAM type: YTN; PAM sequence: TTA
tttctctgcagattcagaca

SEQ ID NO: 214708 - DNA, 20 bp, Artificial Sequence
  Description of Artificial Sequence: Synthetic oligonucleotide
  Target: ATXN1; (-) strand; PAM type: YTN; PAM sequence: TTG
aaattatttctctgcagatt

SEQ ID NO: 214709 - DNA, 20 bp, Artificial Sequence
  Description of Artificial Sequence: Synthetic oligonucleotide
  Target: ATXN1; (-) strand; PAM type: YTN; PAM sequence: TTT
gaaattatttctctgcagat

SEQ ID NO: 214710 - DNA, 20 bp, Artificial Sequence
  Description of Artificial Sequence: Synthetic oligonucleotide
  Target: ATXN1; (-) strand; PAM type: YTN; PAM sequence: TTT
tgaaattatttctctgcaga

SEQ ID NO: 214711 - DNA, 20 bp, Artificial Sequence
  Description of Artificial Sequence: Synthetic oligonucleotide
  Target: ATXN1; (-) strand; PAM type: YTN; PAM sequence: CTT
ttgaaattatttctctgcag

SEQ ID NO: 214712 - DNA, 20 bp, Artificial Sequence
  Description of Artificial Sequence: Synthetic oligonucleotide
  Target: ATXN1; (-) strand; PAM type: YTN; PAM sequence: CTG
aagcccttttgaaattattt

SEQ ID NO: 214713 - DNA, 20 bp, Artificial Sequence
  Description of Artificial Sequence: Synthetic oligonucleotide
  Target: ATXN1; (-) strand; PAM type: YTN; PAM sequence: TTC
tgaagcccttttgaaattat

SEQ ID NO: 214714 - DNA, 20 bp, Artificial Sequence
  Description of Artificial Sequence: Synthetic oligonucleotide
  Target: ATXN1; (-) strand; PAM type: YTN; PAM sequence: CTT
ctgaagcccttttgaaatta

SEQ ID NO: 214715 - DNA, 20 bp, Artificial Sequence
  Description of Artificial Sequence: Synthetic oligonucleotide
  Target: ATXN1; (-) strand; PAM type: YTN; PAM sequence: CTC
cttctgaagcccttttgaaa

SEQ ID NO: 214716 - DNA, 20 bp, Artificial Sequence
  Description of Artificial Sequence: Synthetic oligonucleotide
  Target: ATXN1; (-) strand; PAM type: YTN; PAM sequence: TTC
tccttctgaagcccttttga

SEQ ID NO: 214717 - DNA, 20 bp, Artificial Sequence
  Description of Artificial Sequence: Synthetic oligonucleotide
  Target: ATXN1; (-) strand; PAM type: YTN; PAM sequence: CTT
ctccttctgaagcccttttg

SEQ ID NO: 214718 - DNA, 20 bp, Artificial Sequence
  Description of Artificial Sequence: Synthetic oligonucleotide
  Target: ATXN1; (-) strand; PAM type: YTN; PAM sequence: TTC
cttctccttctgaagccctt

SEQ ID NO: 214719 - DNA, 20 bp, Artificial Sequence
  Description of Artificial Sequence: Synthetic oligonucleotide
  Target: ATXN1; (-) strand; PAM type: YTN; PAM sequence: TTT
ccttctccttctgaagccct

SEQ ID NO: 214720 - DNA, 20 bp, Artificial Sequence
  Description of Artificial Sequence: Synthetic oligonucleotide
  Target: ATXN1; (-) strand; PAM type: YTN; PAM sequence: TTT
tccttctccttctgaagccc

SEQ ID NO: 214721 - DNA, 20 bp, Artificial Sequence
  Description of Artificial Sequence: Synthetic oligonucleotide
  Target: ATXN1; (-) strand; PAM type: YTN; PAM sequence: CTA
cagtggattttccttctcct

SEQ ID NO: 214722 - DNA, 20 bp, Artificial Sequence
  Description of Artificial Sequence: Synthetic oligonucleotide
  Target: ATXN1; (-) strand; PAM type: YTN; PAM sequence: CTG
gctacagtggattttccttc

SEQ ID NO: 214723 - DNA, 20 bp, Artificial Sequence
  Description of Artificial Sequence: Synthetic oligonucleotide
  Target: ATXN1; (-) strand; PAM type: YTN; PAM sequence: TTC
tggctacagtggattttcct

SEQ ID NO: 214724 - DNA, 20 bp, Artificial Sequence
  Description of Artificial Sequence: Synthetic oligonucleotide
  Target: ATXN1; (-) strand; PAM type: YTN; PAM sequence: CTT
ctggctacagtggattttcc

SEQ ID NO: 214725 - DNA, 20 bp, Artificial Sequence
  Description of Artificial Sequence: Synthetic oligonucleotide
  Target: ATXN1; (-) strand; PAM type: YTN; PAM sequence: TTG
gatgcttctggctacagtgg

SEQ ID NO: 214726 - DNA, 20 bp, Artificial Sequence
  Description of Artificial Sequence: Synthetic oligonucleotide
  Target: ATXN1; (-) strand; PAM type: YTN; PAM sequence: TTT
ggatgcttctggctacagtg

SEQ ID NO: 214727 - DNA, 20 bp, Artificial Sequence
  Description of Artificial Sequence: Synthetic oligonucleotide
  Target: ATXN1; (-) strand; PAM type: YTN; PAM sequence: TTT
tggatgcttctggctacagt

SEQ ID NO: 214728 - DNA, 20 bp, Artificial Sequence
  Description of Artificial Sequence: Synthetic oligonucleotide
  Target: ATXN1; (-) strand; PAM type: YTN; PAM sequence: CTT
ttggatgcttctggctacag

SEQ ID NO: 214729 - DNA, 20 bp, Artificial Sequence
  Description of Artificial Sequence: Synthetic oligonucleotide
  Target: ATXN1; (-) strand; PAM type: YTN; PAM sequence: TTC
aggatgcttttggatgcttc

SEQ ID NO: 214730 - DNA, 20 bp, Artificial Sequence
  Description of Artificial Sequence: Synthetic oligonucleotide
  Target: ATXN1; (-) strand; PAM type: YTN; PAM sequence: TTT
caggatgcttttggatgctt

SEQ ID NO: 214731 - DNA, 20 bp, Artificial Sequence
  Description of Artificial Sequence: Synthetic oligonucleotide
  Target: ATXN1; (-) strand; PAM type: YTN; PAM sequence: TTT
tcaggatgcttttggatgct

SEQ ID NO: 214732 - DNA, 20 bp, Artificial Sequence
  Description of Artificial Sequence: Synthetic oligonucleotide
  Target: ATXN1; (-) strand; PAM type: YTN; PAM sequence: CTC
atgttttcaggatgcttttg

SEQ ID NO: 214733 - DNA, 20 bp, Artificial Sequence
  Description of Artificial Sequence: Synthetic oligonucleotide
  Target: ATXN1; (-) strand; PAM type: YTN; PAM sequence: CTC
cactcatgttttcaggatgc

SEQ ID NO: 214734 - DNA, 20 bp, Artificial Sequence
  Description of Artificial Sequence: Synthetic oligonucleotide
  Target: ATXN1; (-) strand; PAM type: YTN; PAM sequence: TTC
ctccactcatgttttcagga

SEQ ID NO: 214735 - DNA, 20 bp, Artificial Sequence
  Description of Artificial Sequence: Synthetic oligonucleotide
  Target: ATXN1; (-) strand; PAM type: YTN; PAM sequence: CTT
cctccactcatgttttcagg

SEQ ID NO: 214736 - DNA, 20 bp, Artificial Sequence
  Description of Artificial Sequence: Synthetic oligonucleotide
  Target: ATXN1; (-) strand; PAM type: YTN; PAM sequence: CTC
agccttcctccactcatgtt

SEQ ID NO: 214737 - DNA, 20 bp, Artificial Sequence
  Description of Artificial Sequence: Synthetic oligonucleotide
  Target: ATXN1; (-) strand; PAM type: YTN; PAM sequence: CTG
ctcagccttcctccactcat

SEQ ID NO: 214738 - DNA, 20 bp, Artificial Sequence
  Description of Artificial Sequence: Synthetic oligonucleotide
  Target: ATXN1; (-) strand; PAM type: YTN; PAM sequence: CTC
cccagcccacacctgctcag

SEQ ID NO: 214739 - DNA, 20 bp, Artificial Sequence
  Description of Artificial Sequence: Synthetic oligonucleotide
  Target: ATXN1; (-) strand; PAM type: YTN; PAM sequence: CTG
cctccccagcccacacctgc

SEQ ID NO: 214740 - DNA, 20 bp, Artificial Sequence
  Description of Artificial Sequence: Synthetic oligonucleotide
  Target: ATXN1; (-) strand; PAM type: YTN; PAM sequence: TTG
cctgcctccccagcccacac

SEQ ID NO: 214741 - DNA, 20 bp, Artificial Sequence
  Description of Artificial Sequence: Synthetic oligonucleotide
  Target: ATXN1; (-) strand; PAM type: YTN; PAM sequence: CTG
tgcggggttgcctgcctccc

SEQ ID NO: 214742 - DNA, 20 bp, Artificial Sequence
  Description of Artificial Sequence: Synthetic oligonucleotide
  Target: ATXN1; (-) strand; PAM type: YTN; PAM sequence: CTG
ctgtgcggggttgcctgcct

SEQ ID NO: 214743 - DNA, 20 bp, Artificial Sequence
  Description of Artificial Sequence: Synthetic oligonucleotide
  Target: ATXN1; (-) strand; PAM type: YTN; PAM sequence: CTG
gctgctgtgcggggttgcct

SEQ ID NO: 214744 - DNA, 20 bp, Artificial Sequence
  Description of Artificial Sequence: Synthetic oligonucleotide
  Target: ATXN1; (-) strand; PAM type: YTN; PAM sequence: TTG
tgctggctgctgtgcggggt

SEQ ID NO: 214745 - DNA, 20 bp, Artificial Sequence
  Description of Artificial Sequence: Synthetic oligonucleotide
  Target: ATXN1; (-) strand; PAM type: YTN; PAM sequence: TTT
gtgctggctgctgtgcgggg

SEQ ID NO: 214746 - DNA, 20 bp, Artificial Sequence
  Description of Artificial Sequence: Synthetic oligonucleotide
  Target: ATXN1; (-) strand; PAM type: YTN; PAM sequence: TTG
tgtttgtgctggctgctgtg

SEQ ID NO: 214747 - DNA, 20 bp, Artificial Sequence
  Description of Artificial Sequence: Synthetic oligonucleotide
  Target: ATXN1; (-) strand; PAM type: YTN; PAM sequence: TTT
gtgtttgtgctggctgctgt

SEQ ID NO: 214748 - DNA, 20 bp, Artificial Sequence
  Description of Artificial Sequence: Synthetic oligonucleotide
  Target: ATXN1; (-) strand; PAM type: YTN; PAM sequence: CTT
tgtgtttgtgctggctgctg

SEQ ID NO: 214749 - DNA, 20 bp, Artificial Sequence
  Description of Artificial Sequence: Synthetic oligonucleotide
  Target: ATXN1; (-) strand; PAM type: YTN; PAM sequence: TTC
cccagcacagtgggcgtcgt

SEQ ID NO: 214750 - DNA, 20 bp, Artificial Sequence
  Description of Artificial Sequence: Synthetic oligonucleotide
  Target: ATXN1; (-) strand; PAM type: YTN; PAM sequence: CTT
ccccagcacagtgggcgtcg

SEQ ID NO: 214751 - DNA, 20 bp, Artificial Sequence
  Description of Artificial Sequence: Synthetic oligonucleotide
  Target: ATXN1; (-) strand; PAM type: YTN; PAM sequence: CTG
tgcttccccagcacagtggg

SEQ ID NO: 214752 - DNA, 20 bp, Artificial Sequence
  Description of Artificial Sequence: Synthetic oligonucleotide
  Target: ATXN1; (-) strand; PAM type: YTN; PAM sequence: CTG
cctgtgcttccccagcacag

SEQ ID NO: 214753 - DNA, 20 bp, Artificial Sequence
  Description of Artificial Sequence: Synthetic oligonucleotide
  Target: ATXN1; (-) strand; PAM type: YTN; PAM sequence: CTG
tgctgcctgtgcttccccag

SEQ ID NO: 214754 - DNA, 20 bp, Artificial Sequence
  Description of Artificial Sequence: Synthetic oligonucleotide
  Target: ATXN1; (-) strand; PAM type: YTN; PAM sequence: TTG
cacggactgtgctgcctgtg

SEQ ID NO: 214755 - DNA, 20 bp, Artificial Sequence
  Description of Artificial Sequence: Synthetic oligonucleotide
  Target: ATXN1; (-) strand; PAM type: YTN; PAM sequence: CTT
gcacggactgtgctgcctgt

SEQ ID NO: 214756 - DNA, 20 bp, Artificial Sequence
  Description of Artificial Sequence: Synthetic oligonucleotide
  Target: ATXN1; (-) strand; PAM type: YTN; PAM sequence: TTC
ccttgcacggactgtgctgc

SEQ ID NO: 214757 - DNA, 20 bp, Artificial Sequence
  Description of Artificial Sequence: Synthetic oligonucleotide
  Target: ATXN1; (-) strand; PAM type: YTN; PAM sequence: TTT
cccttgcacggactgtgctg

SEQ ID NO: 214758 - DNA, 20 bp, Artificial Sequence
  Description of Artificial Sequence: Synthetic oligonucleotide
  Target: ATXN1; (-) strand; PAM type: YTN; PAM sequence: TTG
tagggagccgcgtttccctt

SEQ ID NO: 214759 - DNA, 20 bp, Artificial Sequence
  Description of Artificial Sequence: Synthetic oligonucleotide
  Target: ATXN1; (-) strand; PAM type: YTN; PAM sequence: CTT
gtagggagccgcgtttccct

SEQ ID NO: 214760 - DNA, 20 bp, Artificial Sequence
  Description of Artificial Sequence: Synthetic oligonucleotide
  Target: ATXN1; (-) strand; PAM type: YTN; PAM sequence: TTG
aaaacaccttgtagggagcc

SEQ ID NO: 214761 - DNA, 20 bp, Artificial Sequence
  Description of Artificial Sequence: Synthetic oligonucleotide
  Target: ATXN1; (-) strand; PAM type: YTN; PAM sequence: CTT
gaaaacaccttgtagggagc

SEQ ID NO: 214762 - DNA, 20 bp, Artificial Sequence
  Description of Artificial Sequence: Synthetic oligonucleotide
  Target: ATXN1; (-) strand; PAM type: YTN; PAM sequence: CTG
gggaaaccggaaccttgaaa

SEQ ID NO: 214763 - DNA, 20 bp, Artificial Sequence
  Description of Artificial Sequence: Synthetic oligonucleotide
  Target: ATXN1; (-) strand; PAM type: YTN; PAM sequence: CTC
tggggaaaccggaaccttga

SEQ ID NO: 214764 - DNA, 20 bp, Artificial Sequence
  Description of Artificial Sequence: Synthetic oligonucleotide
  Target: ATXN1; (-) strand; PAM type: YTN; PAM sequence: TTG
tgctctggggaaaccggaac

SEQ ID NO: 214765 - DNA, 20 bp, Artificial Sequence
  Description of Artificial Sequence: Synthetic oligonucleotide
  Target: ATXN1; (-) strand; PAM type: YTN; PAM sequence: TTA
gggttgtgctctggggaaac

SEQ ID NO: 214766 - DNA, 20 bp, Artificial Sequence
  Description of Artificial Sequence: Synthetic oligonucleotide
  Target: ATXN1; (-) strand; PAM type: YTN; PAM sequence: CTG
aggttagggttgtgctctgg

SEQ ID NO: 214767 - DNA, 20 bp, Artificial Sequence
  Description of Artificial Sequence: Synthetic oligonucleotide
  Target: ATXN1; (-) strand; PAM type: YTN; PAM sequence: CTG
cctgaggttagggttgtgct

SEQ ID NO: 214768 - DNA, 20 bp, Artificial Sequence
  Description of Artificial Sequence: Synthetic oligonucleotide
  Target: ATXN1; (-) strand; PAM type: YTN; PAM sequence: CTG
tgcactgcctgaggttaggg

SEQ ID NO: 214769 - DNA, 20 bp, Artificial Sequence
  Description of Artificial Sequence: Synthetic oligonucleotide
  Target: ATXN1; (-) strand; PAM type: YTN; PAM sequence: TTG
ggagaactgtgcactgcctg

SEQ ID NO: 214770 - DNA, 20 bp, Artificial Sequence
  Description of Artificial Sequence: Synthetic oligonucleotide
  Target: ATXN1; (-) strand; PAM type: YTN; PAM sequence: TTA
ttgggagaactgtgcactgc

SEQ ID NO: 214771 - DNA, 20 bp, Artificial Sequence
  Description of Artificial Sequence: Synthetic oligonucleotide
  Target: ATXN1; (-) strand; PAM type: YTN; PAM sequence: TTT
attgggagaactgtgcactg

SEQ ID NO: 214772 - DNA, 20 bp, Artificial Sequence
  Description of Artificial Sequence: Synthetic oligonucleotide
  Target: ATXN1; (-) strand; PAM type: YTN; PAM sequence: TTT
tattgggagaactgtgcact

SEQ ID NO: 214773 - DNA, 20 bp, Artificial Sequence
  Description of Artificial Sequence: Synthetic oligonucleotide
  Target: ATXN1; (-) strand; PAM type: YTN; PAM sequence: CTT
ttattgggagaactgtgcac

SEQ ID NO: 214774 - DNA, 20 bp, Artificial Sequence
  Description of Artificial Sequence: Synthetic oligonucleotide
  Target: ATXN1; (-) strand; PAM type: YTN; PAM sequence: CTC
cacgggcgagtgacttttat

SEQ ID NO: 214775 - DNA, 20 bp, Artificial Sequence
  Description of Artificial Sequence: Synthetic oligonucleotide
  Target: ATXN1; (-) strand; PAM type: YTN; PAM sequence: TTC
ggtgatctccacgggcgagt

SEQ ID NO: 214776 - DNA, 20 bp, Artificial Sequence
  Description of Artificial Sequence: Synthetic oligonucleotide
  Target: ATXN1; (-) strand; PAM type: YTN; PAM sequence: TTC
aggtgttcggtgatctccac

SEQ ID NO: 214777 - DNA, 20 bp, Artificial Sequence
  Description of Artificial Sequence: Synthetic oligonucleotide
  Target: ATXN1; (-) strand; PAM type: YTN; PAM sequence: TTG
gaagtgcccgtggtgtcaat

SEQ ID NO: 214778 - DNA, 20 bp, Artificial Sequence
  Description of Artificial Sequence: Synthetic oligonucleotide
  Target: ATXN1; (-) strand; PAM type: YTN; PAM sequence: TTG
aaagagtaagagaagtcaca

SEQ ID NO: 214779 - DNA, 20 bp, Artificial Sequence
  Description of Artificial Sequence: Synthetic oligonucleotide
  Target: ATXN1; (-) strand; PAM type: YTN; PAM sequence: TTT
gaaagagtaagagaagtcac

SEQ ID NO: 214780 - DNA, 20 bp, Artificial Sequence
  Description of Artificial Sequence: Synthetic oligonucleotide
  Target: ATXN1; (-) strand; PAM type: YTN; PAM sequence: TTG
catttgaaagagtaagagaa

SEQ ID NO: 214781 - DNA, 20 bp, Artificial Sequence
  Description of Artificial Sequence: Synthetic oligonucleotide
  Target: ATXN1; (-) strand; PAM type: YTN; PAM sequence: TTT
gcatttgaaagagtaagaga

SEQ ID NO: 214782 - DNA, 20 bp, Artificial Sequence
  Description of Artificial Sequence: Synthetic oligonucleotide
  Target: ATXN1; (-) strand; PAM type: YTN; PAM sequence: TTT
tgcatttgaaagagtaagag

SEQ ID NO: 214783 - DNA, 20 bp, Artificial Sequence
  Description of Artificial Sequence: Synthetic oligonucleotide
  Target: ATXN1; (-) strand; PAM type: YTN; PAM sequence: CTG
tgacattttgcatttgaaag

SEQ ID NO: 214784 - DNA, 20 bp, Artificial Sequence
  Description of Artificial Sequence: Synthetic oligonucleotide
  Target: ATXN1; (-) strand; PAM type: YTN; PAM sequence: TTC
agctgtgacattttgcattt

SEQ ID NO: 214785 - DNA, 20 bp, Artificial Sequence
  Description of Artificial Sequence: Synthetic oligonucleotide
  Target: ATXN1; (-) strand; PAM type: YTN; PAM sequence: CTT
cagctgtgacattttgcatt

SEQ ID NO: 214786 - DNA, 20 bp, Artificial Sequence
  Description of Artificial Sequence: Synthetic oligonucleotide
  Target: ATXN1; (-) strand; PAM type: YTN; PAM sequence: TTC
ccttcagctgtgacattttg

SEQ ID NO: 214787 - DNA, 20 bp, Artificial Sequence
  Description of Artificial Sequence: Synthetic oligonucleotide
  Target: ATXN1; (-) strand; PAM type: YTN; PAM sequence: CTT
cccttcagctgtgacatttt

SEQ ID NO: 214788 - DNA, 20 bp, Artificial Sequence
  Description of Artificial Sequence: Synthetic oligonucleotide
  Target: ATXN1; (-) strand; PAM type: YTN; PAM sequence: TTC
cttcccttcagctgtgacat

SEQ ID NO: 214789 - DNA, 20 bp, Artificial Sequence
  Description of Artificial Sequence: Synthetic oligonucleotide
  Target: ATXN1; (-) strand; PAM type: YTN; PAM sequence: TTG
gaggttccttcccttcagct

SEQ ID NO: 214790 - DNA, 20 bp, Artificial Sequence
  Description of Artificial Sequence: Synthetic oligonucleotide
  Target: ATXN1; (-) strand; PAM type: YTN; PAM sequence: CTT
ggaggttccttcccttcagc

SEQ ID NO: 214791 - DNA, 20 bp, Artificial Sequence
  Description of Artificial Sequence: Synthetic oligonucleotide
  Target: ATXN1; (-) strand; PAM type: YTN; PAM sequence: CTA
tgaagaagaaagcagtagcc

SEQ ID NO: 214792 - DNA, 20 bp, Artificial Sequence
  Description of Artificial Sequence: Synthetic oligonucleotide
  Target: ATXN1; (-) strand; PAM type: YTN; PAM sequence: CTC
ccctatgaagaagaaagcag

SEQ ID NO: 214793 - DNA, 20 bp, Artificial Sequence
  Description of Artificial Sequence: Synthetic oligonucleotide
  Target: ATXN1; (-) strand; PAM type: YTN; PAM sequence: TTC
ctcccctatgaagaagaaag

SEQ ID NO: 214794 - DNA, 20 bp, Artificial Sequence
  Description of Artificial Sequence: Synthetic oligonucleotide
  Target: ATXN1; (-) strand; PAM type: YTN; PAM sequence: TTT
cctcccctatgaagaagaaa

SEQ ID NO: 214795 - DNA, 20 bp, Artificial Sequence
  Description of Artificial Sequence: Synthetic oligonucleotide
  Target: ATXN1; (-) strand; PAM type: YTN; PAM sequence: CTC
agtttcctcccctatgaaga

SEQ ID NO: 214796 - DNA, 20 bp, Artificial Sequence
  Description of Artificial Sequence: Synthetic oligonucleotide
  Target: ATXN1; (-) strand; PAM type: YTN; PAM sequence: CTG
gaatctcagtttcctcccct

SEQ ID NO: 214797 - DNA, 20 bp, Artificial Sequence
  Description of Artificial Sequence: Synthetic oligonucleotide
  Target: ATXN1; (-) strand; PAM type: YTN; PAM sequence: CTC
tggaatctcagtttcctccc

SEQ ID NO: 214798 - DNA, 20 bp, Artificial Sequence
  Description of Artificial Sequence: Synthetic oligonucleotide
  Target: ATXN1; (-) strand; PAM type: YTN; PAM sequence: CTC
tctggaatctcagtttcctc

SEQ ID NO: 214799 - DNA, 20 bp, Artificial Sequence
  Description of Artificial Sequence: Synthetic oligonucleotide
  Target: ATXN1; (-) strand; PAM type: YTN; PAM sequence: TTA
ccaacctctctggaatctca

SEQ ID NO: 214800 - DNA, 20 bp, Artificial Sequence
  Description of Artificial Sequence: Synthetic oligonucleotide
  Target: ATXN1; (-) strand; PAM type: YTN; PAM sequence: TTG
ggaaagttaccaacctctct

SEQ ID NO: 214801 - DNA, 20 bp, Artificial Sequence
  Description of Artificial Sequence: Synthetic oligonucleotide
  Target: ATXN1; (-) strand; PAM type: YTN; PAM sequence: CTT
gggaaagttaccaacctctc

SEQ ID NO: 214802 - DNA, 20 bp, Artificial Sequence
  Description of Artificial Sequence: Synthetic oligonucleotide
  Target: ATXN1; (-) strand; PAM type: YTN; PAM sequence: TTG
taaccttgggaaagttacca

SEQ ID NO: 214803 - DNA, 20 bp, Artificial Sequence
  Description of Artificial Sequence: Synthetic oligonucleotide
  Target: ATXN1; (-) strand; PAM type: YTN; PAM sequence: TTT
gtaaccttgggaaagttacc

SEQ ID NO: 214804 - DNA, 20 bp, Artificial Sequence
  Description of Artificial Sequence: Synthetic oligonucleotide
  Target: ATXN1; (-) strand; PAM type: YTN; PAM sequence: TTT
tgtaaccttgggaaagttac

SEQ ID NO: 214805 - DNA, 20 bp, Artificial Sequence
  Description of Artificial Sequence: Synthetic oligonucleotide
  Target: ATXN1; (-) strand; PAM type: YTN; PAM sequence: CTA
attttgtaaccttgggaaag

SEQ ID NO: 214806 - DNA, 20 bp, Artificial Sequence
  Description of Artificial Sequence: Synthetic oligonucleotide
  Target: ATXN1; (-) strand; PAM type: YTN; PAM sequence: CTG
ctaattttgtaaccttggga

SEQ ID NO: 214807 - DNA, 20 bp, Artificial Sequence
  Description of Artificial Sequence: Synthetic oligonucleotide
  Target: ATXN1; (-) strand; PAM type: YTN; PAM sequence: CTG
cactgctaattttgtaacct

SEQ ID NO: 214808 - DNA, 20 bp, Artificial Sequence
  Description of Artificial Sequence: Synthetic oligonucleotide
  Target: ATXN1; (-) strand; PAM type: YTN; PAM sequence: TTC
cggctgcactgctaattttg

SEQ ID NO: 214809 - DNA, 20 bp, Artificial Sequence
  Description of Artificial Sequence: Synthetic oligonucleotide
  Target: ATXN1; (-) strand; PAM type: YTN; PAM sequence: TTC
agttccggctgcactgctaa

SEQ ID NO: 214810 - DNA, 20 bp, Artificial Sequence
  Description of Artificial Sequence: Synthetic oligonucleotide
  Target: ATXN1; (-) strand; PAM type: YTN; PAM sequence: TTT
cagttccggctgcactgcta

SEQ ID NO: 214811 - DNA, 20 bp, Artificial Sequence
  Description of Artificial Sequence: Synthetic oligonucleotide
  Target: ATXN1; (-) strand; PAM type: YTN; PAM sequence: TTG
ggaggaggagagtggtcaca

SEQ ID NO: 214812 - DNA, 20 bp, Artificial Sequence
  Description of Artificial Sequence: Synthetic oligonucleotide
  Target: ATXN1; (-) strand; PAM type: YTN; PAM sequence: TTT
gggaggaggagagtggtcac

SEQ ID NO: 214813 - DNA, 20 bp, Artificial Sequence
  Description of Artificial Sequence: Synthetic oligonucleotide
  Target: ATXN1; (-) strand; PAM type: YTN; PAM sequence: CTT
tgggaggaggagagtggtca

SEQ ID NO: 214814 - DNA, 20 bp, Artificial Sequence
  Description of Artificial Sequence: Synthetic oligonucleotide
  Target: ATXN1; (-) strand; PAM type: YTN; PAM sequence: TTG
ctttgggaggaggagagtgg

SEQ ID NO: 214815 - DNA, 20 bp, Artificial Sequence
  Description of Artificial Sequence: Synthetic oligonucleotide
  Target: ATXN1; (-) strand; PAM type: YTN; PAM sequence: CTA
aattgctttgggaggaggag

SEQ ID NO: 214816 - DNA, 20 bp, Artificial Sequence
  Description of Artificial Sequence: Synthetic oligonucleotide
  Target: ATXN1; (-) strand; PAM type: YTN; PAM sequence: TTG
gaaactaaattgctttggga

SEQ ID NO: 214817 - DNA, 20 bp, Artificial Sequence
  Description of Artificial Sequence: Synthetic oligonucleotide
  Target: ATXN1; (-) strand; PAM type: YTN; PAM sequence: CTG
ggggagaaacaagtaggcag

SEQ ID NO: 214818 - DNA, 20 bp, Artificial Sequence
  Description of Artificial Sequence: Synthetic oligonucleotide
  Target: ATXN1; (-) strand; PAM type: YTN; PAM sequence: CTG
ggggctgggggagaaacaag

SEQ ID NO: 214819 - DNA, 20 bp, Artificial Sequence
  Description of Artificial Sequence: Synthetic oligonucleotide
  Target: ATXN1; (-) strand; PAM type: YTN; PAM sequence: CTG
cctgggggctgggggagaaa

SEQ ID NO: 214820 - DNA, 20 bp, Artificial Sequence
  Description of Artificial Sequence: Synthetic oligonucleotide
  Target: ATXN1; (-) strand; PAM type: YTN; PAM sequence: CTC
agcagccacagtgaagggct

SEQ ID NO: 214821 - DNA, 20 bp, Artificial Sequence
  Description of Artificial Sequence: Synthetic oligonucleotide
  Target: ATXN1; (-) strand; PAM type: YTN; PAM sequence: CTG
atgactcagcagccacagtg

SEQ ID NO: 214822 - DNA, 20 bp, Artificial Sequence
  Description of Artificial Sequence: Synthetic oligonucleotide
  Target: ATXN1; (-) strand; PAM type: YTN; PAM sequence: CTC
atcctgatgactcagcagcc

SEQ ID NO: 214823 - DNA, 20 bp, Artificial Sequence
  Description of Artificial Sequence: Synthetic oligonucleotide
  Target: ATXN1; (-) strand; PAM type: YTN; PAM sequence: TTG
agaacaaagctcatcctgat

SEQ ID NO: 214824 - DNA, 20 bp, Artificial Sequence
  Description of Artificial Sequence: Synthetic oligonucleotide
  Target: ATXN1; (-) strand; PAM type: YTN; PAM sequence: CTT
gagaacaaagctcatcctga

SEQ ID NO: 214825 - DNA, 20 bp, Artificial Sequence
  Description of Artificial Sequence: Synthetic oligonucleotide
  Target: ATXN1; (-) strand; PAM type: YTN; PAM sequence: TTG
cttgagaacaaagctcatcc

SEQ ID NO: 214826 - DNA, 20 bp, Artificial Sequence
  Description of Artificial Sequence: Synthetic oligonucleotide
  Target: ATXN1; (-) strand; PAM type: YTN; PAM sequence: CTT
gcttgagaacaaagctcatc

SEQ ID NO: 214827 - DNA, 20 bp, Artificial Sequence
  Description of Artificial Sequence: Synthetic oligonucleotide
  Target: ATXN1; (-) strand; PAM type: YTN; PAM sequence: CTG
tcccagtggcttgcttgaga

SEQ ID NO: 214828 - DNA, 20 bp, Artificial Sequence
  Description of Artificial Sequence: Synthetic oligonucleotide
  Target: ATXN1; (-) strand; PAM type: YTN; PAM sequence: CTC
aagacatgagggcctgtccc

SEQ ID NO: 214829 - DNA, 20 bp, Artificial Sequence
  Description of Artificial Sequence: Synthetic oligonucleotide
  Target: ATXN1; (-) strand; PAM type: YTN; PAM sequence: CTA
ctcaagacatgagggcctgt

SEQ ID NO: 214830 - DNA, 20 bp, Artificial Sequence
  Description of Artificial Sequence: Synthetic oligonucleotide
  Target: ATXN1; (-) strand; PAM type: YTN; PAM sequence: TTG
tcctactcaagacatgaggg

SEQ ID NO: 214831 - DNA, 20 bp, Artificial Sequence
  Description of Artificial Sequence: Synthetic oligonucleotide
  Target: ATXN1; (-) strand; PAM type: YTN; PAM sequence: TTT
gtcctactcaagacatgagg

SEQ ID NO: 214832 - DNA, 20 bp, Artificial Sequence
  Description of Artificial Sequence: Synthetic oligonucleotide
  Target: ATXN1; (-) strand; PAM type: YTN; PAM sequence: CTT
tgtcctactcaagacatgag

SEQ ID NO: 214833 - DNA, 20 bp, Artificial Sequence
  Description of Artificial Sequence: Synthetic oligonucleotide
  Target: ATXN1; (-) strand; PAM type: YTN; PAM sequence: TTG
tcatgggcagaaggtgccca

SEQ ID NO: 214834 - DNA, 20 bp, Artificial Sequence
  Description of Artificial Sequence: Synthetic oligonucleotide
  Target: ATXN1; (-) strand; PAM type: YTN; PAM sequence: TTC
agggcgaatgacagttgtca

SEQ ID NO: 214835 - DNA, 20 bp, Artificial Sequence
  Description of Artificial Sequence: Synthetic oligonucleotide
  Target: ATXN1; (-) strand; PAM type: YTN; PAM sequence: CTA
ttcagggcgaatgacagttg

SEQ ID NO: 214836 - DNA, 20 bp, Artificial Sequence
  Description of Artificial Sequence: Synthetic oligonucleotide
  Target: ATXN1; (-) strand; PAM type: YTN; PAM sequence: TTA
gtagccataaggaggtgtga

SEQ ID NO: 214837 - DNA, 20 bp, Artificial Sequence
  Description of Artificial Sequence: Synthetic oligonucleotide
  Target: ATXN1; (-) strand; PAM type: YTN; PAM sequence: TTA
tgttagtagccataaggagg

SEQ ID NO: 214838 - DNA, 20 bp, Artificial Sequence
  Description of Artificial Sequence: Synthetic oligonucleotide
  Target: ATXN1; (-) strand; PAM type: YTN; PAM sequence: TTT
atgttagtagccataaggag

SEQ ID NO: 214839 - DNA, 20 bp, Artificial Sequence
  Description of Artificial Sequence: Synthetic oligonucleotide
  Target: ATXN1; (-) strand; PAM type: YTN; PAM sequence: TTT
tatgttagtagccataagga

SEQ ID NO: 214840 - DNA, 20 bp, Artificial Sequence
  Description of Artificial Sequence: Synthetic oligonucleotide
  Target: ATXN1; (-) strand; PAM type: YTN; PAM sequence: CTT
ttatgttagtagccataagg

SEQ ID NO: 214841 - DNA, 20 bp, Artificial Sequence
  Description of Artificial Sequence: Synthetic oligonucleotide
  Target: ATXN1; (-) strand; PAM type: YTN; PAM sequence: TTA
ccttttatgttagtagccat

SEQ ID NO: 214842 - DNA, 20 bp, Artificial Sequence
  Description of Artificial Sequence: Synthetic oligonucleotide
  Target: ATXN1; (-) strand; PAM type: YTN; PAM sequence: CTT
accttttatgttagtagcca

SEQ ID NO: 214843 - DNA, 20 bp, Artificial Sequence
  Description of Artificial Sequence: Synthetic oligonucleotide
  Target: ATXN1; (-) strand; PAM type: YTN; PAM sequence: TTA
gtcacttaccttttatgtta

SEQ ID NO: 214844 - DNA, 20 bp, Artificial Sequence
  Description of Artificial Sequence: Synthetic oligonucleotide
  Target: ATXN1; (-) strand; PAM type: YTN; PAM sequence: TTA
ttagtcacttaccttttatg

SEQ ID NO: 214845 - DNA, 20 bp, Artificial Sequence
  Description of Artificial Sequence: Synthetic oligonucleotide
  Target: ATXN1; (-) strand; PAM type: YTN; PAM sequence: TTT
attagtcacttaccttttat

SEQ ID NO: 214846 - DNA, 20 bp, Artificial Sequence
  Description of Artificial Sequence: Synthetic oligonucleotide
  Target: ATXN1; (-) strand; PAM type: YTN; PAM sequence: TTC
atgataccatttattagtca

SEQ ID NO: 214847 - DNA, 20 bp, Artificial Sequence
  Description of Artificial Sequence: Synthetic oligonucleotide
  Target: ATXN1; (-) strand; PAM type: YTN; PAM sequence: TTA
attcatgataccatttatta

SEQ ID NO: 214848 - DNA, 20 bp, Artificial Sequence
  Description of Artificial Sequence: Synthetic oligonucleotide
  Target: ATXN1; (-) strand; PAM type: YTN; PAM sequence: TTC
atattaattcatgataccat

SEQ ID NO: 214849 - DNA, 20 bp, Artificial Sequence
  Description of Artificial Sequence: Synthetic oligonucleotide
  Target: ATXN1; (-) strand; PAM type: YTN; PAM sequence: TTT
catattaattcatgatacca

SEQ ID NO: 214850 - DNA, 20 bp, Artificial Sequence
  Description of Artificial Sequence: Synthetic oligonucleotide
  Target: ATXN1; (-) strand; PAM type: YTN; PAM sequence: CTG
tataaaaggtttcatattaa

SEQ ID NO: 214851 - DNA, 20 bp, Artificial Sequence
  Description of Artificial Sequence: Synthetic oligonucleotide
  Target: ATXN1; (-) strand; PAM type: YTN; PAM sequence: TTG
tctgtataaaaggtttcata

SEQ ID NO: 214852 - DNA, 20 bp, Artificial Sequence
  Description of Artificial Sequence: Synthetic oligonucleotide
  Target: ATXN1; (-) strand; PAM type: YTN; PAM sequence: TTT
gtctgtataaaaggtttcat

SEQ ID NO: 214853 - DNA, 20 bp, Artificial Sequence
  Description of Artificial Sequence: Synthetic oligonucleotide
  Target: ATXN1; (-) strand; PAM type: YTN; PAM sequence: CTG
aggaatcaaatatttgtctg

SEQ ID NO: 214854 - DNA, 20 bp, Artificial Sequence
  Description of Artificial Sequence: Synthetic oligonucleotide
  Target: ATXN1; (-) strand; PAM type: YTN; PAM sequence: CTG
ggaagaaaagatcccaagaa

SEQ ID NO: 214855 - DNA, 20 bp, Artificial Sequence
  Description of Artificial Sequence: Synthetic oligonucleotide
  Target: ATXN1; (-) strand; PAM type: YTN; PAM sequence: CTA
tgacctgggaagaaaagatc

SEQ ID NO: 214856 - DNA, 20 bp, Artificial Sequence
  Description of Artificial Sequence: Synthetic oligonucleotide
  Target: ATXN1; (-) strand; PAM type: YTN; PAM sequence: CTG
ctatgacctgggaagaaaag

SEQ ID NO: 214857 - DNA, 20 bp, Artificial Sequence
  Description of Artificial Sequence: Synthetic oligonucleotide
  Target: ATXN1; (-) strand; PAM type: YTN; PAM sequence: TTG
aaacagcactgctatgacct

SEQ ID NO: 214858 - DNA, 20 bp, Artificial Sequence
  Description of Artificial Sequence: Synthetic oligonucleotide
  Target: ATXN1; (-) strand; PAM type: YTN; PAM sequence: CTG
ttgaaacagcactgctatga

SEQ ID NO: 214859 - DNA, 20 bp, Artificial Sequence
  Description of Artificial Sequence: Synthetic oligonucleotide
  Target: ATXN1; (-) strand; PAM type: YTN; PAM sequence: TTC
ctgttgaaacagcactgcta

SEQ ID NO: 214860 - DNA, 20 bp, Artificial Sequence
  Description of Artificial Sequence: Synthetic oligonucleotide
  Target: ATXN1; (-) strand; PAM type: YTN; PAM sequence: TTT
cctgttgaaacagcactgct

SEQ ID NO: 214861 - DNA, 20 bp, Artificial Sequence
  Description of Artificial Sequence: Synthetic oligonucleotide
  Target: ATXN1; (-) strand; PAM type: YTN; PAM sequence: CTA
tgacatttcctgttgaaaca

SEQ ID NO: 214862 - DNA, 20 bp, Artificial Sequence
  Description of Artificial Sequence: Synthetic oligonucleotide
  Target: ATXN1; (-) strand; PAM type: YTN; PAM sequence: TTC
aagctatgacatttcctgtt

SEQ ID NO: 214863 - DNA, 20 bp, Artificial Sequence
  Description of Artificial Sequence: Synthetic oligonucleotide
  Target: ATXN1; (-) strand; PAM type: YTN; PAM sequence: CTG
gcattcaagctatgacattt

SEQ ID NO: 214864 - DNA, 20 bp, Artificial Sequence
  Description of Artificial Sequence: Synthetic oligonucleotide
  Target: ATXN1; (-) strand; PAM type: YTN; PAM sequence: TTA
aagtgcacctggcattcaag

SEQ ID NO: 214865 - DNA, 20 bp, Artificial Sequence
  Description of Artificial Sequence: Synthetic oligonucleotide
  Target: ATXN1; (-) strand; PAM type: YTN; PAM sequence: TTT
aaagtgcacctggcattcaa

SEQ ID NO: 214866 - DNA, 20 bp, Artificial Sequence
  Description of Artificial Sequence: Synthetic oligonucleotide
  Target: ATXN1; (-) strand; PAM type: YTN; PAM sequence: TTT
taaagtgcacctggcattca

SEQ ID NO: 214867 - DNA, 20 bp, Artificial Sequence
  Description of Artificial Sequence: Synthetic oligonucleotide
  Target: ATXN1; (-) strand; PAM type: YTN; PAM sequence: TTT
ttaaagtgcacctggcattc

SEQ ID NO: 214868 - DNA, 20 bp, Artificial Sequence
  Description of Artificial Sequence: Synthetic oligonucleotide
  Target: ATXN1; (-) strand; PAM type: YTN; PAM sequence: TTT
tttaaagtgcacctggcatt

SEQ ID NO: 214869 - DNA, 20 bp, Artificial Sequence
  Description of Artificial Sequence: Synthetic oligonucleotide
  Target: ATXN1; (-) strand; PAM type: YTN; PAM sequence: TTA
ttttttaaagtgcacctggc

SEQ ID NO: 214870 - DNA, 20 bp, Artificial Sequence
  Description of Artificial Sequence: Synthetic oligonucleotide
  Target: ATXN1; (-) strand; PAM type: YTN; PAM sequence: TTA
gattattttttaaagtgcac

SEQ ID NO: 214871 - DNA, 20 bp, Artificial Sequence
  Description of Artificial Sequence: Synthetic oligonucleotide
  Target: ATXN1; (-) strand; PAM type: YTN; PAM sequence: TTT
agattattttttaaagtgca

SEQ ID NO: 214872 - DNA, 20 bp, Artificial Sequence
  Description of Artificial Sequence: Synthetic oligonucleotide
  Target: ATXN1; (-) strand; PAM type: YTN; PAM sequence: TTA
gtttagattattttttaaag

SEQ ID NO: 214873 - DNA, 20 bp, Artificial Sequence
  Description of Artificial Sequence: Synthetic oligonucleotide
  Target: ATXN1; (-) strand; PAM type: YTN; PAM sequence: TTT
agtttagattattttttaaa

SEQ ID NO: 214874 - DNA, 20 bp, Artificial Sequence
  Description of Artificial Sequence: Synthetic oligonucleotide
  Target: ATXN1; (-) strand; PAM type: YTN; PAM sequence: CTA
atttagtttagattattttt

SEQ ID NO: 214875 - DNA, 20 bp, Artificial Sequence
  Description of Artificial Sequence: Synthetic oligonucleotide
  Target: ATXN1; (-) strand; PAM type: YTN; PAM sequence: TTA
ggtgtaaaagctaatttagt

SEQ ID NO: 214876 - DNA, 20 bp, Artificial Sequence
  Description of Artificial Sequence: Synthetic oligonucleotide
  Target: ATXN1; (-) strand; PAM type: YTN; PAM sequence: TTC
ccaggccgtcgttaggtgta

SEQ ID NO: 214877 - DNA, 20 bp, Artificial Sequence
  Description of Artificial Sequence: Synthetic oligonucleotide
  Target: ATXN1; (-) strand; PAM type: YTN; PAM sequence: TTA
ttcccaggccgtcgttaggt

SEQ ID NO: 214878 - DNA, 20 bp, Artificial Sequence
  Description of Artificial Sequence: Synthetic oligonucleotide
  Target: ATXN1; (-) strand; PAM type: YTN; PAM sequence: TTA
ttattcccaggccgtcgtta

SEQ ID NO: 214879 - DNA, 20 bp, Artificial Sequence
  Description of Artificial Sequence: Synthetic oligonucleotide
  Target: ATXN1; (-) strand; PAM type: YTN; PAM sequence: TTT
attattcccaggccgtcgtt

SEQ ID NO: 214880 - DNA, 20 bp, Artificial Sequence
  Description of Artificial Sequence: Synthetic oligonucleotide
  Target: ATXN1; (-) strand; PAM type: YTN; PAM sequence: CTT
tattattcccaggccgtcgt

SEQ ID NO: 214881 - DNA, 20 bp, Artificial Sequence
  Description of Artificial Sequence: Synthetic oligonucleotide
  Target: ATXN1; (-) strand; PAM type: YTN; PAM sequence: TTC
ctttattattcccaggccgt

SEQ ID NO: 214882 - DNA, 20 bp, Artificial Sequence
  Description of Artificial Sequence: Synthetic oligonucleotide
  Target: ATXN1; (-) strand; PAM type: YTN; PAM sequence: TTC
aaagagttcctttattattc

SEQ ID NO: 214883 - DNA, 20 bp, Artificial Sequence
  Description of Artificial Sequence: Synthetic oligonucleotide
  Target: ATXN1; (-) strand; PAM type: YTN; PAM sequence: TTT
caaagagttcctttattatt

SEQ ID NO: 214884 - DNA, 20 bp, Artificial Sequence
  Description of Artificial Sequence: Synthetic oligonucleotide
  Target: ATXN1; (-) strand; PAM type: YTN; PAM sequence: TTT
tcaaagagttcctttattat

SEQ ID NO: 214885 - DNA, 20 bp, Artificial Sequence
  Description of Artificial Sequence: Synthetic oligonucleotide
  Target: ATXN1; (-) strand; PAM type: YTN; PAM sequence: TTT
ttcaaagagttcctttatta

SEQ ID NO: 214886 - DNA, 20 bp, Artificial Sequence
  Description of Artificial Sequence: Synthetic oligonucleotide
  Target: ATXN1; (-) strand; PAM type: YTN; PAM sequence: CTT
tttcaaagagttcctttatt

SEQ ID NO: 214887 - DNA, 20 bp, Artificial Sequence
  Description of Artificial Sequence: Synthetic oligonucleotide
  Target: ATXN1; (-) strand; PAM type: YTN; PAM sequence: TTC
ctttttcaaagagttccttt

SEQ ID NO: 214888 - DNA, 20 bp, Artificial Sequence
  Description of Artificial Sequence: Synthetic oligonucleotide
  Target: ATXN1; (-) strand; PAM type: YTN; PAM sequence: CTT
cctttttcaaagagttcctt

SEQ ID NO: 214889 - DNA, 20 bp, Artificial Sequence
  Description of Artificial Sequence: Synthetic oligonucleotide
  Target: ATXN1; (-) strand; PAM type: YTN; PAM sequence: TTC
ttcctttttcaaagagttcc

SEQ ID NO: 214890 - DNA, 20 bp, Artificial Sequence
  Description of Artificial Sequence: Synthetic oligonucleotide
  Target: ATXN1; (-) strand; PAM type: YTN; PAM sequence: TTT
cttcctttttcaaagagttc

SEQ ID NO: 214891 - DNA, 20 bp, Artificial Sequence
  Description of Artificial Sequence: Synthetic oligonucleotide
  Target: ATXN1; (-) strand; PAM type: YTN; PAM sequence: CTT
tcttcctttttcaaagagtt

SEQ ID NO: 214892 - DNA, 20 bp, Artificial Sequence
  Description of Artificial Sequence: Synthetic oligonucleotide
  Target: ATXN1; (-) strand; PAM type: YTN; PAM sequence: CTC
cactttcttcctttttcaaa

SEQ ID NO: 214893 - DNA, 20 bp, Artificial Sequence
  Description of Artificial Sequence: Synthetic oligonucleotide
  Target: ATXN1; (-) strand; PAM type: YTN; PAM sequence: TTC
tccactttcttcctttttca

SEQ ID NO: 214894 - DNA, 20 bp, Artificial Sequence
  Description of Artificial Sequence: Synthetic oligonucleotide
  Target: ATXN1; (-) strand; PAM type: YTN; PAM sequence: TTT
ctccactttcttcctttttc

SEQ ID NO: 214895 - DNA, 20 bp, Artificial Sequence
  Description of Artificial Sequence: Synthetic oligonucleotide
  Target: ATXN1; (-) strand; PAM type: YTN; PAM sequence: CTA
tttctccactttcttccttt

SEQ ID NO: 214896 - DNA, 20 bp, Artificial Sequence
  Description of Artificial Sequence: Synthetic oligonucleotide
  Target: ATXN1; (-) strand; PAM type: YTN; PAM sequence: TTC
ctatttctccactttcttcc

SEQ ID NO: 214897 - DNA, 20 bp, Artificial Sequence
  Description of Artificial Sequence: Synthetic oligonucleotide
  Target: ATXN1; (-) strand; PAM type: YTN; PAM sequence: TTG
caggcccaccaacagtgtaa

SEQ ID NO: 214898 - DNA, 20 bp, Artificial Sequence
  Description of Artificial Sequence: Synthetic oligonucleotide
  Target: ATXN1; (-) strand; PAM type: YTN; PAM sequence: TTT
gcaggcccaccaacagtgta

SEQ ID NO: 214899 - DNA, 20 bp, Artificial Sequence
  Description of Artificial Sequence: Synthetic oligonucleotide
  Target: ATXN1; (-) strand; PAM type: YTN; PAM sequence: CTA
gtttgcaggcccaccaacag

SEQ ID NO: 214900 - DNA, 20 bp, Artificial Sequence
  Description of Artificial Sequence: Synthetic oligonucleotide
  Target: ATXN1; (-) strand; PAM type: YTN; PAM sequence: TTG
aactagtttgcaggcccacc

SEQ ID NO: 214901 - DNA, 20 bp, Artificial Sequence
  Description of Artificial Sequence: Synthetic oligonucleotide
  Target: ATXN1; (-) strand; PAM type: YTN; PAM sequence: TTC
cacaatggttgaactagttt

SEQ ID NO: 214902 - DNA, 20 bp, Artificial Sequence
  Description of Artificial Sequence: Synthetic oligonucleotide
  Target: ATXN1; (-) strand; PAM type: YTN; PAM sequence: CTT
ccacaatggttgaactagtt

SEQ ID NO: 214903 - DNA, 20 bp, Artificial Sequence
  Description of Artificial Sequence: Synthetic oligonucleotide
  Target: ATXN1; (-) strand; PAM type: YTN; PAM sequence: CTG
tcttccacaatggttgaact

SEQ ID NO: 214904 - DNA, 20 bp, Artificial Sequence
  Description of Artificial Sequence: Synthetic oligonucleotide
  Target: ATXN1; (-) strand; PAM type: YTN; PAM sequence: TTG
aggaatcgccacactgtctt

SEQ ID NO: 214905 - DNA, 20 bp, Artificial Sequence
  Description of Artificial Sequence: Synthetic oligonucleotide
  Target: ATXN1; (-) strand; PAM type: YTN; PAM sequence: CTT
gaggaatcgccacactgtct

SEQ ID NO: 214906 - DNA, 20 bp, Artificial Sequence
  Description of Artificial Sequence: Synthetic oligonucleotide
  Target: ATXN1; (-) strand; PAM type: YTN; PAM sequence: CTA
gatccttgaggaatcgccac

SEQ ID NO: 214907 - DNA, 20 bp, Artificial Sequence
  Description of Artificial Sequence: Synthetic oligonucleotide
  Target: ATXN1; (-) strand; PAM type: YTN; PAM sequence: TTC
tagatccttgaggaatcgcc

SEQ ID NO: 214908 - DNA, 20 bp, Artificial Sequence
  Description of Artificial Sequence: Synthetic oligonucleotide
  Target: ATXN1; (-) strand; PAM type: YTN; PAM sequence: CTA
gttctagatccttgaggaat

SEQ ID NO: 214909 - DNA, 20 bp, Artificial Sequence
  Description of Artificial Sequence: Synthetic oligonucleotide
  Target: ATXN1; (-) strand; PAM type: YTN; PAM sequence: TTC
tagttctagatccttgagga

SEQ ID NO: 214910 - DNA, 20 bp, Artificial Sequence
  Description of Artificial Sequence: Synthetic oligonucleotide
  Target: ATXN1; (-) strand; PAM type: YTN; PAM sequence: TTT
ctagttctagatccttgagg

SEQ ID NO: 214911 - DNA, 20 bp, Artificial Sequence
  Description of Artificial Sequence: Synthetic oligonucleotide
  Target: ATXN1; (-) strand; PAM type: YTN; PAM sequence: CTG
ggtcaaatggtatttctagt

SEQ ID NO: 214912 - DNA, 20 bp, Artificial Sequence
  Description of Artificial Sequence: Synthetic oligonucleotide
  Target: ATXN1; (-) strand; PAM type: YTN; PAM sequence: TTG
ggtatatccccagtaatggg

SEQ ID NO: 214913 - DNA, 20 bp, Artificial Sequence
  Description of Artificial Sequence: Synthetic oligonucleotide
  Target: ATXN1; (-) strand; PAM type: YTN; PAM sequence: TTT
gggtatatccccagtaatgg

SEQ ID NO: 214914 - DNA, 20 bp, Artificial Sequence
  Description of Artificial Sequence: Synthetic oligonucleotide
  Target: ATXN1; (-) strand; PAM type: YTN; PAM sequence: CTT
tgggtatatccccagtaatg

SEQ ID NO: 214915 - DNA, 20 bp, Artificial Sequence
  Description of Artificial Sequence: Synthetic oligonucleotide
  Target: ATXN1; (-) strand; PAM type: YTN; PAM sequence: TTA
taatcctttgggtatatccc

SEQ ID NO: 214916 - DNA, 20 bp, Artificial Sequence
  Description of Artificial Sequence: Synthetic oligonucleotide
  Target: ATXN1; (-) strand; PAM type: YTN; PAM sequence: TTT
ataatcctttgggtatatcc

SEQ ID NO: 214917 - DNA, 20 bp, Artificial Sequence
  Description of Artificial Sequence: Synthetic oligonucleotide
  Target: ATXN1; (-) strand; PAM type: YTN; PAM sequence: TTA
tagcagcatgatttataatc

SEQ ID NO: 214918 - DNA, 20 bp, Artificial Sequence
  Description of Artificial Sequence: Synthetic oligonucleotide
  Target: ATXN1; (-) strand; PAM type: YTN; PAM sequence: TTT
atagcagcatgatttataat

SEQ ID NO: 214919 - DNA, 20 bp, Artificial Sequence
  Description of Artificial Sequence: Synthetic oligonucleotide
  Target: ATXN1; (-) strand; PAM type: YTN; PAM sequence: CTT
tatagcagcatgatttataa

SEQ ID NO: 214920 - DNA, 20 bp, Artificial Sequence
  Description of Artificial Sequence: Synthetic oligonucleotide
  Target: ATXN1; (-) strand; PAM type: YTN; PAM sequence: TTG
tgaatagtgccgcaataaac

SEQ ID NO: 214921 - DNA, 20 bp, Artificial Sequence
  Description of Artificial Sequence: Synthetic oligonucleotide
  Target: ATXN1; (-) strand; PAM type: YTN; PAM sequence: CTA
ttgtgaatagtgccgcaata

SEQ ID NO: 214922 - DNA, 20 bp, Artificial Sequence
  Description of Artificial Sequence: Synthetic oligonucleotide
  Target: ATXN1; (-) strand; PAM type: YTN; PAM sequence: TTG
ctattgtgaatagtgccgca

SEQ ID NO: 214923 - DNA, 20 bp, Artificial Sequence
  Description of Artificial Sequence: Synthetic oligonucleotide
  Target: ATXN1; (-) strand; PAM type: YTN; PAM sequence: TTT
gctattgtgaatagtgccgc

SEQ ID NO: 214924 - DNA, 20 bp, Artificial Sequence
  Description of Artificial Sequence: Synthetic oligonucleotide
  Target: ATXN1; (-) strand; PAM type: YTN; PAM sequence: CTT
tgctattgtgaatagtgccg

SEQ ID NO: 214925 - DNA, 20 bp, Artificial Sequence
  Description of Artificial Sequence: Synthetic oligonucleotide
  Target: ATXN1; (-) strand; PAM type: YTN; PAM sequence: TTC
caagtctttgctattgtgaa

SEQ ID NO: 214926 - DNA, 20 bp, Artificial Sequence
  Description of Artificial Sequence: Synthetic oligonucleotide
  Target: ATXN1; (-) strand; PAM type: YTN; PAM sequence: TTG
gttccaagtctttgctattg

SEQ ID NO: 214927 - DNA, 20 bp, Artificial Sequence
  Description of Artificial Sequence: Synthetic oligonucleotide
  Target: ATXN1; (-) strand; PAM type: YTN; PAM sequence: TTG
ggttggttccaagtctttgc

SEQ ID NO: 214928 - DNA, 20 bp, Artificial Sequence
  Description of Artificial Sequence: Synthetic oligonucleotide
  Target: ATXN1; (-) strand; PAM type: YTN; PAM sequence: TTT
gggttggttccaagtctttg

SEQ ID NO: 214929 - DNA, 20 bp, Artificial Sequence
  Description of Artificial Sequence: Synthetic oligonucleotide
  Target: ATXN1; (-) strand; PAM type: YTN; PAM sequence: TTG
atggacatttgggttggttc

SEQ ID NO: 214930 - DNA, 20 bp, Artificial Sequence
  Description of Artificial Sequence: Synthetic oligonucleotide
  Target: ATXN1; (-) strand; PAM type: YTN; PAM sequence: CTA
tcattgatggacatttgggt

SEQ ID NO: 214931 - DNA, 20 bp, Artificial Sequence
  Description of Artificial Sequence: Synthetic oligonucleotide
  Target: ATXN1; (-) strand; PAM type: YTN; PAM sequence: TTA
atccagtctatcattgatgg

SEQ ID NO: 214932 - DNA, 20 bp, Artificial Sequence
  Description of Artificial Sequence: Synthetic oligonucleotide
  Target: ATXN1; (-) strand; PAM type: YTN; PAM sequence: CTT
aatccagtctatcattgatg

SEQ ID NO: 214933 - DNA, 20 bp, Artificial Sequence
  Description of Artificial Sequence: Synthetic oligonucleotide
  Target: ATXN1; (-) strand; PAM type: YTN; PAM sequence: TTC
ttaatccagtctatcattga

SEQ ID NO: 214934 - DNA, 20 bp, Artificial Sequence
  Description of Artificial Sequence: Synthetic oligonucleotide
  Target: ATXN1; (-) strand; PAM type: YTN; PAM sequence: TTT
cttaatccagtctatcattg

SEQ ID NO: 214935 - DNA, 20 bp, Artificial Sequence
  Description of Artificial Sequence: Synthetic oligonucleotide
  Target: ATXN1; (-) strand; PAM type: YTN; PAM sequence: TTT
tcttaatccagtctatcatt

SEQ ID NO: 214936 - DNA, 20 bp, Artificial Sequence
  Description of Artificial Sequence: Synthetic oligonucleotide
  Target: ATXN1; (-) strand; PAM type: YTN; PAM sequence: TTC
catggtgtatatgtgccaca

SEQ ID NO: 214937 - DNA, 20 bp, Artificial Sequence
  Description of Artificial Sequence: Synthetic oligonucleotide
  Target: ATXN1; (-) strand; PAM type: YTN; PAM sequence: CTA
catagtattccatggtgtat

SEQ ID NO: 214938 - DNA, 20 bp, Artificial Sequence
  Description of Artificial Sequence: Synthetic oligonucleotide
  Target: ATXN1; (-) strand; PAM type: YTN; PAM sequence: TTA
tggctacatagtattccatg

SEQ ID NO: 214939 - DNA, 20 bp, Artificial Sequence
  Description of Artificial Sequence: Synthetic oligonucleotide
  Target: ATXN1; (-) strand; PAM type: YTN; PAM sequence: TTT
atggctacatagtattccat

SEQ ID NO: 214940 - DNA, 20 bp, Artificial Sequence
  Description of Artificial Sequence: Synthetic oligonucleotide
  Target: ATXN1; (-) strand; PAM type: YTN; PAM sequence: TTT
tatggctacatagtattcca

SEQ ID NO: 214941 - DNA, 20 bp, Artificial Sequence
  Description of Artificial Sequence: Synthetic oligonucleotide
  Target: ATXN1; (-) strand; PAM type: YTN; PAM sequence: TTT
ttatggctacatagtattcc

SEQ ID NO: 214942 - DNA, 20 bp, Artificial Sequence
  Description of Artificial Sequence: Synthetic oligonucleotide
  Target: ATXN1; (-) strand; PAM type: YTN; PAM sequence: TTT
tttatggctacatagtattc

SEQ ID NO: 214943 - DNA, 20 bp, Artificial Sequence
  Description of Artificial Sequence: Synthetic oligonucleotide
  Target: ATXN1; (-) strand; PAM type: YTN; PAM sequence: CTT
ttttatggctacatagtatt

SEQ ID NO: 214944 - DNA, 20 bp, Artificial Sequence
  Description of Artificial Sequence: Synthetic oligonucleotide
  Target: ATXN1; (-) strand; PAM type: YTN; PAM sequence: CTC
atccttttttatggctacat

SEQ ID NO: 214945 - DNA, 20 bp, Artificial Sequence
  Description of Artificial Sequence: Synthetic oligonucleotide
  Target: ATXN1; (-) strand; PAM type: YTN; PAM sequence: TTC
atccatgtcccaacaaagga

SEQ ID NO: 214946 - DNA, 20 bp, Artificial Sequence
  Description of Artificial Sequence: Synthetic oligonucleotide
  Target: ATXN1; (-) strand; PAM type: YTN; PAM sequence: CTT
catccatgtcccaacaaagg

SEQ ID NO: 214947 - DNA, 20 bp, Artificial Sequence
  Description of Artificial Sequence: Synthetic oligonucleotide
  Target: ATXN1; (-) strand; PAM type: YTN; PAM sequence: TTC
cagcttcatccatgtcccaa

SEQ ID NO: 214948 - DNA, 20 bp, Artificial Sequence
  Description of Artificial Sequence: Synthetic oligonucleotide
  Target: ATXN1; (-) strand; PAM type: YTN; PAM sequence: TTT
ccagcttcatccatgtccca

SEQ ID NO: 214949 - DNA, 20 bp, Artificial Sequence
  Description of Artificial Sequence: Synthetic oligonucleotide
  Target: ATXN1; (-) strand; PAM type: YTN; PAM sequence: CTG
agaatgatggtttccagctt

SEQ ID NO: 214950 - DNA, 20 bp, Artificial Sequence
  Description of Artificial Sequence: Synthetic oligonucleotide
  Target: ATXN1; (-) strand; PAM type: YTN; PAM sequence: TTG
ctgagaatgatggtttccag

SEQ ID NO: 214951 - DNA, 20 bp, Artificial Sequence
  Description of Artificial Sequence: Synthetic oligonucleotide
  Target: ATXN1; (-) strand; PAM type: YTN; PAM sequence: TTT
gctgagaatgatggtttcca

SEQ ID NO: 214952 - DNA, 20 bp, Artificial Sequence
  Description of Artificial Sequence: Synthetic oligonucleotide
  Target: ATXN1; (-) strand; PAM type: YTN; PAM sequence: TTG
cgataatttgctgagaatga

SEQ ID NO: 214953 - DNA, 20 bp, Artificial Sequence
  Description of Artificial Sequence: Synthetic oligonucleotide
  Target: ATXN1; (-) strand; PAM type: YTN; PAM sequence: CTT
gcgataatttgctgagaatg

SEQ ID NO: 214954 - DNA, 20 bp, Artificial Sequence
  Description of Artificial Sequence: Synthetic oligonucleotide
  Target: ATXN1; (-) strand; PAM type: YTN; PAM sequence: TTG
tccttgcgataatttgctga

SEQ ID NO: 214955 - DNA, 20 bp, Artificial Sequence
  Description of Artificial Sequence: Synthetic oligonucleotide
  Target: ATXN1; (-) strand; PAM type: YTN; PAM sequence: TTT
gtccttgcgataatttgctg

SEQ ID NO: 214956 - DNA, 20 bp, Artificial Sequence
  Description of Artificial Sequence: Synthetic oligonucleotide
  Target: ATXN1; (-) strand; PAM type: YTN; PAM sequence: TTT
tgtccttgcgataatttgct

SEQ ID NO: 214957 - DNA, 20 bp, Artificial Sequence
  Description of Artificial Sequence: Synthetic oligonucleotide
  Target: ATXN1; (-) strand; PAM type: YTN; PAM sequence: TTT
ttgtccttgcgataatttgc

SEQ ID NO: 214958 - DNA, 20 bp, Artificial Sequence
  Description of Artificial Sequence: Synthetic oligonucleotide
  Target: ATXN1; (-) strand; PAM type: YTN; PAM sequence: TTT
tttgtccttgcgataatttg

SEQ ID NO: 214959 - DNA, 20 bp, Artificial Sequence
  Description of Artificial Sequence: Synthetic oligonucleotide
  Target: ATXN1; (-) strand; PAM type: YTN; PAM sequence: TTG
gttttttgtccttgcgataa

SEQ ID NO: 214960 - DNA, 20 bp, Artificial Sequence
  Description of Artificial Sequence: Synthetic oligonucleotide
  Target: ATXN1; (-) strand; PAM type: YTN; PAM sequence: TTT
ggttttttgtccttgcgata

SEQ ID NO: 214961 - DNA, 20 bp, Artificial Sequence
  Description of Artificial Sequence: Synthetic oligonucleotide
  Target: ATXN1; (-) strand; PAM type: YTN; PAM sequence: CTA
tgagtgagaacatgcggtgt

SEQ ID NO: 214962 - DNA, 20 bp, Artificial Sequence
  Description of Artificial Sequence: Synthetic oligonucleotide
  Target: ATXN1; (-) strand; PAM type: YTN; PAM sequence: TTC
ccacctatgagtgagaacat

SEQ ID NO: 214963 - DNA, 20 bp, Artificial Sequence
  Description of Artificial Sequence: Synthetic oligonucleotide
  Target: ATXN1; (-) strand; PAM type: YTN; PAM sequence: TTC
aattcccacctatgagtgag

SEQ ID NO: 214964 - DNA, 20 bp, Artificial Sequence
  Description of Artificial Sequence: Synthetic oligonucleotide
  Target: ATXN1; (-) strand; PAM type: YTN; PAM sequence: TTG
ttcaattcccacctatgagt

SEQ ID NO: 214965 - DNA, 20 bp, Artificial Sequence
  Description of Artificial Sequence: Synthetic oligonucleotide
  Target: ATXN1; (-) strand; PAM type: YTN; PAM sequence: CTC
attgttcaattcccacctat

SEQ ID NO: 214966 - DNA, 20 bp, Artificial Sequence
  Description of Artificial Sequence: Synthetic oligonucleotide
  Target: ATXN1; (-) strand; PAM type: YTN; PAM sequence: TTC
tcattgttcaattcccacct

SEQ ID NO: 214967 - DNA, 20 bp, Artificial Sequence
  Description of Artificial Sequence: Synthetic oligonucleotide
  Target: ATXN1; (-) strand; PAM type: YTN; PAM sequence: CTG
tgaccaagtgttctcattgt

SEQ ID NO: 214968 - DNA, 20 bp, Artificial Sequence
  Description of Artificial Sequence: Synthetic oligonucleotide
  Target: ATXN1; (-) strand; PAM type: YTN; PAM sequence: TTC
ctgtgaccaagtgttctcat

SEQ ID NO: 214969 - DNA, 20 bp, Artificial Sequence
  Description of Artificial Sequence: Synthetic oligonucleotide
  Target: ATXN1; (-) strand; PAM type: YTN; PAM sequence: CTT
cctgtgaccaagtgttctca

SEQ ID NO: 214970 - DNA, 20 bp, Artificial Sequence
  Description of Artificial Sequence: Synthetic oligonucleotide
  Target: ATXN1; (-) strand; PAM type: YTN; PAM sequence: TTC
cccttcctgtgaccaagtgt

SEQ ID NO: 214971 - DNA, 20 bp, Artificial Sequence
  Description of Artificial Sequence: Synthetic oligonucleotide
  Target: ATXN1; (-) strand; PAM type: YTN; PAM sequence: CTC
catgacaggccccggtgtgc

SEQ ID NO: 214972 - DNA, 20 bp, Artificial Sequence
  Description of Artificial Sequence: Synthetic oligonucleotide
  Target: ATXN1; (-) strand; PAM type: YTN; PAM sequence: CTC
cccccactccatgacaggcc

SEQ ID NO: 214973 - DNA, 20 bp, Artificial Sequence
  Description of Artificial Sequence: Synthetic oligonucleotide
  Target: ATXN1; (-) strand; PAM type: YTN; PAM sequence: CTC
ccccctccccccactccatg

SEQ ID NO: 214974 - DNA, 20 bp, Artificial Sequence
  Description of Artificial Sequence: Synthetic oligonucleotide
  Target: ATXN1; (-) strand; PAM type: YTN; PAM sequence: TTC
cctcccccctccccccactc

SEQ ID NO: 214975 - DNA, 20 bp, Artificial Sequence
  Description of Artificial Sequence: Synthetic oligonucleotide
  Target: ATXN1; (-) strand; PAM type: YTN; PAM sequence: TTT
ccctcccccctccccccact

SEQ ID NO: 214976 - DNA, 20 bp, Artificial Sequence
  Description of Artificial Sequence: Synthetic oligonucleotide
  Target: ATXN1; (-) strand; PAM type: YTN; PAM sequence: CTT
tccctcccccctccccccac

SEQ ID NO: 214977 - DNA, 20 bp, Artificial Sequence
  Description of Artificial Sequence: Synthetic oligonucleotide
  Target: ATXN1; (-) strand; PAM type: YTN; PAM sequence: CTA
aagctttccctcccccctcc

SEQ ID NO: 214978 - DNA, 20 bp, Artificial Sequence
  Description of Artificial Sequence: Synthetic oligonucleotide
  Target: ATXN1; (-) strand; PAM type: YTN; PAM sequence: CTC
ctaaagctttccctcccccc

SEQ ID NO: 214979 - DNA, 20 bp, Artificial Sequence
  Description of Artificial Sequence: Synthetic oligonucleotide
  Target: ATXN1; (-) strand; PAM type: YTN; PAM sequence: TTA
ggtatatctcctaaagcttt

SEQ ID NO: 214980 - DNA, 20 bp, Artificial Sequence
  Description of Artificial Sequence: Synthetic oligonucleotide
  Target: ATXN1; (-) strand; PAM type: YTN; PAM sequence: TTA
cattaggtatatctcctaaa

SEQ ID NO: 214981 - DNA, 20 bp, Artificial Sequence
  Description of Artificial Sequence: Synthetic oligonucleotide
  Target: ATXN1; (-) strand; PAM type: YTN; PAM sequence: TTT
acattaggtatatctcctaa

SEQ ID NO: 214982 - DNA, 20 bp, Artificial Sequence
  Description of Artificial Sequence: Synthetic oligonucleotide
  Target: ATXN1; (-) strand; PAM type: YTN; PAM sequence: CTC
atcatttacattaggtatat

SEQ ID NO: 214983 - DNA, 20 bp, Artificial Sequence
  Description of Artificial Sequence: Synthetic oligonucleotide
  Target: ATXN1; (-) strand; PAM type: YTN; PAM sequence: TTA
actcatcatttacattaggt

SEQ ID NO: 214984 - DNA, 20 bp, Artificial Sequence
  Description of Artificial Sequence: Synthetic oligonucleotide
  Target: ATXN1; (-) strand; PAM type: YTN; PAM sequence: CTG
cacccattaactcatcattt

SEQ ID NO: 214985 - DNA, 20 bp, Artificial Sequence
  Description of Artificial Sequence: Synthetic oligonucleotide
  Target: ATXN1; (-) strand; PAM type: YTN; PAM sequence: TTG
gtgtgctgcacccattaact

SEQ ID NO: 214986 - DNA, 20 bp, Artificial Sequence
  Description of Artificial Sequence: Synthetic oligonucleotide
  Target: ATXN1; (-) strand; PAM type: YTN; PAM sequence: TTA
catatgtatacatgtatcat

SEQ ID NO: 214987 - DNA, 20 bp, Artificial Sequence
  Description of Artificial Sequence: Synthetic oligonucleotide
  Target: ATXN1; (-) strand; PAM type: YTN; PAM sequence: TTG
ttacatatgtatacatgtat

SEQ ID NO: 214988 - DNA, 20 bp, Artificial Sequence
  Description of Artificial Sequence: Synthetic oligonucleotide
  Target: ATXN1; (-) strand; PAM type: YTN; PAM sequence: TTT
gttacatatgtatacatgta

SEQ ID NO: 214989 - DNA, 20 bp, Artificial Sequence
  Description of Artificial Sequence: Synthetic oligonucleotide
  Target: ATXN1; (-) strand; PAM type: YTN; PAM sequence: CTA
gggtacatgtgcacaatgtg

SEQ ID NO: 214990 - DNA, 20 bp, Artificial Sequence
  Description of Artificial Sequence: Synthetic oligonucleotide
  Target: ATXN1; (-) strand; PAM type: YTN; PAM sequence: TTC
tagggtacatgtgcacaatg

SEQ ID NO: 214991 - DNA, 20 bp, Artificial Sequence
  Description of Artificial Sequence: Synthetic oligonucleotide
  Target: ATXN1; (-) strand; PAM type: YTN; PAM sequence: TTA
agttctagggtacatgtgca

SEQ ID NO: 214992 - DNA, 20 bp, Artificial Sequence
  Description of Artificial Sequence: Synthetic oligonucleotide
  Target: ATXN1; (-) strand; PAM type: YTN; PAM sequence: TTT
aagttctagggtacatgtgc

SEQ ID NO: 214993 - DNA, 20 bp, Artificial Sequence
  Description of Artificial Sequence: Synthetic oligonucleotide
  Target: ATXN1; (-) strand; PAM type: YTN; PAM sequence: CTT
taagttctagggtacatgtg

SEQ ID NO: 214994 - DNA, 20 bp, Artificial Sequence
  Description of Artificial Sequence: Synthetic oligonucleotide
  Target: ATXN1; (-) strand; PAM type: YTN; PAM sequence: TTA
tactttaagttctagggtac

SEQ ID NO: 214995 - DNA, 20 bp, Artificial Sequence
  Description of Artificial Sequence: Synthetic oligonucleotide
  Target: ATXN1; (-) strand; PAM type: YTN; PAM sequence: TTA
ttatactttaagttctaggg

SEQ ID NO: 214996 - DNA, 20 bp, Artificial Sequence
  Description of Artificial Sequence: Synthetic oligonucleotide
  Target: ATXN1; (-) strand; PAM type: YTN; PAM sequence: TTT
attatactttaagttctagg

SEQ ID NO: 214997 - DNA, 20 bp, Artificial Sequence
  Description of Artificial Sequence: Synthetic oligonucleotide
  Target: ATXN1; (-) strand; PAM type: YTN; PAM sequence: TTT
tattatactttaagttctag

SEQ ID NO: 214998 - DNA, 20 bp, Artificial Sequence
  Description of Artificial Sequence: Synthetic oligonucleotide
  Target: ATXN1; (-) strand; PAM type: YTN; PAM sequence: TTT
ttattatactttaagttcta

SEQ ID NO: 214999 - DNA, 20 bp, Artificial Sequence
  Description of Artificial Sequence: Synthetic oligonucleotide
  Target: ATXN1; (-) strand; PAM type: YTN; PAM sequence: TTT
tttattatactttaagttct

SEQ ID NO: 215000 - DNA, 20 bp, Artificial Sequence
  Description of Artificial Sequence: Synthetic oligonucleotide
  Target: ATXN1; (-) strand; PAM type: YTN; PAM sequence: TTA
ttttttattatactttaagt

SEQ ID NO: 215001 - DNA, 20 bp, Artificial Sequence
  Description of Artificial Sequence: Synthetic oligonucleotide
  Target: ATXN1; (-) strand; PAM type: YTN; PAM sequence: TTT
attttttattatactttaag

SEQ ID NO: 215002 - DNA, 20 bp, Artificial Sequence
  Description of Artificial Sequence: Synthetic oligonucleotide
  Target: ATXN1; (-) strand; PAM type: YTN; PAM sequence: TTA
tttattttttattatacttt

SEQ ID NO: 215003 - DNA, 20 bp, Artificial Sequence
  Description of Artificial Sequence: Synthetic oligonucleotide
  Target: ATXN1; (-) strand; PAM type: YTN; PAM sequence: TTT
atttattttttattatactt

SEQ ID NO: 215004 - DNA, 20 bp, Artificial Sequence
  Description of Artificial Sequence: Synthetic oligonucleotide
  Target: ATXN1; (-) strand; PAM type: YTN; PAM sequence: TTT
tatttattttttattatact

SEQ ID NO: 215005 - DNA, 20 bp, Artificial Sequence
  Description of Artificial Sequence: Synthetic oligonucleotide
  Target: ATXN1; (-) strand; PAM type: YTN; PAM sequence: TTA
ttttatttattttttattat

SEQ ID NO: 215006 - DNA, 20 bp, Artificial Sequence
  Description of Artificial Sequence: Synthetic oligonucleotide
  Target: ATXN1; (-) strand; PAM type: YTN; PAM sequence: TTT
attttatttattttttatta

SEQ ID NO: 215007 - DNA, 20 bp, Artificial Sequence
  Description of Artificial Sequence: Synthetic oligonucleotide
  Target: ATXN1; (-) strand; PAM type: YTN; PAM sequence: TTT
tattttatttattttttatt

SEQ ID NO: 215008 - DNA, 20 bp, Artificial Sequence
  Description of Artificial Sequence: Synthetic oligonucleotide
  Target: ATXN1; (-) strand; PAM type: YTN; PAM sequence: TTA
ttttattttatttatttttt

SEQ ID NO: 215009 - DNA, 20 bp, Artificial Sequence
  Description of Artificial Sequence: Synthetic oligonucleotide
  Target: ATXN1; (-) strand; PAM type: YTN; PAM sequence: TTT
attttattttatttattttt

SEQ ID NO: 215010 - DNA, 20 bp, Artificial Sequence
  Description of Artificial Sequence: Synthetic oligonucleotide
  Target: ATXN1; (-) strand; PAM type: YTN; PAM sequence: TTT
tattttattttatttatttt

SEQ ID NO: 215011 - DNA, 20 bp, Artificial Sequence
  Description of Artificial Sequence: Synthetic oligonucleotide
  Target: ATXN1; (-) strand; PAM type: YTN; PAM sequence: TTT
ttattttattttatttattt

SEQ ID NO: 215012 - DNA, 20 bp, Artificial Sequence
  Description of Artificial Sequence: Synthetic oligonucleotide
  Target: ATXN1; (-) strand; PAM type: YTN; PAM sequence: TTT
tttattttattttatttatt

SEQ ID NO: 215013 - DNA, 20 bp, Artificial Sequence
  Description of Artificial Sequence: Synthetic oligonucleotide
  Target: ATXN1; (-) strand; PAM type: YTN; PAM sequence: TTT
ttttattttattttatttat

SEQ ID NO: 215014 - DNA, 20 bp, Artificial Sequence
  Description of Artificial Sequence: Synthetic oligonucleotide
  Target: ATXN1; (-) strand; PAM type: YTN; PAM sequence: CTT
tttttattttattttattta

SEQ ID NO: 215015 - DNA, 20 bp, Artificial Sequence
  Description of Artificial Sequence: Synthetic oligonucleotide
  Target: ATXN1; (-) strand; PAM type: YTN; PAM sequence: TTC
tttttttattttattttatt

SEQ ID NO: 215016 - DNA, 20 bp, Artificial Sequence
  Description of Artificial Sequence: Synthetic oligonucleotide
  Target: ATXN1; (-) strand; PAM type: YTN; PAM sequence: TTT
ctttttttattttattttat

SEQ ID NO: 215017 - DNA, 20 bp, Artificial Sequence
  Description of Artificial Sequence: Synthetic oligonucleotide
  Target: ATXN1; (-) strand; PAM type: YTN; PAM sequence: TTT
tctttttttattttatttta

SEQ ID NO: 215018 - DNA, 20 bp, Artificial Sequence
  Description of Artificial Sequence: Synthetic oligonucleotide
  Target: ATXN1; (-) strand; PAM type: YTN; PAM sequence: TTT
ttctttttttattttatttt

SEQ ID NO: 215019 - DNA, 20 bp, Artificial Sequence
  Description of Artificial Sequence: Synthetic oligonucleotide
  Target: ATXN1; (-) strand; PAM type: YTN; PAM sequence: CTT
tttctttttttattttattt

SEQ ID NO: 215020 - DNA, 20 bp, Artificial Sequence
  Description of Artificial Sequence: Synthetic oligonucleotide
  Target: ATXN1; (-) strand; PAM type: YTN; PAM sequence: TTC
ctttttctttttttatttta

SEQ ID NO: 215021 - DNA, 20 bp, Artificial Sequence
  Description of Artificial Sequence: Synthetic oligonucleotide
  Target: ATXN1; (-) strand; PAM type: YTN; PAM sequence: CTT
cctttttctttttttatttt

SEQ ID NO: 215022 - DNA, 20 bp, Artificial Sequence
  Description of Artificial Sequence: Synthetic oligonucleotide
  Target: ATXN1; (-) strand; PAM type: YTN; PAM sequence: TTC
ttcctttttctttttttatt

SEQ ID NO: 215023 - DNA, 20 bp, Artificial Sequence
  Description of Artificial Sequence: Synthetic oligonucleotide
  Target: ATXN1; (-) strand; PAM type: YTN; PAM sequence: TTT
cttcctttttctttttttat

SEQ ID NO: 215024 - DNA, 20 bp, Artificial Sequence
  Description of Artificial Sequence: Synthetic oligonucleotide
  Target: ATXN1; (-) strand; PAM type: YTN; PAM sequence: CTT
tcttcctttttcttttttta

SEQ ID NO: 215025 - DNA, 20 bp, Artificial Sequence
  Description of Artificial Sequence: Synthetic oligonucleotide
  Target: ATXN1; (-) strand; PAM type: YTN; PAM sequence: TTC
tttcttcctttttctttttt

SEQ ID NO: 215026 - DNA, 20 bp, Artificial Sequence
  Description of Artificial Sequence: Synthetic oligonucleotide
  Target: ATXN1; (-) strand; PAM type: YTN; PAM sequence: TTT
ctttcttcctttttcttttt

SEQ ID NO: 215027 - DNA, 20 bp, Artificial Sequence
  Description of Artificial Sequence: Synthetic oligonucleotide
  Target: ATXN1; (-) strand; PAM type: YTN; PAM sequence: TTA
gtttctttcttcctttttct

SEQ ID NO: 215028 - DNA, 20 bp, Artificial Sequence
  Description of Artificial Sequence: Synthetic oligonucleotide
  Target: ATXN1; (-) strand; PAM type: YTN; PAM sequence: CTC
aattagtttctttcttcctt

SEQ ID NO: 215029 - DNA, 20 bp, Artificial Sequence
  Description of Artificial Sequence: Synthetic oligonucleotide
  Target: ATXN1; (-) strand; PAM type: YTN; PAM sequence: CTA
gtgtgctcaattagtttctt

SEQ ID NO: 215030 - DNA, 20 bp, Artificial Sequence
  Description of Artificial Sequence: Synthetic oligonucleotide
  Target: ATXN1; (-) strand; PAM type: YTN; PAM sequence: TTC
tagtgtgctcaattagtttc

SEQ ID NO: 215031 - DNA, 20 bp, Artificial Sequence
  Description of Artificial Sequence: Synthetic oligonucleotide
  Target: ATXN1; (-) strand; PAM type: YTN; PAM sequence: CTT
ctagtgtgctcaattagttt

SEQ ID NO: 215032 - DNA, 20 bp, Artificial Sequence
  Description of Artificial Sequence: Synthetic oligonucleotide
  Target: ATXN1; (-) strand; PAM type: YTN; PAM sequence: TTG
acttctagtgtgctcaatta

SEQ ID NO: 215033 - DNA, 20 bp, Artificial Sequence
  Description of Artificial Sequence: Synthetic oligonucleotide
  Target: ATXN1; (-) strand; PAM type: YTN; PAM sequence: CTG
ttgacttctagtgtgctcaa

SEQ ID NO: 215034 - DNA, 20 bp, Artificial Sequence
  Description of Artificial Sequence: Synthetic oligonucleotide
  Target: ATXN1; (-) strand; PAM type: YTN; PAM sequence: TTG
gagaaacagctgttgacttc

SEQ ID NO: 215035 - DNA, 20 bp, Artificial Sequence
  Description of Artificial Sequence: Synthetic oligonucleotide
  Target: ATXN1; (-) strand; PAM type: YTN; PAM sequence: CTA
attggagaaacagctgttga

SEQ ID NO: 215036 - DNA, 20 bp, Artificial Sequence
  Description of Artificial Sequence: Synthetic oligonucleotide
  Target: ATXN1; (-) strand; PAM type: YTN; PAM sequence: CTC
taattggagaaacagctgtt

SEQ ID NO: 215037 - DNA, 20 bp, Artificial Sequence
  Description of Artificial Sequence: Synthetic oligonucleotide
  Target: ATXN1; (-) strand; PAM type: YTN; PAM sequence: TTA
taggtgactctaattggaga

SEQ ID NO: 215038 - DNA, 20 bp, Artificial Sequence
  Description of Artificial Sequence: Synthetic oligonucleotide
  Target: ATXN1; (-) strand; PAM type: YTN; PAM sequence: TTG
ttataggtgactctaattgg

SEQ ID NO: 215039 - DNA, 20 bp, Artificial Sequence
  Description of Artificial Sequence: Synthetic oligonucleotide
  Target: ATXN1; (-) strand; PAM type: YTN; PAM sequence: CTT
gttataggtgactctaattg

SEQ ID NO: 215040 - DNA, 20 bp, Artificial Sequence
  Description of Artificial Sequence: Synthetic oligonucleotide
  Target: ATXN1; (-) strand; PAM type: YTN; PAM sequence: TTC
acttgttataggtgactcta

SEQ ID NO: 215041 - DNA, 20 bp, Artificial Sequence
  Description of Artificial Sequence: Synthetic oligonucleotide
  Target: ATXN1; (-) strand; PAM type: YTN; PAM sequence: CTA
agaattcacttgttataggt

SEQ ID NO: 215042 - DNA, 20 bp, Artificial Sequence
  Description of Artificial Sequence: Synthetic oligonucleotide
  Target: ATXN1; (-) strand; PAM type: YTN; PAM sequence: CTG
ctaagaattcacttgttata

SEQ ID NO: 215043 - DNA, 20 bp, Artificial Sequence
  Description of Artificial Sequence: Synthetic oligonucleotide
  Target: ATXN1; (-) strand; PAM type: YTN; PAM sequence: TTC
cctgctaagaattcacttgt

SEQ ID NO: 215044 - DNA, 20 bp, Artificial Sequence
  Description of Artificial Sequence: Synthetic oligonucleotide
  Target: ATXN1; (-) strand; PAM type: YTN; PAM sequence: TTT
ccctgctaagaattcacttg

SEQ ID NO: 215045 - DNA, 20 bp, Artificial Sequence
  Description of Artificial Sequence: Synthetic oligonucleotide
  Target: ATXN1; (-) strand; PAM type: YTN; PAM sequence: TTT
tccctgctaagaattcactt

SEQ ID NO: 215046 - DNA, 20 bp, Artificial Sequence
  Description of Artificial Sequence: Synthetic oligonucleotide
  Target: ATXN1; (-) strand; PAM type: YTN; PAM sequence: TTA
aggtgattttccctgctaag

SEQ ID NO: 215047 - DNA, 20 bp, Artificial Sequence
  Description of Artificial Sequence: Synthetic oligonucleotide
  Target: ATXN1; (-) strand; PAM type: YTN; PAM sequence: TTT
aaggtgattttccctgctaa

SEQ ID NO: 215048 - DNA, 20 bp, Artificial Sequence
  Description of Artificial Sequence: Synthetic oligonucleotide
  Target: ATXN1; (-) strand; PAM type: YTN; PAM sequence: TTT
taaggtgattttccctgcta

SEQ ID NO: 215049 - DNA, 20 bp, Artificial Sequence
  Description of Artificial Sequence: Synthetic oligonucleotide
  Target: ATXN1; (-) strand; PAM type: YTN; PAM sequence: CTC
gacatggatattttaaggtg

SEQ ID NO: 215050 - DNA, 20 bp, Artificial Sequence
  Description of Artificial Sequence: Synthetic oligonucleotide
  Target: ATXN1; (-) strand; PAM type: YTN; PAM sequence: CTA
actcgacatggatattttaa

SEQ ID NO: 215051 - DNA, 20 bp, Artificial Sequence
  Description of Artificial Sequence: Synthetic oligonucleotide
  Target: ATXN1; (-) strand; PAM type: YTN; PAM sequence: TTC
ctaactcgacatggatattt

SEQ ID NO: 215052 - DNA, 20 bp, Artificial Sequence
  Description of Artificial Sequence: Synthetic oligonucleotide
  Target: ATXN1; (-) strand; PAM type: YTN; PAM sequence: TTT
cctaactcgacatggatatt

SEQ ID NO: 215053 - DNA, 20 bp, Artificial Sequence
  Description of Artificial Sequence: Synthetic oligonucleotide
  Target: ATXN1; (-) strand; PAM type: YTN; PAM sequence: TTT
tcctaactcgacatggatat

SEQ ID NO: 215054 - DNA, 20 bp, Artificial Sequence
  Description of Artificial Sequence: Synthetic oligonucleotide
  Target: ATXN1; (-) strand; PAM type: YTN; PAM sequence: TTT
ttcctaactcgacatggata

SEQ ID NO: 215055 - DNA, 20 bp, Artificial Sequence
  Description of Artificial Sequence: Synthetic oligonucleotide
  Target: ATXN1; (-) strand; PAM type: YTN; PAM sequence: TTT
tttcctaactcgacatggat

SEQ ID NO: 215056 - DNA, 20 bp, Artificial Sequence
  Description of Artificial Sequence: Synthetic oligonucleotide
  Target: ATXN1; (-) strand; PAM type: YTN; PAM sequence: TTA
tgaaacattttttcctaact

SEQ ID NO: 215057 - DNA, 20 bp, Artificial Sequence
  Description of Artificial Sequence: Synthetic oligonucleotide
  Target: ATXN1; (-) strand; PAM type: YTN; PAM sequence: TTT
atgaaacattttttcctaac

SEQ ID NO: 215058 - DNA, 20 bp, Artificial Sequence
  Description of Artificial Sequence: Synthetic oligonucleotide
  Target: ATXN1; (-) strand; PAM type: YTN; PAM sequence: TTT
tatgaaacattttttcctaa

SEQ ID NO: 215059 - DNA, 20 bp, Artificial Sequence
  Description of Artificial Sequence: Synthetic oligonucleotide
  Target: ATXN1; (-) strand; PAM type: YTN; PAM sequence: CTA
ttttatgaaacattttttcc

SEQ ID NO: 215060 - DNA, 20 bp, Artificial Sequence
  Description of Artificial Sequence: Synthetic oligonucleotide
  Target: ATXN1; (-) strand; PAM type: YTN; PAM sequence: TTA
atagctattttatgaaacat

SEQ ID NO: 215061 - DNA, 20 bp, Artificial Sequence
  Description of Artificial Sequence: Synthetic oligonucleotide
  Target: ATXN1; (-) strand; PAM type: YTN; PAM sequence: TTT
aatagctattttatgaaaca

SEQ ID NO: 215062 - DNA, 20 bp, Artificial Sequence
  Description of Artificial Sequence: Synthetic oligonucleotide
  Target: ATXN1; (-) strand; PAM type: YTN; PAM sequence: TTA
atttaatagctattttatga

SEQ ID NO: 215063 - DNA, 20 bp, Artificial Sequence
  Description of Artificial Sequence: Synthetic oligonucleotide
  Target: ATXN1; (-) strand; PAM type: YTN; PAM sequence: TTC
aagaaaattaatttaatagc

SEQ ID NO: 215064 - DNA, 20 bp, Artificial Sequence
  Description of Artificial Sequence: Synthetic oligonucleotide
  Target: ATXN1; (-) strand; PAM type: YTN; PAM sequence: TTG
tcccatgccaattcaagaaa

SEQ ID NO: 215065 - DNA, 20 bp, Artificial Sequence
  Description of Artificial Sequence: Synthetic oligonucleotide
  Target: ATXN1; (-) strand; PAM type: YTN; PAM sequence: CTT
gtcccatgccaattcaagaa

SEQ ID NO: 215066 - DNA, 20 bp, Artificial Sequence
  Description of Artificial Sequence: Synthetic oligonucleotide
  Target: ATXN1; (-) strand; PAM type: YTN; PAM sequence: TTC
ttgtcccatgccaattcaag

SEQ ID NO: 215067 - DNA, 20 bp, Artificial Sequence
  Description of Artificial Sequence: Synthetic oligonucleotide
  Target: ATXN1; (-) strand; PAM type: YTN; PAM sequence: CTT
cttgtcccatgccaattcaa

SEQ ID NO: 215068 - DNA, 20 bp, Artificial Sequence
  Description of Artificial Sequence: Synthetic oligonucleotide
  Target: ATXN1; (-) strand; PAM type: YTN; PAM sequence: CTA
tatagcttcttgtcccatgc

SEQ ID NO: 215069 - DNA, 20 bp, Artificial Sequence
  Description of Artificial Sequence: Synthetic oligonucleotide
  Target: ATXN1; (-) strand; PAM type: YTN; PAM sequence: CTG
aactatatagcttcttgtcc

SEQ ID NO: 215070 - DNA, 20 bp, Artificial Sequence
  Description of Artificial Sequence: Synthetic oligonucleotide
  Target: ATXN1; (-) strand; PAM type: YTN; PAM sequence: TTA
gcagaactgaactatatagc

SEQ ID NO: 215071 - DNA, 20 bp, Artificial Sequence
  Description of Artificial Sequence: Synthetic oligonucleotide
  Target: ATXN1; (-) strand; PAM type: YTN; PAM sequence: TTT
agcagaactgaactatatag

SEQ ID NO: 215072 - DNA, 20 bp, Artificial Sequence
  Description of Artificial Sequence: Synthetic oligonucleotide
  Target: ATXN1; (-) strand; PAM type: YTN; PAM sequence: TTA
ggtgtttagcagaactgaac

SEQ ID NO: 215073 - DNA, 20 bp, Artificial Sequence
  Description of Artificial Sequence: Synthetic oligonucleotide
  Target: ATXN1; (-) strand; PAM type: YTN; PAM sequence: TTT
aggtgtttagcagaactgaa

SEQ ID NO: 215074 - DNA, 20 bp, Artificial Sequence
  Description of Artificial Sequence: Synthetic oligonucleotide
  Target: ATXN1; (-) strand; PAM type: YTN; PAM sequence: TTT
taggtgtttagcagaactga

SEQ ID NO: 215075 - DNA, 20 bp, Artificial Sequence
  Description of Artificial Sequence: Synthetic oligonucleotide
  Target: ATXN1; (-) strand; PAM type: YTN; PAM sequence: TTT
ttaggtgtttagcagaactg

SEQ ID NO: 215076 - DNA, 20 bp, Artificial Sequence
  Description of Artificial Sequence: Synthetic oligonucleotide
  Target: ATXN1; (-) strand; PAM type: YTN; PAM sequence: TTT
tttaggtgtttagcagaact

SEQ ID NO: 215077 - DNA, 20 bp, Artificial Sequence
  Description of Artificial Sequence: Synthetic oligonucleotide
  Target: ATXN1; (-) strand; PAM type: YTN; PAM sequence: CTG
tagtatatcagagtttttta

SEQ ID NO: 215078 - DNA, 20 bp, Artificial Sequence
  Description of Artificial Sequence: Synthetic oligonucleotide
  Target: ATXN1; (-) strand; PAM type: YTN; PAM sequence: CTG
gcgtagctgtagtatatcag

SEQ ID NO: 215079 - DNA, 20 bp, Artificial Sequence
  Description of Artificial Sequence: Synthetic oligonucleotide
  Target: ATXN1; (-) strand; PAM type: YTN; PAM sequence: TTG
cctggcgtagctgtagtata

SEQ ID NO: 215080 - DNA, 20 bp, Artificial Sequence
  Description of Artificial Sequence: Synthetic oligonucleotide
  Target: ATXN1; (-) strand; PAM type: YTN; PAM sequence: TTT
gcctggcgtagctgtagtat

SEQ ID NO: 215081 - DNA, 20 bp, Artificial Sequence
  Description of Artificial Sequence: Synthetic oligonucleotide
  Target: ATXN1; (-) strand; PAM type: YTN; PAM sequence: TTG
cgatttgcctggcgtagctg

SEQ ID NO: 215082 - DNA, 20 bp, Artificial Sequence
  Description of Artificial Sequence: Synthetic oligonucleotide
  Target: ATXN1; (-) strand; PAM type: YTN; PAM sequence: CTT
gcgatttgcctggcgtagct

SEQ ID NO: 215083 - DNA, 20 bp, Artificial Sequence
  Description of Artificial Sequence: Synthetic oligonucleotide
  Target: ATXN1; (-) strand; PAM type: YTN; PAM sequence: CTG
ggaatcgccccccaacaact

SEQ ID NO: 215084 - DNA, 20 bp, Artificial Sequence
  Description of Artificial Sequence: Synthetic oligonucleotide
  Target: ATXN1; (-) strand; PAM type: YTN; PAM sequence: TTC
tgggaatcgccccccaacaa

SEQ ID NO: 215085 - DNA, 20 bp, Artificial Sequence
  Description of Artificial Sequence: Synthetic oligonucleotide
  Target: ATXN1; (-) strand; PAM type: YTN; PAM sequence: TTT
ctgggaatcgccccccaaca

SEQ ID NO: 215086 - DNA, 20 bp, Artificial Sequence
  Description of Artificial Sequence: Synthetic oligonucleotide
  Target: ATXN1; (-) strand; PAM type: YTN; PAM sequence: TTC
acatatttctgggaatcgcc

SEQ ID NO: 215087 - DNA, 20 bp, Artificial Sequence
  Description of Artificial Sequence: Synthetic oligonucleotide
  Target: ATXN1; (-) strand; PAM type: YTN; PAM sequence: CTG
atgagtcacaatcgtgattc

SEQ ID NO: 215088 - DNA, 20 bp, Artificial Sequence
  Description of Artificial Sequence: Synthetic oligonucleotide
  Target: ATXN1; (-) strand; PAM type: YTN; PAM sequence: TTC
ccaaactgatgagtcacaat

SEQ ID NO: 215089 - DNA, 20 bp, Artificial Sequence
  Description of Artificial Sequence: Synthetic oligonucleotide
  Target: ATXN1; (-) strand; PAM type: YTN; PAM sequence: TTT
cccaaactgatgagtcacaa

SEQ ID NO: 215090 - DNA, 20 bp, Artificial Sequence
  Description of Artificial Sequence: Synthetic oligonucleotide
  Target: ATXN1; (-) strand; PAM type: YTN; PAM sequence: CTA
aatttcccaaactgatgagt

SEQ ID NO: 215091 - DNA, 20 bp, Artificial Sequence
  Description of Artificial Sequence: Synthetic oligonucleotide
  Target: ATXN1; (-) strand; PAM type: YTN; PAM sequence: CTG
atagtgatcatgtcctaaat

SEQ ID NO: 215092 - DNA, 20 bp, Artificial Sequence
  Description of Artificial Sequence: Synthetic oligonucleotide
  Target: ATXN1; (-) strand; PAM type: YTN; PAM sequence: TTG
actgatagtgatcatgtcct

SEQ ID NO: 215093 - DNA, 20 bp, Artificial Sequence
  Description of Artificial Sequence: Synthetic oligonucleotide
  Target: ATXN1; (-) strand; PAM type: YTN; PAM sequence: TTT
gactgatagtgatcatgtcc

SEQ ID NO: 215094 - DNA, 20 bp, Artificial Sequence
  Description of Artificial Sequence: Synthetic oligonucleotide
  Target: ATXN1; (-) strand; PAM type: YTN; PAM sequence: TTG
gcagataataatatcatgtt

SEQ ID NO: 215095 - DNA, 20 bp, Artificial Sequence
  Description of Artificial Sequence: Synthetic oligonucleotide
  Target: ATXN1; (-) strand; PAM type: YTN; PAM sequence: TTT
ggcagataataatatcatgt

SEQ ID NO: 215096 - DNA, 20 bp, Artificial Sequence
  Description of Artificial Sequence: Synthetic oligonucleotide
  Target: ATXN1; (-) strand; PAM type: YTN; PAM sequence: TTG
gacatttggcagataataat

SEQ ID NO: 215097 - DNA, 20 bp, Artificial Sequence
  Description of Artificial Sequence: Synthetic oligonucleotide
  Target: ATXN1; (-) strand; PAM type: YTN; PAM sequence: CTT
ggacatttggcagataataa

SEQ ID NO: 215098 - DNA, 20 bp, Artificial Sequence
  Description of Artificial Sequence: Synthetic oligonucleotide
  Target: ATXN1; (-) strand; PAM type: YTN; PAM sequence: TTA
tatcttggacatttggcaga

SEQ ID NO: 215099 - DNA, 20 bp, Artificial Sequence
  Description of Artificial Sequence: Synthetic oligonucleotide
  Target: ATXN1; (-) strand; PAM type: YTN; PAM sequence: TTT
atatcttggacatttggcag

SEQ ID NO: 215100 - DNA, 20 bp, Artificial Sequence
  Description of Artificial Sequence: Synthetic oligonucleotide
  Target: ATXN1; (-) strand; PAM type: YTN; PAM sequence: TTC
caaggaaatttatatcttgg

SEQ ID NO: 215101 - DNA, 20 bp, Artificial Sequence
  Description of Artificial Sequence: Synthetic oligonucleotide
  Target: ATXN1; (-) strand; PAM type: YTN; PAM sequence: TTT
ccaaggaaatttatatcttg

SEQ ID NO: 215102 - DNA, 20 bp, Artificial Sequence
  Description of Artificial Sequence: Synthetic oligonucleotide
  Target: ATXN1; (-) strand; PAM type: YTN; PAM sequence: CTG
tttccaaggaaatttatatc

SEQ ID NO: 215103 - DNA, 20 bp, Artificial Sequence
  Description of Artificial Sequence: Synthetic oligonucleotide
  Target: ATXN1; (-) strand; PAM type: YTN; PAM sequence: CTG
ccagctgtttccaaggaaat

SEQ ID NO: 215104 - DNA, 20 bp, Artificial Sequence
  Description of Artificial Sequence: Synthetic oligonucleotide
  Target: ATXN1; (-) strand; PAM type: YTN; PAM sequence: CTC
tgccagctgtttccaaggaa

SEQ ID NO: 215105 - DNA, 20 bp, Artificial Sequence
  Description of Artificial Sequence: Synthetic oligonucleotide
  Target: ATXN1; (-) strand; PAM type: YTN; PAM sequence: CTA
cctctgccagctgtttccaa

SEQ ID NO: 215106 - DNA, 20 bp, Artificial Sequence
  Description of Artificial Sequence: Synthetic oligonucleotide
  Target: ATXN1; (-) strand; PAM type: YTN; PAM sequence: CTA
tgcctacctctgccagctgt

SEQ ID NO: 215107 - DNA, 20 bp, Artificial Sequence
  Description of Artificial Sequence: Synthetic oligonucleotide
  Target: ATXN1; (-) strand; PAM type: YTN; PAM sequence: TTA
aagggctatgcctacctctg

SEQ ID NO: 215108 - DNA, 20 bp, Artificial Sequence
  Description of Artificial Sequence: Synthetic oligonucleotide
  Target: ATXN1; (-) strand; PAM type: YTN; PAM sequence: TTA
ggaaaattaaagggctatgc

SEQ ID NO: 215109 - DNA, 20 bp, Artificial Sequence
  Description of Artificial Sequence: Synthetic oligonucleotide
  Target: ATXN1; (-) strand; PAM type: YTN; PAM sequence: CTA
gcccacaaattaggaaaatt

SEQ ID NO: 215110 - DNA, 20 bp, Artificial Sequence
  Description of Artificial Sequence: Synthetic oligonucleotide
  Target: ATXN1; (-) strand; PAM type: YTN; PAM sequence: CTG
ctagcccacaaattaggaaa

SEQ ID NO: 215111 - DNA, 20 bp, Artificial Sequence
  Description of Artificial Sequence: Synthetic oligonucleotide
  Target: ATXN1; (-) strand; PAM type: YTN; PAM sequence: TTC
caaaaaatctgctagcccac

SEQ ID NO: 215112 - DNA, 20 bp, Artificial Sequence
  Description of Artificial Sequence: Synthetic oligonucleotide
  Target: ATXN1; (-) strand; PAM type: YTN; PAM sequence: CTA
gtatgtgaaattccaaaaaa

SEQ ID NO: 215113 - DNA, 20 bp, Artificial Sequence
  Description of Artificial Sequence: Synthetic oligonucleotide
  Target: ATXN1; (-) strand; PAM type: YTN; PAM sequence: TTC
atactagtatgtgaaattcc

SEQ ID NO: 215114 - DNA, 20 bp, Artificial Sequence
  Description of Artificial Sequence: Synthetic oligonucleotide
  Target: ATXN1; (-) strand; PAM type: YTN; PAM sequence: TTT
catactagtatgtgaaattc

SEQ ID NO: 215115 - DNA, 20 bp, Artificial Sequence
  Description of Artificial Sequence: Synthetic oligonucleotide
  Target: ATXN1; (-) strand; PAM type: YTN; PAM sequence: CTT
tcatactagtatgtgaaatt

SEQ ID NO: 215116 - DNA, 20 bp, Artificial Sequence
  Description of Artificial Sequence: Synthetic oligonucleotide
  Target: ATXN1; (-) strand; PAM type: YTN; PAM sequence: CTC
tttcatactagtatgtgaaa

SEQ ID NO: 215117 - DNA, 20 bp, Artificial Sequence
  Description of Artificial Sequence: Synthetic oligonucleotide
  Target: ATXN1; (-) strand; PAM type: YTN; PAM sequence: TTC
tctttcatactagtatgtga

SEQ ID NO: 215118 - DNA, 20 bp, Artificial Sequence
  Description of Artificial Sequence: Synthetic oligonucleotide
  Target: ATXN1; (-) strand; PAM type: YTN; PAM sequence: TTT
ctctttcatactagtatgtg

SEQ ID NO: 215119 - DNA, 20 bp, Artificial Sequence
  Description of Artificial Sequence: Synthetic oligonucleotide
  Target: ATXN1; (-) strand; PAM type: YTN; PAM sequence: TTA
tttctctttcatactagtat

SEQ ID NO: 215120 - DNA, 20 bp, Artificial Sequence
  Description of Artificial Sequence: Synthetic oligonucleotide
  Target: ATXN1; (-) strand; PAM type: YTN; PAM sequence: TTT
atttctctttcatactagta

SEQ ID NO: 215121 - DNA, 20 bp, Artificial Sequence
  Description of Artificial Sequence: Synthetic oligonucleotide
  Target: ATXN1; (-) strand; PAM type: YTN; PAM sequence: TTA
aaacatatttatttctcttt

SEQ ID NO: 215122 - DNA, 20 bp, Artificial Sequence
  Description of Artificial Sequence: Synthetic oligonucleotide
  Target: ATXN1; (-) strand; PAM type: YTN; PAM sequence: TTA
attaaaacatatttatttct

SEQ ID NO: 215123 - DNA, 20 bp, Artificial Sequence
  Description of Artificial Sequence: Synthetic oligonucleotide
  Target: ATXN1; (-) strand; PAM type: YTN; PAM sequence: CTG
tgcatatgtatgcattaatt

SEQ ID NO: 215124 - DNA, 20 bp, Artificial Sequence
  Description of Artificial Sequence: Synthetic oligonucleotide
  Target: ATXN1; (-) strand; PAM type: YTN; PAM sequence: TTA
aactgtgcatatgtatgcat

SEQ ID NO: 215125 - DNA, 20 bp, Artificial Sequence
  Description of Artificial Sequence: Synthetic oligonucleotide
  Target: ATXN1; (-) strand; PAM type: YTN; PAM sequence: TTT
aaactgtgcatatgtatgca

SEQ ID NO: 215126 - DNA, 20 bp, Artificial Sequence
  Description of Artificial Sequence: Synthetic oligonucleotide
  Target: ATXN1; (-) strand; PAM type: YTN; PAM sequence: TTA
tgaatatgtttaaactgtgc

SEQ ID NO: 215127 - DNA, 20 bp, Artificial Sequence
  Description of Artificial Sequence: Synthetic oligonucleotide
  Target: ATXN1; (-) strand; PAM type: YTN; PAM sequence: CTG
attatgaatatgtttaaact

SEQ ID NO: 215128 - DNA, 20 bp, Artificial Sequence
  Description of Artificial Sequence: Synthetic oligonucleotide
  Target: ATXN1; (-) strand; PAM type: YTN; PAM sequence: CTG
gatccacccctgattatgaa

SEQ ID NO: 215129 - DNA, 20 bp, Artificial Sequence
  Description of Artificial Sequence: Synthetic oligonucleotide
  Target: ATXN1; (-) strand; PAM type: YTN; PAM sequence: CTC
acagactggatccacccctg

SEQ ID NO: 215130 - DNA, 20 bp, Artificial Sequence
  Description of Artificial Sequence: Synthetic oligonucleotide
  Target: ATXN1; (-) strand; PAM type: YTN; PAM sequence: CTG
cagacctcacagactggatc

SEQ ID NO: 215131 - DNA, 20 bp, Artificial Sequence
  Description of Artificial Sequence: Synthetic oligonucleotide
  Target: ATXN1; (-) strand; PAM type: YTN; PAM sequence: TTA
taaactgcagacctcacaga

SEQ ID NO: 215132 - DNA, 20 bp, Artificial Sequence
  Description of Artificial Sequence: Synthetic oligonucleotide
  Target: ATXN1; (-) strand; PAM type: YTN; PAM sequence: TTT
ataaactgcagacctcacag

SEQ ID NO: 215133 - DNA, 20 bp, Artificial Sequence
  Description of Artificial Sequence: Synthetic oligonucleotide
  Target: ATXN1; (-) strand; PAM type: YTN; PAM sequence: TTT
tataaactgcagacctcaca

SEQ ID NO: 215134 - DNA, 20 bp, Artificial Sequence
  Description of Artificial Sequence: Synthetic oligonucleotide
  Target: ATXN1; (-) strand; PAM type: YTN; PAM sequence: CTA
gttttataaactgcagacct

SEQ ID NO: 215135 - DNA, 20 bp, Artificial Sequence
  Description of Artificial Sequence: Synthetic oligonucleotide
  Target: ATXN1; (-) strand; PAM type: YTN; PAM sequence: TTG
actagttttataaactgcag

SEQ ID NO: 215136 - DNA, 20 bp, Artificial Sequence
  Description of Artificial Sequence: Synthetic oligonucleotide
  Target: ATXN1; (-) strand; PAM type: YTN; PAM sequence: CTT
gactagttttataaactgca

SEQ ID NO: 215137 - DNA, 20 bp, Artificial Sequence
  Description of Artificial Sequence: Synthetic oligonucleotide
  Target: ATXN1; (-) strand; PAM type: YTN; PAM sequence: CTA
ccccttgactagttttataa

SEQ ID NO: 215138 - DNA, 20 bp, Artificial Sequence
  Description of Artificial Sequence: Synthetic oligonucleotide
  Target: ATXN1; (-) strand; PAM type: YTN; PAM sequence: CTC
taccccttgactagttttat

SEQ ID NO: 215139 - DNA, 20 bp, Artificial Sequence
  Description of Artificial Sequence: Synthetic oligonucleotide
  Target: ATXN1; (-) strand; PAM type: YTN; PAM sequence: CTC
ctctaccccttgactagttt

SEQ ID NO: 215140 - DNA, 20 bp, Artificial Sequence
  Description of Artificial Sequence: Synthetic oligonucleotide
  Target: ATXN1; (-) strand; PAM type: YTN; PAM sequence: CTA
acaccccatacacactcctc

SEQ ID NO: 215141 - DNA, 20 bp, Artificial Sequence
  Description of Artificial Sequence: Synthetic oligonucleotide
  Target: ATXN1; (-) strand; PAM type: YTN; PAM sequence: TTA
aagaccctaacaccccatac

SEQ ID NO: 215142 - DNA, 20 bp, Artificial Sequence
  Description of Artificial Sequence: Synthetic oligonucleotide
  Target: ATXN1; (-) strand; PAM type: YTN; PAM sequence: CTT
aaagaccctaacaccccata

SEQ ID NO: 215143 - DNA, 20 bp, Artificial Sequence
  Description of Artificial Sequence: Synthetic oligonucleotide
  Target: ATXN1; (-) strand; PAM type: YTN; PAM sequence: TTC
ttaaagaccctaacacccca

SEQ ID NO: 215144 - DNA, 20 bp, Artificial Sequence
  Description of Artificial Sequence: Synthetic oligonucleotide
  Target: ATXN1; (-) strand; PAM type: YTN; PAM sequence: TTT
cttaaagaccctaacacccc

SEQ ID NO: 215145 - DNA, 20 bp, Artificial Sequence
  Description of Artificial Sequence: Synthetic oligonucleotide
  Target: ATXN1; (-) strand; PAM type: YTN; PAM sequence: TTT
tcttaaagaccctaacaccc

SEQ ID NO: 215146 - DNA, 20 bp, Artificial Sequence
  Description of Artificial Sequence: Synthetic oligonucleotide
  Target: ATXN1; (-) strand; PAM type: YTN; PAM sequence: CTT
ttcttaaagaccctaacacc

SEQ ID NO: 215147 - DNA, 20 bp, Artificial Sequence
  Description of Artificial Sequence: Synthetic oligonucleotide
  Target: ATXN1; (-) strand; PAM type: YTN; PAM sequence: TTG
agatcttttcttaaagaccc

SEQ ID NO: 215148 - DNA, 20 bp, Artificial Sequence
  Description of Artificial Sequence: Synthetic oligonucleotide
  Target: ATXN1; (-) strand; PAM type: YTN; PAM sequence: TTT
gagatcttttcttaaagacc

SEQ ID NO: 215149 - DNA, 20 bp, Artificial Sequence
  Description of Artificial Sequence: Synthetic oligonucleotide
  Target: ATXN1; (-) strand; PAM type: YTN; PAM sequence: CTT
tgagatcttttcttaaagac

SEQ ID NO: 215150 - DNA, 20 bp, Artificial Sequence
  Description of Artificial Sequence: Synthetic oligonucleotide
  Target: ATXN1; (-) strand; PAM type: YTN; PAM sequence: CTG
gcctttgagatcttttctta

SEQ ID NO: 215151 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagtgaccatggc

SEQ ID NO: 215152 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagtgac

SEQ ID NO: 215153 - DNA, 20 bp, Artificial Sequence
  Description of Artificial Sequence: Synthetic oligonucleotide
  Target: ATXN1; (-) strand; PAM type: YTN; PAM sequence: TTC
tgggattacaggcgtgagtg

SEQ ID NO: 215154 - DNA, 20 bp, Artificial Sequence
  Description of Artificial Sequence: Synthetic oligonucleotide
  Target: ATXN1; (-) strand; PAM type: YTN; PAM sequence: CTC
ccaaagttctgggattacag

SEQ ID NO: 215155 - DNA, 20 bp, Artificial Sequence
  Description of Artificial Sequence: Synthetic oligonucleotide
  Target: ATXN1; (-) strand; PAM type: YTN; PAM sequence: TTC
agcctcccaaagttctggga

SEQ ID NO: 215156 - DNA, 20 bp, Artificial Sequence
  Description of Artificial Sequence: Synthetic oligonucleotide
  Target: ATXN1; (-) strand; PAM type: YTN; PAM sequence: CTT
cagcctcccaaagttctggg

SEQ ID NO: 215157 - DNA, 20 bp, Artificial Sequence
  Description of Artificial Sequence: Synthetic oligonucleotide
  Target: ATXN1; (-) strand; PAM type: YTN; PAM sequence: CTC
cacttcagcctcccaaagtt

SEQ ID NO: 215158 - DNA, 20 bp, Artificial Sequence
  Description of Artificial Sequence: Synthetic oligonucleotide
  Target: ATXN1; (-) strand; PAM type: YTN; PAM sequence: CTC
aagcgatcctccacttcagc

SEQ ID NO: 215159 - DNA, 20 bp, Artificial Sequence
  Description of Artificial Sequence: Synthetic oligonucleotide
  Target: ATXN1; (-) strand; PAM type: YTN; PAM sequence: CTG
ggctcaagcgatcctccact

SEQ ID NO: 215160 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagcgatcctcc

SEQ ID NO: 215161 - DNA, 20 bp, Artificial Sequence
  Description of Artificial Sequence: Synthetic oligonucleotide
  Target: ATXN1; (-) strand; PAM type: YTN; PAM sequence: TTG
aactcctgggctcaagcgat

SEQ ID NO: 215162 - DNA, 20 bp, Artificial Sequence
  Description of Artificial Sequence: Synthetic oligonucleotide
  Target: ATXN1; (-) strand; PAM type: YTN; PAM sequence: CTT
gaactcctgggctcaagcga

SEQ ID NO: 215163 - DNA, 20 bp, Artificial Sequence
  Description of Artificial Sequence: Synthetic oligonucleotide
  Target: ATXN1; (-) strand; PAM type: YTN; PAM sequence: TTG
tcttgaactcctgggctcaa

SEQ ID NO: 215164 - DNA, 20 bp, Artificial Sequence
  Description of Artificial Sequence: Synthetic oligonucleotide
  Target: ATXN1; (-) strand; PAM type: YTN; PAM sequence: TTT
gtcttgaactcctgggctca

SEQ ID NO: 215165 - DNA, 20 bp, Artificial Sequence
  Description of Artificial Sequence: Synthetic oligonucleotide
  Target: ATXN1; (-) strand; PAM type: YTN; PAM sequence: TTT
tgtcttgaactcctgggctc

SEQ ID NO: 215166 - DNA, 20 bp, Artificial Sequence
  Description of Artificial Sequence: Synthetic oligonucleotide
  Target: ATXN1; (-) strand; PAM type: YTN; PAM sequence: TTG
cccagttttgtcttgaactc

SEQ ID NO: 215167 - DNA, 20 bp, Artificial Sequence
  Description of Artificial Sequence: Synthetic oligonucleotide
  Target: ATXN1; (-) strand; PAM type: YTN; PAM sequence: CTA
tgttgcccagttttgtcttg

SEQ ID NO: 215168 - DNA, 20 bp, Artificial Sequence
  Description of Artificial Sequence: Synthetic oligonucleotide
  Target: ATXN1; (-) strand; PAM type: YTN; PAM sequence: CTC
actatgttgcccagttttgt

SEQ ID NO: 215169 - DNA, 20 bp, Artificial Sequence
  Description of Artificial Sequence: Synthetic oligonucleotide
  Target: ATXN1; (-) strand; PAM type: YTN; PAM sequence: TTG
tagagatgggggtctcacta

SEQ ID NO: 215170 - DNA, 20 bp, Artificial Sequence
  Description of Artificial Sequence: Synthetic oligonucleotide
  Target: ATXN1; (-) strand; PAM type: YTN; PAM sequence: TTT
gtagagatgggggtctcact

SEQ ID NO: 215171 - DNA, 20 bp, Artificial Sequence
  Description of Artificial Sequence: Synthetic oligonucleotide
  Target: ATXN1; (-) strand; PAM type: YTN; PAM sequence: TTT
tgtagagatgggggtctcac

SEQ ID NO: 215172 - DNA, 20 bp, Artificial Sequence
  Description of Artificial Sequence: Synthetic oligonucleotide
  Target: ATXN1; (-) strand; PAM type: YTN; PAM sequence: TTT
ttgtagagatgggggtctca

SEQ ID NO: 215173 - DNA, 20 bp, Artificial Sequence
  Description of Artificial Sequence: Synthetic oligonucleotide
  Target: ATXN1; (-) strand; PAM type: YTN; PAM sequence: TTT
tttgtagagatgggggtctc

SEQ ID NO: 215174 - DNA, 20 bp, Artificial Sequence
  Description of Artificial Sequence: Synthetic oligonucleotide
  Target: ATXN1; (-) strand; PAM type: YTN; PAM sequence: TTT
ttttgtagagatgggggtct

SEQ ID NO: 215175 - DNA, 20 bp, Artificial Sequence
  Description of Artificial Sequence: Synthetic oligonucleotide
  Target: ATXN1; (-) strand; PAM type: YTN; PAM sequence: TTG
tatttttttgtagagatggg

SEQ ID NO: 215176 - DNA, 20 bp, Artificial Sequence
  Description of Artificial Sequence: Synthetic oligonucleotide
  Target: ATXN1; (-) strand; PAM type: YTN; PAM sequence: TTT
gtatttttttgtagagatgg

SEQ ID NO: 215177 - DNA, 20 bp, Artificial Sequence
  Description of Artificial Sequence: Synthetic oligonucleotide
  Target: ATXN1; (-) strand; PAM type: YTN; PAM sequence: TTT
tgtatttttttgtagagatg

SEQ ID NO: 215178 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttttgtagagat

SEQ ID NO: 215179 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttttgtag

SEQ ID NO: 215180 - DNA, 20 bp, Artificial Sequence
  Description of Artificial Sequence: Synthetic oligonucleotide
  Target: ATXN1; (-) strand; PAM type: YTN; PAM sequence: CTC
agctaatttttgtatttttt

SEQ ID NO: 215181 - DNA, 20 bp, Artificial Sequence
  Description of Artificial Sequence: Synthetic oligonucleotide
  Target: ATXN1; (-) strand; PAM type: YTN; PAM sequence: CTG
tgagcagatacatatgccac

SEQ ID NO: 215182 - DNA, 20 bp, Artificial Sequence
  Description of Artificial Sequence: Synthetic oligonucleotide
  Target: ATXN1; (-) strand; PAM type: YTN; PAM sequence: CTG
agtagctgtgagcagataca

SEQ ID NO: 215183 - DNA, 20 bp, Artificial Sequence
  Description of Artificial Sequence: Synthetic oligonucleotide
  Target: ATXN1; (-) strand; PAM type: YTN; PAM sequence: TTC
tgagtagctgtgagcagata

SEQ ID NO: 215184 - DNA, 20 bp, Artificial Sequence
  Description of Artificial Sequence: Synthetic oligonucleotide
  Target: ATXN1; (-) strand; PAM type: YTN; PAM sequence: CTT
ctgagtagctgtgagcagat

SEQ ID NO: 215185 - DNA, 20 bp, Artificial Sequence
  Description of Artificial Sequence: Synthetic oligonucleotide
  Target: ATXN1; (-) strand; PAM type: YTN; PAM sequence: CTG
agccttctgagtagctgtga

SEQ ID NO: 215186 - DNA, 20 bp, Artificial Sequence
  Description of Artificial Sequence: Synthetic oligonucleotide
  Target: ATXN1; (-) strand; PAM type: YTN; PAM sequence: CTC
ccacctgagccttctgagta

SEQ ID NO: 215187 - DNA, 20 bp, Artificial Sequence
  Description of Artificial Sequence: Synthetic oligonucleotide
  Target: ATXN1; (-) strand; PAM type: YTN; PAM sequence: CTC
aagtgatcctcccacctgag

SEQ ID NO: 215188 - DNA, 20 bp, Artificial Sequence
  Description of Artificial Sequence: Synthetic oligonucleotide
  Target: ATXN1; (-) strand; PAM type: YTN; PAM sequence: CTC
ccaggctcaagtgatcctcc

SEQ ID NO: 215189 - DNA, 20 bp, Artificial Sequence
  Description of Artificial Sequence: Synthetic oligonucleotide
  Target: ATXN1; (-) strand; PAM type: YTN; PAM sequence: CTC
aacctcccaggctcaagtga

SEQ ID NO: 215190 - DNA, 20 bp, Artificial Sequence
  Description of Artificial Sequence: Synthetic oligonucleotide
  Target: ATXN1; (-) strand; PAM type: YTN; PAM sequence: CTG
cagcctcaacctcccaggct

SEQ ID NO: 215191 - DNA, 20 bp, Artificial Sequence
  Description of Artificial Sequence: Synthetic oligonucleotide
  Target: ATXN1; (-) strand; PAM type: YTN; PAM sequence: CTC
actgcagcctcaacctccca

SEQ ID NO: 215192 - DNA, 20 bp, Artificial Sequence
  Description of Artificial Sequence: Synthetic oligonucleotide
  Target: ATXN1; (-) strand; PAM type: YTN; PAM sequence: TTG
gctcactgcagcctcaacct

SEQ ID NO: 215193 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcagcctcaacc

SEQ ID NO: 215194 - DNA, 20 bp, Artificial Sequence
  Description of Artificial Sequence: Synthetic oligonucleotide
  Target: ATXN1; (-) strand; PAM type: YTN; PAM sequence: TTG
tgatcttggctcactgcagc

SEQ ID NO: 215195 - DNA, 20 bp, Artificial Sequence
  Description of Artificial Sequence: Synthetic oligonucleotide
  Target: ATXN1; (-) strand; PAM type: YTN; PAM sequence: TTG
cagtgttgtgatcttggctc

SEQ ID NO: 215196 - DNA, 20 bp, Artificial Sequence
  Description of Artificial Sequence: Synthetic oligonucleotide
  Target: ATXN1; (-) strand; PAM type: YTN; PAM sequence: CTG
gattgcagtgttgtgatctt

SEQ ID NO: 215197 - DNA, 20 bp, Artificial Sequence
  Description of Artificial Sequence: Synthetic oligonucleotide
  Target: ATXN1; (-) strand; PAM type: YTN; PAM sequence: CTG
tcatccaggctggattgcag

SEQ ID NO: 215198 - DNA, 20 bp, Artificial Sequence
  Description of Artificial Sequence: Synthetic oligonucleotide
  Target: ATXN1; (-) strand; PAM type: YTN; PAM sequence: CTC
tgtcatccaggctggattgc

SEQ ID NO: 215199 - DNA, 20 bp, Artificial Sequence
  Description of Artificial Sequence: Synthetic oligonucleotide
  Target: ATXN1; (-) strand; PAM type: YTN; PAM sequence: CTA
gctctgtcatccaggctgga

SEQ ID NO: 215200 - DNA, 20 bp, Artificial Sequence
  Description of Artificial Sequence: Synthetic oligonucleotide
  Target: ATXN1; (-) strand; PAM type: YTN; PAM sequence: TTG
aggcagcgtctagctctgtc

SEQ ID NO: 215201 - DNA, 20 bp, Artificial Sequence
  Description of Artificial Sequence: Synthetic oligonucleotide
  Target: ATXN1; (-) strand; PAM type: YTN; PAM sequence: TTT
gaggcagcgtctagctctgt

SEQ ID NO: 215202 - DNA, 20 bp, Artificial Sequence
  Description of Artificial Sequence: Synthetic oligonucleotide
  Target: ATXN1; (-) strand; PAM type: YTN; PAM sequence: TTT
tgaggcagcgtctagctctg

SEQ ID NO: 215203 - DNA, 20 bp, Artificial Sequence
  Description of Artificial Sequence: Synthetic oligonucleotide
  Target: ATXN1; (-) strand; PAM type: YTN; PAM sequence: TTT
ttgaggcagcgtctagctct

SEQ ID NO: 215204 - DNA, 20 bp, Artificial Sequence
  Description of Artificial Sequence: Synthetic oligonucleotide
  Target: ATXN1; (-) strand; PAM type: YTN; PAM sequence: TTT
tttgaggcagcgtctagctc

SEQ ID NO: 215205 - DNA, 20 bp, Artificial Sequence
  Description of Artificial Sequence: Synthetic oligonucleotide
  Target: ATXN1; (-) strand; PAM type: YTN; PAM sequence: TTT
ttttgaggcagcgtctagct

SEQ ID NO: 215206 - DNA, 20 bp, Artificial Sequence
  Description of Artificial Sequence: Synthetic oligonucleotide
  Target: ATXN1; (-) strand; PAM type: YTN; PAM sequence: TTT
tttttgaggcagcgtctagc

SEQ ID NO: 215207 - DNA, 20 bp, Artificial Sequence
  Description of Artificial Sequence: Synthetic oligonucleotide
  Target: ATXN1; (-) strand; PAM type: YTN; PAM sequence: TTT
ttttttgaggcagcgtctag

SEQ ID NO: 215208 - DNA, 20 bp, Artificial Sequence
  Description of Artificial Sequence: Synthetic oligonucleotide
  Target: ATXN1; (-) strand; PAM type: YTN; PAM sequence: TTT
tttttttgaggcagcgtcta

SEQ ID NO: 215209 - DNA, 20 bp, Artificial Sequence
  Description of Artificial Sequence: Synthetic oligonucleotide
  Target: ATXN1; (-) strand; PAM type: YTN; PAM sequence: TTT
ttttttttgaggcagcgtct

SEQ ID NO: 215210 - DNA, 20 bp, Artificial Sequence
  Description of Artificial Sequence: Synthetic oligonucleotide
  Target: ATXN1; (-) strand; PAM type: YTN; PAM sequence: TTT
tttttttttgaggcagcgtc

SEQ ID NO: 215211 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgaggcagcgt

SEQ ID NO: 215212 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgaggcagcg

SEQ ID NO: 215213 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgaggcagc

SEQ ID NO: 215214 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgaggcag

SEQ ID NO: 215215 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgaggca

SEQ ID NO: 215216 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgaggc

SEQ ID NO: 215217 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgagg

SEQ ID NO: 215218 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgag

SEQ ID NO: 215219 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttga

SEQ ID NO: 215220 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttg

SEQ ID NO: 215221 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 215222 - DNA, 20 bp, Artificial Sequence
  Description of Artificial Sequence: Synthetic oligonucleotide
  Target: ATXN1; (-) strand; PAM type: YTN; PAM sequence: TTG
tgcagttttttttttttttt

SEQ ID NO: 215223 - DNA, 20 bp, Artificial Sequence
  Description of Artificial Sequence: Synthetic oligonucleotide
  Target: ATXN1; (-) strand; PAM type: YTN; PAM sequence: TTT
gtgcagtttttttttttttt

SEQ ID NO: 215224 - DNA, 20 bp, Artificial Sequence
  Description of Artificial Sequence: Synthetic oligonucleotide
  Target: ATXN1; (-) strand; PAM type: YTN; PAM sequence: TTT
tgtgcagttttttttttttt

SEQ ID NO: 215225 - DNA, 20 bp, Artificial Sequence
  Description of Artificial Sequence: Synthetic oligonucleotide
  Target: ATXN1; (-) strand; PAM type: YTN; PAM sequence: TTG
ataattttgtgcagtttttt

SEQ ID NO: 215226 - DNA, 20 bp, Artificial Sequence
  Description of Artificial Sequence: Synthetic oligonucleotide
  Target: ATXN1; (-) strand; PAM type: YTN; PAM sequence: TTA
tgttgataattttgtgcagt

SEQ ID NO: 215227 - DNA, 20 bp, Artificial Sequence
  Description of Artificial Sequence: Synthetic oligonucleotide
  Target: ATXN1; (-) strand; PAM type: YTN; PAM sequence: TTT
atgttgataattttgtgcag

SEQ ID NO: 215228 - DNA, 20 bp, Artificial Sequence
  Description of Artificial Sequence: Synthetic oligonucleotide
  Target: ATXN1; (-) strand; PAM type: YTN; PAM sequence: TTT
tatgttgataattttgtgca

SEQ ID NO: 215229 - DNA, 20 bp, Artificial Sequence
  Description of Artificial Sequence: Synthetic oligonucleotide
  Target: ATXN1; (-) strand; PAM type: YTN; PAM sequence: CTA
attttatgttgataattttg

SEQ ID NO: 215230 - DNA, 20 bp, Artificial Sequence
  Description of Artificial Sequence: Synthetic oligonucleotide
  Target: ATXN1; (-) strand; PAM type: YTN; PAM sequence: CTG
tacctaattttatgttgata

SEQ ID NO: 215231 - DNA, 20 bp, Artificial Sequence
  Description of Artificial Sequence: Synthetic oligonucleotide
  Target: ATXN1; (-) strand; PAM type: YTN; PAM sequence: TTG
taagaccctgtacctaattt

SEQ ID NO: 215232 - DNA, 20 bp, Artificial Sequence
  Description of Artificial Sequence: Synthetic oligonucleotide
  Target: ATXN1; (-) strand; PAM type: YTN; PAM sequence: TTT
gtaagaccctgtacctaatt

SEQ ID NO: 215233 - DNA, 20 bp, Artificial Sequence
  Description of Artificial Sequence: Synthetic oligonucleotide
  Target: ATXN1; (-) strand; PAM type: YTN; PAM sequence: CTT
tgtaagaccctgtacctaat

SEQ ID NO: 215234 - DNA, 20 bp, Artificial Sequence
  Description of Artificial Sequence: Synthetic oligonucleotide
  Target: ATXN1; (-) strand; PAM type: YTN; PAM sequence: CTG
caggccctttgtaagaccct

SEQ ID NO: 215235 - DNA, 20 bp, Artificial Sequence
  Description of Artificial Sequence: Synthetic oligonucleotide
  Target: ATXN1; (-) strand; PAM type: YTN; PAM sequence: CTC
ctgcaggccctttgtaagac

SEQ ID NO: 215236 - DNA, 20 bp, Artificial Sequence
  Description of Artificial Sequence: Synthetic oligonucleotide
  Target: ATXN1; (-) strand; PAM type: YTN; PAM sequence: CTC
gctcctgcaggccctttgta

SEQ ID NO: 215237 - DNA, 20 bp, Artificial Sequence
  Description of Artificial Sequence: Synthetic oligonucleotide
  Target: ATXN1; (-) strand; PAM type: YTN; PAM sequence: TTC
agcgtcaaggcgtctcgctc

SEQ ID NO: 215238 - DNA, 20 bp, Artificial Sequence
  Description of Artificial Sequence: Synthetic oligonucleotide
  Target: ATXN1; (-) strand; PAM type: YTN; PAM sequence: CTT
cagcgtcaaggcgtctcgct

SEQ ID NO: 215239 - DNA, 20 bp, Artificial Sequence
  Description of Artificial Sequence: Synthetic oligonucleotide
  Target: ATXN1; (-) strand; PAM type: YTN; PAM sequence: CTA
gtgacacttcagcgtcaagg

SEQ ID NO: 215240 - DNA, 20 bp, Artificial Sequence
  Description of Artificial Sequence: Synthetic oligonucleotide
  Target: ATXN1; (-) strand; PAM type: YTN; PAM sequence: CTG
gaagctagtgacacttcagc

SEQ ID NO: 215241 - DNA, 20 bp, Artificial Sequence
  Description of Artificial Sequence: Synthetic oligonucleotide
  Target: ATXN1; (-) strand; PAM type: YTN; PAM sequence: TTA
tctggaagctagtgacactt

SEQ ID NO: 215242 - DNA, 20 bp, Artificial Sequence
  Description of Artificial Sequence: Synthetic oligonucleotide
  Target: ATXN1; (-) strand; PAM type: YTN; PAM sequence: TTT
atctggaagctagtgacact

SEQ ID NO: 215243 - DNA, 20 bp, Artificial Sequence
  Description of Artificial Sequence: Synthetic oligonucleotide
  Target: ATXN1; (-) strand; PAM type: YTN; PAM sequence: TTT
tatctggaagctagtgacac

SEQ ID NO: 215244 - DNA, 20 bp, Artificial Sequence
  Description of Artificial Sequence: Synthetic oligonucleotide
  Target: ATXN1; (-) strand; PAM type: YTN; PAM sequence: TTG
tgggccaggaggttttatct

SEQ ID NO: 215245 - DNA, 20 bp, Artificial Sequence
  Description of Artificial Sequence: Synthetic oligonucleotide
  Target: ATXN1; (-) strand; PAM type: YTN; PAM sequence: CTG
tgatgtgtgcatgcattgtg

SEQ ID NO: 215246 - DNA, 20 bp, Artificial Sequence
  Description of Artificial Sequence: Synthetic oligonucleotide
  Target: ATXN1; (-) strand; PAM type: YTN; PAM sequence: TTC
ccaccactgtgatgtgtgca

SEQ ID NO: 215247 - DNA, 20 bp, Artificial Sequence
  Description of Artificial Sequence: Synthetic oligonucleotide
  Target: ATXN1; (-) strand; PAM type: YTN; PAM sequence: TTA
taggtgttcccaccactgtg

SEQ ID NO: 215248 - DNA, 20 bp, Artificial Sequence
  Description of Artificial Sequence: Synthetic oligonucleotide
  Target: ATXN1; (-) strand; PAM type: YTN; PAM sequence: TTT
ataggtgttcccaccactgt

SEQ ID NO: 215249 - DNA, 20 bp, Artificial Sequence
  Description of Artificial Sequence: Synthetic oligonucleotide
  Target: ATXN1; (-) strand; PAM type: YTN; PAM sequence: TTG
gtcatttataggtgttccca

SEQ ID NO: 215250 - DNA, 20 bp, Artificial Sequence
  Description of Artificial Sequence: Synthetic oligonucleotide
  Target: ATXN1; (-) strand; PAM type: YTN; PAM sequence: CTT
ggtcatttataggtgttccc

SEQ ID NO: 215251 - DNA, 20 bp, Artificial Sequence
  Description of Artificial Sequence: Synthetic oligonucleotide
  Target: ATXN1; (-) strand; PAM type: YTN; PAM sequence: TTG
atcttggtcatttataggtg

SEQ ID NO: 215252 - DNA, 20 bp, Artificial Sequence
  Description of Artificial Sequence: Synthetic oligonucleotide
  Target: ATXN1; (-) strand; PAM type: YTN; PAM sequence: TTA
taatgaaatatgttgatctt

SEQ ID NO: 215253 - DNA, 20 bp, Artificial Sequence
  Description of Artificial Sequence: Synthetic oligonucleotide
  Target: ATXN1; (-) strand; PAM type: YTN; PAM sequence: TTG
aagggaattataatgaaata

SEQ ID NO: 215254 - DNA, 20 bp, Artificial Sequence
  Description of Artificial Sequence: Synthetic oligonucleotide
  Target: ATXN1; (-) strand; PAM type: YTN; PAM sequence: TTG
gcattgaagggaattataat

SEQ ID NO: 215255 - DNA, 20 bp, Artificial Sequence
  Description of Artificial Sequence: Synthetic oligonucleotide
  Target: ATXN1; (-) strand; PAM type: YTN; PAM sequence: CTT
ggcattgaagggaattataa

SEQ ID NO: 215256 - DNA, 20 bp, Artificial Sequence
  Description of Artificial Sequence: Synthetic oligonucleotide
  Target: ATXN1; (-) strand; PAM type: YTN; PAM sequence: TTA
ccatatacttggcattgaag

SEQ ID NO: 215257 - DNA, 20 bp, Artificial Sequence
  Description of Artificial Sequence: Synthetic oligonucleotide
  Target: ATXN1; (-) strand; PAM type: YTN; PAM sequence: TTT
accatatacttggcattgaa

SEQ ID NO: 215258 - DNA, 20 bp, Artificial Sequence
  Description of Artificial Sequence: Synthetic oligonucleotide
  Target: ATXN1; (-) strand; PAM type: YTN; PAM sequence: CTA
aagtgtttaccatatacttg

SEQ ID NO: 215259 - DNA, 20 bp, Artificial Sequence
  Description of Artificial Sequence: Synthetic oligonucleotide
  Target: ATXN1; (-) strand; PAM type: YTN; PAM sequence: CTC
agcaaaaatgtatactaaag

SEQ ID NO: 215260 - DNA, 20 bp, Artificial Sequence
  Description of Artificial Sequence: Synthetic oligonucleotide
  Target: ATXN1; (-) strand; PAM type: YTN; PAM sequence: TTA
gtcacgtgtactcagcaaaa

SEQ ID NO: 215261 - DNA, 20 bp, Artificial Sequence
  Description of Artificial Sequence: Synthetic oligonucleotide
  Target: ATXN1; (-) strand; PAM type: YTN; PAM sequence: TTT
agtcacgtgtactcagcaaa

SEQ ID NO: 215262 - DNA, 20 bp, Artificial Sequence
  Description of Artificial Sequence: Synthetic oligonucleotide
  Target: ATXN1; (-) strand; PAM type: YTN; PAM sequence: CTA
tttagtcacgtgtactcagc

SEQ ID NO: 215263 - DNA, 20 bp, Artificial Sequence
  Description of Artificial Sequence: Synthetic oligonucleotide
  Target: ATXN1; (-) strand; PAM type: YTN; PAM sequence: TTC
tatttagtcacgtgtactca

SEQ ID NO: 215264 - DNA, 20 bp, Artificial Sequence
  Description of Artificial Sequence: Synthetic oligonucleotide
  Target: ATXN1; (-) strand; PAM type: YTN; PAM sequence: TTT
ctatttagtcacgtgtactc

SEQ ID NO: 215265 - DNA, 20 bp, Artificial Sequence
  Description of Artificial Sequence: Synthetic oligonucleotide
  Target: ATXN1; (-) strand; PAM type: YTN; PAM sequence: TTG
taaacatttctatttagtca

SEQ ID NO: 215266 - DNA, 20 bp, Artificial Sequence
  Description of Artificial Sequence: Synthetic oligonucleotide
  Target: ATXN1; (-) strand; PAM type: YTN; PAM sequence: TTT
gtaaacatttctatttagtc

SEQ ID NO: 215267 - DNA, 20 bp, Artificial Sequence
  Description of Artificial Sequence: Synthetic oligonucleotide
  Target: ATXN1; (-) strand; PAM type: YTN; PAM sequence: CTC
gacaacataatttgtaaaca

SEQ ID NO: 215268 - DNA, 20 bp, Artificial Sequence
  Description of Artificial Sequence: Synthetic oligonucleotide
  Target: ATXN1; (-) strand; PAM type: YTN; PAM sequence: TTA
acagctcgacaacataattt

SEQ ID NO: 215269 - DNA, 20 bp, Artificial Sequence
  Description of Artificial Sequence: Synthetic oligonucleotide
  Target: ATXN1; (-) strand; PAM type: YTN; PAM sequence: TTT
aacagctcgacaacataatt

SEQ ID NO: 215270 - DNA, 20 bp, Artificial Sequence
  Description of Artificial Sequence: Synthetic oligonucleotide
  Target: ATXN1; (-) strand; PAM type: YTN; PAM sequence: TTC
atttaacagctcgacaacat

SEQ ID NO: 215271 - DNA, 20 bp, Artificial Sequence
  Description of Artificial Sequence: Synthetic oligonucleotide
  Target: ATXN1; (-) strand; PAM type: YTN; PAM sequence: TTG
gaattcatttaacagctcga

SEQ ID NO: 215272 - DNA, 20 bp, Artificial Sequence
  Description of Artificial Sequence: Synthetic oligonucleotide
  Target: ATXN1; (-) strand; PAM type: YTN; PAM sequence: CTG
atgaggtagtaaagccacat

SEQ ID NO: 215273 - DNA, 20 bp, Artificial Sequence
  Description of Artificial Sequence: Synthetic oligonucleotide
  Target: ATXN1; (-) strand; PAM type: YTN; PAM sequence: TTC
ctgatgaggtagtaaagcca

SEQ ID NO: 215274 - DNA, 20 bp, Artificial Sequence
  Description of Artificial Sequence: Synthetic oligonucleotide
  Target: ATXN1; (-) strand; PAM type: YTN; PAM sequence: TTT
cctgatgaggtagtaaagcc

SEQ ID NO: 215275 - DNA, 20 bp, Artificial Sequence
  Description of Artificial Sequence: Synthetic oligonucleotide
  Target: ATXN1; (-) strand; PAM type: YTN; PAM sequence: TTT
tcctgatgaggtagtaaagc

SEQ ID NO: 215276 - DNA, 20 bp, Artificial Sequence
  Description of Artificial Sequence: Synthetic oligonucleotide
  Target: ATXN1; (-) strand; PAM type: YTN; PAM sequence: CTG
tgggatacaggttttcctga

SEQ ID NO: 215277 - DNA, 20 bp, Artificial Sequence
  Description of Artificial Sequence: Synthetic oligonucleotide
  Target: ATXN1; (-) strand; PAM type: YTN; PAM sequence: CTG
ataaatgactgtgggataca

SEQ ID NO: 215278 - DNA, 20 bp, Artificial Sequence
  Description of Artificial Sequence: Synthetic oligonucleotide
  Target: ATXN1; (-) strand; PAM type: YTN; PAM sequence: CTG
cctgataaatgactgtggga

SEQ ID NO: 215279 - DNA, 20 bp, Artificial Sequence
  Description of Artificial Sequence: Synthetic oligonucleotide
  Target: ATXN1; (-) strand; PAM type: YTN; PAM sequence: TTG
ctgcctgataaatgactgtg

SEQ ID NO: 215280 - DNA, 20 bp, Artificial Sequence
  Description of Artificial Sequence: Synthetic oligonucleotide
  Target: ATXN1; (-) strand; PAM type: YTN; PAM sequence: CTA
gacattgctgcctgataaat

SEQ ID NO: 215281 - DNA, 20 bp, Artificial Sequence
  Description of Artificial Sequence: Synthetic oligonucleotide
  Target: ATXN1; (-) strand; PAM type: YTN; PAM sequence: TTC
cataagctagacattgctgc

SEQ ID NO: 215282 - DNA, 20 bp, Artificial Sequence
  Description of Artificial Sequence: Synthetic oligonucleotide
  Target: ATXN1; (-) strand; PAM type: YTN; PAM sequence: TTT
ccataagctagacattgctg

SEQ ID NO: 215283 - DNA, 20 bp, Artificial Sequence
  Description of Artificial Sequence: Synthetic oligonucleotide
  Target: ATXN1; (-) strand; PAM type: YTN; PAM sequence: CTG
cagatgggtttccataagct

SEQ ID NO: 215284 - DNA, 20 bp, Artificial Sequence
  Description of Artificial Sequence: Synthetic oligonucleotide
  Target: ATXN1; (-) strand; PAM type: YTN; PAM sequence: TTA
ggaacctgcagatgggtttc

SEQ ID NO: 215285 - DNA, 20 bp, Artificial Sequence
  Description of Artificial Sequence: Synthetic oligonucleotide
  Target: ATXN1; (-) strand; PAM type: YTN; PAM sequence: CTT
aggaacctgcagatgggttt

SEQ ID NO: 215286 - DNA, 20 bp, Artificial Sequence
  Description of Artificial Sequence: Synthetic oligonucleotide
  Target: ATXN1; (-) strand; PAM type: YTN; PAM sequence: TTG
cttaggaacctgcagatggg

SEQ ID NO: 215287 - DNA, 20 bp, Artificial Sequence
  Description of Artificial Sequence: Synthetic oligonucleotide
  Target: ATXN1; (-) strand; PAM type: YTN; PAM sequence: CTT
gcttaggaacctgcagatgg

SEQ ID NO: 215288 - DNA, 20 bp, Artificial Sequence
  Description of Artificial Sequence: Synthetic oligonucleotide
  Target: ATXN1; (-) strand; PAM type: YTN; PAM sequence: CTA
cttgcttaggaacctgcaga

SEQ ID NO: 215289 - DNA, 20 bp, Artificial Sequence
  Description of Artificial Sequence: Synthetic oligonucleotide
  Target: ATXN1; (-) strand; PAM type: YTN; PAM sequence: CTG
ggctacttgcttaggaacct

SEQ ID NO: 215290 - DNA, 20 bp, Artificial Sequence
  Description of Artificial Sequence: Synthetic oligonucleotide
  Target: ATXN1; (-) strand; PAM type: YTN; PAM sequence: TTA
atctgggctacttgcttagg

SEQ ID NO: 215291 - DNA, 20 bp, Artificial Sequence
  Description of Artificial Sequence: Synthetic oligonucleotide
  Target: ATXN1; (-) strand; PAM type: YTN; PAM sequence: CTA
tgatattaatctgggctact

SEQ ID NO: 215292 - DNA, 20 bp, Artificial Sequence
  Description of Artificial Sequence: Synthetic oligonucleotide
  Target: ATXN1; (-) strand; PAM type: YTN; PAM sequence: CTG
cactatgatattaatctggg

SEQ ID NO: 215293 - DNA, 20 bp, Artificial Sequence
  Description of Artificial Sequence: Synthetic oligonucleotide
  Target: ATXN1; (-) strand; PAM type: YTN; PAM sequence: CTA
gctgcactatgatattaatc

SEQ ID NO: 215294 - DNA, 20 bp, Artificial Sequence
  Description of Artificial Sequence: Synthetic oligonucleotide
  Target: ATXN1; (-) strand; PAM type: YTN; PAM sequence: TTA
tagccaccgactagctgcac

SEQ ID NO: 215295 - DNA, 20 bp, Artificial Sequence
  Description of Artificial Sequence: Synthetic oligonucleotide
  Target: ATXN1; (-) strand; PAM type: YTN; PAM sequence: TTA
attatagccaccgactagct

SEQ ID NO: 215296 - DNA, 20 bp, Artificial Sequence
  Description of Artificial Sequence: Synthetic oligonucleotide
  Target: ATXN1; (-) strand; PAM type: YTN; PAM sequence: TTT
aattatagccaccgactagc

SEQ ID NO: 215297 - DNA, 20 bp, Artificial Sequence
  Description of Artificial Sequence: Synthetic oligonucleotide
  Target: ATXN1; (-) strand; PAM type: YTN; PAM sequence: CTG
catttaattatagccaccga

SEQ ID NO: 215298 - DNA, 20 bp, Artificial Sequence
  Description of Artificial Sequence: Synthetic oligonucleotide
  Target: ATXN1; (-) strand; PAM type: YTN; PAM sequence: TTC
tgcatttaattatagccacc

SEQ ID NO: 215299 - DNA, 20 bp, Artificial Sequence
  Description of Artificial Sequence: Synthetic oligonucleotide
  Target: ATXN1; (-) strand; PAM type: YTN; PAM sequence: CTT
ctgcatttaattatagccac

SEQ ID NO: 215300 - DNA, 20 bp, Artificial Sequence
  Description of Artificial Sequence: Synthetic oligonucleotide
  Target: ATXN1; (-) strand; PAM type: YTN; PAM sequence: CTC
aataccacttctgcatttaa

SEQ ID NO: 215301 - DNA, 20 bp, Artificial Sequence
  Description of Artificial Sequence: Synthetic oligonucleotide
  Target: ATXN1; (-) strand; PAM type: YTN; PAM sequence: CTC
tcaataccacttctgcattt

SEQ ID NO: 215302 - DNA, 20 bp, Artificial Sequence
  Description of Artificial Sequence: Synthetic oligonucleotide
  Target: ATXN1; (-) strand; PAM type: YTN; PAM sequence: TTC
acctctcaataccacttctg

SEQ ID NO: 215303 - DNA, 20 bp, Artificial Sequence
  Description of Artificial Sequence: Synthetic oligonucleotide
  Target: ATXN1; (-) strand; PAM type: YTN; PAM sequence: CTT
cacctctcaataccacttct

SEQ ID NO: 215304 - DNA, 20 bp, Artificial Sequence
  Description of Artificial Sequence: Synthetic oligonucleotide
  Target: ATXN1; (-) strand; PAM type: YTN; PAM sequence: CTG
gcttcacctctcaataccac

SEQ ID NO: 215305 - DNA, 20 bp, Artificial Sequence
  Description of Artificial Sequence: Synthetic oligonucleotide
  Target: ATXN1; (-) strand; PAM type: YTN; PAM sequence: CTC
gacccaagaagtccagctgg

SEQ ID NO: 215306 - DNA, 20 bp, Artificial Sequence
  Description of Artificial Sequence: Synthetic oligonucleotide
  Target: ATXN1; (-) strand; PAM type: YTN; PAM sequence: CTC
caagtccccactcgacccaa

SEQ ID NO: 215307 - DNA, 20 bp, Artificial Sequence
  Description of Artificial Sequence: Synthetic oligonucleotide
  Target: ATXN1; (-) strand; PAM type: YTN; PAM sequence: TTC
tccaagtccccactcgaccc

SEQ ID NO: 215308 - DNA, 20 bp, Artificial Sequence
  Description of Artificial Sequence: Synthetic oligonucleotide
  Target: ATXN1; (-) strand; PAM type: YTN; PAM sequence: TTG
taagacagaaaagttctcca

SEQ ID NO: 215309 - DNA, 20 bp, Artificial Sequence
  Description of Artificial Sequence: Synthetic oligonucleotide
  Target: ATXN1; (-) strand; PAM type: YTN; PAM sequence: CTT
gtaagacagaaaagttctcc

SEQ ID NO: 215310 - DNA, 20 bp, Artificial Sequence
  Description of Artificial Sequence: Synthetic oligonucleotide
  Target: ATXN1; (-) strand; PAM type: YTN; PAM sequence: TTA
caatccccttgtaagacaga

SEQ ID NO: 215311 - DNA, 20 bp, Artificial Sequence
  Description of Artificial Sequence: Synthetic oligonucleotide
  Target: ATXN1; (-) strand; PAM type: YTN; PAM sequence: TTT
acaatccccttgtaagacag

SEQ ID NO: 215312 - DNA, 20 bp, Artificial Sequence
  Description of Artificial Sequence: Synthetic oligonucleotide
  Target: ATXN1; (-) strand; PAM type: YTN; PAM sequence: TTT
tacaatccccttgtaagaca

SEQ ID NO: 215313 - DNA, 20 bp, Artificial Sequence
  Description of Artificial Sequence: Synthetic oligonucleotide
  Target: ATXN1; (-) strand; PAM type: YTN; PAM sequence: TTG
gtgcattttacaatcccctt

SEQ ID NO: 215314 - DNA, 20 bp, Artificial Sequence
  Description of Artificial Sequence: Synthetic oligonucleotide
  Target: ATXN1; (-) strand; PAM type: YTN; PAM sequence: CTC
attggtgcattttacaatcc

SEQ ID NO: 215315 - DNA, 20 bp, Artificial Sequence
  Description of Artificial Sequence: Synthetic oligonucleotide
  Target: ATXN1; (-) strand; PAM type: YTN; PAM sequence: TTA
cagagcactcattggtgcat

SEQ ID NO: 215316 - DNA, 20 bp, Artificial Sequence
  Description of Artificial Sequence: Synthetic oligonucleotide
  Target: ATXN1; (-) strand; PAM type: YTN; PAM sequence: TTT
acagagcactcattggtgca

SEQ ID NO: 215317 - DNA, 20 bp, Artificial Sequence
  Description of Artificial Sequence: Synthetic oligonucleotide
  Target: ATXN1; (-) strand; PAM type: YTN; PAM sequence: TTT
tacagagcactcattggtgc

SEQ ID NO: 215318 - DNA, 20 bp, Artificial Sequence
  Description of Artificial Sequence: Synthetic oligonucleotide
  Target: ATXN1; (-) strand; PAM type: YTN; PAM sequence: TTT
ttacagagcactcattggtg

SEQ ID NO: 215319 - DNA, 20 bp, Artificial Sequence
  Description of Artificial Sequence: Synthetic oligonucleotide
  Target: ATXN1; (-) strand; PAM type: YTN; PAM sequence: TTG
gtgtgtttttacagagcact

SEQ ID NO: 215320 - DNA, 20 bp, Artificial Sequence
  Description of Artificial Sequence: Synthetic oligonucleotide
  Target: ATXN1; (-) strand; PAM type: YTN; PAM sequence: CTG
attggtgtgtttttacagag

SEQ ID NO: 215321 - DNA, 20 bp, Artificial Sequence
  Description of Artificial Sequence: Synthetic oligonucleotide
  Target: ATXN1; (-) strand; PAM type: YTN; PAM sequence: CTA
cagagcgctgattggtgtgt

SEQ ID NO: 215322 - DNA, 20 bp, Artificial Sequence
  Description of Artificial Sequence: Synthetic oligonucleotide
  Target: ATXN1; (-) strand; PAM type: YTN; PAM sequence: CTA
gctacagagcgctgattggt

SEQ ID NO: 215323 - DNA, 20 bp, Artificial Sequence
  Description of Artificial Sequence: Synthetic oligonucleotide
  Target: ATXN1; (-) strand; PAM type: YTN; PAM sequence: CTC
aagctagctacagagcgctg

SEQ ID NO: 215324 - DNA, 20 bp, Artificial Sequence
  Description of Artificial Sequence: Synthetic oligonucleotide
  Target: ATXN1; (-) strand; PAM type: YTN; PAM sequence: TTA
caaacctcaagctagctaca

SEQ ID NO: 215325 - DNA, 20 bp, Artificial Sequence
  Description of Artificial Sequence: Synthetic oligonucleotide
  Target: ATXN1; (-) strand; PAM type: YTN; PAM sequence: TTT
acaaacctcaagctagctac

SEQ ID NO: 215326 - DNA, 20 bp, Artificial Sequence
  Description of Artificial Sequence: Synthetic oligonucleotide
  Target: ATXN1; (-) strand; PAM type: YTN; PAM sequence: TTT
tacaaacctcaagctagcta

SEQ ID NO: 215327 - DNA, 20 bp, Artificial Sequence
  Description of Artificial Sequence: Synthetic oligonucleotide
  Target: ATXN1; (-) strand; PAM type: YTN; PAM sequence: TTG
gtccattttacaaacctcaa

SEQ ID NO: 215328 - DNA, 20 bp, Artificial Sequence
  Description of Artificial Sequence: Synthetic oligonucleotide
  Target: ATXN1; (-) strand; PAM type: YTN; PAM sequence: CTG
attggtccattttacaaacc

SEQ ID NO: 215329 - DNA, 20 bp, Artificial Sequence
  Description of Artificial Sequence: Synthetic oligonucleotide
  Target: ATXN1; (-) strand; PAM type: YTN; PAM sequence: TTA
cagagtgctgattggtccat

SEQ ID NO: 215330 - DNA, 20 bp, Artificial Sequence
  Description of Artificial Sequence: Synthetic oligonucleotide
  Target: ATXN1; (-) strand; PAM type: YTN; PAM sequence: TTT
acagagtgctgattggtcca

SEQ ID NO: 215331 - DNA, 20 bp, Artificial Sequence
  Description of Artificial Sequence: Synthetic oligonucleotide
  Target: ATXN1; (-) strand; PAM type: YTN; PAM sequence: TTT
tacagagtgctgattggtcc

SEQ ID NO: 215332 - DNA, 20 bp, Artificial Sequence
  Description of Artificial Sequence: Synthetic oligonucleotide
  Target: ATXN1; (-) strand; PAM type: YTN; PAM sequence: TTG
gtccattttacagagtgctg

SEQ ID NO: 215333 - DNA, 20 bp, Artificial Sequence
  Description of Artificial Sequence: Synthetic oligonucleotide
  Target: ATXN1; (-) strand; PAM type: YTN; PAM sequence: CTG
attggtccattttacagagt

SEQ ID NO: 215334 - DNA, 20 bp, Artificial Sequence
  Description of Artificial Sequence: Synthetic oligonucleotide
  Target: ATXN1; (-) strand; PAM type: YTN; PAM sequence: CTA
cagagcactgattggtccat

SEQ ID NO: 215335 - DNA, 20 bp, Artificial Sequence
  Description of Artificial Sequence: Synthetic oligonucleotide
  Target: ATXN1; (-) strand; PAM type: YTN; PAM sequence: TTC
tacagagcactgattggtcc

SEQ ID NO: 215336 - DNA, 20 bp, Artificial Sequence
  Description of Artificial Sequence: Synthetic oligonucleotide
  Target: ATXN1; (-) strand; PAM type: YTN; PAM sequence: TTG
gtccattctacagagcactg

SEQ ID NO: 215337 - DNA, 20 bp, Artificial Sequence
  Description of Artificial Sequence: Synthetic oligonucleotide
  Target: ATXN1; (-) strand; PAM type: YTN; PAM sequence: CTG
attggtccattctacagagc

SEQ ID NO: 215338 - DNA, 20 bp, Artificial Sequence
  Description of Artificial Sequence: Synthetic oligonucleotide
  Target: ATXN1; (-) strand; PAM type: YTN; PAM sequence: CTG
ctgattggtccattctacag

SEQ ID NO: 215339 - DNA, 20 bp, Artificial Sequence
  Description of Artificial Sequence: Synthetic oligonucleotide
  Target: ATXN1; (-) strand; PAM type: YTN; PAM sequence: CTG
cccatgtcctgctgattggt

SEQ ID NO: 215340 - DNA, 20 bp, Artificial Sequence
  Description of Artificial Sequence: Synthetic oligonucleotide
  Target: ATXN1; (-) strand; PAM type: YTN; PAM sequence: TTG
tccctgcccatgtcctgctg

SEQ ID NO: 215341 - DNA, 20 bp, Artificial Sequence
  Description of Artificial Sequence: Synthetic oligonucleotide
  Target: ATXN1; (-) strand; PAM type: YTN; PAM sequence: TTT
gtccctgcccatgtcctgct

SEQ ID NO: 215342 - DNA, 20 bp, Artificial Sequence
  Description of Artificial Sequence: Synthetic oligonucleotide
  Target: ATXN1; (-) strand; PAM type: YTN; PAM sequence: TTA
tttgtccctgcccatgtcct

SEQ ID NO: 215343 - DNA, 20 bp, Artificial Sequence
  Description of Artificial Sequence: Synthetic oligonucleotide
  Target: ATXN1; (-) strand; PAM type: YTN; PAM sequence: CTT
atttgtccctgcccatgtcc

SEQ ID NO: 215344 - DNA, 20 bp, Artificial Sequence
  Description of Artificial Sequence: Synthetic oligonucleotide
  Target: ATXN1; (-) strand; PAM type: YTN; PAM sequence: TTC
ccttatttgtccctgcccat

SEQ ID NO: 215345 - DNA, 20 bp, Artificial Sequence
  Description of Artificial Sequence: Synthetic oligonucleotide
  Target: ATXN1; (-) strand; PAM type: YTN; PAM sequence: TTA
ttcccttatttgtccctgcc

SEQ ID NO: 215346 - DNA, 20 bp, Artificial Sequence
  Description of Artificial Sequence: Synthetic oligonucleotide
  Target: ATXN1; (-) strand; PAM type: YTN; PAM sequence: TTT
attcccttatttgtccctgc

SEQ ID NO: 215347 - DNA, 20 bp, Artificial Sequence
  Description of Artificial Sequence: Synthetic oligonucleotide
  Target: ATXN1; (-) strand; PAM type: YTN; PAM sequence: TTT
tattcccttatttgtccctg

SEQ ID NO: 215348 - DNA, 20 bp, Artificial Sequence
  Description of Artificial Sequence: Synthetic oligonucleotide
  Target: ATXN1; (-) strand; PAM type: YTN; PAM sequence: CTT
ttattcccttatttgtccct

SEQ ID NO: 215349 - DNA, 20 bp, Artificial Sequence
  Description of Artificial Sequence: Synthetic oligonucleotide
  Target: ATXN1; (-) strand; PAM type: YTN; PAM sequence: CTG
gcgtggccagcttttattcc

SEQ ID NO: 215350 - DNA, 20 bp, Artificial Sequence
  Description of Artificial Sequence: Synthetic oligonucleotide
  Target: ATXN1; (-) strand; PAM type: YTN; PAM sequence: CTG
gctggcgtggccagctttta

SEQ ID NO: 215351 - DNA, 20 bp, Artificial Sequence
  Description of Artificial Sequence: Synthetic oligonucleotide
  Target: ATXN1; (-) strand; PAM type: YTN; PAM sequence: CTG
ctggctggcgtggccagctt

SEQ ID NO: 215352 - DNA, 20 bp, Artificial Sequence
  Description of Artificial Sequence: Synthetic oligonucleotide
  Target: ATXN1; (-) strand; PAM type: YTN; PAM sequence: CTC
tgctggctggcgtggccagc

SEQ ID NO: 215353 - DNA, 20 bp, Artificial Sequence
  Description of Artificial Sequence: Synthetic oligonucleotide
  Target: ATXN1; (-) strand; PAM type: YTN; PAM sequence: TTG
tctctgctggctggcgtggc

SEQ ID NO: 215354 - DNA, 20 bp, Artificial Sequence
  Description of Artificial Sequence: Synthetic oligonucleotide
  Target: ATXN1; (-) strand; PAM type: YTN; PAM sequence: TTC
cacagcgtggaaggggaccc

SEQ ID NO: 215355 - DNA, 20 bp, Artificial Sequence
  Description of Artificial Sequence: Synthetic oligonucleotide
  Target: ATXN1; (-) strand; PAM type: YTN; PAM sequence: CTT
ccacagcgtggaaggggacc

SEQ ID NO: 215356 - DNA, 20 bp, Artificial Sequence
  Description of Artificial Sequence: Synthetic oligonucleotide
  Target: ATXN1; (-) strand; PAM type: YTN; PAM sequence: TTG
tgaggagcgaaagaacaaac

SEQ ID NO: 215357 - DNA, 20 bp, Artificial Sequence
  Description of Artificial Sequence: Synthetic oligonucleotide
  Target: ATXN1; (-) strand; PAM type: YTN; PAM sequence: TTA
ttgtgaggagcgaaagaaca

SEQ ID NO: 215358 - DNA, 20 bp, Artificial Sequence
  Description of Artificial Sequence: Synthetic oligonucleotide
  Target: ATXN1; (-) strand; PAM type: YTN; PAM sequence: TTT
attgtgaggagcgaaagaac

SEQ ID NO: 215359 - DNA, 20 bp, Artificial Sequence
  Description of Artificial Sequence: Synthetic oligonucleotide
  Target: ATXN1; (-) strand; PAM type: YTN; PAM sequence: TTA
aagatggtagggacccaaag

SEQ ID NO: 215360 - DNA, 20 bp, Artificial Sequence
  Description of Artificial Sequence: Synthetic oligonucleotide
  Target: ATXN1; (-) strand; PAM type: YTN; PAM sequence: CTT
aaagatggtagggacccaaa

SEQ ID NO: 215361 - DNA, 20 bp, Artificial Sequence
  Description of Artificial Sequence: Synthetic oligonucleotide
  Target: ATXN1; (-) strand; PAM type: YTN; PAM sequence: CTC
ttaaagatggtagggaccca

SEQ ID NO: 215362 - DNA, 20 bp, Artificial Sequence
  Description of Artificial Sequence: Synthetic oligonucleotide
  Target: ATXN1; (-) strand; PAM type: YTN; PAM sequence: TTA
cagctcttaaagatggtagg

SEQ ID NO: 215363 - DNA, 20 bp, Artificial Sequence
  Description of Artificial Sequence: Synthetic oligonucleotide
  Target: ATXN1; (-) strand; PAM type: YTN; PAM sequence: TTC
acagtgagtgttacagctct

SEQ ID NO: 215364 - DNA, 20 bp, Artificial Sequence
  Description of Artificial Sequence: Synthetic oligonucleotide
  Target: ATXN1; (-) strand; PAM type: YTN; PAM sequence: CTT
cacagtgagtgttacagctc

SEQ ID NO: 215365 - DNA, 20 bp, Artificial Sequence
  Description of Artificial Sequence: Synthetic oligonucleotide
  Target: ATXN1; (-) strand; PAM type: YTN; PAM sequence: TTC
aagaatggagccacggacct

SEQ ID NO: 215366 - DNA, 20 bp, Artificial Sequence
  Description of Artificial Sequence: Synthetic oligonucleotide
  Target: ATXN1; (-) strand; PAM type: YTN; PAM sequence: CTT
caagaatggagccacggacc

SEQ ID NO: 215367 - DNA, 20 bp, Artificial Sequence
  Description of Artificial Sequence: Synthetic oligonucleotide
  Target: ATXN1; (-) strand; PAM type: YTN; PAM sequence: CTG
acttcaagaatggagccacg

SEQ ID NO: 215368 - DNA, 20 bp, Artificial Sequence
  Description of Artificial Sequence: Synthetic oligonucleotide
  Target: ATXN1; (-) strand; PAM type: YTN; PAM sequence: TTG
ctgacttcaagaatggagcc

SEQ ID NO: 215369 - DNA, 20 bp, Artificial Sequence
  Description of Artificial Sequence: Synthetic oligonucleotide
  Target: ATXN1; (-) strand; PAM type: YTN; PAM sequence: CTT
gctgacttcaagaatggagc

SEQ ID NO: 215370 - DNA, 20 bp, Artificial Sequence
  Description of Artificial Sequence: Synthetic oligonucleotide
  Target: ATXN1; (-) strand; PAM type: YTN; PAM sequence: TTG
tggtcttgctgacttcaaga

SEQ ID NO: 215371 - DNA, 20 bp, Artificial Sequence
  Description of Artificial Sequence: Synthetic oligonucleotide
  Target: ATXN1; (-) strand; PAM type: YTN; PAM sequence: TTT
gtggtcttgctgacttcaag

SEQ ID NO: 215372 - DNA, 20 bp, Artificial Sequence
  Description of Artificial Sequence: Synthetic oligonucleotide
  Target: ATXN1; (-) strand; PAM type: YTN; PAM sequence: TTC
cgataggtttgtggtcttgc

SEQ ID NO: 215373 - DNA, 20 bp, Artificial Sequence
  Description of Artificial Sequence: Synthetic oligonucleotide
  Target: ATXN1; (-) strand; PAM type: YTN; PAM sequence: CTT
ccgataggtttgtggtcttg

SEQ ID NO: 215374 - DNA, 20 bp, Artificial Sequence
  Description of Artificial Sequence: Synthetic oligonucleotide
  Target: ATXN1; (-) strand; PAM type: YTN; PAM sequence: TTC
cttccgataggtttgtggtc

SEQ ID NO: 215375 - DNA, 20 bp, Artificial Sequence
  Description of Artificial Sequence: Synthetic oligonucleotide
  Target: ATXN1; (-) strand; PAM type: YTN; PAM sequence: TTG
gttccttccgataggtttgt

SEQ ID NO: 215376 - DNA, 20 bp, Artificial Sequence
  Description of Artificial Sequence: Synthetic oligonucleotide
  Target: ATXN1; (-) strand; PAM type: YTN; PAM sequence: CTG
gagttggttccttccgatag

SEQ ID NO: 215377 - DNA, 20 bp, Artificial Sequence
  Description of Artificial Sequence: Synthetic oligonucleotide
  Target: ATXN1; (-) strand; PAM type: YTN; PAM sequence: CTG
tgtctggagttggttccttc

SEQ ID NO: 215378 - DNA, 20 bp, Artificial Sequence
  Description of Artificial Sequence: Synthetic oligonucleotide
  Target: ATXN1; (-) strand; PAM type: YTN; PAM sequence: TTG
cggtgagcctgtgtctggag

SEQ ID NO: 215379 - DNA, 20 bp, Artificial Sequence
  Description of Artificial Sequence: Synthetic oligonucleotide
  Target: ATXN1; (-) strand; PAM type: YTN; PAM sequence: CTA
ggaggtggaggttgcggtga

SEQ ID NO: 215380 - DNA, 20 bp, Artificial Sequence
  Description of Artificial Sequence: Synthetic oligonucleotide
  Target: ATXN1; (-) strand; PAM type: YTN; PAM sequence: TTG
aacctaggaggtggaggttg

SEQ ID NO: 215381 - DNA, 20 bp, Artificial Sequence
  Description of Artificial Sequence: Synthetic oligonucleotide
  Target: ATXN1; (-) strand; PAM type: YTN; PAM sequence: CTT
gaacctaggaggtggaggtt

SEQ ID NO: 215382 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgcttgaa

SEQ ID NO: 215383 - DNA, 20 bp, Artificial Sequence
  Description of Artificial Sequence: Synthetic oligonucleotide
  Target: ATXN1; (-) strand; PAM type: YTN; PAM sequence: TTA
ggcggctgaggcaggagaat

SEQ ID NO: 215384 - DNA, 20 bp, Artificial Sequence
  Description of Artificial Sequence: Synthetic oligonucleotide
  Target: ATXN1; (-) strand; PAM type: YTN; PAM sequence: CTT
aggcggctgaggcaggagaa

SEQ ID NO: 215385 - DNA, 20 bp, Artificial Sequence
  Description of Artificial Sequence: Synthetic oligonucleotide
  Target: ATXN1; (-) strand; PAM type: YTN; PAM sequence: CTA
cttaggcggctgaggcagga

SEQ ID NO: 215386 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacttaggcg

SEQ ID NO: 215387 - DNA, 20 bp, Artificial Sequence
  Description of Artificial Sequence: Synthetic oligonucleotide
  Target: ATXN1; (-) strand; PAM type: YTN; PAM sequence: TTA
gccgggtgtggtggggcatg

SEQ ID NO: 215388 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaattagccggg

SEQ ID NO: 215389 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaattagcc

SEQ ID NO: 215390 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaattag

SEQ ID NO: 215391 - DNA, 20 bp, Artificial Sequence
  Description of Artificial Sequence: Synthetic oligonucleotide
  Target: ATXN1; (-) strand; PAM type: YTN; PAM sequence: CTG
accaacatggagaaacccca

SEQ ID NO: 215392 - DNA, 20 bp, Artificial Sequence
  Description of Artificial Sequence: Synthetic oligonucleotide
  Target: ATXN1; (-) strand; PAM type: YTN; PAM sequence: TTC
aagaaccagcctgaccaaca

SEQ ID NO: 215393 - DNA, 20 bp, Artificial Sequence
  Description of Artificial Sequence: Synthetic oligonucleotide
  Target: ATXN1; (-) strand; PAM type: YTN; PAM sequence: TTG
ggagttcaagaaccagcctg

SEQ ID NO: 215394 - DNA, 20 bp, Artificial Sequence
  Description of Artificial Sequence: Synthetic oligonucleotide
  Target: ATXN1; (-) strand; PAM type: YTN; PAM sequence: CTG
aggttgggagttcaagaacc

SEQ ID NO: 215395 - DNA, 20 bp, Artificial Sequence
  Description of Artificial Sequence: Synthetic oligonucleotide
  Target: ATXN1; (-) strand; PAM type: YTN; PAM sequence: CTG
aggcaggcgaatcacctgag

SEQ ID NO: 215396 - DNA, 20 bp, Artificial Sequence
  Description of Artificial Sequence: Synthetic oligonucleotide
  Target: ATXN1; (-) strand; PAM type: YTN; PAM sequence: TTG
ggaagctgaggcaggcgaat

SEQ ID NO: 215397 - DNA, 20 bp, Artificial Sequence
  Description of Artificial Sequence: Synthetic oligonucleotide
  Target: ATXN1; (-) strand; PAM type: YTN; PAM sequence: CTT
gggaagctgaggcaggcgaa

SEQ ID NO: 215398 - DNA, 20 bp, Artificial Sequence
  Description of Artificial Sequence: Synthetic oligonucleotide
  Target: ATXN1; (-) strand; PAM type: YTN; PAM sequence: CTG
taatcccagcaccttgggaa

SEQ ID NO: 215399 - DNA, 20 bp, Artificial Sequence
  Description of Artificial Sequence: Synthetic oligonucleotide
  Target: ATXN1; (-) strand; PAM type: YTN; PAM sequence: CTC
aggcctgtaatcccagcacc

SEQ ID NO: 215400 - DNA, 20 bp, Artificial Sequence
  Description of Artificial Sequence: Synthetic oligonucleotide
  Target: ATXN1; (-) strand; PAM type: YTN; PAM sequence: TTA
agaaagaaacccaggggccg

SEQ ID NO: 215401 - DNA, 20 bp, Artificial Sequence
  Description of Artificial Sequence: Synthetic oligonucleotide
  Target: ATXN1; (-) strand; PAM type: YTN; PAM sequence: CTT
aagaaagaaacccaggggcc

SEQ ID NO: 215402 - DNA, 20 bp, Artificial Sequence
  Description of Artificial Sequence: Synthetic oligonucleotide
  Target: ATXN1; (-) strand; PAM type: YTN; PAM sequence: CTC
caaaagccttaagaaagaaa

SEQ ID NO: 215403 - DNA, 20 bp, Artificial Sequence
  Description of Artificial Sequence: Synthetic oligonucleotide
  Target: ATXN1; (-) strand; PAM type: YTN; PAM sequence: TTG
gagctccaaaagccttaaga

SEQ ID NO: 215404 - DNA, 20 bp, Artificial Sequence
  Description of Artificial Sequence: Synthetic oligonucleotide
  Target: ATXN1; (-) strand; PAM type: YTN; PAM sequence: CTT
ggagctccaaaagccttaag

SEQ ID NO: 215405 - DNA, 20 bp, Artificial Sequence
  Description of Artificial Sequence: Synthetic oligonucleotide
  Target: ATXN1; (-) strand; PAM type: YTN; PAM sequence: CTG
gccccttggagctccaaaag

SEQ ID NO: 215406 - DNA, 20 bp, Artificial Sequence
  Description of Artificial Sequence: Synthetic oligonucleotide
  Target: ATXN1; (-) strand; PAM type: YTN; PAM sequence: TTC
cctggccccttggagctcca

SEQ ID NO: 215407 - DNA, 20 bp, Artificial Sequence
  Description of Artificial Sequence: Synthetic oligonucleotide
  Target: ATXN1; (-) strand; PAM type: YTN; PAM sequence: CTT
ccctggccccttggagctcc

SEQ ID NO: 215408 - DNA, 20 bp, Artificial Sequence
  Description of Artificial Sequence: Synthetic oligonucleotide
  Target: ATXN1; (-) strand; PAM type: YTN; PAM sequence: CTG
cacttccctggccccttgga

SEQ ID NO: 215409 - DNA, 20 bp, Artificial Sequence
  Description of Artificial Sequence: Synthetic oligonucleotide
  Target: ATXN1; (-) strand; PAM type: YTN; PAM sequence: TTG
aagctgcacttccctggccc

SEQ ID NO: 215410 - DNA, 20 bp, Artificial Sequence
  Description of Artificial Sequence: Synthetic oligonucleotide
  Target: ATXN1; (-) strand; PAM type: YTN; PAM sequence: CTG
gttgaagctgcacttccctg

SEQ ID NO: 215411 - DNA, 20 bp, Artificial Sequence
  Description of Artificial Sequence: Synthetic oligonucleotide
  Target: ATXN1; (-) strand; PAM type: YTN; PAM sequence: CTG
ctggttgaagctgcacttcc

SEQ ID NO: 215412 - DNA, 20 bp, Artificial Sequence
  Description of Artificial Sequence: Synthetic oligonucleotide
  Target: ATXN1; (-) strand; PAM type: YTN; PAM sequence: CTG
ctgctggttgaagctgcact

SEQ ID NO: 215413 - DNA, 20 bp, Artificial Sequence
  Description of Artificial Sequence: Synthetic oligonucleotide
  Target: ATXN1; (-) strand; PAM type: YTN; PAM sequence: TTA
gaacaatggctgctgctggt

SEQ ID NO: 215414 - DNA, 20 bp, Artificial Sequence
  Description of Artificial Sequence: Synthetic oligonucleotide
  Target: ATXN1; (-) strand; PAM type: YTN; PAM sequence: CTG
ttagaacaatggctgctgct

SEQ ID NO: 215415 - DNA, 20 bp, Artificial Sequence
  Description of Artificial Sequence: Synthetic oligonucleotide
  Target: ATXN1; (-) strand; PAM type: YTN; PAM sequence: TTC
tgttagaacaatggctgctg

SEQ ID NO: 215416 - DNA, 20 bp, Artificial Sequence
  Description of Artificial Sequence: Synthetic oligonucleotide
  Target: ATXN1; (-) strand; PAM type: YTN; PAM sequence: TTT
ctgttagaacaatggctgct

SEQ ID NO: 215417 - DNA, 20 bp, Artificial Sequence
  Description of Artificial Sequence: Synthetic oligonucleotide
  Target: ATXN1; (-) strand; PAM type: YTN; PAM sequence: TTC
agatttctgttagaacaatg

SEQ ID NO: 215418 - DNA, 20 bp, Artificial Sequence
  Description of Artificial Sequence: Synthetic oligonucleotide
  Target: ATXN1; (-) strand; PAM type: YTN; PAM sequence: TTT
cagatttctgttagaacaat

SEQ ID NO: 215419 - DNA, 20 bp, Artificial Sequence
  Description of Artificial Sequence: Synthetic oligonucleotide
  Target: ATXN1; (-) strand; PAM type: YTN; PAM sequence: TTT
tcagatttctgttagaacaa

SEQ ID NO: 215420 - DNA, 20 bp, Artificial Sequence
  Description of Artificial Sequence: Synthetic oligonucleotide
  Target: ATXN1; (-) strand; PAM type: YTN; PAM sequence: TTA
ttttcagatttctgttagaa

SEQ ID NO: 215421 - DNA, 20 bp, Artificial Sequence
  Description of Artificial Sequence: Synthetic oligonucleotide
  Target: ATXN1; (-) strand; PAM type: YTN; PAM sequence: TTG
gcatgtcagagtgaatgtgt

SEQ ID NO: 215422 - DNA, 20 bp, Artificial Sequence
  Description of Artificial Sequence: Synthetic oligonucleotide
  Target: ATXN1; (-) strand; PAM type: YTN; PAM sequence: TTA
aaagtagtgagttggcatgt

SEQ ID NO: 215423 - DNA, 20 bp, Artificial Sequence
  Description of Artificial Sequence: Synthetic oligonucleotide
  Target: ATXN1; (-) strand; PAM type: YTN; PAM sequence: TTA
atgagccacaattaaaagta

SEQ ID NO: 215424 - DNA, 20 bp, Artificial Sequence
  Description of Artificial Sequence: Synthetic oligonucleotide
  Target: ATXN1; (-) strand; PAM type: YTN; PAM sequence: TTT
aatgagccacaattaaaagt

SEQ ID NO: 215425 - DNA, 20 bp, Artificial Sequence
  Description of Artificial Sequence: Synthetic oligonucleotide
  Target: ATXN1; (-) strand; PAM type: YTN; PAM sequence: CTT
taatgagccacaattaaaag

SEQ ID NO: 215426 - DNA, 20 bp, Artificial Sequence
  Description of Artificial Sequence: Synthetic oligonucleotide
  Target: ATXN1; (-) strand; PAM type: YTN; PAM sequence: TTA
catctttaatgagccacaat

SEQ ID NO: 215427 - DNA, 20 bp, Artificial Sequence
  Description of Artificial Sequence: Synthetic oligonucleotide
  Target: ATXN1; (-) strand; PAM type: YTN; PAM sequence: TTT
acatctttaatgagccacaa

SEQ ID NO: 215428 - DNA, 20 bp, Artificial Sequence
  Description of Artificial Sequence: Synthetic oligonucleotide
  Target: ATXN1; (-) strand; PAM type: YTN; PAM sequence: CTA
tttacatctttaatgagcca

SEQ ID NO: 215429 - DNA, 20 bp, Artificial Sequence
  Description of Artificial Sequence: Synthetic oligonucleotide
  Target: ATXN1; (-) strand; PAM type: YTN; PAM sequence: TTC
tatttacatctttaatgagc

SEQ ID NO: 215430 - DNA, 20 bp, Artificial Sequence
  Description of Artificial Sequence: Synthetic oligonucleotide
  Target: ATXN1; (-) strand; PAM type: YTN; PAM sequence: CTT
ctatttacatctttaatgag

SEQ ID NO: 215431 - DNA, 20 bp, Artificial Sequence
  Description of Artificial Sequence: Synthetic oligonucleotide
  Target: ATXN1; (-) strand; PAM type: YTN; PAM sequence: TTC
ttctatttacatctttaatg

SEQ ID NO: 215432 - DNA, 20 bp, Artificial Sequence
  Description of Artificial Sequence: Synthetic oligonucleotide
  Target: ATXN1; (-) strand; PAM type: YTN; PAM sequence: TTG
tagtagaggtgaacataatt

SEQ ID NO: 215433 - DNA, 20 bp, Artificial Sequence
  Description of Artificial Sequence: Synthetic oligonucleotide
  Target: ATXN1; (-) strand; PAM type: YTN; PAM sequence: CTG
cagcaatgaaattgtagtag

SEQ ID NO: 215434 - DNA, 20 bp, Artificial Sequence
  Description of Artificial Sequence: Synthetic oligonucleotide
  Target: ATXN1; (-) strand; PAM type: YTN; PAM sequence: TTA
ctgcagcaatgaaattgtag

SEQ ID NO: 215435 - DNA, 20 bp, Artificial Sequence
  Description of Artificial Sequence: Synthetic oligonucleotide
  Target: ATXN1; (-) strand; PAM type: YTN; PAM sequence: TTT
actgcagcaatgaaattgta

SEQ ID NO: 215436 - DNA, 20 bp, Artificial Sequence
  Description of Artificial Sequence: Synthetic oligonucleotide
  Target: ATXN1; (-) strand; PAM type: YTN; PAM sequence: TTT
tactgcagcaatgaaattgt

SEQ ID NO: 215437 - DNA, 20 bp, Artificial Sequence
  Description of Artificial Sequence: Synthetic oligonucleotide
  Target: ATXN1; (-) strand; PAM type: YTN; PAM sequence: TTG
taattttactgcagcaatga

SEQ ID NO: 215438 - DNA, 20 bp, Artificial Sequence
  Description of Artificial Sequence: Synthetic oligonucleotide
  Target: ATXN1; (-) strand; PAM type: YTN; PAM sequence: CTG
catagaaggaaacattgtaa

SEQ ID NO: 215439 - DNA, 20 bp, Artificial Sequence
  Description of Artificial Sequence: Synthetic oligonucleotide
  Target: ATXN1; (-) strand; PAM type: YTN; PAM sequence: TTC
tgcatagaaggaaacattgt

SEQ ID NO: 215440 - DNA, 20 bp, Artificial Sequence
  Description of Artificial Sequence: Synthetic oligonucleotide
  Target: ATXN1; (-) strand; PAM type: YTN; PAM sequence: TTT
ctgcatagaaggaaacattg

SEQ ID NO: 215441 - DNA, 20 bp, Artificial Sequence
  Description of Artificial Sequence: Synthetic oligonucleotide
  Target: ATXN1; (-) strand; PAM type: YTN; PAM sequence: CTT
tctgcatagaaggaaacatt

SEQ ID NO: 215442 - DNA, 20 bp, Artificial Sequence
  Description of Artificial Sequence: Synthetic oligonucleotide
  Target: ATXN1; (-) strand; PAM type: YTN; PAM sequence: TTC
tttctgcatagaaggaaaca

SEQ ID NO: 215443 - DNA, 20 bp, Artificial Sequence
  Description of Artificial Sequence: Synthetic oligonucleotide
  Target: ATXN1; (-) strand; PAM type: YTN; PAM sequence: TTT
ctttctgcatagaaggaaac

SEQ ID NO: 215444 - DNA, 20 bp, Artificial Sequence
  Description of Artificial Sequence: Synthetic oligonucleotide
  Target: ATXN1; (-) strand; PAM type: YTN; PAM sequence: CTC
agagaagaagtatttctttc

SEQ ID NO: 215445 - DNA, 20 bp, Artificial Sequence
  Description of Artificial Sequence: Synthetic oligonucleotide
  Target: ATXN1; (-) strand; PAM type: YTN; PAM sequence: TTA
ctcagagaagaagtatttct

SEQ ID NO: 215446 - DNA, 20 bp, Artificial Sequence
  Description of Artificial Sequence: Synthetic oligonucleotide
  Target: ATXN1; (-) strand; PAM type: YTN; PAM sequence: CTA
ttactcagagaagaagtatt

SEQ ID NO: 215447 - DNA, 20 bp, Artificial Sequence
  Description of Artificial Sequence: Synthetic oligonucleotide
  Target: ATXN1; (-) strand; PAM type: YTN; PAM sequence: CTG
gtgctattactcagagaaga

SEQ ID NO: 215448 - DNA, 20 bp, Artificial Sequence
  Description of Artificial Sequence: Synthetic oligonucleotide
  Target: ATXN1; (-) strand; PAM type: YTN; PAM sequence: TTC
tggtgctattactcagagaa

SEQ ID NO: 215449 - DNA, 20 bp, Artificial Sequence
  Description of Artificial Sequence: Synthetic oligonucleotide
  Target: ATXN1; (-) strand; PAM type: YTN; PAM sequence: CTT
ctggtgctattactcagaga

SEQ ID NO: 215450 - DNA, 20 bp, Artificial Sequence
  Description of Artificial Sequence: Synthetic oligonucleotide
  Target: ATXN1; (-) strand; PAM type: YTN; PAM sequence: CTC
cacttctggtgctattactc

SEQ ID NO: 215451 - DNA, 20 bp, Artificial Sequence
  Description of Artificial Sequence: Synthetic oligonucleotide
  Target: ATXN1; (-) strand; PAM type: YTN; PAM sequence: TTG
gtgaatcataggcctccact

SEQ ID NO: 215452 - DNA, 20 bp, Artificial Sequence
  Description of Artificial Sequence: Synthetic oligonucleotide
  Target: ATXN1; (-) strand; PAM type: YTN; PAM sequence: TTG
gagaattggtgaatcatagg

SEQ ID NO: 215453 - DNA, 20 bp, Artificial Sequence
  Description of Artificial Sequence: Synthetic oligonucleotide
  Target: ATXN1; (-) strand; PAM type: YTN; PAM sequence: CTG
ttggagaattggtgaatcat

SEQ ID NO: 215454 - DNA, 20 bp, Artificial Sequence
  Description of Artificial Sequence: Synthetic oligonucleotide
  Target: ATXN1; (-) strand; PAM type: YTN; PAM sequence: CTA
ctgttggagaattggtgaat

SEQ ID NO: 215455 - DNA, 20 bp, Artificial Sequence
  Description of Artificial Sequence: Synthetic oligonucleotide
  Target: ATXN1; (-) strand; PAM type: YTN; PAM sequence: CTG
tccaacaacaggcagtcaca

SEQ ID NO: 215456 - DNA, 20 bp, Artificial Sequence
  Description of Artificial Sequence: Synthetic oligonucleotide
  Target: ATXN1; (-) strand; PAM type: YTN; PAM sequence: CTC
tgtccaacaacaggcagtca

SEQ ID NO: 215457 - DNA, 20 bp, Artificial Sequence
  Description of Artificial Sequence: Synthetic oligonucleotide
  Target: ATXN1; (-) strand; PAM type: YTN; PAM sequence: CTG
cctctgtccaacaacaggca

SEQ ID NO: 215458 - DNA, 20 bp, Artificial Sequence
  Description of Artificial Sequence: Synthetic oligonucleotide
  Target: ATXN1; (-) strand; PAM type: YTN; PAM sequence: CTG
tccatctgcctctgtccaac

SEQ ID NO: 215459 - DNA, 20 bp, Artificial Sequence
  Description of Artificial Sequence: Synthetic oligonucleotide
  Target: ATXN1; (-) strand; PAM type: YTN; PAM sequence: TTC
tgtccatctgcctctgtcca

SEQ ID NO: 215460 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaataacgttctgtc

SEQ ID NO: 215461 - DNA, 20 bp, Artificial Sequence
  Description of Artificial Sequence: Synthetic oligonucleotide
  Target: ATXN1; (-) strand; PAM type: YTN; PAM sequence: TTC
attaaaaaaaaataacgttc

SEQ ID NO: 215462 - DNA, 20 bp, Artificial Sequence
  Description of Artificial Sequence: Synthetic oligonucleotide
  Target: ATXN1; (-) strand; PAM type: YTN; PAM sequence: TTT
cattaaaaaaaaataacgtt

SEQ ID NO: 215463 - DNA, 20 bp, Artificial Sequence
  Description of Artificial Sequence: Synthetic oligonucleotide
  Target: ATXN1; (-) strand; PAM type: YTN; PAM sequence: TTT
tcattaaaaaaaaataacgt

SEQ ID NO: 215464 - DNA, 20 bp, Artificial Sequence
  Description of Artificial Sequence: Synthetic oligonucleotide
  Target: ATXN1; (-) strand; PAM type: YTN; PAM sequence: CTT
ttcattaaaaaaaaataacg

SEQ ID NO: 215465 - DNA, 20 bp, Artificial Sequence
  Description of Artificial Sequence: Synthetic oligonucleotide
  Target: ATXN1; (-) strand; PAM type: YTN; PAM sequence: TTC
ttttcattaaaaaaaaataa

SEQ ID NO: 215466 - DNA, 20 bp, Artificial Sequence
  Description of Artificial Sequence: Synthetic oligonucleotide
  Target: ATXN1; (-) strand; PAM type: YTN; PAM sequence: TTT
cttttcattaaaaaaaaata

SEQ ID NO: 215467 - DNA, 20 bp, Artificial Sequence
  Description of Artificial Sequence: Synthetic oligonucleotide
  Target: ATXN1; (-) strand; PAM type: YTN; PAM sequence: CTT
tcttttcattaaaaaaaaat

SEQ ID NO: 215468 - DNA, 20 bp, Artificial Sequence
  Description of Artificial Sequence: Synthetic oligonucleotide
  Target: ATXN1; (-) strand; PAM type: YTN; PAM sequence: CTG
atgtgtcctttcttttcatt

SEQ ID NO: 215469 - DNA, 20 bp, Artificial Sequence
  Description of Artificial Sequence: Synthetic oligonucleotide
  Target: ATXN1; (-) strand; PAM type: YTN; PAM sequence: TTC
aactgatgtgtcctttcttt

SEQ ID NO: 215470 - DNA, 20 bp, Artificial Sequence
  Description of Artificial Sequence: Synthetic oligonucleotide
  Target: ATXN1; (-) strand; PAM type: YTN; PAM sequence: TTT
caactgatgtgtcctttctt

SEQ ID NO: 215471 - DNA, 20 bp, Artificial Sequence
  Description of Artificial Sequence: Synthetic oligonucleotide
  Target: ATXN1; (-) strand; PAM type: YTN; PAM sequence: CTT
tcaactgatgtgtcctttct

SEQ ID NO: 215472 - DNA, 20 bp, Artificial Sequence
  Description of Artificial Sequence: Synthetic oligonucleotide
  Target: ATXN1; (-) strand; PAM type: YTN; PAM sequence: TTG
catctttcaactgatgtgtc

SEQ ID NO: 215473 - DNA, 20 bp, Artificial Sequence
  Description of Artificial Sequence: Synthetic oligonucleotide
  Target: ATXN1; (-) strand; PAM type: YTN; PAM sequence: CTG
ttgcatctttcaactgatgt

SEQ ID NO: 215474 - DNA, 20 bp, Artificial Sequence
  Description of Artificial Sequence: Synthetic oligonucleotide
  Target: ATXN1; (-) strand; PAM type: YTN; PAM sequence: CTG
caaaggacaacaaagtgaaa

SEQ ID NO: 215475 - DNA, 20 bp, Artificial Sequence
  Description of Artificial Sequence: Synthetic oligonucleotide
  Target: ATXN1; (-) strand; PAM type: YTN; PAM sequence: TTG
aaaaaaaaatgcagtatctg

SEQ ID NO: 215476 - DNA, 20 bp, Artificial Sequence
  Description of Artificial Sequence: Synthetic oligonucleotide
  Target: ATXN1; (-) strand; PAM type: YTN; PAM sequence: TTT
gaaaaaaaaatgcagtatct

SEQ ID NO: 215477 - DNA, 20 bp, Artificial Sequence
  Description of Artificial Sequence: Synthetic oligonucleotide
  Target: ATXN1; (-) strand; PAM type: YTN; PAM sequence: TTC
aatttgaaaaaaaaatgcag

SEQ ID NO: 215478 - DNA, 20 bp, Artificial Sequence
  Description of Artificial Sequence: Synthetic oligonucleotide
  Target: ATXN1; (-) strand; PAM type: YTN; PAM sequence: CTT
caatttgaaaaaaaaatgca

SEQ ID NO: 215479 - DNA, 20 bp, Artificial Sequence
  Description of Artificial Sequence: Synthetic oligonucleotide
  Target: ATXN1; (-) strand; PAM type: YTN; PAM sequence: TTG
ccacagaacttcaatttgaa

SEQ ID NO: 215480 - DNA, 20 bp, Artificial Sequence
  Description of Artificial Sequence: Synthetic oligonucleotide
  Target: ATXN1; (-) strand; PAM type: YTN; PAM sequence: TTG
acacggggttgccacagaac

SEQ ID NO: 215481 - DNA, 20 bp, Artificial Sequence
  Description of Artificial Sequence: Synthetic oligonucleotide
  Target: ATXN1; (-) strand; PAM type: YTN; PAM sequence: CTT
gacacggggttgccacagaa

SEQ ID NO: 215482 - DNA, 20 bp, Artificial Sequence
  Description of Artificial Sequence: Synthetic oligonucleotide
  Target: ATXN1; (-) strand; PAM type: YTN; PAM sequence: TTG
cttgacacggggttgccaca

SEQ ID NO: 215483 - DNA, 20 bp, Artificial Sequence
  Description of Artificial Sequence: Synthetic oligonucleotide
  Target: ATXN1; (-) strand; PAM type: YTN; PAM sequence: CTG
gtggagttgcttgacacggg

SEQ ID NO: 215484 - DNA, 20 bp, Artificial Sequence
  Description of Artificial Sequence: Synthetic oligonucleotide
  Target: ATXN1; (-) strand; PAM type: YTN; PAM sequence: TTG
gagaggtgatgctggtggag

SEQ ID NO: 215485 - DNA, 20 bp, Artificial Sequence
  Description of Artificial Sequence: Synthetic oligonucleotide
  Target: ATXN1; (-) strand; PAM type: YTN; PAM sequence: CTG
ttggagaggtgatgctggtg

SEQ ID NO: 215486 - DNA, 20 bp, Artificial Sequence
  Description of Artificial Sequence: Synthetic oligonucleotide
  Target: ATXN1; (-) strand; PAM type: YTN; PAM sequence: CTC
aacatgagcacatgctgttg

SEQ ID NO: 215487 - DNA, 20 bp, Artificial Sequence
  Description of Artificial Sequence: Synthetic oligonucleotide
  Target: ATXN1; (-) strand; PAM type: YTN; PAM sequence: TTA
ccgaaatgtggcagaggctc

SEQ ID NO: 215488 - DNA, 20 bp, Artificial Sequence
  Description of Artificial Sequence: Synthetic oligonucleotide
  Target: ATXN1; (-) strand; PAM type: YTN; PAM sequence: CTG
tattaccgaaatgtggcaga

SEQ ID NO: 215489 - DNA, 20 bp, Artificial Sequence
  Description of Artificial Sequence: Synthetic oligonucleotide
  Target: ATXN1; (-) strand; PAM type: YTN; PAM sequence: TTG
aaatactgtattaccgaaat

SEQ ID NO: 215490 - DNA, 20 bp, Artificial Sequence
  Description of Artificial Sequence: Synthetic oligonucleotide
  Target: ATXN1; (-) strand; PAM type: YTN; PAM sequence: TTT
gaaatactgtattaccgaaa

SEQ ID NO: 215491 - DNA, 20 bp, Artificial Sequence
  Description of Artificial Sequence: Synthetic oligonucleotide
  Target: ATXN1; (-) strand; PAM type: YTN; PAM sequence: CTC
agatcaccataacagatata

SEQ ID NO: 215492 - DNA, 20 bp, Artificial Sequence
  Description of Artificial Sequence: Synthetic oligonucleotide
  Target: ATXN1; (-) strand; PAM type: YTN; PAM sequence: CTG
atctcagatcaccataacag

SEQ ID NO: 215493 - DNA, 20 bp, Artificial Sequence
  Description of Artificial Sequence: Synthetic oligonucleotide
  Target: ATXN1; (-) strand; PAM type: YTN; PAM sequence: TTA
taatagtaacgtcaaagagc

SEQ ID NO: 215494 - DNA, 20 bp, Artificial Sequence
  Description of Artificial Sequence: Synthetic oligonucleotide
  Target: ATXN1; (-) strand; PAM type: YTN; PAM sequence: TTC
atggtgaacaaaacaattat

SEQ ID NO: 215495 - DNA, 20 bp, Artificial Sequence
  Description of Artificial Sequence: Synthetic oligonucleotide
  Target: ATXN1; (-) strand; PAM type: YTN; PAM sequence: TTA
tatggggtgtgtggttcatg

SEQ ID NO: 215496 - DNA, 20 bp, Artificial Sequence
  Description of Artificial Sequence: Synthetic oligonucleotide
  Target: ATXN1; (-) strand; PAM type: YTN; PAM sequence: CTT
atatggggtgtgtggttcat

SEQ ID NO: 215497 - DNA, 20 bp, Artificial Sequence
  Description of Artificial Sequence: Synthetic oligonucleotide
  Target: ATXN1; (-) strand; PAM type: YTN; PAM sequence: TTA
ccttatatggggtgtgtggt

SEQ ID NO: 215498 - DNA, 20 bp, Artificial Sequence
  Description of Artificial Sequence: Synthetic oligonucleotide
  Target: ATXN1; (-) strand; PAM type: YTN; PAM sequence: TTC
attaccttatatggggtgtg

SEQ ID NO: 215499 - DNA, 20 bp, Artificial Sequence
  Description of Artificial Sequence: Synthetic oligonucleotide
  Target: ATXN1; (-) strand; PAM type: YTN; PAM sequence: TTA
agttcattaccttatatggg

SEQ ID NO: 215500 - DNA, 20 bp, Artificial Sequence
  Description of Artificial Sequence: Synthetic oligonucleotide
  Target: ATXN1; (-) strand; PAM type: YTN; PAM sequence: CTG
attaagttcattaccttata

SEQ ID NO: 215501 - DNA, 20 bp, Artificial Sequence
  Description of Artificial Sequence: Synthetic oligonucleotide
  Target: ATXN1; (-) strand; PAM type: YTN; PAM sequence: TTA
ctgattaagttcattacctt

SEQ ID NO: 215502 - DNA, 20 bp, Artificial Sequence
  Description of Artificial Sequence: Synthetic oligonucleotide
  Target: ATXN1; (-) strand; PAM type: YTN; PAM sequence: TTT
actgattaagttcattacct

SEQ ID NO: 215503 - DNA, 20 bp, Artificial Sequence
  Description of Artificial Sequence: Synthetic oligonucleotide
  Target: ATXN1; (-) strand; PAM type: YTN; PAM sequence: TTG
tagcagtcagaacacacatg

SEQ ID NO: 215504 - DNA, 20 bp, Artificial Sequence
  Description of Artificial Sequence: Synthetic oligonucleotide
  Target: ATXN1; (-) strand; PAM type: YTN; PAM sequence: TTT
gtagcagtcagaacacacat

SEQ ID NO: 215505 - DNA, 20 bp, Artificial Sequence
  Description of Artificial Sequence: Synthetic oligonucleotide
  Target: ATXN1; (-) strand; PAM type: YTN; PAM sequence: CTT
tgtagcagtcagaacacaca

SEQ ID NO: 215506 - DNA, 20 bp, Artificial Sequence
  Description of Artificial Sequence: Synthetic oligonucleotide
  Target: ATXN1; (-) strand; PAM type: YTN; PAM sequence: CTG
aggaaacaaggaggcccgag

SEQ ID NO: 215507 - DNA, 20 bp, Artificial Sequence
  Description of Artificial Sequence: Synthetic oligonucleotide
  Target: ATXN1; (-) strand; PAM type: YTN; PAM sequence: TTG
tgtctgaggaaacaaggagg

SEQ ID NO: 215508 - DNA, 20 bp, Artificial Sequence
  Description of Artificial Sequence: Synthetic oligonucleotide
  Target: ATXN1; (-) strand; PAM type: YTN; PAM sequence: CTT
gtgtctgaggaaacaaggag

SEQ ID NO: 215509 - DNA, 20 bp, Artificial Sequence
  Description of Artificial Sequence: Synthetic oligonucleotide
  Target: ATXN1; (-) strand; PAM type: YTN; PAM sequence: TTC
ttgtgtctgaggaaacaagg

SEQ ID NO: 215510 - DNA, 20 bp, Artificial Sequence
  Description of Artificial Sequence: Synthetic oligonucleotide
  Target: ATXN1; (-) strand; PAM type: YTN; PAM sequence: TTC
aatattcttgtgtctgagga

SEQ ID NO: 215511 - DNA, 20 bp, Artificial Sequence
  Description of Artificial Sequence: Synthetic oligonucleotide
  Target: ATXN1; (-) strand; PAM type: YTN; PAM sequence: CTT
caatattcttgtgtctgagg

SEQ ID NO: 215512 - DNA, 20 bp, Artificial Sequence
  Description of Artificial Sequence: Synthetic oligonucleotide
  Target: ATXN1; (-) strand; PAM type: YTN; PAM sequence: CTG
gccaacttcaatattcttgt

SEQ ID NO: 215513 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagcccccgtgcc

SEQ ID NO: 215514 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagcccc

SEQ ID NO: 215515 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 215516 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 215517 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 215518 - DNA, 20 bp, Artificial Sequence
  Description of Artificial Sequence: Synthetic oligonucleotide
  Target: ATXN1; (-) strand; PAM type: YTN; PAM sequence: CTG
cccaccttggcctcccaaag

SEQ ID NO: 215519 - DNA, 20 bp, Artificial Sequence
  Description of Artificial Sequence: Synthetic oligonucleotide
  Target: ATXN1; (-) strand; PAM type: YTN; PAM sequence: CTC
gtgatctgcccaccttggcc

SEQ ID NO: 215520 - DNA, 20 bp, Artificial Sequence
  Description of Artificial Sequence: Synthetic oligonucleotide
  Target: ATXN1; (-) strand; PAM type: YTN; PAM sequence: CTG
aactcgtgatctgcccacct

SEQ ID NO: 215521 - DNA, 20 bp, Artificial Sequence
  Description of Artificial Sequence: Synthetic oligonucleotide
  Target: ATXN1; (-) strand; PAM type: YTN; PAM sequence: CTC
ctgaactcgtgatctgccca

SEQ ID NO: 215522 - DNA, 20 bp, Artificial Sequence
  Description of Artificial Sequence: Synthetic oligonucleotide
  Target: ATXN1; (-) strand; PAM type: YTN; PAM sequence: TTG
atctcctgaactcgtgatct

SEQ ID NO: 215523 - DNA, 20 bp, Artificial Sequence
  Description of Artificial Sequence: Synthetic oligonucleotide
  Target: ATXN1; (-) strand; PAM type: YTN; PAM sequence: CTT
gatctcctgaactcgtgatc

SEQ ID NO: 215524 - DNA, 20 bp, Artificial Sequence
  Description of Artificial Sequence: Synthetic oligonucleotide
  Target: ATXN1; (-) strand; PAM type: YTN; PAM sequence: TTA
gccaggatggtcttgatctc

SEQ ID NO: 215525 - DNA, 20 bp, Artificial Sequence
  Description of Artificial Sequence: Synthetic oligonucleotide
  Target: ATXN1; (-) strand; PAM type: YTN; PAM sequence: TTC
accatgttagccaggatggt

SEQ ID NO: 215526 - DNA, 20 bp, Artificial Sequence
  Description of Artificial Sequence: Synthetic oligonucleotide
  Target: ATXN1; (-) strand; PAM type: YTN; PAM sequence: TTT
caccatgttagccaggatgg

SEQ ID NO: 215527 - DNA, 20 bp, Artificial Sequence
  Description of Artificial Sequence: Synthetic oligonucleotide
  Target: ATXN1; (-) strand; PAM type: YTN; PAM sequence: TTG
agtttcaccatgttagccag

SEQ ID NO: 215528 - DNA, 20 bp, Artificial Sequence
  Description of Artificial Sequence: Synthetic oligonucleotide
  Target: ATXN1; (-) strand; PAM type: YTN; PAM sequence: TTA
gtagagattgagtttcacca

SEQ ID NO: 215529 - DNA, 20 bp, Artificial Sequence
  Description of Artificial Sequence: Synthetic oligonucleotide
  Target: ATXN1; (-) strand; PAM type: YTN; PAM sequence: TTT
agtagagattgagtttcacc

SEQ ID NO: 215530 - DNA, 20 bp, Artificial Sequence
  Description of Artificial Sequence: Synthetic oligonucleotide
  Target: ATXN1; (-) strand; PAM type: YTN; PAM sequence: TTT
tagtagagattgagtttcac

SEQ ID NO: 215531 - DNA, 20 bp, Artificial Sequence
  Description of Artificial Sequence: Synthetic oligonucleotide
  Target: ATXN1; (-) strand; PAM type: YTN; PAM sequence: TTT
ttagtagagattgagtttca

SEQ ID NO: 215532 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagattgag

SEQ ID NO: 215533 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagattga

SEQ ID NO: 215534 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagattg

SEQ ID NO: 215535 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatt

SEQ ID NO: 215536 - DNA, 20 bp, Artificial Sequence
  Description of Artificial Sequence: Synthetic oligonucleotide
  Target: ATXN1; (-) strand; PAM type: YTN; PAM sequence: CTT
tttgtatttttagtagagat

SEQ ID NO: 215537 - DNA, 20 bp, Artificial Sequence
  Description of Artificial Sequence: Synthetic oligonucleotide
  Target: ATXN1; (-) strand; PAM type: YTN; PAM sequence: CTA
actttttgtatttttagtag

SEQ ID NO: 215538 - DNA, 20 bp, Artificial Sequence
  Description of Artificial Sequence: Synthetic oligonucleotide
  Target: ATXN1; (-) strand; PAM type: YTN; PAM sequence: CTA
cgtccggctaactttttgta

SEQ ID NO: 215539 - DNA, 20 bp, Artificial Sequence
  Description of Artificial Sequence: Synthetic oligonucleotide
  Target: ATXN1; (-) strand; PAM type: YTN; PAM sequence: CTA
caggcacccgccactacgtc

SEQ ID NO: 215540 - DNA, 20 bp, Artificial Sequence
  Description of Artificial Sequence: Synthetic oligonucleotide
  Target: ATXN1; (-) strand; PAM type: YTN; PAM sequence: CTG
agactacaggcacccgccac

SEQ ID NO: 215541 - DNA, 20 bp, Artificial Sequence
  Description of Artificial Sequence: Synthetic oligonucleotide
  Target: ATXN1; (-) strand; PAM type: YTN; PAM sequence: CTC
ccgaatagctgagactacag

SEQ ID NO: 215542 - DNA, 20 bp, Artificial Sequence
  Description of Artificial Sequence: Synthetic oligonucleotide
  Target: ATXN1; (-) strand; PAM type: YTN; PAM sequence: CTC
agcctcccgaatagctgaga

SEQ ID NO: 215543 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgaatagct

SEQ ID NO: 215544 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgaata

SEQ ID NO: 215545 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgaa

SEQ ID NO: 215546 - DNA, 20 bp, Artificial Sequence
  Description of Artificial Sequence: Synthetic oligonucleotide
  Target: ATXN1; (-) strand; PAM type: YTN; PAM sequence: TTC
acgccattctcctgcctcag

SEQ ID NO: 215547 - DNA, 20 bp, Artificial Sequence
  Description of Artificial Sequence: Synthetic oligonucleotide
  Target: ATXN1; (-) strand; PAM type: YTN; PAM sequence: CTC
ccgggttcacgccattctcc

SEQ ID NO: 215548 - DNA, 20 bp, Artificial Sequence
  Description of Artificial Sequence: Synthetic oligonucleotide
  Target: ATXN1; (-) strand; PAM type: YTN; PAM sequence: CTC
cgcctcccgggttcacgcca

SEQ ID NO: 215549 - DNA, 20 bp, Artificial Sequence
  Description of Artificial Sequence: Synthetic oligonucleotide
  Target: ATXN1; (-) strand; PAM type: YTN; PAM sequence: CTG
caagctccgcctcccgggtt

SEQ ID NO: 215550 - DNA, 20 bp, Artificial Sequence
  Description of Artificial Sequence: Synthetic oligonucleotide
  Target: ATXN1; (-) strand; PAM type: YTN; PAM sequence: TTA
ctgcaagctccgcctcccgg

SEQ ID NO: 215551 - DNA, 20 bp, Artificial Sequence
  Description of Artificial Sequence: Synthetic oligonucleotide
  Target: ATXN1; (-) strand; PAM type: YTN; PAM sequence: CTT
actgcaagctccgcctcccg

SEQ ID NO: 215552 - DNA, 20 bp, Artificial Sequence
  Description of Artificial Sequence: Synthetic oligonucleotide
  Target: ATXN1; (-) strand; PAM type: YTN; PAM sequence: CTG
cttactgcaagctccgcctc

SEQ ID NO: 215553 - DNA, 20 bp, Artificial Sequence
  Description of Artificial Sequence: Synthetic oligonucleotide
  Target: ATXN1; (-) strand; PAM type: YTN; PAM sequence: CTC
tgcttactgcaagctccgcc

SEQ ID NO: 215554 - DNA, 20 bp, Artificial Sequence
  Description of Artificial Sequence: Synthetic oligonucleotide
  Target: ATXN1; (-) strand; PAM type: YTN; PAM sequence: TTG
agtgcagtggcacgatctct

SEQ ID NO: 215555 - DNA, 20 bp, Artificial Sequence
  Description of Artificial Sequence: Synthetic oligonucleotide
  Target: ATXN1; (-) strand; PAM type: YTN; PAM sequence: CTT
gagtgcagtggcacgatctc

SEQ ID NO: 215556 - DNA, 20 bp, Artificial Sequence
  Description of Artificial Sequence: Synthetic oligonucleotide
  Target: ATXN1; (-) strand; PAM type: YTN; PAM sequence: CTG
tcacccaggcttgagtgcag

SEQ ID NO: 215557 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggcttgagtgc

SEQ ID NO: 215558 - DNA, 20 bp, Artificial Sequence
  Description of Artificial Sequence: Synthetic oligonucleotide
  Target: ATXN1; (-) strand; PAM type: YTN; PAM sequence: CTC
gctctgtcacccaggcttga

SEQ ID NO: 215559 - DNA, 20 bp, Artificial Sequence
  Description of Artificial Sequence: Synthetic oligonucleotide
  Target: ATXN1; (-) strand; PAM type: YTN; PAM sequence: TTG
agacagagtctcgctctgtc

SEQ ID NO: 215560 - DNA, 20 bp, Artificial Sequence
  Description of Artificial Sequence: Synthetic oligonucleotide
  Target: ATXN1; (-) strand; PAM type: YTN; PAM sequence: TTT
gagacagagtctcgctctgt

SEQ ID NO: 215561 - DNA, 20 bp, Artificial Sequence
  Description of Artificial Sequence: Synthetic oligonucleotide
  Target: ATXN1; (-) strand; PAM type: YTN; PAM sequence: TTT
tgagacagagtctcgctctg

SEQ ID NO: 215562 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagtctcgctct

SEQ ID NO: 215563 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagtctcgctc

SEQ ID NO: 215564 - DNA, 20 bp, Artificial Sequence
  Description of Artificial Sequence: Synthetic oligonucleotide
  Target: ATXN1; (-) strand; PAM type: YTN; PAM sequence: CTT
ttttgagacagagtctcgct

SEQ ID NO: 215565 - DNA, 20 bp, Artificial Sequence
  Description of Artificial Sequence: Synthetic oligonucleotide
  Target: ATXN1; (-) strand; PAM type: YTN; PAM sequence: TTC
ttttttgagacagagtctcg

SEQ ID NO: 215566 - DNA, 20 bp, Artificial Sequence
  Description of Artificial Sequence: Synthetic oligonucleotide
  Target: ATXN1; (-) strand; PAM type: YTN; PAM sequence: TTT
cttttttgagacagagtctc

SEQ ID NO: 215567 - DNA, 20 bp, Artificial Sequence
  Description of Artificial Sequence: Synthetic oligonucleotide
  Target: ATXN1; (-) strand; PAM type: YTN; PAM sequence: TTT
tcttttttgagacagagtct

SEQ ID NO: 215568 - DNA, 20 bp, Artificial Sequence
  Description of Artificial Sequence: Synthetic oligonucleotide
  Target: ATXN1; (-) strand; PAM type: YTN; PAM sequence: TTT
ttcttttttgagacagagtc

SEQ ID NO: 215569 - DNA, 20 bp, Artificial Sequence
  Description of Artificial Sequence: Synthetic oligonucleotide
  Target: ATXN1; (-) strand; PAM type: YTN; PAM sequence: TTT
tttcttttttgagacagagt

SEQ ID NO: 215570 - DNA, 20 bp, Artificial Sequence
  Description of Artificial Sequence: Synthetic oligonucleotide
  Target: ATXN1; (-) strand; PAM type: YTN; PAM sequence: TTT
ttttcttttttgagacagag

SEQ ID NO: 215571 - DNA, 20 bp, Artificial Sequence
  Description of Artificial Sequence: Synthetic oligonucleotide
  Target: ATXN1; (-) strand; PAM type: YTN; PAM sequence: TTT
tttttcttttttgagacaga

SEQ ID NO: 215572 - DNA, 20 bp, Artificial Sequence
  Description of Artificial Sequence: Synthetic oligonucleotide
  Target: ATXN1; (-) strand; PAM type: YTN; PAM sequence: TTT
ttttttcttttttgagacag

SEQ ID NO: 215573 - DNA, 20 bp, Artificial Sequence
  Description of Artificial Sequence: Synthetic oligonucleotide
  Target: ATXN1; (-) strand; PAM type: YTN; PAM sequence: TTT
tttttttcttttttgagaca

SEQ ID NO: 215574 - DNA, 20 bp, Artificial Sequence
  Description of Artificial Sequence: Synthetic oligonucleotide
  Target: ATXN1; (-) strand; PAM type: YTN; PAM sequence: TTT
ttttttttcttttttgagac

SEQ ID NO: 215575 - DNA, 20 bp, Artificial Sequence
  Description of Artificial Sequence: Synthetic oligonucleotide
  Target: ATXN1; (-) strand; PAM type: YTN; PAM sequence: TTT
tttttttttcttttttgaga

SEQ ID NO: 215576 - DNA, 20 bp, Artificial Sequence
  Description of Artificial Sequence: Synthetic oligonucleotide
  Target: ATXN1; (-) strand; PAM type: YTN; PAM sequence: CTT
ttttttttttcttttttgag

SEQ ID NO: 215577 - DNA, 20 bp, Artificial Sequence
  Description of Artificial Sequence: Synthetic oligonucleotide
  Target: ATXN1; (-) strand; PAM type: YTN; PAM sequence: TTC
ttttttttttttcttttttg

SEQ ID NO: 215578 - DNA, 20 bp, Artificial Sequence
  Description of Artificial Sequence: Synthetic oligonucleotide
  Target: ATXN1; (-) strand; PAM type: YTN; PAM sequence: TTC
aatattcttttttttttttc

SEQ ID NO: 215579 - DNA, 20 bp, Artificial Sequence
  Description of Artificial Sequence: Synthetic oligonucleotide
  Target: ATXN1; (-) strand; PAM type: YTN; PAM sequence: TTT
caatattctttttttttttt

SEQ ID NO: 215580 - DNA, 20 bp, Artificial Sequence
  Description of Artificial Sequence: Synthetic oligonucleotide
  Target: ATXN1; (-) strand; PAM type: YTN; PAM sequence: CTA
atttcaatattctttttttt

SEQ ID NO: 215581 - DNA, 20 bp, Artificial Sequence
  Description of Artificial Sequence: Synthetic oligonucleotide
  Target: ATXN1; (-) strand; PAM type: YTN; PAM sequence: TTG
gcctaatttcaatattcttt

SEQ ID NO: 215582 - DNA, 20 bp, Artificial Sequence
  Description of Artificial Sequence: Synthetic oligonucleotide
  Target: ATXN1; (-) strand; PAM type: YTN; PAM sequence: TTA
attggcctaatttcaatatt

SEQ ID NO: 215583 - DNA, 20 bp, Artificial Sequence
  Description of Artificial Sequence: Synthetic oligonucleotide
  Target: ATXN1; (-) strand; PAM type: YTN; PAM sequence: TTA
ttaattggcctaatttcaat

SEQ ID NO: 215584 - DNA, 20 bp, Artificial Sequence
  Description of Artificial Sequence: Synthetic oligonucleotide
  Target: ATXN1; (-) strand; PAM type: YTN; PAM sequence: TTA
gggttattaattggcctaat

SEQ ID NO: 215585 - DNA, 20 bp, Artificial Sequence
  Description of Artificial Sequence: Synthetic oligonucleotide
  Target: ATXN1; (-) strand; PAM type: YTN; PAM sequence: TTT
agggttattaattggcctaa

SEQ ID NO: 215586 - DNA, 20 bp, Artificial Sequence
  Description of Artificial Sequence: Synthetic oligonucleotide
  Target: ATXN1; (-) strand; PAM type: YTN; PAM sequence: TTT
tagggttattaattggccta

SEQ ID NO: 215587 - DNA, 20 bp, Artificial Sequence
  Description of Artificial Sequence: Synthetic oligonucleotide
  Target: ATXN1; (-) strand; PAM type: YTN; PAM sequence: CTA
ttttagggttattaattggc

SEQ ID NO: 215588 - DNA, 20 bp, Artificial Sequence
  Description of Artificial Sequence: Synthetic oligonucleotide
  Target: ATXN1; (-) strand; PAM type: YTN; PAM sequence: TTA
gcggctattttagggttatt

SEQ ID NO: 215589 - DNA, 20 bp, Artificial Sequence
  Description of Artificial Sequence: Synthetic oligonucleotide
  Target: ATXN1; (-) strand; PAM type: YTN; PAM sequence: CTT
agcggctattttagggttat

SEQ ID NO: 215590 - DNA, 20 bp, Artificial Sequence
  Description of Artificial Sequence: Synthetic oligonucleotide
  Target: ATXN1; (-) strand; PAM type: YTN; PAM sequence: TTG
aatgcttagcggctatttta

SEQ ID NO: 215591 - DNA, 20 bp, Artificial Sequence
  Description of Artificial Sequence: Synthetic oligonucleotide
  Target: ATXN1; (-) strand; PAM type: YTN; PAM sequence: CTT
gaatgcttagcggctatttt

SEQ ID NO: 215592 - DNA, 20 bp, Artificial Sequence
  Description of Artificial Sequence: Synthetic oligonucleotide
  Target: ATXN1; (-) strand; PAM type: YTN; PAM sequence: TTC
acttgaatgcttagcggcta

SEQ ID NO: 215593 - DNA, 20 bp, Artificial Sequence
  Description of Artificial Sequence: Synthetic oligonucleotide
  Target: ATXN1; (-) strand; PAM type: YTN; PAM sequence: TTT
cacttgaatgcttagcggct

SEQ ID NO: 215594 - DNA, 20 bp, Artificial Sequence
  Description of Artificial Sequence: Synthetic oligonucleotide
  Target: ATXN1; (-) strand; PAM type: YTN; PAM sequence: CTT
tcacttgaatgcttagcggc

SEQ ID NO: 215595 - DNA, 20 bp, Artificial Sequence
  Description of Artificial Sequence: Synthetic oligonucleotide
  Target: ATXN1; (-) strand; PAM type: YTN; PAM sequence: TTC
ctttcacttgaatgcttagc

SEQ ID NO: 215596 - DNA, 20 bp, Artificial Sequence
  Description of Artificial Sequence: Synthetic oligonucleotide
  Target: ATXN1; (-) strand; PAM type: YTN; PAM sequence: CTT
cctttcacttgaatgcttag

SEQ ID NO: 215597 - DNA, 20 bp, Artificial Sequence
  Description of Artificial Sequence: Synthetic oligonucleotide
  Target: ATXN1; (-) strand; PAM type: YTN; PAM sequence: CTC
ttcctttcacttgaatgctt

SEQ ID NO: 215598 - DNA, 20 bp, Artificial Sequence
  Description of Artificial Sequence: Synthetic oligonucleotide
  Target: ATXN1; (-) strand; PAM type: YTN; PAM sequence: CTC
actcttcctttcacttgaat

SEQ ID NO: 215599 - DNA, 20 bp, Artificial Sequence
  Description of Artificial Sequence: Synthetic oligonucleotide
  Target: ATXN1; (-) strand; PAM type: YTN; PAM sequence: TTG
agaggtatgtgactcactct

SEQ ID NO: 215600 - DNA, 20 bp, Artificial Sequence
  Description of Artificial Sequence: Synthetic oligonucleotide
  Target: ATXN1; (-) strand; PAM type: YTN; PAM sequence: TTA
aattgagaggtatgtgactc

SEQ ID NO: 215601 - DNA, 20 bp, Artificial Sequence
  Description of Artificial Sequence: Synthetic oligonucleotide
  Target: ATXN1; (-) strand; PAM type: YTN; PAM sequence: TTT
aaattgagaggtatgtgact

SEQ ID NO: 215602 - DNA, 20 bp, Artificial Sequence
  Description of Artificial Sequence: Synthetic oligonucleotide
  Target: ATXN1; (-) strand; PAM type: YTN; PAM sequence: TTA
tttaaattgagaggtatgtg

SEQ ID NO: 215603 - DNA, 20 bp, Artificial Sequence
  Description of Artificial Sequence: Synthetic oligonucleotide
  Target: ATXN1; (-) strand; PAM type: YTN; PAM sequence: CTT
atttaaattgagaggtatgt

SEQ ID NO: 215604 - DNA, 20 bp, Artificial Sequence
  Description of Artificial Sequence: Synthetic oligonucleotide
  Target: ATXN1; (-) strand; PAM type: YTN; PAM sequence: TTC
ttatttaaattgagaggtat

SEQ ID NO: 215605 - DNA, 20 bp, Artificial Sequence
  Description of Artificial Sequence: Synthetic oligonucleotide
  Target: ATXN1; (-) strand; PAM type: YTN; PAM sequence: TTT
cttatttaaattgagaggta

SEQ ID NO: 215606 - DNA, 20 bp, Artificial Sequence
  Description of Artificial Sequence: Synthetic oligonucleotide
  Target: ATXN1; (-) strand; PAM type: YTN; PAM sequence: TTT
tcttatttaaattgagaggt

SEQ ID NO: 215607 - DNA, 20 bp, Artificial Sequence
  Description of Artificial Sequence: Synthetic oligonucleotide
  Target: ATXN1; (-) strand; PAM type: YTN; PAM sequence: CTA
gttttcttatttaaattgag

SEQ ID NO: 215608 - DNA, 20 bp, Artificial Sequence
  Description of Artificial Sequence: Synthetic oligonucleotide
  Target: ATXN1; (-) strand; PAM type: YTN; PAM sequence: TTC
tagttttcttatttaaattg

SEQ ID NO: 215609 - DNA, 20 bp, Artificial Sequence
  Description of Artificial Sequence: Synthetic oligonucleotide
  Target: ATXN1; (-) strand; PAM type: YTN; PAM sequence: TTT
ctagttttcttatttaaatt

SEQ ID NO: 215610 - DNA, 20 bp, Artificial Sequence
  Description of Artificial Sequence: Synthetic oligonucleotide
  Target: ATXN1; (-) strand; PAM type: YTN; PAM sequence: TTA
atcatttctagttttcttat

SEQ ID NO: 215611 - DNA, 20 bp, Artificial Sequence
  Description of Artificial Sequence: Synthetic oligonucleotide
  Target: ATXN1; (-) strand; PAM type: YTN; PAM sequence: CTT
aatcatttctagttttctta

SEQ ID NO: 215612 - DNA, 20 bp, Artificial Sequence
  Description of Artificial Sequence: Synthetic oligonucleotide
  Target: ATXN1; (-) strand; PAM type: YTN; PAM sequence: CTA
agcttaatcatttctagttt

SEQ ID NO: 215613 - DNA, 20 bp, Artificial Sequence
  Description of Artificial Sequence: Synthetic oligonucleotide
  Target: ATXN1; (-) strand; PAM type: YTN; PAM sequence: CTC
gctaagcttaatcatttcta

SEQ ID NO: 215614 - DNA, 20 bp, Artificial Sequence
  Description of Artificial Sequence: Synthetic oligonucleotide
  Target: ATXN1; (-) strand; PAM type: YTN; PAM sequence: TTC
ctcgctaagcttaatcattt

SEQ ID NO: 215615 - DNA, 20 bp, Artificial Sequence
  Description of Artificial Sequence: Synthetic oligonucleotide
  Target: ATXN1; (-) strand; PAM type: YTN; PAM sequence: CTT
cctcgctaagcttaatcatt

SEQ ID NO: 215616 - DNA, 20 bp, Artificial Sequence
  Description of Artificial Sequence: Synthetic oligonucleotide
  Target: ATXN1; (-) strand; PAM type: YTN; PAM sequence: TTC
aacatgccttcctcgctaag

SEQ ID NO: 215617 - DNA, 20 bp, Artificial Sequence
  Description of Artificial Sequence: Synthetic oligonucleotide
  Target: ATXN1; (-) strand; PAM type: YTN; PAM sequence: TTT
caacatgccttcctcgctaa

SEQ ID NO: 215618 - DNA, 20 bp, Artificial Sequence
  Description of Artificial Sequence: Synthetic oligonucleotide
  Target: ATXN1; (-) strand; PAM type: YTN; PAM sequence: CTT
tcaacatgccttcctcgcta

SEQ ID NO: 215619 - DNA, 20 bp, Artificial Sequence
  Description of Artificial Sequence: Synthetic oligonucleotide
  Target: ATXN1; (-) strand; PAM type: YTN; PAM sequence: TTG
acatatgtcagctttcaaca

SEQ ID NO: 215620 - DNA, 20 bp, Artificial Sequence
  Description of Artificial Sequence: Synthetic oligonucleotide
  Target: ATXN1; (-) strand; PAM type: YTN; PAM sequence: TTT
gacatatgtcagctttcaac

SEQ ID NO: 215621 - DNA, 20 bp, Artificial Sequence
  Description of Artificial Sequence: Synthetic oligonucleotide
  Target: ATXN1; (-) strand; PAM type: YTN; PAM sequence: TTT
tgacatatgtcagctttcaa

SEQ ID NO: 215622 - DNA, 20 bp, Artificial Sequence
  Description of Artificial Sequence: Synthetic oligonucleotide
  Target: ATXN1; (-) strand; PAM type: YTN; PAM sequence: CTT
ttgacatatgtcagctttca

SEQ ID NO: 215623 - DNA, 20 bp, Artificial Sequence
  Description of Artificial Sequence: Synthetic oligonucleotide
  Target: ATXN1; (-) strand; PAM type: YTN; PAM sequence: CTG
gcttttgacatatgtcagct

SEQ ID NO: 215624 - DNA, 20 bp, Artificial Sequence
  Description of Artificial Sequence: Synthetic oligonucleotide
  Target: ATXN1; (-) strand; PAM type: YTN; PAM sequence: TTC
agtcacaagaagcctggctt

SEQ ID NO: 215625 - DNA, 20 bp, Artificial Sequence
  Description of Artificial Sequence: Synthetic oligonucleotide
  Target: ATXN1; (-) strand; PAM type: YTN; PAM sequence: CTT
cagtcacaagaagcctggct

SEQ ID NO: 215626 - DNA, 20 bp, Artificial Sequence
  Description of Artificial Sequence: Synthetic oligonucleotide
  Target: ATXN1; (-) strand; PAM type: YTN; PAM sequence: CTA
acccttcagtcacaagaagc

SEQ ID NO: 215627 - DNA, 20 bp, Artificial Sequence
  Description of Artificial Sequence: Synthetic oligonucleotide
  Target: ATXN1; (-) strand; PAM type: YTN; PAM sequence: TTG
gctaacccttcagtcacaag

SEQ ID NO: 215628 - DNA, 20 bp, Artificial Sequence
  Description of Artificial Sequence: Synthetic oligonucleotide
  Target: ATXN1; (-) strand; PAM type: YTN; PAM sequence: CTT
ggctaacccttcagtcacaa

SEQ ID NO: 215629 - DNA, 20 bp, Artificial Sequence
  Description of Artificial Sequence: Synthetic oligonucleotide
  Target: ATXN1; (-) strand; PAM type: YTN; PAM sequence: TTC
acagcttggctaacccttca

SEQ ID NO: 215630 - DNA, 20 bp, Artificial Sequence
  Description of Artificial Sequence: Synthetic oligonucleotide
  Target: ATXN1; (-) strand; PAM type: YTN; PAM sequence: TTA
gcattcacagcttggctaac

SEQ ID NO: 215631 - DNA, 20 bp, Artificial Sequence
  Description of Artificial Sequence: Synthetic oligonucleotide
  Target: ATXN1; (-) strand; PAM type: YTN; PAM sequence: CTT
agcattcacagcttggctaa

SEQ ID NO: 215632 - DNA, 20 bp, Artificial Sequence
  Description of Artificial Sequence: Synthetic oligonucleotide
  Target: ATXN1; (-) strand; PAM type: YTN; PAM sequence: TTC
cttagcattcacagcttggc

SEQ ID NO: 215633 - DNA, 20 bp, Artificial Sequence
  Description of Artificial Sequence: Synthetic oligonucleotide
  Target: ATXN1; (-) strand; PAM type: YTN; PAM sequence: TTT
ccttagcattcacagcttgg

SEQ ID NO: 215634 - DNA, 20 bp, Artificial Sequence
  Description of Artificial Sequence: Synthetic oligonucleotide
  Target: ATXN1; (-) strand; PAM type: YTN; PAM sequence: TTT
tccttagcattcacagcttg

SEQ ID NO: 215635 - DNA, 20 bp, Artificial Sequence
  Description of Artificial Sequence: Synthetic oligonucleotide
  Target: ATXN1; (-) strand; PAM type: YTN; PAM sequence: CTT
ttccttagcattcacagctt

SEQ ID NO: 215636 - DNA, 20 bp, Artificial Sequence
  Description of Artificial Sequence: Synthetic oligonucleotide
  Target: ATXN1; (-) strand; PAM type: YTN; PAM sequence: TTC
aagaacttttccttagcatt

SEQ ID NO: 215637 - DNA, 20 bp, Artificial Sequence
  Description of Artificial Sequence: Synthetic oligonucleotide
  Target: ATXN1; (-) strand; PAM type: YTN; PAM sequence: CTT
caagaacttttccttagcat

SEQ ID NO: 215638 - DNA, 20 bp, Artificial Sequence
  Description of Artificial Sequence: Synthetic oligonucleotide
  Target: ATXN1; (-) strand; PAM type: YTN; PAM sequence: TTC
ttcaagaacttttccttagc

SEQ ID NO: 215639 - DNA, 20 bp, Artificial Sequence
  Description of Artificial Sequence: Synthetic oligonucleotide
  Target: ATXN1; (-) strand; PAM type: YTN; PAM sequence: TTT
cttcaagaacttttccttag

SEQ ID NO: 215640 - DNA, 20 bp, Artificial Sequence
  Description of Artificial Sequence: Synthetic oligonucleotide
  Target: ATXN1; (-) strand; PAM type: YTN; PAM sequence: TTT
tcttcaagaacttttcctta

SEQ ID NO: 215641 - DNA, 20 bp, Artificial Sequence
  Description of Artificial Sequence: Synthetic oligonucleotide
  Target: ATXN1; (-) strand; PAM type: YTN; PAM sequence: TTA
attttcttcaagaacttttc

SEQ ID NO: 215642 - DNA, 20 bp, Artificial Sequence
  Description of Artificial Sequence: Synthetic oligonucleotide
  Target: ATXN1; (-) strand; PAM type: YTN; PAM sequence: TTT
aattttcttcaagaactttt

SEQ ID NO: 215643 - DNA, 20 bp, Artificial Sequence
  Description of Artificial Sequence: Synthetic oligonucleotide
  Target: ATXN1; (-) strand; PAM type: YTN; PAM sequence: TTT
taattttcttcaagaacttt

SEQ ID NO: 215644 - DNA, 20 bp, Artificial Sequence
  Description of Artificial Sequence: Synthetic oligonucleotide
  Target: ATXN1; (-) strand; PAM type: YTN; PAM sequence: CTT
ttaattttcttcaagaactt

SEQ ID NO: 215645 - DNA, 20 bp, Artificial Sequence
  Description of Artificial Sequence: Synthetic oligonucleotide
  Target: ATXN1; (-) strand; PAM type: YTN; PAM sequence: CTG
gagtagcacttttaattttc

SEQ ID NO: 215646 - DNA, 20 bp, Artificial Sequence
  Description of Artificial Sequence: Synthetic oligonucleotide
  Target: ATXN1; (-) strand; PAM type: YTN; PAM sequence: TTC
actggagtagcacttttaat

SEQ ID NO: 215647 - DNA, 20 bp, Artificial Sequence
  Description of Artificial Sequence: Synthetic oligonucleotide
  Target: ATXN1; (-) strand; PAM type: YTN; PAM sequence: TTG
atgagttcactggagtagca

SEQ ID NO: 215648 - DNA, 20 bp, Artificial Sequence
  Description of Artificial Sequence: Synthetic oligonucleotide
  Target: ATXN1; (-) strand; PAM type: YTN; PAM sequence: TTA
ccattgatgagttcactgga

SEQ ID NO: 215649 - DNA, 20 bp, Artificial Sequence
  Description of Artificial Sequence: Synthetic oligonucleotide
  Target: ATXN1; (-) strand; PAM type: YTN; PAM sequence: CTT
accattgatgagttcactgg

SEQ ID NO: 215650 - DNA, 20 bp, Artificial Sequence
  Description of Artificial Sequence: Synthetic oligonucleotide
  Target: ATXN1; (-) strand; PAM type: YTN; PAM sequence: TTC
ttaccattgatgagttcact

SEQ ID NO: 215651 - DNA, 20 bp, Artificial Sequence
  Description of Artificial Sequence: Synthetic oligonucleotide
  Target: ATXN1; (-) strand; PAM type: YTN; PAM sequence: TTT
cttaccattgatgagttcac

SEQ ID NO: 215652 - DNA, 20 bp, Artificial Sequence
  Description of Artificial Sequence: Synthetic oligonucleotide
  Target: ATXN1; (-) strand; PAM type: YTN; PAM sequence: CTT
tcttaccattgatgagttca

SEQ ID NO: 215653 - DNA, 20 bp, Artificial Sequence
  Description of Artificial Sequence: Synthetic oligonucleotide
  Target: ATXN1; (-) strand; PAM type: YTN; PAM sequence: TTC
actttcttaccattgatgag

SEQ ID NO: 215654 - DNA, 20 bp, Artificial Sequence
  Description of Artificial Sequence: Synthetic oligonucleotide
  Target: ATXN1; (-) strand; PAM type: YTN; PAM sequence: TTT
cactttcttaccattgatga

SEQ ID NO: 215655 - DNA, 20 bp, Artificial Sequence
  Description of Artificial Sequence: Synthetic oligonucleotide
  Target: ATXN1; (-) strand; PAM type: YTN; PAM sequence: CTG
tttcactttcttaccattga

SEQ ID NO: 215656 - DNA, 20 bp, Artificial Sequence
  Description of Artificial Sequence: Synthetic oligonucleotide
  Target: ATXN1; (-) strand; PAM type: YTN; PAM sequence: TTG
tccatatcagcaacaaggct

SEQ ID NO: 215657 - DNA, 20 bp, Artificial Sequence
  Description of Artificial Sequence: Synthetic oligonucleotide
  Target: ATXN1; (-) strand; PAM type: YTN; PAM sequence: TTT
gtccatatcagcaacaaggc

SEQ ID NO: 215658 - DNA, 20 bp, Artificial Sequence
  Description of Artificial Sequence: Synthetic oligonucleotide
  Target: ATXN1; (-) strand; PAM type: YTN; PAM sequence: CTT
tgtccatatcagcaacaagg

SEQ ID NO: 215659 - DNA, 20 bp, Artificial Sequence
  Description of Artificial Sequence: Synthetic oligonucleotide
  Target: ATXN1; (-) strand; PAM type: YTN; PAM sequence: CTA
actttgtccatatcagcaac

SEQ ID NO: 215660 - DNA, 20 bp, Artificial Sequence
  Description of Artificial Sequence: Synthetic oligonucleotide
  Target: ATXN1; (-) strand; PAM type: YTN; PAM sequence: CTC
taactttgtccatatcagca

SEQ ID NO: 215661 - DNA, 20 bp, Artificial Sequence
  Description of Artificial Sequence: Synthetic oligonucleotide
  Target: ATXN1; (-) strand; PAM type: YTN; PAM sequence: TTC
agaccactctaactttgtcc

SEQ ID NO: 215662 - DNA, 20 bp, Artificial Sequence
  Description of Artificial Sequence: Synthetic oligonucleotide
  Target: ATXN1; (-) strand; PAM type: YTN; PAM sequence: CTA
ttcagaccactctaactttg

SEQ ID NO: 215663 - DNA, 20 bp, Artificial Sequence
  Description of Artificial Sequence: Synthetic oligonucleotide
  Target: ATXN1; (-) strand; PAM type: YTN; PAM sequence: TTC
tattcagaccactctaactt

SEQ ID NO: 215664 - DNA, 20 bp, Artificial Sequence
  Description of Artificial Sequence: Synthetic oligonucleotide
  Target: ATXN1; (-) strand; PAM type: YTN; PAM sequence: TTT
ctattcagaccactctaact

SEQ ID NO: 215665 - DNA, 20 bp, Artificial Sequence
  Description of Artificial Sequence: Synthetic oligonucleotide
  Target: ATXN1; (-) strand; PAM type: YTN; PAM sequence: TTT
tctattcagaccactctaac

SEQ ID NO: 215666 - DNA, 20 bp, Artificial Sequence
  Description of Artificial Sequence: Synthetic oligonucleotide
  Target: ATXN1; (-) strand; PAM type: YTN; PAM sequence: CTT
ttctattcagaccactctaa

SEQ ID NO: 215667 - DNA, 20 bp, Artificial Sequence
  Description of Artificial Sequence: Synthetic oligonucleotide
  Target: ATXN1; (-) strand; PAM type: YTN; PAM sequence: TTG
cttttctattcagaccactc

SEQ ID NO: 215668 - DNA, 20 bp, Artificial Sequence
  Description of Artificial Sequence: Synthetic oligonucleotide
  Target: ATXN1; (-) strand; PAM type: YTN; PAM sequence: TTT
gcttttctattcagaccact

SEQ ID NO: 215669 - DNA, 20 bp, Artificial Sequence
  Description of Artificial Sequence: Synthetic oligonucleotide
  Target: ATXN1; (-) strand; PAM type: YTN; PAM sequence: CTG
gtttgcttttctattcagac

SEQ ID NO: 215670 - DNA, 20 bp, Artificial Sequence
  Description of Artificial Sequence: Synthetic oligonucleotide
  Target: ATXN1; (-) strand; PAM type: YTN; PAM sequence: TTA
agggaatgtatggctggttt

SEQ ID NO: 215671 - DNA, 20 bp, Artificial Sequence
  Description of Artificial Sequence: Synthetic oligonucleotide
  Target: ATXN1; (-) strand; PAM type: YTN; PAM sequence: CTT
aagggaatgtatggctggtt

SEQ ID NO: 215672 - DNA, 20 bp, Artificial Sequence
  Description of Artificial Sequence: Synthetic oligonucleotide
  Target: ATXN1; (-) strand; PAM type: YTN; PAM sequence: TTG
gcttaagggaatgtatggct

SEQ ID NO: 215673 - DNA, 20 bp, Artificial Sequence
  Description of Artificial Sequence: Synthetic oligonucleotide
  Target: ATXN1; (-) strand; PAM type: YTN; PAM sequence: TTT
ggcttaagggaatgtatggc

SEQ ID NO: 215674 - DNA, 20 bp, Artificial Sequence
  Description of Artificial Sequence: Synthetic oligonucleotide
  Target: ATXN1; (-) strand; PAM type: YTN; PAM sequence: CTT
tggcttaagggaatgtatgg

SEQ ID NO: 215675 - DNA, 20 bp, Artificial Sequence
  Description of Artificial Sequence: Synthetic oligonucleotide
  Target: ATXN1; (-) strand; PAM type: YTN; PAM sequence: TTA
ggctttggcttaagggaatg

SEQ ID NO: 215676 - DNA, 20 bp, Artificial Sequence
  Description of Artificial Sequence: Synthetic oligonucleotide
  Target: ATXN1; (-) strand; PAM type: YTN; PAM sequence: CTG
gattaggctttggcttaagg

SEQ ID NO: 215677 - DNA, 20 bp, Artificial Sequence
  Description of Artificial Sequence: Synthetic oligonucleotide
  Target: ATXN1; (-) strand; PAM type: YTN; PAM sequence: TTG
atctggattaggctttggct

SEQ ID NO: 215678 - DNA, 20 bp, Artificial Sequence
  Description of Artificial Sequence: Synthetic oligonucleotide
  Target: ATXN1; (-) strand; PAM type: YTN; PAM sequence: CTT
gatctggattaggctttggc

SEQ ID NO: 215679 - DNA, 20 bp, Artificial Sequence
  Description of Artificial Sequence: Synthetic oligonucleotide
  Target: ATXN1; (-) strand; PAM type: YTN; PAM sequence: TTA
gggccttgatctggattagg

SEQ ID NO: 215680 - DNA, 20 bp, Artificial Sequence
  Description of Artificial Sequence: Synthetic oligonucleotide
  Target: ATXN1; (-) strand; PAM type: YTN; PAM sequence: TTC
atagaagtgaagagagttag

SEQ ID NO: 215681 - DNA, 20 bp, Artificial Sequence
  Description of Artificial Sequence: Synthetic oligonucleotide
  Target: ATXN1; (-) strand; PAM type: YTN; PAM sequence: CTT
catagaagtgaagagagtta

SEQ ID NO: 215682 - DNA, 20 bp, Artificial Sequence
  Description of Artificial Sequence: Synthetic oligonucleotide
  Target: ATXN1; (-) strand; PAM type: YTN; PAM sequence: CTC
agccttcatagaagtgaaga

SEQ ID NO: 215683 - DNA, 20 bp, Artificial Sequence
  Description of Artificial Sequence: Synthetic oligonucleotide
  Target: ATXN1; (-) strand; PAM type: YTN; PAM sequence: CTC
tcagccttcatagaagtgaa

SEQ ID NO: 215684 - DNA, 20 bp, Artificial Sequence
  Description of Artificial Sequence: Synthetic oligonucleotide
  Target: ATXN1; (-) strand; PAM type: YTN; PAM sequence: CTC
tctcagccttcatagaagtg

SEQ ID NO: 215685 - DNA, 20 bp, Artificial Sequence
  Description of Artificial Sequence: Synthetic oligonucleotide
  Target: ATXN1; (-) strand; PAM type: YTN; PAM sequence: CTC
acctctctcagccttcatag

SEQ ID NO: 215686 - DNA, 20 bp, Artificial Sequence
  Description of Artificial Sequence: Synthetic oligonucleotide
  Target: ATXN1; (-) strand; PAM type: YTN; PAM sequence: TTC
ctcacctctctcagccttca

SEQ ID NO: 215687 - DNA, 20 bp, Artificial Sequence
  Description of Artificial Sequence: Synthetic oligonucleotide
  Target: ATXN1; (-) strand; PAM type: YTN; PAM sequence: CTC
caagttcctcacctctctca

SEQ ID NO: 215688 - DNA, 20 bp, Artificial Sequence
  Description of Artificial Sequence: Synthetic oligonucleotide
  Target: ATXN1; (-) strand; PAM type: YTN; PAM sequence: TTC
tccaagttcctcacctctct

SEQ ID NO: 215689 - DNA, 20 bp, Artificial Sequence
  Description of Artificial Sequence: Synthetic oligonucleotide
  Target: ATXN1; (-) strand; PAM type: YTN; PAM sequence: CTT
ctccaagttcctcacctctc

SEQ ID NO: 215690 - DNA, 20 bp, Artificial Sequence
  Description of Artificial Sequence: Synthetic oligonucleotide
  Target: ATXN1; (-) strand; PAM type: YTN; PAM sequence: TTC
ttctccaagttcctcacctc

SEQ ID NO: 215691 - DNA, 20 bp, Artificial Sequence
  Description of Artificial Sequence: Synthetic oligonucleotide
  Target: ATXN1; (-) strand; PAM type: YTN; PAM sequence: TTT
cttctccaagttcctcacct

SEQ ID NO: 215692 - DNA, 20 bp, Artificial Sequence
  Description of Artificial Sequence: Synthetic oligonucleotide
  Target: ATXN1; (-) strand; PAM type: YTN; PAM sequence: TTT
tcttctccaagttcctcacc

SEQ ID NO: 215693 - DNA, 20 bp, Artificial Sequence
  Description of Artificial Sequence: Synthetic oligonucleotide
  Target: ATXN1; (-) strand; PAM type: YTN; PAM sequence: CTT
ttcttctccaagttcctcac

SEQ ID NO: 215694 - DNA, 20 bp, Artificial Sequence
  Description of Artificial Sequence: Synthetic oligonucleotide
  Target: ATXN1; (-) strand; PAM type: YTN; PAM sequence: TTC
aaacttttcttctccaagtt

SEQ ID NO: 215695 - DNA, 20 bp, Artificial Sequence
  Description of Artificial Sequence: Synthetic oligonucleotide
  Target: ATXN1; (-) strand; PAM type: YTN; PAM sequence: CTT
caaacttttcttctccaagt

SEQ ID NO: 215696 - DNA, 20 bp, Artificial Sequence
  Description of Artificial Sequence: Synthetic oligonucleotide
  Target: ATXN1; (-) strand; PAM type: YTN; PAM sequence: CTA
gcttcaaacttttcttctcc

SEQ ID NO: 215697 - DNA, 20 bp, Artificial Sequence
  Description of Artificial Sequence: Synthetic oligonucleotide
  Target: ATXN1; (-) strand; PAM type: YTN; PAM sequence: CTG
ctagcttcaaacttttcttc

SEQ ID NO: 215698 - DNA, 20 bp, Artificial Sequence
  Description of Artificial Sequence: Synthetic oligonucleotide
  Target: ATXN1; (-) strand; PAM type: YTN; PAM sequence: TTC
tgctagcttcaaacttttct

SEQ ID NO: 215699 - DNA, 20 bp, Artificial Sequence
  Description of Artificial Sequence: Synthetic oligonucleotide
  Target: ATXN1; (-) strand; PAM type: YTN; PAM sequence: CTT
ctgctagcttcaaacttttc

SEQ ID NO: 215700 - DNA, 20 bp, Artificial Sequence
  Description of Artificial Sequence: Synthetic oligonucleotide
  Target: ATXN1; (-) strand; PAM type: YTN; PAM sequence: CTC
acgaaccaacttctgctagc

SEQ ID NO: 215701 - DNA, 20 bp, Artificial Sequence
  Description of Artificial Sequence: Synthetic oligonucleotide
  Target: ATXN1; (-) strand; PAM type: YTN; PAM sequence: TTA
aatctcacgaaccaacttct

SEQ ID NO: 215702 - DNA, 20 bp, Artificial Sequence
  Description of Artificial Sequence: Synthetic oligonucleotide
  Target: ATXN1; (-) strand; PAM type: YTN; PAM sequence: CTT
aaatctcacgaaccaacttc

SEQ ID NO: 215703 - DNA, 20 bp, Artificial Sequence
  Description of Artificial Sequence: Synthetic oligonucleotide
  Target: ATXN1; (-) strand; PAM type: YTN; PAM sequence: TTC
cttaaatctcacgaaccaac

SEQ ID NO: 215704 - DNA, 20 bp, Artificial Sequence
  Description of Artificial Sequence: Synthetic oligonucleotide
  Target: ATXN1; (-) strand; PAM type: YTN; PAM sequence: TTT
ccttaaatctcacgaaccaa

SEQ ID NO: 215705 - DNA, 20 bp, Artificial Sequence
  Description of Artificial Sequence: Synthetic oligonucleotide
  Target: ATXN1; (-) strand; PAM type: YTN; PAM sequence: CTT
tccttaaatctcacgaacca

SEQ ID NO: 215706 - DNA, 20 bp, Artificial Sequence
  Description of Artificial Sequence: Synthetic oligonucleotide
  Target: ATXN1; (-) strand; PAM type: YTN; PAM sequence: TTC
tttccttaaatctcacgaac

SEQ ID NO: 215707 - DNA, 20 bp, Artificial Sequence
  Description of Artificial Sequence: Synthetic oligonucleotide
  Target: ATXN1; (-) strand; PAM type: YTN; PAM sequence: TTT
ctttccttaaatctcacgaa

SEQ ID NO: 215708 - DNA, 20 bp, Artificial Sequence
  Description of Artificial Sequence: Synthetic oligonucleotide
  Target: ATXN1; (-) strand; PAM type: YTN; PAM sequence: TTG
gagaagatttctttccttaa

SEQ ID NO: 215709 - DNA, 20 bp, Artificial Sequence
  Description of Artificial Sequence: Synthetic oligonucleotide
  Target: ATXN1; (-) strand; PAM type: YTN; PAM sequence: TTT
ggagaagatttctttcctta

SEQ ID NO: 215710 - DNA, 20 bp, Artificial Sequence
  Description of Artificial Sequence: Synthetic oligonucleotide
  Target: ATXN1; (-) strand; PAM type: YTN; PAM sequence: CTA
catcagcatttggagaagat

SEQ ID NO: 215711 - DNA, 20 bp, Artificial Sequence
  Description of Artificial Sequence: Synthetic oligonucleotide
  Target: ATXN1; (-) strand; PAM type: YTN; PAM sequence: TTC
tacatcagcatttggagaag

SEQ ID NO: 215712 - DNA, 20 bp, Artificial Sequence
  Description of Artificial Sequence: Synthetic oligonucleotide
  Target: ATXN1; (-) strand; PAM type: YTN; PAM sequence: CTT
ctacatcagcatttggagaa

SEQ ID NO: 215713 - DNA, 20 bp, Artificial Sequence
  Description of Artificial Sequence: Synthetic oligonucleotide
  Target: ATXN1; (-) strand; PAM type: YTN; PAM sequence: CTG
cagcttctacatcagcattt

SEQ ID NO: 215714 - DNA, 20 bp, Artificial Sequence
  Description of Artificial Sequence: Synthetic oligonucleotide
  Target: ATXN1; (-) strand; PAM type: YTN; PAM sequence: CTG
ctgcagcttctacatcagca

SEQ ID NO: 215715 - DNA, 20 bp, Artificial Sequence
  Description of Artificial Sequence: Synthetic oligonucleotide
  Target: ATXN1; (-) strand; PAM type: YTN; PAM sequence: CTG
gataacctgctgcagcttct

SEQ ID NO: 215716 - DNA, 20 bp, Artificial Sequence
  Description of Artificial Sequence: Synthetic oligonucleotide
  Target: ATXN1; (-) strand; PAM type: YTN; PAM sequence: TTC
tggataacctgctgcagctt

SEQ ID NO: 215717 - DNA, 20 bp, Artificial Sequence
  Description of Artificial Sequence: Synthetic oligonucleotide
  Target: ATXN1; (-) strand; PAM type: YTN; PAM sequence: TTT
ctggataacctgctgcagct

SEQ ID NO: 215718 - DNA, 20 bp, Artificial Sequence
  Description of Artificial Sequence: Synthetic oligonucleotide
  Target: ATXN1; (-) strand; PAM type: YTN; PAM sequence: TTT
tctggataacctgctgcagc

SEQ ID NO: 215719 - DNA, 20 bp, Artificial Sequence
  Description of Artificial Sequence: Synthetic oligonucleotide
  Target: ATXN1; (-) strand; PAM type: YTN; PAM sequence: TTA
aattttctggataacctgct

SEQ ID NO: 215720 - DNA, 20 bp, Artificial Sequence
  Description of Artificial Sequence: Synthetic oligonucleotide
  Target: ATXN1; (-) strand; PAM type: YTN; PAM sequence: TTA
gttaaattttctggataacc

SEQ ID NO: 215721 - DNA, 20 bp, Artificial Sequence
  Description of Artificial Sequence: Synthetic oligonucleotide
  Target: ATXN1; (-) strand; PAM type: YTN; PAM sequence: CTT
agttaaattttctggataac

SEQ ID NO: 215722 - DNA, 20 bp, Artificial Sequence
  Description of Artificial Sequence: Synthetic oligonucleotide
  Target: ATXN1; (-) strand; PAM type: YTN; PAM sequence: TTC
atcaatgatcttagttaaat

SEQ ID NO: 215723 - DNA, 20 bp, Artificial Sequence
  Description of Artificial Sequence: Synthetic oligonucleotide
  Target: ATXN1; (-) strand; PAM type: YTN; PAM sequence: CTT
catcaatgatcttagttaaa

SEQ ID NO: 215724 - DNA, 20 bp, Artificial Sequence
  Description of Artificial Sequence: Synthetic oligonucleotide
  Target: ATXN1; (-) strand; PAM type: YTN; PAM sequence: CTG
tagtcaccttcatcaatgat

SEQ ID NO: 215725 - DNA, 20 bp, Artificial Sequence
  Description of Artificial Sequence: Synthetic oligonucleotide
  Target: ATXN1; (-) strand; PAM type: YTN; PAM sequence: TTG
aaaaatctgtagtcaccttc

SEQ ID NO: 215726 - DNA, 20 bp, Artificial Sequence
  Description of Artificial Sequence: Synthetic oligonucleotide
  Target: ATXN1; (-) strand; PAM type: YTN; PAM sequence: CTA
cgttgaaaaatctgtagtca

SEQ ID NO: 215727 - DNA, 20 bp, Artificial Sequence
  Description of Artificial Sequence: Synthetic oligonucleotide
  Target: ATXN1; (-) strand; PAM type: YTN; PAM sequence: TTG
cctacgttgaaaaatctgta

SEQ ID NO: 215728 - DNA, 20 bp, Artificial Sequence
  Description of Artificial Sequence: Synthetic oligonucleotide
  Target: ATXN1; (-) strand; PAM type: YTN; PAM sequence: TTT
gcctacgttgaaaaatctgt

SEQ ID NO: 215729 - DNA, 20 bp, Artificial Sequence
  Description of Artificial Sequence: Synthetic oligonucleotide
  Target: ATXN1; (-) strand; PAM type: YTN; PAM sequence: CTT
tgcctacgttgaaaaatctg

SEQ ID NO: 215730 - DNA, 20 bp, Artificial Sequence
  Description of Artificial Sequence: Synthetic oligonucleotide
  Target: ATXN1; (-) strand; PAM type: YTN; PAM sequence: CTG
ctttgcctacgttgaaaaat

SEQ ID NO: 215731 - DNA, 20 bp, Artificial Sequence
  Description of Artificial Sequence: Synthetic oligonucleotide
  Target: ATXN1; (-) strand; PAM type: YTN; PAM sequence: TTC
caatagaaggctgctttgcc

SEQ ID NO: 215732 - DNA, 20 bp, Artificial Sequence
  Description of Artificial Sequence: Synthetic oligonucleotide
  Target: ATXN1; (-) strand; PAM type: YTN; PAM sequence: CTT
ccaatagaaggctgctttgc

SEQ ID NO: 215733 - DNA, 20 bp, Artificial Sequence
  Description of Artificial Sequence: Synthetic oligonucleotide
  Target: ATXN1; (-) strand; PAM type: YTN; PAM sequence: TTC
ttccaatagaaggctgcttt

SEQ ID NO: 215734 - DNA, 20 bp, Artificial Sequence
  Description of Artificial Sequence: Synthetic oligonucleotide
  Target: ATXN1; (-) strand; PAM type: YTN; PAM sequence: TTT
cttccaatagaaggctgctt

SEQ ID NO: 215735 - DNA, 20 bp, Artificial Sequence
  Description of Artificial Sequence: Synthetic oligonucleotide
  Target: ATXN1; (-) strand; PAM type: YTN; PAM sequence: TTT
tcttccaatagaaggctgct

SEQ ID NO: 215736 - DNA, 20 bp, Artificial Sequence
  Description of Artificial Sequence: Synthetic oligonucleotide
  Target: ATXN1; (-) strand; PAM type: YTN; PAM sequence: TTA
aatggcattttcttccaata

SEQ ID NO: 215737 - DNA, 20 bp, Artificial Sequence
  Description of Artificial Sequence: Synthetic oligonucleotide
  Target: ATXN1; (-) strand; PAM type: YTN; PAM sequence: CTT
aaatggcattttcttccaat

SEQ ID NO: 215738 - DNA, 20 bp, Artificial Sequence
  Description of Artificial Sequence: Synthetic oligonucleotide
  Target: ATXN1; (-) strand; PAM type: YTN; PAM sequence: CTA
tgaaagtcttaaatggcatt

SEQ ID NO: 215739 - DNA, 20 bp, Artificial Sequence
  Description of Artificial Sequence: Synthetic oligonucleotide
  Target: ATXN1; (-) strand; PAM type: YTN; PAM sequence: CTA
gctatgaaagtcttaaatgg

SEQ ID NO: 215740 - DNA, 20 bp, Artificial Sequence
  Description of Artificial Sequence: Synthetic oligonucleotide
  Target: ATXN1; (-) strand; PAM type: YTN; PAM sequence: CTC
tagctatgaaagtcttaaat

SEQ ID NO: 215741 - DNA, 20 bp, Artificial Sequence
  Description of Artificial Sequence: Synthetic oligonucleotide
  Target: ATXN1; (-) strand; PAM type: YTN; PAM sequence: CTC
tctagctatgaaagtcttaa

SEQ ID NO: 215742 - DNA, 20 bp, Artificial Sequence
  Description of Artificial Sequence: Synthetic oligonucleotide
  Target: ATXN1; (-) strand; PAM type: YTN; PAM sequence: CTC
ctctctagctatgaaagtct

SEQ ID NO: 215743 - DNA, 20 bp, Artificial Sequence
  Description of Artificial Sequence: Synthetic oligonucleotide
  Target: ATXN1; (-) strand; PAM type: YTN; PAM sequence: TTC
tcctctctagctatgaaagt

SEQ ID NO: 215744 - DNA, 20 bp, Artificial Sequence
  Description of Artificial Sequence: Synthetic oligonucleotide
  Target: ATXN1; (-) strand; PAM type: YTN; PAM sequence: CTT
ctcctctctagctatgaaag

SEQ ID NO: 215745 - DNA, 20 bp, Artificial Sequence
  Description of Artificial Sequence: Synthetic oligonucleotide
  Target: ATXN1; (-) strand; PAM type: YTN; PAM sequence: TTG
acttctcctctctagctatg

SEQ ID NO: 215746 - DNA, 20 bp, Artificial Sequence
  Description of Artificial Sequence: Synthetic oligonucleotide
  Target: ATXN1; (-) strand; PAM type: YTN; PAM sequence: TTG
tagtcaagcattgacttctc

SEQ ID NO: 215747 - DNA, 20 bp, Artificial Sequence
  Description of Artificial Sequence: Synthetic oligonucleotide
  Target: ATXN1; (-) strand; PAM type: YTN; PAM sequence: TTT
gtagtcaagcattgacttct

SEQ ID NO: 215748 - DNA, 20 bp, Artificial Sequence
  Description of Artificial Sequence: Synthetic oligonucleotide
  Target: ATXN1; (-) strand; PAM type: YTN; PAM sequence: CTT
tgtagtcaagcattgacttc

SEQ ID NO: 215749 - DNA, 20 bp, Artificial Sequence
  Description of Artificial Sequence: Synthetic oligonucleotide
  Target: ATXN1; (-) strand; PAM type: YTN; PAM sequence: TTG
aagctttgtagtcaagcatt

SEQ ID NO: 215750 - DNA, 20 bp, Artificial Sequence
  Description of Artificial Sequence: Synthetic oligonucleotide
  Target: ATXN1; (-) strand; PAM type: YTN; PAM sequence: TTT
gaagctttgtagtcaagcat

SEQ ID NO: 215751 - DNA, 20 bp, Artificial Sequence
  Description of Artificial Sequence: Synthetic oligonucleotide
  Target: ATXN1; (-) strand; PAM type: YTN; PAM sequence: CTT
tgaagctttgtagtcaagca

SEQ ID NO: 215752 - DNA, 20 bp, Artificial Sequence
  Description of Artificial Sequence: Synthetic oligonucleotide
  Target: ATXN1; (-) strand; PAM type: YTN; PAM sequence: CTC
ctttgaagctttgtagtcaa

SEQ ID NO: 215753 - DNA, 20 bp, Artificial Sequence
  Description of Artificial Sequence: Synthetic oligonucleotide
  Target: ATXN1; (-) strand; PAM type: YTN; PAM sequence: CTC
tcctttgaagctttgtagtc

SEQ ID NO: 215754 - DNA, 20 bp, Artificial Sequence
  Description of Artificial Sequence: Synthetic oligonucleotide
  Target: ATXN1; (-) strand; PAM type: YTN; PAM sequence: TTG
cccgtaacaagagagtcagc

SEQ ID NO: 215755 - DNA, 20 bp, Artificial Sequence
  Description of Artificial Sequence: Synthetic oligonucleotide
  Target: ATXN1; (-) strand; PAM type: YTN; PAM sequence: TTT
gcccgtaacaagagagtcag

SEQ ID NO: 215756 - DNA, 20 bp, Artificial Sequence
  Description of Artificial Sequence: Synthetic oligonucleotide
  Target: ATXN1; (-) strand; PAM type: YTN; PAM sequence: CTG
catttgcccgtaacaagaga

SEQ ID NO: 215757 - DNA, 20 bp, Artificial Sequence
  Description of Artificial Sequence: Synthetic oligonucleotide
  Target: ATXN1; (-) strand; PAM type: YTN; PAM sequence: CTA
gctgcatttgcccgtaacaa

SEQ ID NO: 215758 - DNA, 20 bp, Artificial Sequence
  Description of Artificial Sequence: Synthetic oligonucleotide
  Target: ATXN1; (-) strand; PAM type: YTN; PAM sequence: CTA
aagtcactagctgcatttgc

SEQ ID NO: 215759 - DNA, 20 bp, Artificial Sequence
  Description of Artificial Sequence: Synthetic oligonucleotide
  Target: ATXN1; (-) strand; PAM type: YTN; PAM sequence: TTC
aactaaagtcactagctgca

SEQ ID NO: 215760 - DNA, 20 bp, Artificial Sequence
  Description of Artificial Sequence: Synthetic oligonucleotide
  Target: ATXN1; (-) strand; PAM type: YTN; PAM sequence: CTT
caactaaagtcactagctgc

SEQ ID NO: 215761 - DNA, 20 bp, Artificial Sequence
  Description of Artificial Sequence: Synthetic oligonucleotide
  Target: ATXN1; (-) strand; PAM type: YTN; PAM sequence: TTG
gcttcaactaaagtcactag

SEQ ID NO: 215762 - DNA, 20 bp, Artificial Sequence
  Description of Artificial Sequence: Synthetic oligonucleotide
  Target: ATXN1; (-) strand; PAM type: YTN; PAM sequence: TTG
gaatggtaaatgagcattgg

SEQ ID NO: 215763 - DNA, 20 bp, Artificial Sequence
  Description of Artificial Sequence: Synthetic oligonucleotide
  Target: ATXN1; (-) strand; PAM type: YTN; PAM sequence: TTT
ggaatggtaaatgagcattg

SEQ ID NO: 215764 - DNA, 20 bp, Artificial Sequence
  Description of Artificial Sequence: Synthetic oligonucleotide
  Target: ATXN1; (-) strand; PAM type: YTN; PAM sequence: TTT
tggaatggtaaatgagcatt

SEQ ID NO: 215765 - DNA, 20 bp, Artificial Sequence
  Description of Artificial Sequence: Synthetic oligonucleotide
  Target: ATXN1; (-) strand; PAM type: YTN; PAM sequence: TTT
ttggaatggtaaatgagcat

SEQ ID NO: 215766 - DNA, 20 bp, Artificial Sequence
  Description of Artificial Sequence: Synthetic oligonucleotide
  Target: ATXN1; (-) strand; PAM type: YTN; PAM sequence: CTA
ggatttttggaatggtaaat

SEQ ID NO: 215767 - DNA, 20 bp, Artificial Sequence
  Description of Artificial Sequence: Synthetic oligonucleotide
  Target: ATXN1; (-) strand; PAM type: YTN; PAM sequence: CTC
taggatttttggaatggtaa

SEQ ID NO: 215768 - DNA, 20 bp, Artificial Sequence
  Description of Artificial Sequence: Synthetic oligonucleotide
  Target: ATXN1; (-) strand; PAM type: YTN; PAM sequence: TTA
gggctctaggatttttggaa

SEQ ID NO: 215769 - DNA, 20 bp, Artificial Sequence
  Description of Artificial Sequence: Synthetic oligonucleotide
  Target: ATXN1; (-) strand; PAM type: YTN; PAM sequence: TTA
ttagggctctaggatttttg

SEQ ID NO: 215770 - DNA, 20 bp, Artificial Sequence
  Description of Artificial Sequence: Synthetic oligonucleotide
  Target: ATXN1; (-) strand; PAM type: YTN; PAM sequence: TTC
agcataattattagggctct

SEQ ID NO: 215771 - DNA, 20 bp, Artificial Sequence
  Description of Artificial Sequence: Synthetic oligonucleotide
  Target: ATXN1; (-) strand; PAM type: YTN; PAM sequence: CTG
gcagagtagattcagcataa

SEQ ID NO: 215772 - DNA, 20 bp, Artificial Sequence
  Description of Artificial Sequence: Synthetic oligonucleotide
  Target: ATXN1; (-) strand; PAM type: YTN; PAM sequence: CTA
tagcactggcagagtagatt

SEQ ID NO: 215773 - DNA, 20 bp, Artificial Sequence
  Description of Artificial Sequence: Synthetic oligonucleotide
  Target: ATXN1; (-) strand; PAM type: YTN; PAM sequence: TTC
tatagcactggcagagtaga

SEQ ID NO: 215774 - DNA, 20 bp, Artificial Sequence
  Description of Artificial Sequence: Synthetic oligonucleotide
  Target: ATXN1; (-) strand; PAM type: YTN; PAM sequence: TTT
ctatagcactggcagagtag

SEQ ID NO: 215775 - DNA, 20 bp, Artificial Sequence
  Description of Artificial Sequence: Synthetic oligonucleotide
  Target: ATXN1; (-) strand; PAM type: YTN; PAM sequence: TTC
catttctatagcactggcag

SEQ ID NO: 215776 - DNA, 20 bp, Artificial Sequence
  Description of Artificial Sequence: Synthetic oligonucleotide
  Target: ATXN1; (-) strand; PAM type: YTN; PAM sequence: TTG
ttccatttctatagcactgg

SEQ ID NO: 215777 - DNA, 20 bp, Artificial Sequence
  Description of Artificial Sequence: Synthetic oligonucleotide
  Target: ATXN1; (-) strand; PAM type: YTN; PAM sequence: TTG
ttgttccatttctatagcac

SEQ ID NO: 215778 - DNA, 20 bp, Artificial Sequence
  Description of Artificial Sequence: Synthetic oligonucleotide
  Target: ATXN1; (-) strand; PAM type: YTN; PAM sequence: TTT
gttgttccatttctatagca

SEQ ID NO: 215779 - DNA, 20 bp, Artificial Sequence
  Description of Artificial Sequence: Synthetic oligonucleotide
  Target: ATXN1; (-) strand; PAM type: YTN; PAM sequence: CTT
tgttgttccatttctatagc

SEQ ID NO: 215780 - DNA, 20 bp, Artificial Sequence
  Description of Artificial Sequence: Synthetic oligonucleotide
  Target: ATXN1; (-) strand; PAM type: YTN; PAM sequence: TTC
atccaggctttgttgttcca

SEQ ID NO: 215781 - DNA, 20 bp, Artificial Sequence
  Description of Artificial Sequence: Synthetic oligonucleotide
  Target: ATXN1; (-) strand; PAM type: YTN; PAM sequence: TTT
catccaggctttgttgttcc

SEQ ID NO: 215782 - DNA, 20 bp, Artificial Sequence
  Description of Artificial Sequence: Synthetic oligonucleotide
  Target: ATXN1; (-) strand; PAM type: YTN; PAM sequence: CTT
tcatccaggctttgttgttc

SEQ ID NO: 215783 - DNA, 20 bp, Artificial Sequence
  Description of Artificial Sequence: Synthetic oligonucleotide
  Target: ATXN1; (-) strand; PAM type: YTN; PAM sequence: TTA
gtaacccaatgtgctttcat

SEQ ID NO: 215784 - DNA, 20 bp, Artificial Sequence
  Description of Artificial Sequence: Synthetic oligonucleotide
  Target: ATXN1; (-) strand; PAM type: YTN; PAM sequence: TTT
agtaacccaatgtgctttca

SEQ ID NO: 215785 - DNA, 20 bp, Artificial Sequence
  Description of Artificial Sequence: Synthetic oligonucleotide
  Target: ATXN1; (-) strand; PAM type: YTN; PAM sequence: TTA
aagtatttagtaacccaatg

SEQ ID NO: 215786 - DNA, 20 bp, Artificial Sequence
  Description of Artificial Sequence: Synthetic oligonucleotide
  Target: ATXN1; (-) strand; PAM type: YTN; PAM sequence: CTT
aaagtatttagtaacccaat

SEQ ID NO: 215787 - DNA, 20 bp, Artificial Sequence
  Description of Artificial Sequence: Synthetic oligonucleotide
  Target: ATXN1; (-) strand; PAM type: YTN; PAM sequence: CTC
aacagtgggcttaaagtatt

SEQ ID NO: 215788 - DNA, 20 bp, Artificial Sequence
  Description of Artificial Sequence: Synthetic oligonucleotide
  Target: ATXN1; (-) strand; PAM type: YTN; PAM sequence: TTA
agtctcaacagtgggcttaa

SEQ ID NO: 215789 - DNA, 20 bp, Artificial Sequence
  Description of Artificial Sequence: Synthetic oligonucleotide
  Target: ATXN1; (-) strand; PAM type: YTN; PAM sequence: CTG
agcaattaagtctcaacagt

SEQ ID NO: 215790 - DNA, 20 bp, Artificial Sequence
  Description of Artificial Sequence: Synthetic oligonucleotide
  Target: ATXN1; (-) strand; PAM type: YTN; PAM sequence: TTC
tgagcaattaagtctcaaca

SEQ ID NO: 215791 - DNA, 20 bp, Artificial Sequence
  Description of Artificial Sequence: Synthetic oligonucleotide
  Target: ATXN1; (-) strand; PAM type: YTN; PAM sequence: TTT
ctgagcaattaagtctcaac

SEQ ID NO: 215792 - DNA, 20 bp, Artificial Sequence
  Description of Artificial Sequence: Synthetic oligonucleotide
  Target: ATXN1; (-) strand; PAM type: YTN; PAM sequence: TTT
tctgagcaattaagtctcaa

SEQ ID NO: 215793 - DNA, 20 bp, Artificial Sequence
  Description of Artificial Sequence: Synthetic oligonucleotide
  Target: ATXN1; (-) strand; PAM type: YTN; PAM sequence: TTT
ttctgagcaattaagtctca

SEQ ID NO: 215794 - DNA, 20 bp, Artificial Sequence
  Description of Artificial Sequence: Synthetic oligonucleotide
  Target: ATXN1; (-) strand; PAM type: YTN; PAM sequence: CTT
tttctgagcaattaagtctc

SEQ ID NO: 215795 - DNA, 20 bp, Artificial Sequence
  Description of Artificial Sequence: Synthetic oligonucleotide
  Target: ATXN1; (-) strand; PAM type: YTN; PAM sequence: TTG
aaaggaatctttttctgagc

SEQ ID NO: 215796 - DNA, 20 bp, Artificial Sequence
  Description of Artificial Sequence: Synthetic oligonucleotide
  Target: ATXN1; (-) strand; PAM type: YTN; PAM sequence: TTT
gaaaggaatctttttctgag

SEQ ID NO: 215797 - DNA, 20 bp, Artificial Sequence
  Description of Artificial Sequence: Synthetic oligonucleotide
  Target: ATXN1; (-) strand; PAM type: YTN; PAM sequence: TTT
tgaaaggaatctttttctga

SEQ ID NO: 215798 - DNA, 20 bp, Artificial Sequence
  Description of Artificial Sequence: Synthetic oligonucleotide
  Target: ATXN1; (-) strand; PAM type: YTN; PAM sequence: TTG
tcaataagcagtaatatttt

SEQ ID NO: 215799 - DNA, 20 bp, Artificial Sequence
  Description of Artificial Sequence: Synthetic oligonucleotide
  Target: ATXN1; (-) strand; PAM type: YTN; PAM sequence: TTA
gatgagtgacgaagtgcatt

SEQ ID NO: 215800 - DNA, 20 bp, Artificial Sequence
  Description of Artificial Sequence: Synthetic oligonucleotide
  Target: ATXN1; (-) strand; PAM type: YTN; PAM sequence: CTT
agatgagtgacgaagtgcat

SEQ ID NO: 215801 - DNA, 20 bp, Artificial Sequence
  Description of Artificial Sequence: Synthetic oligonucleotide
  Target: ATXN1; (-) strand; PAM type: YTN; PAM sequence: CTC
ttagatgagtgacgaagtgc

SEQ ID NO: 215802 - DNA, 20 bp, Artificial Sequence
  Description of Artificial Sequence: Synthetic oligonucleotide
  Target: ATXN1; (-) strand; PAM type: YTN; PAM sequence: TTC
catcagagctcttagatgag

SEQ ID NO: 215803 - DNA, 20 bp, Artificial Sequence
  Description of Artificial Sequence: Synthetic oligonucleotide
  Target: ATXN1; (-) strand; PAM type: YTN; PAM sequence: TTT
ccatcagagctcttagatga

SEQ ID NO: 215804 - DNA, 20 bp, Artificial Sequence
  Description of Artificial Sequence: Synthetic oligonucleotide
  Target: ATXN1; (-) strand; PAM type: YTN; PAM sequence: TTG
tatatttccatcagagctct

SEQ ID NO: 215805 - DNA, 20 bp, Artificial Sequence
  Description of Artificial Sequence: Synthetic oligonucleotide
  Target: ATXN1; (-) strand; PAM type: YTN; PAM sequence: CTT
gtatatttccatcagagctc

SEQ ID NO: 215806 - DNA, 20 bp, Artificial Sequence
  Description of Artificial Sequence: Synthetic oligonucleotide
  Target: ATXN1; (-) strand; PAM type: YTN; PAM sequence: CTC
cttgtatatttccatcagag

SEQ ID NO: 215807 - DNA, 20 bp, Artificial Sequence
  Description of Artificial Sequence: Synthetic oligonucleotide
  Target: ATXN1; (-) strand; PAM type: YTN; PAM sequence: TTA
gcaggcgtgaaaacgacatg

SEQ ID NO: 215808 - DNA, 20 bp, Artificial Sequence
  Description of Artificial Sequence: Synthetic oligonucleotide
  Target: ATXN1; (-) strand; PAM type: YTN; PAM sequence: TTG
tgttagcaggcgtgaaaacg

SEQ ID NO: 215809 - DNA, 20 bp, Artificial Sequence
  Description of Artificial Sequence: Synthetic oligonucleotide
  Target: ATXN1; (-) strand; PAM type: YTN; PAM sequence: TTG
cagaatgggtgttgtgttag

SEQ ID NO: 215810 - DNA, 20 bp, Artificial Sequence
  Description of Artificial Sequence: Synthetic oligonucleotide
  Target: ATXN1; (-) strand; PAM type: YTN; PAM sequence: TTG
atccatgggttgcagaatgg

SEQ ID NO: 215811 - DNA, 20 bp, Artificial Sequence
  Description of Artificial Sequence: Synthetic oligonucleotide
  Target: ATXN1; (-) strand; PAM type: YTN; PAM sequence: CTT
gatccatgggttgcagaatg

SEQ ID NO: 215812 - DNA, 20 bp, Artificial Sequence
  Description of Artificial Sequence: Synthetic oligonucleotide
  Target: ATXN1; (-) strand; PAM type: YTN; PAM sequence: CTC
cttgatccatgggttgcaga

SEQ ID NO: 215813 - DNA, 20 bp, Artificial Sequence
  Description of Artificial Sequence: Synthetic oligonucleotide
  Target: ATXN1; (-) strand; PAM type: YTN; PAM sequence: TTA
ctccttgatccatgggttgc

SEQ ID NO: 215814 - DNA, 20 bp, Artificial Sequence
  Description of Artificial Sequence: Synthetic oligonucleotide
  Target: ATXN1; (-) strand; PAM type: YTN; PAM sequence: TTG
aaaataaaaattactccttg

SEQ ID NO: 215815 - DNA, 20 bp, Artificial Sequence
  Description of Artificial Sequence: Synthetic oligonucleotide
  Target: ATXN1; (-) strand; PAM type: YTN; PAM sequence: CTT
gaaaataaaaattactcctt

SEQ ID NO: 215816 - DNA, 20 bp, Artificial Sequence
  Description of Artificial Sequence: Synthetic oligonucleotide
  Target: ATXN1; (-) strand; PAM type: YTN; PAM sequence: TTA
aataagaagacttgaaaata

SEQ ID NO: 215817 - DNA, 20 bp, Artificial Sequence
  Description of Artificial Sequence: Synthetic oligonucleotide
  Target: ATXN1; (-) strand; PAM type: YTN; PAM sequence: CTT
aaataagaagacttgaaaat

SEQ ID NO: 215818 - DNA, 20 bp, Artificial Sequence
  Description of Artificial Sequence: Synthetic oligonucleotide
  Target: ATXN1; (-) strand; PAM type: YTN; PAM sequence: TTC
ttaaataagaagacttgaaa

SEQ ID NO: 215819 - DNA, 20 bp, Artificial Sequence
  Description of Artificial Sequence: Synthetic oligonucleotide
  Target: ATXN1; (-) strand; PAM type: YTN; PAM sequence: TTT
cttaaataagaagacttgaa

SEQ ID NO: 215820 - DNA, 20 bp, Artificial Sequence
  Description of Artificial Sequence: Synthetic oligonucleotide
  Target: ATXN1; (-) strand; PAM type: YTN; PAM sequence: TTA
cagaatgtatttcttaaata

SEQ ID NO: 215821 - DNA, 20 bp, Artificial Sequence
  Description of Artificial Sequence: Synthetic oligonucleotide
  Target: ATXN1; (-) strand; PAM type: YTN; PAM sequence: CTT
acagaatgtatttcttaaat

SEQ ID NO: 215822 - DNA, 20 bp, Artificial Sequence
  Description of Artificial Sequence: Synthetic oligonucleotide
  Target: ATXN1; (-) strand; PAM type: YTN; PAM sequence: CTG
tggcaatgatagccttacag

SEQ ID NO: 215823 - DNA, 20 bp, Artificial Sequence
  Description of Artificial Sequence: Synthetic oligonucleotide
  Target: ATXN1; (-) strand; PAM type: YTN; PAM sequence: TTC
tgtggcaatgatagccttac

SEQ ID NO: 215824 - DNA, 20 bp, Artificial Sequence
  Description of Artificial Sequence: Synthetic oligonucleotide
  Target: ATXN1; (-) strand; PAM type: YTN; PAM sequence: TTT
ctgtggcaatgatagcctta

SEQ ID NO: 215825 - DNA, 20 bp, Artificial Sequence
  Description of Artificial Sequence: Synthetic oligonucleotide
  Target: ATXN1; (-) strand; PAM type: YTN; PAM sequence: CTT
tctgtggcaatgatagcctt

SEQ ID NO: 215826 - DNA, 20 bp, Artificial Sequence
  Description of Artificial Sequence: Synthetic oligonucleotide
  Target: ATXN1; (-) strand; PAM type: YTN; PAM sequence: TTA
ctttctgtggcaatgatagc

SEQ ID NO: 215827 - DNA, 20 bp, Artificial Sequence
  Description of Artificial Sequence: Synthetic oligonucleotide
  Target: ATXN1; (-) strand; PAM type: YTN; PAM sequence: TTC
ccagatccatcagaggaatt

SEQ ID NO: 215828 - DNA, 20 bp, Artificial Sequence
  Description of Artificial Sequence: Synthetic oligonucleotide
  Target: ATXN1; (-) strand; PAM type: YTN; PAM sequence: TTT
cccagatccatcagaggaat

SEQ ID NO: 215829 - DNA, 20 bp, Artificial Sequence
  Description of Artificial Sequence: Synthetic oligonucleotide
  Target: ATXN1; (-) strand; PAM type: YTN; PAM sequence: TTT
tcccagatccatcagaggaa

SEQ ID NO: 215830 - DNA, 20 bp, Artificial Sequence
  Description of Artificial Sequence: Synthetic oligonucleotide
  Target: ATXN1; (-) strand; PAM type: YTN; PAM sequence: CTT
ttcccagatccatcagagga

SEQ ID NO: 215831 - DNA, 20 bp, Artificial Sequence
  Description of Artificial Sequence: Synthetic oligonucleotide
  Target: ATXN1; (-) strand; PAM type: YTN; PAM sequence: TTA
cttttcccagatccatcaga

SEQ ID NO: 215832 - DNA, 20 bp, Artificial Sequence
  Description of Artificial Sequence: Synthetic oligonucleotide
  Target: ATXN1; (-) strand; PAM type: YTN; PAM sequence: TTT
acttttcccagatccatcag

SEQ ID NO: 215833 - DNA, 20 bp, Artificial Sequence
  Description of Artificial Sequence: Synthetic oligonucleotide
  Target: ATXN1; (-) strand; PAM type: YTN; PAM sequence: TTC
aatttacttttcccagatcc

SEQ ID NO: 215834 - DNA, 20 bp, Artificial Sequence
  Description of Artificial Sequence: Synthetic oligonucleotide
  Target: ATXN1; (-) strand; PAM type: YTN; PAM sequence: TTT
caatttacttttcccagatc

SEQ ID NO: 215835 - DNA, 20 bp, Artificial Sequence
  Description of Artificial Sequence: Synthetic oligonucleotide
  Target: ATXN1; (-) strand; PAM type: YTN; PAM sequence: TTT
tcaatttacttttcccagat

SEQ ID NO: 215836 - DNA, 20 bp, Artificial Sequence
  Description of Artificial Sequence: Synthetic oligonucleotide
  Target: ATXN1; (-) strand; PAM type: YTN; PAM sequence: TTC
caggaggttttcaatttact

SEQ ID NO: 215837 - DNA, 20 bp, Artificial Sequence
  Description of Artificial Sequence: Synthetic oligonucleotide
  Target: ATXN1; (-) strand; PAM type: YTN; PAM sequence: TTT
ccaggaggttttcaatttac

SEQ ID NO: 215838 - DNA, 20 bp, Artificial Sequence
  Description of Artificial Sequence: Synthetic oligonucleotide
  Target: ATXN1; (-) strand; PAM type: YTN; PAM sequence: CTT
tccaggaggttttcaattta

SEQ ID NO: 215839 - DNA, 20 bp, Artificial Sequence
  Description of Artificial Sequence: Synthetic oligonucleotide
  Target: ATXN1; (-) strand; PAM type: YTN; PAM sequence: CTA
caatggtgaatcctttccag

SEQ ID NO: 215840 - DNA, 20 bp, Artificial Sequence
  Description of Artificial Sequence: Synthetic oligonucleotide
  Target: ATXN1; (-) strand; PAM type: YTN; PAM sequence: TTA
atgacatctacaatggtgaa

SEQ ID NO: 215841 - DNA, 20 bp, Artificial Sequence
  Description of Artificial Sequence: Synthetic oligonucleotide
  Target: ATXN1; (-) strand; PAM type: YTN; PAM sequence: CTT
aatgacatctacaatggtga

SEQ ID NO: 215842 - DNA, 20 bp, Artificial Sequence
  Description of Artificial Sequence: Synthetic oligonucleotide
  Target: ATXN1; (-) strand; PAM type: YTN; PAM sequence: TTC
ttaatgacatctacaatggt

SEQ ID NO: 215843 - DNA, 20 bp, Artificial Sequence
  Description of Artificial Sequence: Synthetic oligonucleotide
  Target: ATXN1; (-) strand; PAM type: YTN; PAM sequence: TTC
ccatgaatcaaatgttctta

SEQ ID NO: 215844 - DNA, 20 bp, Artificial Sequence
  Description of Artificial Sequence: Synthetic oligonucleotide
  Target: ATXN1; (-) strand; PAM type: YTN; PAM sequence: CTT
cccatgaatcaaatgttctt

SEQ ID NO: 215845 - DNA, 20 bp, Artificial Sequence
  Description of Artificial Sequence: Synthetic oligonucleotide
  Target: ATXN1; (-) strand; PAM type: YTN; PAM sequence: CTC
ttcccatgaatcaaatgttc

SEQ ID NO: 215846 - DNA, 20 bp, Artificial Sequence
  Description of Artificial Sequence: Synthetic oligonucleotide
  Target: ATXN1; (-) strand; PAM type: YTN; PAM sequence: TTG
acctcttcccatgaatcaaa

SEQ ID NO: 215847 - DNA, 20 bp, Artificial Sequence
  Description of Artificial Sequence: Synthetic oligonucleotide
  Target: ATXN1; (-) strand; PAM type: YTN; PAM sequence: TTT
gacctcttcccatgaatcaa

SEQ ID NO: 215848 - DNA, 20 bp, Artificial Sequence
  Description of Artificial Sequence: Synthetic oligonucleotide
  Target: ATXN1; (-) strand; PAM type: YTN; PAM sequence: TTT
tgacctcttcccatgaatca

SEQ ID NO: 215849 - DNA, 20 bp, Artificial Sequence
  Description of Artificial Sequence: Synthetic oligonucleotide
  Target: ATXN1; (-) strand; PAM type: YTN; PAM sequence: TTG
atattttgacctcttcccat

SEQ ID NO: 215850 - DNA, 20 bp, Artificial Sequence
  Description of Artificial Sequence: Synthetic oligonucleotide
  Target: ATXN1; (-) strand; PAM type: YTN; PAM sequence: TTC
atgttgatattttgacctct

SEQ ID NO: 215851 - DNA, 20 bp, Artificial Sequence
  Description of Artificial Sequence: Synthetic oligonucleotide
  Target: ATXN1; (-) strand; PAM type: YTN; PAM sequence: CTG
atgttcatgttgatattttg

SEQ ID NO: 215852 - DNA, 20 bp, Artificial Sequence
  Description of Artificial Sequence: Synthetic oligonucleotide
  Target: ATXN1; (-) strand; PAM type: YTN; PAM sequence: TTC
caaactgatgttcatgttga

SEQ ID NO: 215853 - DNA, 20 bp, Artificial Sequence
  Description of Artificial Sequence: Synthetic oligonucleotide
  Target: ATXN1; (-) strand; PAM type: YTN; PAM sequence: CTT
ccaaactgatgttcatgttg

SEQ ID NO: 215854 - DNA, 20 bp, Artificial Sequence
  Description of Artificial Sequence: Synthetic oligonucleotide
  Target: ATXN1; (-) strand; PAM type: YTN; PAM sequence: TTC
ttccaaactgatgttcatgt

SEQ ID NO: 215855 - DNA, 20 bp, Artificial Sequence
  Description of Artificial Sequence: Synthetic oligonucleotide
  Target: ATXN1; (-) strand; PAM type: YTN; PAM sequence: CTT
cttccaaactgatgttcatg

SEQ ID NO: 215856 - DNA, 20 bp, Artificial Sequence
  Description of Artificial Sequence: Synthetic oligonucleotide
  Target: ATXN1; (-) strand; PAM type: YTN; PAM sequence: TTG
gaatcaacttcttccaaact

SEQ ID NO: 215857 - DNA, 20 bp, Artificial Sequence
  Description of Artificial Sequence: Synthetic oligonucleotide
  Target: ATXN1; (-) strand; PAM type: YTN; PAM sequence: CTC
aagtcatccatgggggttgg

SEQ ID NO: 215858 - DNA, 20 bp, Artificial Sequence
  Description of Artificial Sequence: Synthetic oligonucleotide
  Target: ATXN1; (-) strand; PAM type: YTN; PAM sequence: TTG
aaaccctcaagtcatccatg

SEQ ID NO: 215859 - DNA, 20 bp, Artificial Sequence
  Description of Artificial Sequence: Synthetic oligonucleotide
  Target: ATXN1; (-) strand; PAM type: YTN; PAM sequence: CTT
gaaaccctcaagtcatccat

SEQ ID NO: 215860 - DNA, 20 bp, Artificial Sequence
  Description of Artificial Sequence: Synthetic oligonucleotide
  Target: ATXN1; (-) strand; PAM type: YTN; PAM sequence: CTC
caccgaagtcttgaaaccct

SEQ ID NO: 215861 - DNA, 20 bp, Artificial Sequence
  Description of Artificial Sequence: Synthetic oligonucleotide
  Target: ATXN1; (-) strand; PAM type: YTN; PAM sequence: TTC
ctccaccgaagtcttgaaac

SEQ ID NO: 215862 - DNA, 20 bp, Artificial Sequence
  Description of Artificial Sequence: Synthetic oligonucleotide
  Target: ATXN1; (-) strand; PAM type: YTN; PAM sequence: CTT
cctccaccgaagtcttgaaa

SEQ ID NO: 215863 - DNA, 20 bp, Artificial Sequence
  Description of Artificial Sequence: Synthetic oligonucleotide
  Target: ATXN1; (-) strand; PAM type: YTN; PAM sequence: TTC
cttcctccaccgaagtcttg

SEQ ID NO: 215864 - DNA, 20 bp, Artificial Sequence
  Description of Artificial Sequence: Synthetic oligonucleotide
  Target: ATXN1; (-) strand; PAM type: YTN; PAM sequence: CTG
cagttccttcctccaccgaa

SEQ ID NO: 215865 - DNA, 20 bp, Artificial Sequence
  Description of Artificial Sequence: Synthetic oligonucleotide
  Target: ATXN1; (-) strand; PAM type: YTN; PAM sequence: CTC
atctgcagttccttcctcca

SEQ ID NO: 215866 - DNA, 20 bp, Artificial Sequence
  Description of Artificial Sequence: Synthetic oligonucleotide
  Target: ATXN1; (-) strand; PAM type: YTN; PAM sequence: TTC
cacctcatctgcagttcctt

SEQ ID NO: 215867 - DNA, 20 bp, Artificial Sequence
  Description of Artificial Sequence: Synthetic oligonucleotide
  Target: ATXN1; (-) strand; PAM type: YTN; PAM sequence: TTT
ccacctcatctgcagttcct

SEQ ID NO: 215868 - DNA, 20 bp, Artificial Sequence
  Description of Artificial Sequence: Synthetic oligonucleotide
  Target: ATXN1; (-) strand; PAM type: YTN; PAM sequence: CTG
tttccacctcatctgcagtt

SEQ ID NO: 215869 - DNA, 20 bp, Artificial Sequence
  Description of Artificial Sequence: Synthetic oligonucleotide
  Target: ATXN1; (-) strand; PAM type: YTN; PAM sequence: TTG
ctgtttccacctcatctgca

SEQ ID NO: 215870 - DNA, 20 bp, Artificial Sequence
  Description of Artificial Sequence: Synthetic oligonucleotide
  Target: ATXN1; (-) strand; PAM type: YTN; PAM sequence: CTT
gctgtttccacctcatctgc

SEQ ID NO: 215871 - DNA, 20 bp, Artificial Sequence
  Description of Artificial Sequence: Synthetic oligonucleotide
  Target: ATXN1; (-) strand; PAM type: YTN; PAM sequence: CTC
ttgctgtttccacctcatct

SEQ ID NO: 215872 - DNA, 20 bp, Artificial Sequence
  Description of Artificial Sequence: Synthetic oligonucleotide
  Target: ATXN1; (-) strand; PAM type: YTN; PAM sequence: TTC
tcttgctgtttccacctcat

SEQ ID NO: 215873 - DNA, 20 bp, Artificial Sequence
  Description of Artificial Sequence: Synthetic oligonucleotide
  Target: ATXN1; (-) strand; PAM type: YTN; PAM sequence: CTG
gttctcttgctgtttccacc

SEQ ID NO: 215874 - DNA, 20 bp, Artificial Sequence
  Description of Artificial Sequence: Synthetic oligonucleotide
  Target: ATXN1; (-) strand; PAM type: YTN; PAM sequence: TTC
tggttctcttgctgtttcca

SEQ ID NO: 215875 - DNA, 20 bp, Artificial Sequence
  Description of Artificial Sequence: Synthetic oligonucleotide
  Target: ATXN1; (-) strand; PAM type: YTN; PAM sequence: CTA
attctggttctcttgctgtt

SEQ ID NO: 215876 - DNA, 20 bp, Artificial Sequence
  Description of Artificial Sequence: Synthetic oligonucleotide
  Target: ATXN1; (-) strand; PAM type: YTN; PAM sequence: TTC
taattctggttctcttgctg

SEQ ID NO: 215877 - DNA, 20 bp, Artificial Sequence
  Description of Artificial Sequence: Synthetic oligonucleotide
  Target: ATXN1; (-) strand; PAM type: YTN; PAM sequence: TTT
ctaattctggttctcttgct

SEQ ID NO: 215878 - DNA, 20 bp, Artificial Sequence
  Description of Artificial Sequence: Synthetic oligonucleotide
  Target: ATXN1; (-) strand; PAM type: YTN; PAM sequence: CTC
catttctaattctggttctc

SEQ ID NO: 215879 - DNA, 20 bp, Artificial Sequence
  Description of Artificial Sequence: Synthetic oligonucleotide
  Target: ATXN1; (-) strand; PAM type: YTN; PAM sequence: TTC
aggctccatttctaattctg

SEQ ID NO: 215880 - DNA, 20 bp, Artificial Sequence
  Description of Artificial Sequence: Synthetic oligonucleotide
  Target: ATXN1; (-) strand; PAM type: YTN; PAM sequence: TTT
caggctccatttctaattct

SEQ ID NO: 215881 - DNA, 20 bp, Artificial Sequence
  Description of Artificial Sequence: Synthetic oligonucleotide
  Target: ATXN1; (-) strand; PAM type: YTN; PAM sequence: TTT
tcaggctccatttctaattc

SEQ ID NO: 215882 - DNA, 20 bp, Artificial Sequence
  Description of Artificial Sequence: Synthetic oligonucleotide
  Target: ATXN1; (-) strand; PAM type: YTN; PAM sequence: TTC
agtcacattttcaggctcca

SEQ ID NO: 215883 - DNA, 20 bp, Artificial Sequence
  Description of Artificial Sequence: Synthetic oligonucleotide
  Target: ATXN1; (-) strand; PAM type: YTN; PAM sequence: TTG
cagcaatcaattcagtcaca

SEQ ID NO: 215884 - DNA, 20 bp, Artificial Sequence
  Description of Artificial Sequence: Synthetic oligonucleotide
  Target: ATXN1; (-) strand; PAM type: YTN; PAM sequence: TTG
atcatgagattgcagcaatc

SEQ ID NO: 215885 - DNA, 20 bp, Artificial Sequence
  Description of Artificial Sequence: Synthetic oligonucleotide
  Target: ATXN1; (-) strand; PAM type: YTN; PAM sequence: TTT
gatcatgagattgcagcaat

SEQ ID NO: 215886 - DNA, 20 bp, Artificial Sequence
  Description of Artificial Sequence: Synthetic oligonucleotide
  Target: ATXN1; (-) strand; PAM type: YTN; PAM sequence: CTG
aagtttgatcatgagattgc

SEQ ID NO: 215887 - DNA, 20 bp, Artificial Sequence
  Description of Artificial Sequence: Synthetic oligonucleotide
  Target: ATXN1; (-) strand; PAM type: YTN; PAM sequence: CTG
ctgaagtttgatcatgagat

SEQ ID NO: 215888 - DNA, 20 bp, Artificial Sequence
  Description of Artificial Sequence: Synthetic oligonucleotide
  Target: ATXN1; (-) strand; PAM type: YTN; PAM sequence: CTC
atctgctgaagtttgatcat

SEQ ID NO: 215889 - DNA, 20 bp, Artificial Sequence
  Description of Artificial Sequence: Synthetic oligonucleotide
  Target: ATXN1; (-) strand; PAM type: YTN; PAM sequence: CTC
ctcatctgctgaagtttgat

SEQ ID NO: 215890 - DNA, 20 bp, Artificial Sequence
  Description of Artificial Sequence: Synthetic oligonucleotide
  Target: ATXN1; (-) strand; PAM type: YTN; PAM sequence: CTC
catagaggcaactcctcatc

SEQ ID NO: 215891 - DNA, 20 bp, Artificial Sequence
  Description of Artificial Sequence: Synthetic oligonucleotide
  Target: ATXN1; (-) strand; PAM type: YTN; PAM sequence: CTC
ctccatagaggcaactcctc

SEQ ID NO: 215892 - DNA, 20 bp, Artificial Sequence
  Description of Artificial Sequence: Synthetic oligonucleotide
  Target: ATXN1; (-) strand; PAM type: YTN; PAM sequence: TTG
ctcctccatagaggcaactc

SEQ ID NO: 215893 - DNA, 20 bp, Artificial Sequence
  Description of Artificial Sequence: Synthetic oligonucleotide
  Target: ATXN1; (-) strand; PAM type: YTN; PAM sequence: TTT
gctcctccatagaggcaact

SEQ ID NO: 215894 - DNA, 20 bp, Artificial Sequence
  Description of Artificial Sequence: Synthetic oligonucleotide
  Target: ATXN1; (-) strand; PAM type: YTN; PAM sequence: CTT
tgctcctccatagaggcaac

SEQ ID NO: 215895 - DNA, 20 bp, Artificial Sequence
  Description of Artificial Sequence: Synthetic oligonucleotide
  Target: ATXN1; (-) strand; PAM type: YTN; PAM sequence: TTC
tttgctcctccatagaggca

SEQ ID NO: 215896 - DNA, 20 bp, Artificial Sequence
  Description of Artificial Sequence: Synthetic oligonucleotide
  Target: ATXN1; (-) strand; PAM type: YTN; PAM sequence: TTT
ctttgctcctccatagaggc

SEQ ID NO: 215897 - DNA, 20 bp, Artificial Sequence
  Description of Artificial Sequence: Synthetic oligonucleotide
  Target: ATXN1; (-) strand; PAM type: YTN; PAM sequence: CTT
tctttgctcctccatagagg

SEQ ID NO: 215898 - DNA, 20 bp, Artificial Sequence
  Description of Artificial Sequence: Synthetic oligonucleotide
  Target: ATXN1; (-) strand; PAM type: YTN; PAM sequence: CTG
tgcccggccatgaaaccact

SEQ ID NO: 215899 - DNA, 20 bp, Artificial Sequence
  Description of Artificial Sequence: Synthetic oligonucleotide
  Target: ATXN1; (-) strand; PAM type: YTN; PAM sequence: TTA
caagcgtgagccactgtgcc

SEQ ID NO: 215900 - DNA, 20 bp, Artificial Sequence
  Description of Artificial Sequence: Synthetic oligonucleotide
  Target: ATXN1; (-) strand; PAM type: YTN; PAM sequence: CTG
agattacaagcgtgagccac

SEQ ID NO: 215901 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgagattacaa

SEQ ID NO: 215902 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctgaga

SEQ ID NO: 215903 - DNA, 20 bp, Artificial Sequence
  Description of Artificial Sequence: Synthetic oligonucleotide
  Target: ATXN1; (-) strand; PAM type: YTN; PAM sequence: CTG
cctcggcctcccaaagtgct

SEQ ID NO: 215904 - DNA, 20 bp, Artificial Sequence
  Description of Artificial Sequence: Synthetic oligonucleotide
  Target: ATXN1; (-) strand; PAM type: YTN; PAM sequence: TTC
ccctgcctcggcctcccaaa

SEQ ID NO: 215905 - DNA, 20 bp, Artificial Sequence
  Description of Artificial Sequence: Synthetic oligonucleotide
  Target: ATXN1; (-) strand; PAM type: YTN; PAM sequence: TTG
tgattcccctgcctcggcct

SEQ ID NO: 215906 - DNA, 20 bp, Artificial Sequence
  Description of Artificial Sequence: Synthetic oligonucleotide
  Target: ATXN1; (-) strand; PAM type: YTN; PAM sequence: CTT
gtgattcccctgcctcggcc

SEQ ID NO: 215907 - DNA, 20 bp, Artificial Sequence
  Description of Artificial Sequence: Synthetic oligonucleotide
  Target: ATXN1; (-) strand; PAM type: YTN; PAM sequence: CTC
cggaccttgtgattcccctg

SEQ ID NO: 215908 - DNA, 20 bp, Artificial Sequence
  Description of Artificial Sequence: Synthetic oligonucleotide
  Target: ATXN1; (-) strand; PAM type: YTN; PAM sequence: CTA
tctccggaccttgtgattcc

SEQ ID NO: 215909 - DNA, 20 bp, Artificial Sequence
  Description of Artificial Sequence: Synthetic oligonucleotide
  Target: ATXN1; (-) strand; PAM type: YTN; PAM sequence: CTC
tatctccggaccttgtgatt

SEQ ID NO: 215910 - DNA, 20 bp, Artificial Sequence
  Description of Artificial Sequence: Synthetic oligonucleotide
  Target: ATXN1; (-) strand; PAM type: YTN; PAM sequence: TTA
gccaggatggcctctatctc

SEQ ID NO: 215911 - DNA, 20 bp, Artificial Sequence
  Description of Artificial Sequence: Synthetic oligonucleotide
  Target: ATXN1; (-) strand; PAM type: YTN; PAM sequence: CTG
tgttagccaggatggcctct

SEQ ID NO: 215912 - DNA, 20 bp, Artificial Sequence
  Description of Artificial Sequence: Synthetic oligonucleotide
  Target: ATXN1; (-) strand; PAM type: YTN; PAM sequence: TTA
gctgtgttagccaggatggc

SEQ ID NO: 215913 - DNA, 20 bp, Artificial Sequence
  Description of Artificial Sequence: Synthetic oligonucleotide
  Target: ATXN1; (-) strand; PAM type: YTN; PAM sequence: TTC
acaatgttagctgtgttagc

SEQ ID NO: 215914 - DNA, 20 bp, Artificial Sequence
  Description of Artificial Sequence: Synthetic oligonucleotide
  Target: ATXN1; (-) strand; PAM type: YTN; PAM sequence: TTT
cacaatgttagctgtgttag

SEQ ID NO: 215915 - DNA, 20 bp, Artificial Sequence
  Description of Artificial Sequence: Synthetic oligonucleotide
  Target: ATXN1; (-) strand; PAM type: YTN; PAM sequence: TTA
gtagagatgggtttcacaat

SEQ ID NO: 215916 - DNA, 20 bp, Artificial Sequence
  Description of Artificial Sequence: Synthetic oligonucleotide
  Target: ATXN1; (-) strand; PAM type: YTN; PAM sequence: TTT
agtagagatgggtttcacaa

SEQ ID NO: 215917 - DNA, 20 bp, Artificial Sequence
  Description of Artificial Sequence: Synthetic oligonucleotide
  Target: ATXN1; (-) strand; PAM type: YTN; PAM sequence: TTT
tagtagagatgggtttcaca

SEQ ID NO: 215918 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatgggtttcac

SEQ ID NO: 215919 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggt

SEQ ID NO: 215920 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 215921 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 215922 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 215923 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagat

SEQ ID NO: 215924 - DNA, 20 bp, Artificial Sequence
  Description of Artificial Sequence: Synthetic oligonucleotide
  Target: ATXN1; (-) strand; PAM type: YTN; PAM sequence: CTA
attttttgtatttttagtag

SEQ ID NO: 215925 - DNA, 20 bp, Artificial Sequence
  Description of Artificial Sequence: Synthetic oligonucleotide
  Target: ATXN1; (-) strand; PAM type: YTN; PAM sequence: CTG
ggctaattttttgtattttt

SEQ ID NO: 215926 - DNA, 20 bp, Artificial Sequence
  Description of Artificial Sequence: Synthetic oligonucleotide
  Target: ATXN1; (-) strand; PAM type: YTN; PAM sequence: CTA
caggtgcgcaccaccacgct

SEQ ID NO: 215927 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgcgcaccac

SEQ ID NO: 215928 - DNA, 20 bp, Artificial Sequence
  Description of Artificial Sequence: Synthetic oligonucleotide
  Target: ATXN1; (-) strand; PAM type: YTN; PAM sequence: CTG
agtagctgggactacaggtg

SEQ ID NO: 215929 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggactacag

SEQ ID NO: 215930 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctggga

SEQ ID NO: 215931 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagct

SEQ ID NO: 215932 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgagta

SEQ ID NO: 215933 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcctgag

SEQ ID NO: 215934 - DNA, 20 bp, Artificial Sequence
  Description of Artificial Sequence: Synthetic oligonucleotide
  Target: ATXN1; (-) strand; PAM type: YTN; PAM sequence: TTC
aaacaattctcctgcctcag

SEQ ID NO: 215935 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaaacaattctcc

SEQ ID NO: 215936 - DNA, 20 bp, Artificial Sequence
  Description of Artificial Sequence: Synthetic oligonucleotide
  Target: ATXN1; (-) strand; PAM type: YTN; PAM sequence: CTC
cacctcccaggttcaaacaa

SEQ ID NO: 215937 - DNA, 20 bp, Artificial Sequence
  Description of Artificial Sequence: Synthetic oligonucleotide
  Target: ATXN1; (-) strand; PAM type: YTN; PAM sequence: CTG
caacctccacctcccaggtt

SEQ ID NO: 215938 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccacctccca

SEQ ID NO: 215939 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctccacc

SEQ ID NO: 215940 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcgcgatctc

SEQ ID NO: 215941 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgcag

SEQ ID NO: 215942 - DNA, 20 bp, Artificial Sequence
  Description of Artificial Sequence: Synthetic oligonucleotide
  Target: ATXN1; (-) strand; PAM type: YTN; PAM sequence: TTC
tgtcacccaggctggagtgc

SEQ ID NO: 215943 - DNA, 20 bp, Artificial Sequence
  Description of Artificial Sequence: Synthetic oligonucleotide
  Target: ATXN1; (-) strand; PAM type: YTN; PAM sequence: CTC
gttctgtcacccaggctgga

SEQ ID NO: 215944 - DNA, 20 bp, Artificial Sequence
  Description of Artificial Sequence: Synthetic oligonucleotide
  Target: ATXN1; (-) strand; PAM type: YTN; PAM sequence: TTG
agacggagtctcgttctgtc

SEQ ID NO: 215945 - DNA, 20 bp, Artificial Sequence
  Description of Artificial Sequence: Synthetic oligonucleotide
  Target: ATXN1; (-) strand; PAM type: YTN; PAM sequence: TTT
gagacggagtctcgttctgt

SEQ ID NO: 215946 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtctcgttctg

SEQ ID NO: 215947 - DNA, 20 bp, Artificial Sequence
  Description of Artificial Sequence: Synthetic oligonucleotide
  Target: ATXN1; (-) strand; PAM type: YTN; PAM sequence: TTG
ttttgagacggagtctcgtt

SEQ ID NO: 215948 - DNA, 20 bp, Artificial Sequence
  Description of Artificial Sequence: Synthetic oligonucleotide
  Target: ATXN1; (-) strand; PAM type: YTN; PAM sequence: TTT
gttttgagacggagtctcgt

SEQ ID NO: 215949 - DNA, 20 bp, Artificial Sequence
  Description of Artificial Sequence: Synthetic oligonucleotide
  Target: ATXN1; (-) strand; PAM type: YTN; PAM sequence: TTG
tttgttttgagacggagtct

SEQ ID NO: 215950 - DNA, 20 bp, Artificial Sequence
  Description of Artificial Sequence: Synthetic oligonucleotide
  Target: ATXN1; (-) strand; PAM type: YTN; PAM sequence: TTT
gtttgttttgagacggagtc

SEQ ID NO: 215951 - DNA, 20 bp, Artificial Sequence
  Description of Artificial Sequence: Synthetic oligonucleotide
  Target: ATXN1; (-) strand; PAM type: YTN; PAM sequence: TTG
tttgtttgttttgagacgga

SEQ ID NO: 215952 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgttttgagacgg

SEQ ID NO: 215953 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgttttgaga

SEQ ID NO: 215954 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgttttgag

SEQ ID NO: 215955 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgtttgtttt

SEQ ID NO: 215956 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgtttgttt

SEQ ID NO: 215957 - DNA, 20 bp, Artificial Sequence
  Description of Artificial Sequence: Synthetic oligonucleotide
  Target: ATXN1; (-) strand; PAM type: YTN; PAM sequence: TTT
tgtttgtttgtttgtttgtt

SEQ ID NO: 215958 - DNA, 20 bp, Artificial Sequence
  Description of Artificial Sequence: Synthetic oligonucleotide
  Target: ATXN1; (-) strand; PAM type: YTN; PAM sequence: TTT
ttgtttgtttgtttgtttgt

SEQ ID NO: 215959 - DNA, 20 bp, Artificial Sequence
  Description of Artificial Sequence: Synthetic oligonucleotide
  Target: ATXN1; (-) strand; PAM type: YTN; PAM sequence: TTT
tttgtttgtttgtttgtttg

SEQ ID NO: 215960 - DNA, 20 bp, Artificial Sequence
  Description of Artificial Sequence: Synthetic oligonucleotide
  Target: ATXN1; (-) strand; PAM type: YTN; PAM sequence: TTT
ttttgtttgtttgtttgttt

SEQ ID NO: 215961 - DNA, 20 bp, Artificial Sequence
  Description of Artificial Sequence: Synthetic oligonucleotide
  Target: ATXN1; (-) strand; PAM type: YTN; PAM sequence: CTG
gtttttttgtttgtttgttt

SEQ ID NO: 215962 - DNA, 20 bp, Artificial Sequence
  Description of Artificial Sequence: Synthetic oligonucleotide
  Target: ATXN1; (-) strand; PAM type: YTN; PAM sequence: CTC
atgaaaccactggttttttt

SEQ ID NO: 215963 - DNA, 20 bp, Artificial Sequence
  Description of Artificial Sequence: Synthetic oligonucleotide
  Target: ATXN1; (-) strand; PAM type: YTN; PAM sequence: TTA
catctcatgaaaccactggt

SEQ ID NO: 215964 - DNA, 20 bp, Artificial Sequence
  Description of Artificial Sequence: Synthetic oligonucleotide
  Target: ATXN1; (-) strand; PAM type: YTN; PAM sequence: TTC
atcaggagtagattacatct

SEQ ID NO: 215965 - DNA, 20 bp, Artificial Sequence
  Description of Artificial Sequence: Synthetic oligonucleotide
  Target: ATXN1; (-) strand; PAM type: YTN; PAM sequence: CTT
catcaggagtagattacatc

SEQ ID NO: 215966 - DNA, 20 bp, Artificial Sequence
  Description of Artificial Sequence: Synthetic oligonucleotide
  Target: ATXN1; (-) strand; PAM type: YTN; PAM sequence: TTC
acagtatcttcatcaggagt

SEQ ID NO: 215967 - DNA, 20 bp, Artificial Sequence
  Description of Artificial Sequence: Synthetic oligonucleotide
  Target: ATXN1; (-) strand; PAM type: YTN; PAM sequence: TTA
acagtgttcacagtatcttc

SEQ ID NO: 215968 - DNA, 20 bp, Artificial Sequence
  Description of Artificial Sequence: Synthetic oligonucleotide
  Target: ATXN1; (-) strand; PAM type: YTN; PAM sequence: TTT
aacagtgttcacagtatctt

SEQ ID NO: 215969 - DNA, 20 bp, Artificial Sequence
  Description of Artificial Sequence: Synthetic oligonucleotide
  Target: ATXN1; (-) strand; PAM type: YTN; PAM sequence: TTT
taacagtgttcacagtatct

SEQ ID NO: 215970 - DNA, 20 bp, Artificial Sequence
  Description of Artificial Sequence: Synthetic oligonucleotide
  Target: ATXN1; (-) strand; PAM type: YTN; PAM sequence: TTG
tcattttaacagtgttcaca

SEQ ID NO: 215971 - DNA, 20 bp, Artificial Sequence
  Description of Artificial Sequence: Synthetic oligonucleotide
  Target: ATXN1; (-) strand; PAM type: YTN; PAM sequence: TTG
ttgtcattttaacagtgttc

SEQ ID NO: 215972 - DNA, 20 bp, Artificial Sequence
  Description of Artificial Sequence: Synthetic oligonucleotide
  Target: ATXN1; (-) strand; PAM type: YTN; PAM sequence: TTT
gttgtcattttaacagtgtt

SEQ ID NO: 215973 - DNA, 20 bp, Artificial Sequence
  Description of Artificial Sequence: Synthetic oligonucleotide
  Target: ATXN1; (-) strand; PAM type: YTN; PAM sequence: CTT
tgttgtcattttaacagtgt

SEQ ID NO: 215974 - DNA, 20 bp, Artificial Sequence
  Description of Artificial Sequence: Synthetic oligonucleotide
  Target: ATXN1; (-) strand; PAM type: YTN; PAM sequence: TTC
aaatcctttgttgtcatttt

SEQ ID NO: 215975 - DNA, 20 bp, Artificial Sequence
  Description of Artificial Sequence: Synthetic oligonucleotide
  Target: ATXN1; (-) strand; PAM type: YTN; PAM sequence: TTT
caaatcctttgttgtcattt

SEQ ID NO: 215976 - DNA, 20 bp, Artificial Sequence
  Description of Artificial Sequence: Synthetic oligonucleotide
  Target: ATXN1; (-) strand; PAM type: YTN; PAM sequence: TTA
tgtaatatttcaaatccttt

SEQ ID NO: 215977 - DNA, 20 bp, Artificial Sequence
  Description of Artificial Sequence: Synthetic oligonucleotide
  Target: ATXN1; (-) strand; PAM type: YTN; PAM sequence: TTT
atgtaatatttcaaatcctt

SEQ ID NO: 215978 - DNA, 20 bp, Artificial Sequence
  Description of Artificial Sequence: Synthetic oligonucleotide
  Target: ATXN1; (-) strand; PAM type: YTN; PAM sequence: TTA
agtttatgtaatatttcaaa

SEQ ID NO: 215979 - DNA, 20 bp, Artificial Sequence
  Description of Artificial Sequence: Synthetic oligonucleotide
  Target: ATXN1; (-) strand; PAM type: YTN; PAM sequence: CTG
catcaattaagtttatgtaa

SEQ ID NO: 215980 - DNA, 20 bp, Artificial Sequence
  Description of Artificial Sequence: Synthetic oligonucleotide
  Target: ATXN1; (-) strand; PAM type: YTN; PAM sequence: CTG
tcactgcatcaattaagttt

SEQ ID NO: 215981 - DNA, 20 bp, Artificial Sequence
  Description of Artificial Sequence: Synthetic oligonucleotide
  Target: ATXN1; (-) strand; PAM type: YTN; PAM sequence: CTC
aaacctgtcactgcatcaat

SEQ ID NO: 215982 - DNA, 20 bp, Artificial Sequence
  Description of Artificial Sequence: Synthetic oligonucleotide
  Target: ATXN1; (-) strand; PAM type: YTN; PAM sequence: CTC
tcaaacctgtcactgcatca

SEQ ID NO: 215983 - DNA, 20 bp, Artificial Sequence
  Description of Artificial Sequence: Synthetic oligonucleotide
  Target: ATXN1; (-) strand; PAM type: YTN; PAM sequence: TTA
gagtcagtcctctcaaacct

SEQ ID NO: 215984 - DNA, 20 bp, Artificial Sequence
  Description of Artificial Sequence: Synthetic oligonucleotide
  Target: ATXN1; (-) strand; PAM type: YTN; PAM sequence: TTC
aaagttagagtcagtcctct

SEQ ID NO: 215985 - DNA, 20 bp, Artificial Sequence
  Description of Artificial Sequence: Synthetic oligonucleotide
  Target: ATXN1; (-) strand; PAM type: YTN; PAM sequence: TTT
caaagttagagtcagtcctc

SEQ ID NO: 215986 - DNA, 20 bp, Artificial Sequence
  Description of Artificial Sequence: Synthetic oligonucleotide
  Target: ATXN1; (-) strand; PAM type: YTN; PAM sequence: CTT
tcaaagttagagtcagtcct

SEQ ID NO: 215987 - DNA, 20 bp, Artificial Sequence
  Description of Artificial Sequence: Synthetic oligonucleotide
  Target: ATXN1; (-) strand; PAM type: YTN; PAM sequence: TTA
cccatagtagaactttcaaa

SEQ ID NO: 215988 - DNA, 20 bp, Artificial Sequence
  Description of Artificial Sequence: Synthetic oligonucleotide
  Target: ATXN1; (-) strand; PAM type: YTN; PAM sequence: TTT
acccatagtagaactttcaa

SEQ ID NO: 215989 - DNA, 20 bp, Artificial Sequence
  Description of Artificial Sequence: Synthetic oligonucleotide
  Target: ATXN1; (-) strand; PAM type: YTN; PAM sequence: TTT
tacccatagtagaactttca

SEQ ID NO: 215990 - DNA, 20 bp, Artificial Sequence
  Description of Artificial Sequence: Synthetic oligonucleotide
  Target: ATXN1; (-) strand; PAM type: YTN; PAM sequence: TTG
agagcattttacccatagta

SEQ ID NO: 215991 - DNA, 20 bp, Artificial Sequence
  Description of Artificial Sequence: Synthetic oligonucleotide
  Target: ATXN1; (-) strand; PAM type: YTN; PAM sequence: TTT
gagagcattttacccatagt

SEQ ID NO: 215992 - DNA, 20 bp, Artificial Sequence
  Description of Artificial Sequence: Synthetic oligonucleotide
  Target: ATXN1; (-) strand; PAM type: YTN; PAM sequence: TTG
tttgagagcattttacccat

SEQ ID NO: 215993 - DNA, 20 bp, Artificial Sequence
  Description of Artificial Sequence: Synthetic oligonucleotide
  Target: ATXN1; (-) strand; PAM type: YTN; PAM sequence: CTG
tagtatgcaccattgtttga

SEQ ID NO: 215994 - DNA, 20 bp, Artificial Sequence
  Description of Artificial Sequence: Synthetic oligonucleotide
  Target: ATXN1; (-) strand; PAM type: YTN; PAM sequence: CTC
tgtagtatgcaccattgttt

SEQ ID NO: 215995 - DNA, 20 bp, Artificial Sequence
  Description of Artificial Sequence: Synthetic oligonucleotide
  Target: ATXN1; (-) strand; PAM type: YTN; PAM sequence: TTC
tctgtagtatgcaccattgt

SEQ ID NO: 215996 - DNA, 20 bp, Artificial Sequence
  Description of Artificial Sequence: Synthetic oligonucleotide
  Target: ATXN1; (-) strand; PAM type: YTN; PAM sequence: TTT
ctctgtagtatgcaccattg

SEQ ID NO: 215997 - DNA, 20 bp, Artificial Sequence
  Description of Artificial Sequence: Synthetic oligonucleotide
  Target: ATXN1; (-) strand; PAM type: YTN; PAM sequence: TTC
atgaaagatttctctgtagt

SEQ ID NO: 215998 - DNA, 20 bp, Artificial Sequence
  Description of Artificial Sequence: Synthetic oligonucleotide
  Target: ATXN1; (-) strand; PAM type: YTN; PAM sequence: TTT
catgaaagatttctctgtag

SEQ ID NO: 215999 - DNA, 20 bp, Artificial Sequence
  Description of Artificial Sequence: Synthetic oligonucleotide
  Target: ATXN1; (-) strand; PAM type: YTN; PAM sequence: CTT
tcatgaaagatttctctgta

SEQ ID NO: 216000 - DNA, 20 bp, Artificial Sequence
  Description of Artificial Sequence: Synthetic oligonucleotide
  Target: ATXN1; (-) strand; PAM type: YTN; PAM sequence: TTC
ctttcatgaaagatttctct

SEQ ID NO: 216001 - DNA, 20 bp, Artificial Sequence
  Description of Artificial Sequence: Synthetic oligonucleotide
  Target: ATXN1; (-) strand; PAM type: YTN; PAM sequence: CTT
cctttcatgaaagatttctc

SEQ ID NO: 216002 - DNA, 20 bp, Artificial Sequence
  Description of Artificial Sequence: Synthetic oligonucleotide
  Target: ATXN1; (-) strand; PAM type: YTN; PAM sequence: CTC
ttcctttcatgaaagatttc

SEQ ID NO: 216003 - DNA, 20 bp, Artificial Sequence
  Description of Artificial Sequence: Synthetic oligonucleotide
  Target: ATXN1; (-) strand; PAM type: YTN; PAM sequence: TTG
actcttcctttcatgaaaga

SEQ ID NO: 216004 - DNA, 20 bp, Artificial Sequence
  Description of Artificial Sequence: Synthetic oligonucleotide
  Target: ATXN1; (-) strand; PAM type: YTN; PAM sequence: TTA
ttgactcttcctttcatgaa

SEQ ID NO: 216005 - DNA, 20 bp, Artificial Sequence
  Description of Artificial Sequence: Synthetic oligonucleotide
  Target: ATXN1; (-) strand; PAM type: YTN; PAM sequence: TTT
attgactcttcctttcatga

SEQ ID NO: 216006 - DNA, 20 bp, Artificial Sequence
  Description of Artificial Sequence: Synthetic oligonucleotide
  Target: ATXN1; (-) strand; PAM type: YTN; PAM sequence: TTG
ccacatttattgactcttcc

SEQ ID NO: 216007 - DNA, 20 bp, Artificial Sequence
  Description of Artificial Sequence: Synthetic oligonucleotide
  Target: ATXN1; (-) strand; PAM type: YTN; PAM sequence: TTT
gccacatttattgactcttc

SEQ ID NO: 216008 - DNA, 20 bp, Artificial Sequence
  Description of Artificial Sequence: Synthetic oligonucleotide
  Target: ATXN1; (-) strand; PAM type: YTN; PAM sequence: TTA
gacaacaatgacgtttgcca

SEQ ID NO: 216009 - DNA, 20 bp, Artificial Sequence
  Description of Artificial Sequence: Synthetic oligonucleotide
  Target: ATXN1; (-) strand; PAM type: YTN; PAM sequence: TTA
aaattagacaacaatgacgt

SEQ ID NO: 216010 - DNA, 20 bp, Artificial Sequence
  Description of Artificial Sequence: Synthetic oligonucleotide
  Target: ATXN1; (-) strand; PAM type: YTN; PAM sequence: CTT
aaaattagacaacaatgacg

SEQ ID NO: 216011 - DNA, 20 bp, Artificial Sequence
  Description of Artificial Sequence: Synthetic oligonucleotide
  Target: ATXN1; (-) strand; PAM type: YTN; PAM sequence: TTC
ttaaaattagacaacaatga

SEQ ID NO: 216012 - DNA, 20 bp, Artificial Sequence
  Description of Artificial Sequence: Synthetic oligonucleotide
  Target: ATXN1; (-) strand; PAM type: YTN; PAM sequence: TTT
cttaaaattagacaacaatg

SEQ ID NO: 216013 - DNA, 20 bp, Artificial Sequence
  Description of Artificial Sequence: Synthetic oligonucleotide
  Target: ATXN1; (-) strand; PAM type: YTN; PAM sequence: CTG
gggtggcggtggcaatttct

SEQ ID NO: 216014 - DNA, 20 bp, Artificial Sequence
  Description of Artificial Sequence: Synthetic oligonucleotide
  Target: ATXN1; (-) strand; PAM type: YTN; PAM sequence: CTG
aaagctggggtggcggtggc

SEQ ID NO: 216015 - DNA, 20 bp, Artificial Sequence
  Description of Artificial Sequence: Synthetic oligonucleotide
  Target: ATXN1; (-) strand; PAM type: YTN; PAM sequence: TTG
ctgaaagctggggtggcggt

SEQ ID NO: 216016 - DNA, 20 bp, Artificial Sequence
  Description of Artificial Sequence: Synthetic oligonucleotide
  Target: ATXN1; (-) strand; PAM type: YTN; PAM sequence: TTA
gggaggtggttgctgaaagc

SEQ ID NO: 216017 - DNA, 20 bp, Artificial Sequence
  Description of Artificial Sequence: Synthetic oligonucleotide
  Target: ATXN1; (-) strand; PAM type: YTN; PAM sequence: TTT
agggaggtggttgctgaaag

SEQ ID NO: 216018 - DNA, 20 bp, Artificial Sequence
  Description of Artificial Sequence: Synthetic oligonucleotide
  Target: ATXN1; (-) strand; PAM type: YTN; PAM sequence: CTG
atttagggaggtggttgctg

SEQ ID NO: 216019 - DNA, 20 bp, Artificial Sequence
  Description of Artificial Sequence: Synthetic oligonucleotide
  Target: ATXN1; (-) strand; PAM type: YTN; PAM sequence: CTG
actgatttagggaggtggtt

SEQ ID NO: 216020 - DNA, 20 bp, Artificial Sequence
  Description of Artificial Sequence: Synthetic oligonucleotide
  Target: ATXN1; (-) strand; PAM type: YTN; PAM sequence: CTG
ctgactgatttagggaggtg

SEQ ID NO: 216021 - DNA, 20 bp, Artificial Sequence
  Description of Artificial Sequence: Synthetic oligonucleotide
  Target: ATXN1; (-) strand; PAM type: YTN; PAM sequence: TTG
atggctgctgactgatttag

SEQ ID NO: 216022 - DNA, 20 bp, Artificial Sequence
  Description of Artificial Sequence: Synthetic oligonucleotide
  Target: ATXN1; (-) strand; PAM type: YTN; PAM sequence: TTA
cgttgatggctgctgactga

SEQ ID NO: 216023 - DNA, 20 bp, Artificial Sequence
  Description of Artificial Sequence: Synthetic oligonucleotide
  Target: ATXN1; (-) strand; PAM type: YTN; PAM sequence: TTT
acgttgatggctgctgactg

SEQ ID NO: 216024 - DNA, 20 bp, Artificial Sequence
  Description of Artificial Sequence: Synthetic oligonucleotide
  Target: ATXN1; (-) strand; PAM type: YTN; PAM sequence: CTT
tacgttgatggctgctgact

SEQ ID NO: 216025 - DNA, 20 bp, Artificial Sequence
  Description of Artificial Sequence: Synthetic oligonucleotide
  Target: ATXN1; (-) strand; PAM type: YTN; PAM sequence: TTG
gtaaagggtctttacgttga

SEQ ID NO: 216026 - DNA, 20 bp, Artificial Sequence
  Description of Artificial Sequence: Synthetic oligonucleotide
  Target: ATXN1; (-) strand; PAM type: YTN; PAM sequence: TTG
ttggtaaagggtctttacgt

SEQ ID NO: 216027 - DNA, 20 bp, Artificial Sequence
  Description of Artificial Sequence: Synthetic oligonucleotide
  Target: ATXN1; (-) strand; PAM type: YTN; PAM sequence: TTT
gttggtaaagggtctttacg

SEQ ID NO: 216028 - DNA, 20 bp, Artificial Sequence
  Description of Artificial Sequence: Synthetic oligonucleotide
  Target: ATXN1; (-) strand; PAM type: YTN; PAM sequence: TTT
tgttggtaaagggtctttac

SEQ ID NO: 216029 - DNA, 20 bp, Artificial Sequence
  Description of Artificial Sequence: Synthetic oligonucleotide
  Target: ATXN1; (-) strand; PAM type: YTN; PAM sequence: TTG
aaccataatcgttttgttgg

SEQ ID NO: 216030 - DNA, 20 bp, Artificial Sequence
  Description of Artificial Sequence: Synthetic oligonucleotide
  Target: ATXN1; (-) strand; PAM type: YTN; PAM sequence: TTC
attgaaccataatcgttttg

SEQ ID NO: 216031 - DNA, 20 bp, Artificial Sequence
  Description of Artificial Sequence: Synthetic oligonucleotide
  Target: ATXN1; (-) strand; PAM type: YTN; PAM sequence: CTT
cattgaaccataatcgtttt

SEQ ID NO: 216032 - DNA, 20 bp, Artificial Sequence
  Description of Artificial Sequence: Synthetic oligonucleotide
  Target: ATXN1; (-) strand; PAM type: YTN; PAM sequence: TTA
acgatcatcttcattgaacc

SEQ ID NO: 216033 - DNA, 20 bp, Artificial Sequence
  Description of Artificial Sequence: Synthetic oligonucleotide
  Target: ATXN1; (-) strand; PAM type: YTN; PAM sequence: CTG
ttaacgatcatcttcattga

SEQ ID NO: 216034 - DNA, 20 bp, Artificial Sequence
  Description of Artificial Sequence: Synthetic oligonucleotide
  Target: ATXN1; (-) strand; PAM type: YTN; PAM sequence: CTA
aaaactgttaacgatcatct

SEQ ID NO: 216035 - DNA, 20 bp, Artificial Sequence
  Description of Artificial Sequence: Synthetic oligonucleotide
  Target: ATXN1; (-) strand; PAM type: YTN; PAM sequence: TTG
ctaaaaactgttaacgatca

SEQ ID NO: 216036 - DNA, 20 bp, Artificial Sequence
  Description of Artificial Sequence: Synthetic oligonucleotide
  Target: ATXN1; (-) strand; PAM type: YTN; PAM sequence: TTA
ttgctaaaaactgttaacga

SEQ ID NO: 216037 - DNA, 20 bp, Artificial Sequence
  Description of Artificial Sequence: Synthetic oligonucleotide
  Target: ATXN1; (-) strand; PAM type: YTN; PAM sequence: TTT
attgctaaaaactgttaacg

SEQ ID NO: 216038 - DNA, 20 bp, Artificial Sequence
  Description of Artificial Sequence: Synthetic oligonucleotide
  Target: ATXN1; (-) strand; PAM type: YTN; PAM sequence: CTT
tattgctaaaaactgttaac

SEQ ID NO: 216039 - DNA, 20 bp, Artificial Sequence
  Description of Artificial Sequence: Synthetic oligonucleotide
  Target: ATXN1; (-) strand; PAM type: YTN; PAM sequence: TTA
aaatgctttattgctaaaaa

SEQ ID NO: 216040 - DNA, 20 bp, Artificial Sequence
  Description of Artificial Sequence: Synthetic oligonucleotide
  Target: ATXN1; (-) strand; PAM type: YTN; PAM sequence: TTT
aaaatgctttattgctaaaa

SEQ ID NO: 216041 - DNA, 20 bp, Artificial Sequence
  Description of Artificial Sequence: Synthetic oligonucleotide
  Target: ATXN1; (-) strand; PAM type: YTN; PAM sequence: TTT
taaaatgctttattgctaaa

SEQ ID NO: 216042 - DNA, 20 bp, Artificial Sequence
  Description of Artificial Sequence: Synthetic oligonucleotide
  Target: ATXN1; (-) strand; PAM type: YTN; PAM sequence: TTA
attttaaaatgctttattgc

SEQ ID NO: 216043 - DNA, 20 bp, Artificial Sequence
  Description of Artificial Sequence: Synthetic oligonucleotide
  Target: ATXN1; (-) strand; PAM type: YTN; PAM sequence: CTT
aattttaaaatgctttattg

SEQ ID NO: 216044 - DNA, 20 bp, Artificial Sequence
  Description of Artificial Sequence: Synthetic oligonucleotide
  Target: ATXN1; (-) strand; PAM type: YTN; PAM sequence: CTA
aacaaaagtacataccttaa

SEQ ID NO: 216045 - DNA, 20 bp, Artificial Sequence
  Description of Artificial Sequence: Synthetic oligonucleotide
  Target: ATXN1; (-) strand; PAM type: YTN; PAM sequence: TTG
tctaaacaaaagtacatacc

SEQ ID NO: 216046 - DNA, 20 bp, Artificial Sequence
  Description of Artificial Sequence: Synthetic oligonucleotide
  Target: ATXN1; (-) strand; PAM type: YTN; PAM sequence: TTT
gtctaaacaaaagtacatac

SEQ ID NO: 216047 - DNA, 20 bp, Artificial Sequence
  Description of Artificial Sequence: Synthetic oligonucleotide
  Target: ATXN1; (-) strand; PAM type: YTN; PAM sequence: TTT
tgtctaaacaaaagtacata

SEQ ID NO: 216048 - DNA, 20 bp, Artificial Sequence
  Description of Artificial Sequence: Synthetic oligonucleotide
  Target: ATXN1; (-) strand; PAM type: YTN; PAM sequence: TTA
tccaataacattttgtctaa

SEQ ID NO: 216049 - DNA, 20 bp, Artificial Sequence
  Description of Artificial Sequence: Synthetic oligonucleotide
  Target: ATXN1; (-) strand; PAM type: YTN; PAM sequence: TTA
attatccaataacattttgt

SEQ ID NO: 216050 - DNA, 20 bp, Artificial Sequence
  Description of Artificial Sequence: Synthetic oligonucleotide
  Target: ATXN1; (-) strand; PAM type: YTN; PAM sequence: CTA
ttaattatccaataacattt

SEQ ID NO: 216051 - DNA, 20 bp, Artificial Sequence
  Description of Artificial Sequence: Synthetic oligonucleotide
  Target: ATXN1; (-) strand; PAM type: YTN; PAM sequence: CTA
tagtctattaattatccaat

SEQ ID NO: 216052 - DNA, 20 bp, Artificial Sequence
  Description of Artificial Sequence: Synthetic oligonucleotide
  Target: ATXN1; (-) strand; PAM type: YTN; PAM sequence: TTA
caccatactatagtctatta

SEQ ID NO: 216053 - DNA, 20 bp, Artificial Sequence
  Description of Artificial Sequence: Synthetic oligonucleotide
  Target: ATXN1; (-) strand; PAM type: YTN; PAM sequence: TTT
acaccatactatagtctatt

SEQ ID NO: 216054 - DNA, 20 bp, Artificial Sequence
  Description of Artificial Sequence: Synthetic oligonucleotide
  Target: ATXN1; (-) strand; PAM type: YTN; PAM sequence: TTA
tgtttacaccatactatagt

SEQ ID NO: 216055 - DNA, 20 bp, Artificial Sequence
  Description of Artificial Sequence: Synthetic oligonucleotide
  Target: ATXN1; (-) strand; PAM type: YTN; PAM sequence: TTC
cagtgcatataagttatgtt

SEQ ID NO: 216056 - DNA, 20 bp, Artificial Sequence
  Description of Artificial Sequence: Synthetic oligonucleotide
  Target: ATXN1; (-) strand; PAM type: YTN; PAM sequence: TTT
ccagtgcatataagttatgt

SEQ ID NO: 216057 - DNA, 20 bp, Artificial Sequence
  Description of Artificial Sequence: Synthetic oligonucleotide
  Target: ATXN1; (-) strand; PAM type: YTN; PAM sequence: TTT
tccagtgcatataagttatg

SEQ ID NO: 216058 - DNA, 20 bp, Artificial Sequence
  Description of Artificial Sequence: Synthetic oligonucleotide
  Target: ATXN1; (-) strand; PAM type: YTN; PAM sequence: TTG
gttttccagtgcatataagt

SEQ ID NO: 216059 - DNA, 20 bp, Artificial Sequence
  Description of Artificial Sequence: Synthetic oligonucleotide
  Target: ATXN1; (-) strand; PAM type: YTN; PAM sequence: TTT
ggttttccagtgcatataag

SEQ ID NO: 216060 - DNA, 20 bp, Artificial Sequence
  Description of Artificial Sequence: Synthetic oligonucleotide
  Target: ATXN1; (-) strand; PAM type: YTN; PAM sequence: TTT
tggttttccagtgcatataa

SEQ ID NO: 216061 - DNA, 20 bp, Artificial Sequence
  Description of Artificial Sequence: Synthetic oligonucleotide
  Target: ATXN1; (-) strand; PAM type: YTN; PAM sequence: TTT
ttggttttccagtgcatata

SEQ ID NO: 216062 - DNA, 20 bp, Artificial Sequence
  Description of Artificial Sequence: Synthetic oligonucleotide
  Target: ATXN1; (-) strand; PAM type: YTN; PAM sequence: TTT
tttggttttccagtgcatat

SEQ ID NO: 216063 - DNA, 20 bp, Artificial Sequence
  Description of Artificial Sequence: Synthetic oligonucleotide
  Target: ATXN1; (-) strand; PAM type: YTN; PAM sequence: TTG
caatacagcaaatcacacaa

SEQ ID NO: 216064 - DNA, 20 bp, Artificial Sequence
  Description of Artificial Sequence: Synthetic oligonucleotide
  Target: ATXN1; (-) strand; PAM type: YTN; PAM sequence: TTA
tagaccacagcagtaaagca

SEQ ID NO: 216065 - DNA, 20 bp, Artificial Sequence
  Description of Artificial Sequence: Synthetic oligonucleotide
  Target: ATXN1; (-) strand; PAM type: YTN; PAM sequence: CTT
atagaccacagcagtaaagc

SEQ ID NO: 216066 - DNA, 20 bp, Artificial Sequence
  Description of Artificial Sequence: Synthetic oligonucleotide
  Target: ATXN1; (-) strand; PAM type: YTN; PAM sequence: TTC
acttatagaccacagcagta

SEQ ID NO: 216067 - DNA, 20 bp, Artificial Sequence
  Description of Artificial Sequence: Synthetic oligonucleotide
  Target: ATXN1; (-) strand; PAM type: YTN; PAM sequence: TTG
ggttcacttatagaccacag

SEQ ID NO: 216068 - DNA, 20 bp, Artificial Sequence
  Description of Artificial Sequence: Synthetic oligonucleotide
  Target: ATXN1; (-) strand; PAM type: YTN; PAM sequence: TTT
gggttcacttatagaccaca

SEQ ID NO: 216069 - DNA, 20 bp, Artificial Sequence
  Description of Artificial Sequence: Synthetic oligonucleotide
  Target: ATXN1; (-) strand; PAM type: YTN; PAM sequence: TTT
tgggttcacttatagaccac

SEQ ID NO: 216070 - DNA, 20 bp, Artificial Sequence
  Description of Artificial Sequence: Synthetic oligonucleotide
  Target: ATXN1; (-) strand; PAM type: YTN; PAM sequence: CTC
agagatattttgggttcact

SEQ ID NO: 216071 - DNA, 20 bp, Artificial Sequence
  Description of Artificial Sequence: Synthetic oligonucleotide
  Target: ATXN1; (-) strand; PAM type: YTN; PAM sequence: CTG
gacactcagagatattttgg

SEQ ID NO: 216072 - DNA, 20 bp, Artificial Sequence
  Description of Artificial Sequence: Synthetic oligonucleotide
  Target: ATXN1; (-) strand; PAM type: YTN; PAM sequence: CTG
tgcctggacactcagagata

SEQ ID NO: 216073 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccactgtgcc

SEQ ID NO: 216074 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 216075 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 216076 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 216077 - DNA, 20 bp, Artificial Sequence
  Description of Artificial Sequence: Synthetic oligonucleotide
  Target: ATXN1; (-) strand; PAM type: YTN; PAM sequence: CTG
accccaggtgatccacccac

SEQ ID NO: 216078 - DNA, 20 bp, Artificial Sequence
  Description of Artificial Sequence: Synthetic oligonucleotide
  Target: ATXN1; (-) strand; PAM type: YTN; PAM sequence: CTC
ctgaccccaggtgatccacc

SEQ ID NO: 216079 - DNA, 20 bp, Artificial Sequence
  Description of Artificial Sequence: Synthetic oligonucleotide
  Target: ATXN1; (-) strand; PAM type: YTN; PAM sequence: CTC
gaactcctgaccccaggtga

SEQ ID NO: 216080 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacccca

SEQ ID NO: 216081 - DNA, 20 bp, Artificial Sequence
  Description of Artificial Sequence: Synthetic oligonucleotide
  Target: ATXN1; (-) strand; PAM type: YTN; PAM sequence: TTG
gtgaggctggtctcgaactc

SEQ ID NO: 216082 - DNA, 20 bp, Artificial Sequence
  Description of Artificial Sequence: Synthetic oligonucleotide
  Target: ATXN1; (-) strand; PAM type: YTN; PAM sequence: TTC
accatattggtgaggctggt

SEQ ID NO: 216083 - DNA, 20 bp, Artificial Sequence
  Description of Artificial Sequence: Synthetic oligonucleotide
  Target: ATXN1; (-) strand; PAM type: YTN; PAM sequence: TTT
caccatattggtgaggctgg

SEQ ID NO: 216084 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttcacca

SEQ ID NO: 216085 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttcacc

SEQ ID NO: 216086 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttcac

SEQ ID NO: 216087 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttca

SEQ ID NO: 216088 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 216089 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 216090 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 216091 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 216092 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 216093 - DNA, 20 bp, Artificial Sequence
  Description of Artificial Sequence: Synthetic oligonucleotide
  Target: ATXN1; (-) strand; PAM type: YTN; PAM sequence: CTG
ccaccatgcccagctaattt

SEQ ID NO: 216094 - DNA, 20 bp, Artificial Sequence
  Description of Artificial Sequence: Synthetic oligonucleotide
  Target: ATXN1; (-) strand; PAM type: YTN; PAM sequence: CTA
taggtgcctgccaccatgcc

SEQ ID NO: 216095 - DNA, 20 bp, Artificial Sequence
  Description of Artificial Sequence: Synthetic oligonucleotide
  Target: ATXN1; (-) strand; PAM type: YTN; PAM sequence: CTG
ggactataggtgcctgccac

SEQ ID NO: 216096 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggactatag

SEQ ID NO: 216097 - DNA, 20 bp, Artificial Sequence
  Description of Artificial Sequence: Synthetic oligonucleotide
  Target: ATXN1; (-) strand; PAM type: YTN; PAM sequence: TTC
aagcctcccaagtagctggg

SEQ ID NO: 216098 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcctcccaagtag

SEQ ID NO: 216099 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcctcccaag

SEQ ID NO: 216100 - DNA, 20 bp, Artificial Sequence
  Description of Artificial Sequence: Synthetic oligonucleotide
  Target: ATXN1; (-) strand; PAM type: YTN; PAM sequence: CTC
cgcctcctgggttcaagcct

SEQ ID NO: 216101 - DNA, 20 bp, Artificial Sequence
  Description of Artificial Sequence: Synthetic oligonucleotide
  Target: ATXN1; (-) strand; PAM type: YTN; PAM sequence: CTG
caagctccgcctcctgggtt

SEQ ID NO: 216102 - DNA, 20 bp, Artificial Sequence
  Description of Artificial Sequence: Synthetic oligonucleotide
  Target: ATXN1; (-) strand; PAM type: YTN; PAM sequence: CTC
actgcaagctccgcctcctg

SEQ ID NO: 216103 - DNA, 20 bp, Artificial Sequence
  Description of Artificial Sequence: Synthetic oligonucleotide
  Target: ATXN1; (-) strand; PAM type: YTN; PAM sequence: CTG
ctcactgcaagctccgcctc

SEQ ID NO: 216104 - DNA, 20 bp, Artificial Sequence
  Description of Artificial Sequence: Synthetic oligonucleotide
  Target: ATXN1; (-) strand; PAM type: YTN; PAM sequence: CTC
tgctcactgcaagctccgcc

SEQ ID NO: 216105 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcacgatctc

SEQ ID NO: 216106 - DNA, 20 bp, Artificial Sequence
  Description of Artificial Sequence: Synthetic oligonucleotide
  Target: ATXN1; (-) strand; PAM type: YTN; PAM sequence: TTG
ccaggctggagtgcagtggc

SEQ ID NO: 216107 - DNA, 20 bp, Artificial Sequence
  Description of Artificial Sequence: Synthetic oligonucleotide
  Target: ATXN1; (-) strand; PAM type: YTN; PAM sequence: TTG
ttgccaggctggagtgcagt

SEQ ID NO: 216108 - DNA, 20 bp, Artificial Sequence
  Description of Artificial Sequence: Synthetic oligonucleotide
  Target: ATXN1; (-) strand; PAM type: YTN; PAM sequence: TTT
gttgccaggctggagtgcag

SEQ ID NO: 216109 - DNA, 20 bp, Artificial Sequence
  Description of Artificial Sequence: Synthetic oligonucleotide
  Target: ATXN1; (-) strand; PAM type: YTN; PAM sequence: CTT
tgttgccaggctggagtgca

SEQ ID NO: 216110 - DNA, 20 bp, Artificial Sequence
  Description of Artificial Sequence: Synthetic oligonucleotide
  Target: ATXN1; (-) strand; PAM type: YTN; PAM sequence: TTG
ctttgttgccaggctggagt

SEQ ID NO: 216111 - DNA, 20 bp, Artificial Sequence
  Description of Artificial Sequence: Synthetic oligonucleotide
  Target: ATXN1; (-) strand; PAM type: YTN; PAM sequence: CTT
gctttgttgccaggctggag

SEQ ID NO: 216112 - DNA, 20 bp, Artificial Sequence
  Description of Artificial Sequence: Synthetic oligonucleotide
  Target: ATXN1; (-) strand; PAM type: YTN; PAM sequence: TTG
ggagtcttgctttgttgcca

SEQ ID NO: 216113 - DNA, 20 bp, Artificial Sequence
  Description of Artificial Sequence: Synthetic oligonucleotide
  Target: ATXN1; (-) strand; PAM type: YTN; PAM sequence: TTG
agttgggagtcttgctttgt

SEQ ID NO: 216114 - DNA, 20 bp, Artificial Sequence
  Description of Artificial Sequence: Synthetic oligonucleotide
  Target: ATXN1; (-) strand; PAM type: YTN; PAM sequence: TTT
gagttgggagtcttgctttg

SEQ ID NO: 216115 - DNA, 20 bp, Artificial Sequence
  Description of Artificial Sequence: Synthetic oligonucleotide
  Target: ATXN1; (-) strand; PAM type: YTN; PAM sequence: TTT
tgagttgggagtcttgcttt

SEQ ID NO: 216116 - DNA, 20 bp, Artificial Sequence
  Description of Artificial Sequence: Synthetic oligonucleotide
  Target: ATXN1; (-) strand; PAM type: YTN; PAM sequence: TTT
ttgagttgggagtcttgctt

SEQ ID NO: 216117 - DNA, 20 bp, Artificial Sequence
  Description of Artificial Sequence: Synthetic oligonucleotide
  Target: ATXN1; (-) strand; PAM type: YTN; PAM sequence: TTT
tttgagttgggagtcttgct

SEQ ID NO: 216118 - DNA, 20 bp, Artificial Sequence
  Description of Artificial Sequence: Synthetic oligonucleotide
  Target: ATXN1; (-) strand; PAM type: YTN; PAM sequence: TTT
ttttgagttgggagtcttgc

SEQ ID NO: 216119 - DNA, 20 bp, Artificial Sequence
  Description of Artificial Sequence: Synthetic oligonucleotide
  Target: ATXN1; (-) strand; PAM type: YTN; PAM sequence: TTT
tttttgagttgggagtcttg

SEQ ID NO: 216120 - DNA, 20 bp, Artificial Sequence
  Description of Artificial Sequence: Synthetic oligonucleotide
  Target: ATXN1; (-) strand; PAM type: YTN; PAM sequence: TTT
ttttttgagttgggagtctt

SEQ ID NO: 216121 - DNA, 20 bp, Artificial Sequence
  Description of Artificial Sequence: Synthetic oligonucleotide
  Target: ATXN1; (-) strand; PAM type: YTN; PAM sequence: TTT
tttttttgagttgggagtct

SEQ ID NO: 216122 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagttgggagtc

SEQ ID NO: 216123 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagttgggagt

SEQ ID NO: 216124 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagttgggag

SEQ ID NO: 216125 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagttggga

SEQ ID NO: 216126 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagttggg

SEQ ID NO: 216127 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagttgg

SEQ ID NO: 216128 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttgagttg

SEQ ID NO: 216129 - DNA, 20 bp, Artificial Sequence
  Description of Artificial Sequence: Synthetic oligonucleotide
  Target: ATXN1; (-) strand; PAM type: YTN; PAM sequence: TTG
tgtctttttttttttttttt

SEQ ID NO: 216130 - DNA, 20 bp, Artificial Sequence
  Description of Artificial Sequence: Synthetic oligonucleotide
  Target: ATXN1; (-) strand; PAM type: YTN; PAM sequence: CTC
agagatattgtgtctttttt

SEQ ID NO: 216131 - DNA, 20 bp, Artificial Sequence
  Description of Artificial Sequence: Synthetic oligonucleotide
  Target: ATXN1; (-) strand; PAM type: YTN; PAM sequence: TTA
gacacaggcatagctcagag

SEQ ID NO: 216132 - DNA, 20 bp, Artificial Sequence
  Description of Artificial Sequence: Synthetic oligonucleotide
  Target: ATXN1; (-) strand; PAM type: YTN; PAM sequence: TTT
agacacaggcatagctcaga

SEQ ID NO: 216133 - DNA, 20 bp, Artificial Sequence
  Description of Artificial Sequence: Synthetic oligonucleotide
  Target: ATXN1; (-) strand; PAM type: YTN; PAM sequence: TTT
tagacacaggcatagctcag

SEQ ID NO: 216134 - DNA, 20 bp, Artificial Sequence
  Description of Artificial Sequence: Synthetic oligonucleotide
  Target: ATXN1; (-) strand; PAM type: YTN; PAM sequence: TTT
ttagacacaggcatagctca

SEQ ID NO: 216135 - DNA, 20 bp, Artificial Sequence
  Description of Artificial Sequence: Synthetic oligonucleotide
  Target: ATXN1; (-) strand; PAM type: YTN; PAM sequence: TTT
tttagacacaggcatagctc

SEQ ID NO: 216136 - DNA, 20 bp, Artificial Sequence
  Description of Artificial Sequence: Synthetic oligonucleotide
  Target: ATXN1; (-) strand; PAM type: YTN; PAM sequence: TTC
agaattttttagacacaggc

SEQ ID NO: 216137 - DNA, 20 bp, Artificial Sequence
  Description of Artificial Sequence: Synthetic oligonucleotide
  Target: ATXN1; (-) strand; PAM type: YTN; PAM sequence: TTA
ggaagagttcagaatttttt

SEQ ID NO: 216138 - DNA, 20 bp, Artificial Sequence
  Description of Artificial Sequence: Synthetic oligonucleotide
  Target: ATXN1; (-) strand; PAM type: YTN; PAM sequence: CTG
ttaggaagagttcagaattt

SEQ ID NO: 216139 - DNA, 20 bp, Artificial Sequence
  Description of Artificial Sequence: Synthetic oligonucleotide
  Target: ATXN1; (-) strand; PAM type: YTN; PAM sequence: CTG
tagtgcctgttaggaagagt

SEQ ID NO: 216140 - DNA, 20 bp, Artificial Sequence
  Description of Artificial Sequence: Synthetic oligonucleotide
  Target: ATXN1; (-) strand; PAM type: YTN; PAM sequence: TTC
tgtagtgcctgttaggaaga

SEQ ID NO: 216141 - DNA, 20 bp, Artificial Sequence
  Description of Artificial Sequence: Synthetic oligonucleotide
  Target: ATXN1; (-) strand; PAM type: YTN; PAM sequence: TTT
ctgtagtgcctgttaggaag

SEQ ID NO: 216142 - DNA, 20 bp, Artificial Sequence
  Description of Artificial Sequence: Synthetic oligonucleotide
  Target: ATXN1; (-) strand; PAM type: YTN; PAM sequence: TTA
catttctgtagtgcctgtta

SEQ ID NO: 216143 - DNA, 20 bp, Artificial Sequence
  Description of Artificial Sequence: Synthetic oligonucleotide
  Target: ATXN1; (-) strand; PAM type: YTN; PAM sequence: CTT
acatttctgtagtgcctgtt

SEQ ID NO: 216144 - DNA, 20 bp, Artificial Sequence
  Description of Artificial Sequence: Synthetic oligonucleotide
  Target: ATXN1; (-) strand; PAM type: YTN; PAM sequence: CTG
gccaggcttacatttctgta

SEQ ID NO: 216145 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccgcagc

SEQ ID NO: 216146 - DNA, 20 bp, Artificial Sequence
  Description of Artificial Sequence: Synthetic oligonucleotide
  Target: ATXN1; (-) strand; PAM type: YTN; PAM sequence: CTG
gaattacaggcgtgagccac

SEQ ID NO: 216147 - DNA, 20 bp, Artificial Sequence
  Description of Artificial Sequence: Synthetic oligonucleotide
  Target: ATXN1; (-) strand; PAM type: YTN; PAM sequence: CTC
aaagtgctggaattacaggc

SEQ ID NO: 216148 - DNA, 20 bp, Artificial Sequence
  Description of Artificial Sequence: Synthetic oligonucleotide
  Target: ATXN1; (-) strand; PAM type: YTN; PAM sequence: CTC
tcaaagtgctggaattacag

SEQ ID NO: 216149 - DNA, 20 bp, Artificial Sequence
  Description of Artificial Sequence: Synthetic oligonucleotide
  Target: ATXN1; (-) strand; PAM type: YTN; PAM sequence: TTG
gcctctcaaagtgctggaat

SEQ ID NO: 216150 - DNA, 20 bp, Artificial Sequence
  Description of Artificial Sequence: Synthetic oligonucleotide
  Target: ATXN1; (-) strand; PAM type: YTN; PAM sequence: CTT
ggcctctcaaagtgctggaa

SEQ ID NO: 216151 - DNA, 20 bp, Artificial Sequence
  Description of Artificial Sequence: Synthetic oligonucleotide
  Target: ATXN1; (-) strand; PAM type: YTN; PAM sequence: CTA
cccgtcttggcctctcaaag

SEQ ID NO: 216152 - DNA, 20 bp, Artificial Sequence
  Description of Artificial Sequence: Synthetic oligonucleotide
  Target: ATXN1; (-) strand; PAM type: YTN; PAM sequence: CTC
aagcagtctacccgtcttgg

SEQ ID NO: 216153 - DNA, 20 bp, Artificial Sequence
  Description of Artificial Sequence: Synthetic oligonucleotide
  Target: ATXN1; (-) strand; PAM type: YTN; PAM sequence: CTG
ggctcaagcagtctacccgt

SEQ ID NO: 216154 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagcagtctacc

SEQ ID NO: 216155 - DNA, 20 bp, Artificial Sequence
  Description of Artificial Sequence: Synthetic oligonucleotide
  Target: ATXN1; (-) strand; PAM type: YTN; PAM sequence: TTA
aactcctgggctcaagcagt

SEQ ID NO: 216156 - DNA, 20 bp, Artificial Sequence
  Description of Artificial Sequence: Synthetic oligonucleotide
  Target: ATXN1; (-) strand; PAM type: YTN; PAM sequence: CTT
aaactcctgggctcaagcag

SEQ ID NO: 216157 - DNA, 20 bp, Artificial Sequence
  Description of Artificial Sequence: Synthetic oligonucleotide
  Target: ATXN1; (-) strand; PAM type: YTN; PAM sequence: TTG
tcttaaactcctgggctcaa

SEQ ID NO: 216158 - DNA, 20 bp, Artificial Sequence
  Description of Artificial Sequence: Synthetic oligonucleotide
  Target: ATXN1; (-) strand; PAM type: YTN; PAM sequence: CTT
gtcttaaactcctgggctca

SEQ ID NO: 216159 - DNA, 20 bp, Artificial Sequence
  Description of Artificial Sequence: Synthetic oligonucleotide
  Target: ATXN1; (-) strand; PAM type: YTN; PAM sequence: TTG
cccaggcttgtcttaaactc

SEQ ID NO: 216160 - DNA, 20 bp, Artificial Sequence
  Description of Artificial Sequence: Synthetic oligonucleotide
  Target: ATXN1; (-) strand; PAM type: YTN; PAM sequence: TTC
atcatgttgcccaggcttgt

SEQ ID NO: 216161 - DNA, 20 bp, Artificial Sequence
  Description of Artificial Sequence: Synthetic oligonucleotide
  Target: ATXN1; (-) strand; PAM type: YTN; PAM sequence: TTT
catcatgttgcccaggcttg

SEQ ID NO: 216162 - DNA, 20 bp, Artificial Sequence
  Description of Artificial Sequence: Synthetic oligonucleotide
  Target: ATXN1; (-) strand; PAM type: YTN; PAM sequence: TTG
tagagacgaggtttcatcat

SEQ ID NO: 216163 - DNA, 20 bp, Artificial Sequence
  Description of Artificial Sequence: Synthetic oligonucleotide
  Target: ATXN1; (-) strand; PAM type: YTN; PAM sequence: TTT
gtagagacgaggtttcatca

SEQ ID NO: 216164 - DNA, 20 bp, Artificial Sequence
  Description of Artificial Sequence: Synthetic oligonucleotide
  Target: ATXN1; (-) strand; PAM type: YTN; PAM sequence: TTT
tgtagagacgaggtttcatc

SEQ ID NO: 216165 - DNA, 20 bp, Artificial Sequence
  Description of Artificial Sequence: Synthetic oligonucleotide
  Target: ATXN1; (-) strand; PAM type: YTN; PAM sequence: TTT
ttgtagagacgaggtttcat

SEQ ID NO: 216166 - DNA, 20 bp, Artificial Sequence
  Description of Artificial Sequence: Synthetic oligonucleotide
  Target: ATXN1; (-) strand; PAM type: YTN; PAM sequence: TTT
tttgtagagacgaggtttca

SEQ ID NO: 216167 - DNA, 20 bp, Artificial Sequence
  Description of Artificial Sequence: Synthetic oligonucleotide
  Target: ATXN1; (-) strand; PAM type: YTN; PAM sequence: TTG
tattttttgtagagacgagg

SEQ ID NO: 216168 - DNA, 20 bp, Artificial Sequence
  Description of Artificial Sequence: Synthetic oligonucleotide
  Target: ATXN1; (-) strand; PAM type: YTN; PAM sequence: TTT
gtattttttgtagagacgag

SEQ ID NO: 216169 - DNA, 20 bp, Artificial Sequence
  Description of Artificial Sequence: Synthetic oligonucleotide
  Target: ATXN1; (-) strand; PAM type: YTN; PAM sequence: TTT
tgtattttttgtagagacga

SEQ ID NO: 216170 - DNA, 20 bp, Artificial Sequence
  Description of Artificial Sequence: Synthetic oligonucleotide
  Target: ATXN1; (-) strand; PAM type: YTN; PAM sequence: TTT
ttgtattttttgtagagacg

SEQ ID NO: 216171 - DNA, 20 bp, Artificial Sequence
  Description of Artificial Sequence: Synthetic oligonucleotide
  Target: ATXN1; (-) strand; PAM type: YTN; PAM sequence: CTA
atttttgtattttttgtaga

SEQ ID NO: 216172 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtattttttg

SEQ ID NO: 216173 - DNA, 20 bp, Artificial Sequence
  Description of Artificial Sequence: Synthetic oligonucleotide
  Target: ATXN1; (-) strand; PAM type: YTN; PAM sequence: TTA
catgtgtgcacgacaacacc

SEQ ID NO: 216174 - DNA, 20 bp, Artificial Sequence
  Description of Artificial Sequence: Synthetic oligonucleotide
  Target: ATXN1; (-) strand; PAM type: YTN; PAM sequence: CTG
agattacatgtgtgcacgac

SEQ ID NO: 216175 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgagattacat

SEQ ID NO: 216176 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctgaga

SEQ ID NO: 216177 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 216178 - DNA, 20 bp, Artificial Sequence
  Description of Artificial Sequence: Synthetic oligonucleotide
  Target: ATXN1; (-) strand; PAM type: YTN; PAM sequence: TTC
ctgcctcagcctcccaagta

SEQ ID NO: 216179 - DNA, 20 bp, Artificial Sequence
  Description of Artificial Sequence: Synthetic oligonucleotide
  Target: ATXN1; (-) strand; PAM type: YTN; PAM sequence: CTT
cctgcctcagcctcccaagt

SEQ ID NO: 216180 - DNA, 20 bp, Artificial Sequence
  Description of Artificial Sequence: Synthetic oligonucleotide
  Target: ATXN1; (-) strand; PAM type: YTN; PAM sequence: CTC
aagtgatcttcctgcctcag

SEQ ID NO: 216181 - DNA, 20 bp, Artificial Sequence
  Description of Artificial Sequence: Synthetic oligonucleotide
  Target: ATXN1; (-) strand; PAM type: YTN; PAM sequence: CTC
cgggcctcaagtgatcttcc

SEQ ID NO: 216182 - DNA, 20 bp, Artificial Sequence
  Description of Artificial Sequence: Synthetic oligonucleotide
  Target: ATXN1; (-) strand; PAM type: YTN; PAM sequence: CTC
gacctccgggcctcaagtga

SEQ ID NO: 216183 - DNA, 20 bp, Artificial Sequence
  Description of Artificial Sequence: Synthetic oligonucleotide
  Target: ATXN1; (-) strand; PAM type: YTN; PAM sequence: CTG
cagcctcgacctccgggcct

SEQ ID NO: 216184 - DNA, 20 bp, Artificial Sequence
  Description of Artificial Sequence: Synthetic oligonucleotide
  Target: ATXN1; (-) strand; PAM type: YTN; PAM sequence: CTC
actgcagcctcgacctccgg

SEQ ID NO: 216185 - DNA, 20 bp, Artificial Sequence
  Description of Artificial Sequence: Synthetic oligonucleotide
  Target: ATXN1; (-) strand; PAM type: YTN; PAM sequence: CTC
agctcactgcagcctcgacc

SEQ ID NO: 216186 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcaatctc

SEQ ID NO: 216187 - DNA, 20 bp, Artificial Sequence
  Description of Artificial Sequence: Synthetic oligonucleotide
  Target: ATXN1; (-) strand; PAM type: YTN; PAM sequence: CTC
ccaggctggagtgcagtggt

SEQ ID NO: 216188 - DNA, 20 bp, Artificial Sequence
  Description of Artificial Sequence: Synthetic oligonucleotide
  Target: ATXN1; (-) strand; PAM type: YTN; PAM sequence: TTG
tctcccaggctggagtgcag

SEQ ID NO: 216189 - DNA, 20 bp, Artificial Sequence
  Description of Artificial Sequence: Synthetic oligonucleotide
  Target: ATXN1; (-) strand; PAM type: YTN; PAM sequence: CTT
gtctcccaggctggagtgca

SEQ ID NO: 216190 - DNA, 20 bp, Artificial Sequence
  Description of Artificial Sequence: Synthetic oligonucleotide
  Target: ATXN1; (-) strand; PAM type: YTN; PAM sequence: CTC
ttgtctcccaggctggagtg

SEQ ID NO: 216191 - DNA, 20 bp, Artificial Sequence
  Description of Artificial Sequence: Synthetic oligonucleotide
  Target: ATXN1; (-) strand; PAM type: YTN; PAM sequence: CTC
actcttgtctcccaggctgg

SEQ ID NO: 216192 - DNA, 20 bp, Artificial Sequence
  Description of Artificial Sequence: Synthetic oligonucleotide
  Target: ATXN1; (-) strand; PAM type: YTN; PAM sequence: TTG
gcagggtctcactcttgtct

SEQ ID NO: 216193 - DNA, 20 bp, Artificial Sequence
  Description of Artificial Sequence: Synthetic oligonucleotide
  Target: ATXN1; (-) strand; PAM type: YTN; PAM sequence: TTT
ggcagggtctcactcttgtc

SEQ ID NO: 216194 - DNA, 20 bp, Artificial Sequence
  Description of Artificial Sequence: Synthetic oligonucleotide
  Target: ATXN1; (-) strand; PAM type: YTN; PAM sequence: TTT
tggcagggtctcactcttgt

SEQ ID NO: 216195 - DNA, 20 bp, Artificial Sequence
  Description of Artificial Sequence: Synthetic oligonucleotide
  Target: ATXN1; (-) strand; PAM type: YTN; PAM sequence: TTT
ttggcagggtctcactcttg

SEQ ID NO: 216196 - DNA, 20 bp, Artificial Sequence
  Description of Artificial Sequence: Synthetic oligonucleotide
  Target: ATXN1; (-) strand; PAM type: YTN; PAM sequence: TTT
tttggcagggtctcactctt

SEQ ID NO: 216197 - DNA, 20 bp, Artificial Sequence
  Description of Artificial Sequence: Synthetic oligonucleotide
  Target: ATXN1; (-) strand; PAM type: YTN; PAM sequence: TTT
ttttggcagggtctcactct

SEQ ID NO: 216198 - DNA, 20 bp, Artificial Sequence
  Description of Artificial Sequence: Synthetic oligonucleotide
  Target: ATXN1; (-) strand; PAM type: YTN; PAM sequence: TTT
tttttggcagggtctcactc

SEQ ID NO: 216199 - DNA, 20 bp, Artificial Sequence
  Description of Artificial Sequence: Synthetic oligonucleotide
  Target: ATXN1; (-) strand; PAM type: YTN; PAM sequence: TTT
ttttttggcagggtctcact

SEQ ID NO: 216200 - DNA, 20 bp, Artificial Sequence
  Description of Artificial Sequence: Synthetic oligonucleotide
  Target: ATXN1; (-) strand; PAM type: YTN; PAM sequence: TTT
tttttttggcagggtctcac

SEQ ID NO: 216201 - DNA, 20 bp, Artificial Sequence
  Description of Artificial Sequence: Synthetic oligonucleotide
  Target: ATXN1; (-) strand; PAM type: YTN; PAM sequence: TTT
ttttttttggcagggtctca

SEQ ID NO: 216202 - DNA, 20 bp, Artificial Sequence
  Description of Artificial Sequence: Synthetic oligonucleotide
  Target: ATXN1; (-) strand; PAM type: YTN; PAM sequence: TTT
tttttttttggcagggtctc

SEQ ID NO: 216203 - DNA, 20 bp, Artificial Sequence
  Description of Artificial Sequence: Synthetic oligonucleotide
  Target: ATXN1; (-) strand; PAM type: YTN; PAM sequence: TTT
ttttttttttggcagggtct

SEQ ID NO: 216204 - DNA, 20 bp, Artificial Sequence
  Description of Artificial Sequence: Synthetic oligonucleotide
  Target: ATXN1; (-) strand; PAM type: YTN; PAM sequence: TTT
tttttttttttggcagggtc

SEQ ID NO: 216205 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttggcagggt

SEQ ID NO: 216206 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttggcaggg

SEQ ID NO: 216207 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttggcagg

SEQ ID NO: 216208 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttggcag

SEQ ID NO: 216209 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttggca

SEQ ID NO: 216210 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttggc

SEQ ID NO: 216211 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttgg

SEQ ID NO: 216212 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttttttg

SEQ ID NO: 216213 - DNA, 20 bp, Artificial Sequence
  Description of Artificial Sequence: Synthetic oligonucleotide
  Target: ATXN1; (-) strand; PAM type: YTN; PAM sequence: CTC
tttttttttttttttttttt

SEQ ID NO: 216214 - DNA, 20 bp, Artificial Sequence
  Description of Artificial Sequence: Synthetic oligonucleotide
  Target: ATXN1; (-) strand; PAM type: YTN; PAM sequence: TTC
tctttttttttttttttttt

SEQ ID NO: 216215 - DNA, 20 bp, Artificial Sequence
  Description of Artificial Sequence: Synthetic oligonucleotide
  Target: ATXN1; (-) strand; PAM type: YTN; PAM sequence: CTT
ctcttttttttttttttttt

SEQ ID NO: 216216 - DNA, 20 bp, Artificial Sequence
  Description of Artificial Sequence: Synthetic oligonucleotide
  Target: ATXN1; (-) strand; PAM type: YTN; PAM sequence: CTC
ttctcttttttttttttttt

SEQ ID NO: 216217 - DNA, 20 bp, Artificial Sequence
  Description of Artificial Sequence: Synthetic oligonucleotide
  Target: ATXN1; (-) strand; PAM type: YTN; PAM sequence: TTC
tcttctcttttttttttttt

SEQ ID NO: 216218 - DNA, 20 bp, Artificial Sequence
  Description of Artificial Sequence: Synthetic oligonucleotide
  Target: ATXN1; (-) strand; PAM type: YTN; PAM sequence: CTT
ctcttctctttttttttttt

SEQ ID NO: 216219 - DNA, 20 bp, Artificial Sequence
  Description of Artificial Sequence: Synthetic oligonucleotide
  Target: ATXN1; (-) strand; PAM type: YTN; PAM sequence: TTC
ttctcttctctttttttttt

SEQ ID NO: 216220 - DNA, 20 bp, Artificial Sequence
  Description of Artificial Sequence: Synthetic oligonucleotide
  Target: ATXN1; (-) strand; PAM type: YTN; PAM sequence: CTG
cgttcttctcttctcttttt

SEQ ID NO: 216221 - DNA, 20 bp, Artificial Sequence
  Description of Artificial Sequence: Synthetic oligonucleotide
  Target: ATXN1; (-) strand; PAM type: YTN; PAM sequence: CTC
atagtcctgcgttcttctct

SEQ ID NO: 216222 - DNA, 20 bp, Artificial Sequence
  Description of Artificial Sequence: Synthetic oligonucleotide
  Target: ATXN1; (-) strand; PAM type: YTN; PAM sequence: CTG
caagcaggctcatagtcctg

SEQ ID NO: 216223 - DNA, 20 bp, Artificial Sequence
  Description of Artificial Sequence: Synthetic oligonucleotide
  Target: ATXN1; (-) strand; PAM type: YTN; PAM sequence: TTC
tgcaagcaggctcatagtcc

SEQ ID NO: 216224 - DNA, 20 bp, Artificial Sequence
  Description of Artificial Sequence: Synthetic oligonucleotide
  Target: ATXN1; (-) strand; PAM type: YTN; PAM sequence: TTT
ctgcaagcaggctcatagtc

SEQ ID NO: 216225 - DNA, 20 bp, Artificial Sequence
  Description of Artificial Sequence: Synthetic oligonucleotide
  Target: ATXN1; (-) strand; PAM type: YTN; PAM sequence: CTC
agaatttctgcaagcaggct

SEQ ID NO: 216226 - DNA, 20 bp, Artificial Sequence
  Description of Artificial Sequence: Synthetic oligonucleotide
  Target: ATXN1; (-) strand; PAM type: YTN; PAM sequence: TTC
tcagaatttctgcaagcagg

SEQ ID NO: 216227 - DNA, 20 bp, Artificial Sequence
  Description of Artificial Sequence: Synthetic oligonucleotide
  Target: ATXN1; (-) strand; PAM type: YTN; PAM sequence: CTT
ctcagaatttctgcaagcag

SEQ ID NO: 216228 - DNA, 20 bp, Artificial Sequence
  Description of Artificial Sequence: Synthetic oligonucleotide
  Target: ATXN1; (-) strand; PAM type: YTN; PAM sequence: TTC
ttctcagaatttctgcaagc

SEQ ID NO: 216229 - DNA, 20 bp, Artificial Sequence
  Description of Artificial Sequence: Synthetic oligonucleotide
  Target: ATXN1; (-) strand; PAM type: YTN; PAM sequence: TTG
gcccgaattcttctcagaat

SEQ ID NO: 216230 - DNA, 20 bp, Artificial Sequence
  Description of Artificial Sequence: Synthetic oligonucleotide
  Target: ATXN1; (-) strand; PAM type: YTN; PAM sequence: TTT
ggcccgaattcttctcagaa

SEQ ID NO: 216231 - DNA, 20 bp, Artificial Sequence
  Description of Artificial Sequence: Synthetic oligonucleotide
  Target: ATXN1; (-) strand; PAM type: YTN; PAM sequence: CTA
tttggcccgaattcttctca

SEQ ID NO: 216232 - DNA, 20 bp, Artificial Sequence
  Description of Artificial Sequence: Synthetic oligonucleotide
  Target: ATXN1; (-) strand; PAM type: YTN; PAM sequence: CTC
ctatttggcccgaattcttc

SEQ ID NO: 216233 - DNA, 20 bp, Artificial Sequence
  Description of Artificial Sequence: Synthetic oligonucleotide
  Target: ATXN1; (-) strand; PAM type: YTN; PAM sequence: TTA
actcctatttggcccgaatt

SEQ ID NO: 216234 - DNA, 20 bp, Artificial Sequence
  Description of Artificial Sequence: Synthetic oligonucleotide
  Target: ATXN1; (-) strand; PAM type: YTN; PAM sequence: TTT
aactcctatttggcccgaat

SEQ ID NO: 216235 - DNA, 20 bp, Artificial Sequence
  Description of Artificial Sequence: Synthetic oligonucleotide
  Target: ATXN1; (-) strand; PAM type: YTN; PAM sequence: TTT
taactcctatttggcccgaa

SEQ ID NO: 216236 - DNA, 20 bp, Artificial Sequence
  Description of Artificial Sequence: Synthetic oligonucleotide
  Target: ATXN1; (-) strand; PAM type: YTN; PAM sequence: TTA
ttttaactcctatttggccc

SEQ ID NO: 216237 - DNA, 20 bp, Artificial Sequence
  Description of Artificial Sequence: Synthetic oligonucleotide
  Target: ATXN1; (-) strand; PAM type: YTN; PAM sequence: TTT
attttaactcctatttggcc

SEQ ID NO: 216238 - DNA, 20 bp, Artificial Sequence
  Description of Artificial Sequence: Synthetic oligonucleotide
  Target: ATXN1; (-) strand; PAM type: YTN; PAM sequence: CTT
tattttaactcctatttggc

SEQ ID NO: 216239 - DNA, 20 bp, Artificial Sequence
  Description of Artificial Sequence: Synthetic oligonucleotide
  Target: ATXN1; (-) strand; PAM type: YTN; PAM sequence: CTC
actttattttaactcctatt

SEQ ID NO: 216240 - DNA, 20 bp, Artificial Sequence
  Description of Artificial Sequence: Synthetic oligonucleotide
  Target: ATXN1; (-) strand; PAM type: YTN; PAM sequence: TTC
ccctcactttattttaactc

SEQ ID NO: 216241 - DNA, 20 bp, Artificial Sequence
  Description of Artificial Sequence: Synthetic oligonucleotide
  Target: ATXN1; (-) strand; PAM type: YTN; PAM sequence: TTT
cccctcactttattttaact

SEQ ID NO: 216242 - DNA, 20 bp, Artificial Sequence
  Description of Artificial Sequence: Synthetic oligonucleotide
  Target: ATXN1; (-) strand; PAM type: YTN; PAM sequence: TTG
atttcccctcactttatttt

SEQ ID NO: 216243 - DNA, 20 bp, Artificial Sequence
  Description of Artificial Sequence: Synthetic oligonucleotide
  Target: ATXN1; (-) strand; PAM type: YTN; PAM sequence: TTG
gagttgatttcccctcactt

SEQ ID NO: 216244 - DNA, 20 bp, Artificial Sequence
  Description of Artificial Sequence: Synthetic oligonucleotide
  Target: ATXN1; (-) strand; PAM type: YTN; PAM sequence: TTT
ggagttgatttcccctcact

SEQ ID NO: 216245 - DNA, 20 bp, Artificial Sequence
  Description of Artificial Sequence: Synthetic oligonucleotide
  Target: ATXN1; (-) strand; PAM type: YTN; PAM sequence: CTT
tggagttgatttcccctcac

SEQ ID NO: 216246 - DNA, 20 bp, Artificial Sequence
  Description of Artificial Sequence: Synthetic oligonucleotide
  Target: ATXN1; (-) strand; PAM type: YTN; PAM sequence: CTC
tttggagttgatttcccctc

SEQ ID NO: 216247 - DNA, 20 bp, Artificial Sequence
  Description of Artificial Sequence: Synthetic oligonucleotide
  Target: ATXN1; (-) strand; PAM type: YTN; PAM sequence: TTC
atgtgcctctttggagttga

SEQ ID NO: 216248 - DNA, 20 bp, Artificial Sequence
  Description of Artificial Sequence: Synthetic oligonucleotide
  Target: ATXN1; (-) strand; PAM type: YTN; PAM sequence: TTT
catgtgcctctttggagttg

SEQ ID NO: 216249 - DNA, 20 bp, Artificial Sequence
  Description of Artificial Sequence: Synthetic oligonucleotide
  Target: ATXN1; (-) strand; PAM type: YTN; PAM sequence: CTG
agacatagtttcatgtgcct

SEQ ID NO: 216250 - DNA, 20 bp, Artificial Sequence
  Description of Artificial Sequence: Synthetic oligonucleotide
  Target: ATXN1; (-) strand; PAM type: YTN; PAM sequence: TTC
tgagacatagtttcatgtgc

SEQ ID NO: 216251 - DNA, 20 bp, Artificial Sequence
  Description of Artificial Sequence: Synthetic oligonucleotide
  Target: ATXN1; (-) strand; PAM type: YTN; PAM sequence: TTT
ctgagacatagtttcatgtg

SEQ ID NO: 216252 - DNA, 20 bp, Artificial Sequence
  Description of Artificial Sequence: Synthetic oligonucleotide
  Target: ATXN1; (-) strand; PAM type: YTN; PAM sequence: CTT
tctgagacatagtttcatgt

SEQ ID NO: 216253 - DNA, 20 bp, Artificial Sequence
  Description of Artificial Sequence: Synthetic oligonucleotide
  Target: ATXN1; (-) strand; PAM type: YTN; PAM sequence: CTC
tttctgagacatagtttcat

SEQ ID NO: 216254 - DNA, 20 bp, Artificial Sequence
  Description of Artificial Sequence: Synthetic oligonucleotide
  Target: ATXN1; (-) strand; PAM type: YTN; PAM sequence: TTA
tcaaacaaacgatcgaactc

SEQ ID NO: 216255 - DNA, 20 bp, Artificial Sequence
  Description of Artificial Sequence: Synthetic oligonucleotide
  Target: ATXN1; (-) strand; PAM type: YTN; PAM sequence: TTT
atcaaacaaacgatcgaact

SEQ ID NO: 216256 - DNA, 20 bp, Artificial Sequence
  Description of Artificial Sequence: Synthetic oligonucleotide
  Target: ATXN1; (-) strand; PAM type: YTN; PAM sequence: CTG
aagagaataacatttatcaa

SEQ ID NO: 216257 - DNA, 20 bp, Artificial Sequence
  Description of Artificial Sequence: Synthetic oligonucleotide
  Target: ATXN1; (-) strand; PAM type: YTN; PAM sequence: TTA
ataactgaagagaataacat

SEQ ID NO: 216258 - DNA, 20 bp, Artificial Sequence
  Description of Artificial Sequence: Synthetic oligonucleotide
  Target: ATXN1; (-) strand; PAM type: YTN; PAM sequence: CTT
aataactgaagagaataaca

SEQ ID NO: 216259 - DNA, 20 bp, Artificial Sequence
  Description of Artificial Sequence: Synthetic oligonucleotide
  Target: ATXN1; (-) strand; PAM type: YTN; PAM sequence: TTC
ttaataactgaagagaataa

SEQ ID NO: 216260 - DNA, 20 bp, Artificial Sequence
  Description of Artificial Sequence: Synthetic oligonucleotide
  Target: ATXN1; (-) strand; PAM type: YTN; PAM sequence: CTT
cttaataactgaagagaata

SEQ ID NO: 216261 - DNA, 20 bp, Artificial Sequence
  Description of Artificial Sequence: Synthetic oligonucleotide
  Target: ATXN1; (-) strand; PAM type: YTN; PAM sequence: TTC
ttcttaataactgaagagaa

SEQ ID NO: 216262 - DNA, 20 bp, Artificial Sequence
  Description of Artificial Sequence: Synthetic oligonucleotide
  Target: ATXN1; (-) strand; PAM type: YTN; PAM sequence: TTT
cttcttaataactgaagaga

SEQ ID NO: 216263 - DNA, 20 bp, Artificial Sequence
  Description of Artificial Sequence: Synthetic oligonucleotide
  Target: ATXN1; (-) strand; PAM type: YTN; PAM sequence: TTT
tcttcttaataactgaagag

SEQ ID NO: 216264 - DNA, 20 bp, Artificial Sequence
  Description of Artificial Sequence: Synthetic oligonucleotide
  Target: ATXN1; (-) strand; PAM type: YTN; PAM sequence: TTT
ttcttcttaataactgaaga

SEQ ID NO: 216265 - DNA, 20 bp, Artificial Sequence
  Description of Artificial Sequence: Synthetic oligonucleotide
  Target: ATXN1; (-) strand; PAM type: YTN; PAM sequence: TTT
tttcttcttaataactgaag

SEQ ID NO: 216266 - DNA, 20 bp, Artificial Sequence
  Description of Artificial Sequence: Synthetic oligonucleotide
  Target: ATXN1; (-) strand; PAM type: YTN; PAM sequence: TTT
ttttcttcttaataactgaa

SEQ ID NO: 216267 - DNA, 20 bp, Artificial Sequence
  Description of Artificial Sequence: Synthetic oligonucleotide
  Target: ATXN1; (-) strand; PAM type: YTN; PAM sequence: TTT
tttttcttcttaataactga

SEQ ID NO: 216268 - DNA, 20 bp, Artificial Sequence
  Description of Artificial Sequence: Synthetic oligonucleotide
  Target: ATXN1; (-) strand; PAM type: YTN; PAM sequence: TTT
ttttttcttcttaataactg

SEQ ID NO: 216269 - DNA, 20 bp, Artificial Sequence
  Description of Artificial Sequence: Synthetic oligonucleotide
  Target: ATXN1; (-) strand; PAM type: YTN; PAM sequence: TTG
gaatatgggcatagagaaga

SEQ ID NO: 216270 - DNA, 20 bp, Artificial Sequence
  Description of Artificial Sequence: Synthetic oligonucleotide
  Target: ATXN1; (-) strand; PAM type: YTN; PAM sequence: TTG
tattggaatatgggcataga

SEQ ID NO: 216271 - DNA, 20 bp, Artificial Sequence
  Description of Artificial Sequence: Synthetic oligonucleotide
  Target: ATXN1; (-) strand; PAM type: YTN; PAM sequence: CTG
ggttgtattggaatatgggc

SEQ ID NO: 216272 - DNA, 20 bp, Artificial Sequence
  Description of Artificial Sequence: Synthetic oligonucleotide
  Target: ATXN1; (-) strand; PAM type: YTN; PAM sequence: TTC
agaaactgggttgtattgga

SEQ ID NO: 216273 - DNA, 20 bp, Artificial Sequence
  Description of Artificial Sequence: Synthetic oligonucleotide
  Target: ATXN1; (-) strand; PAM type: YTN; PAM sequence: TTT
cagaaactgggttgtattgg

SEQ ID NO: 216274 - DNA, 20 bp, Artificial Sequence
  Description of Artificial Sequence: Synthetic oligonucleotide
  Target: ATXN1; (-) strand; PAM type: YTN; PAM sequence: CTA
atttcagaaactgggttgta

SEQ ID NO: 216275 - DNA, 20 bp, Artificial Sequence
  Description of Artificial Sequence: Synthetic oligonucleotide
  Target: ATXN1; (-) strand; PAM type: YTN; PAM sequence: TTC
taatttcagaaactgggttg

SEQ ID NO: 216276 - DNA, 20 bp, Artificial Sequence
  Description of Artificial Sequence: Synthetic oligonucleotide
  Target: ATXN1; (-) strand; PAM type: YTN; PAM sequence: CTC
attctaatttcagaaactgg

SEQ ID NO: 216277 - DNA, 20 bp, Artificial Sequence
  Description of Artificial Sequence: Synthetic oligonucleotide
  Target: ATXN1; (-) strand; PAM type: YTN; PAM sequence: TTC
tcattctaatttcagaaact

SEQ ID NO: 216278 - DNA, 20 bp, Artificial Sequence
  Description of Artificial Sequence: Synthetic oligonucleotide
  Target: ATXN1; (-) strand; PAM type: YTN; PAM sequence: TTA
tcaataagttctcattctaa

SEQ ID NO: 216279 - DNA, 20 bp, Artificial Sequence
  Description of Artificial Sequence: Synthetic oligonucleotide
  Target: ATXN1; (-) strand; PAM type: YTN; PAM sequence: TTA
tgtcagtaattatcaataag

SEQ ID NO: 216280 - DNA, 20 bp, Artificial Sequence
  Description of Artificial Sequence: Synthetic oligonucleotide
  Target: ATXN1; (-) strand; PAM type: YTN; PAM sequence: TTA
ttatgtcagtaattatcaat

SEQ ID NO: 216281 - DNA, 20 bp, Artificial Sequence
  Description of Artificial Sequence: Synthetic oligonucleotide
  Target: ATXN1; (-) strand; PAM type: YTN; PAM sequence: TTT
attatgtcagtaattatcaa

SEQ ID NO: 216282 - DNA, 20 bp, Artificial Sequence
  Description of Artificial Sequence: Synthetic oligonucleotide
  Target: ATXN1; (-) strand; PAM type: YTN; PAM sequence: CTT
tattatgtcagtaattatca

SEQ ID NO: 216283 - DNA, 20 bp, Artificial Sequence
  Description of Artificial Sequence: Synthetic oligonucleotide
  Target: ATXN1; (-) strand; PAM type: YTN; PAM sequence: TTA
tcaatactttattatgtcag

SEQ ID NO: 216284 - DNA, 20 bp, Artificial Sequence
  Description of Artificial Sequence: Synthetic oligonucleotide
  Target: ATXN1; (-) strand; PAM type: YTN; PAM sequence: TTG
ttatcaatactttattatgt

SEQ ID NO: 216285 - DNA, 20 bp, Artificial Sequence
  Description of Artificial Sequence: Synthetic oligonucleotide
  Target: ATXN1; (-) strand; PAM type: YTN; PAM sequence: TTT
gttatcaatactttattatg

SEQ ID NO: 216286 - DNA, 20 bp, Artificial Sequence
  Description of Artificial Sequence: Synthetic oligonucleotide
  Target: ATXN1; (-) strand; PAM type: YTN; PAM sequence: TTC
caaagtatttgttatcaata

SEQ ID NO: 216287 - DNA, 20 bp, Artificial Sequence
  Description of Artificial Sequence: Synthetic oligonucleotide
  Target: ATXN1; (-) strand; PAM type: YTN; PAM sequence: TTT
ccaaagtatttgttatcaat

SEQ ID NO: 216288 - DNA, 20 bp, Artificial Sequence
  Description of Artificial Sequence: Synthetic oligonucleotide
  Target: ATXN1; (-) strand; PAM type: YTN; PAM sequence: TTT
tccaaagtatttgttatcaa

SEQ ID NO: 216289 - DNA, 20 bp, Artificial Sequence
  Description of Artificial Sequence: Synthetic oligonucleotide
  Target: ATXN1; (-) strand; PAM type: YTN; PAM sequence: CTT
ttccaaagtatttgttatca

SEQ ID NO: 216290 - DNA, 20 bp, Artificial Sequence
  Description of Artificial Sequence: Synthetic oligonucleotide
  Target: ATXN1; (-) strand; PAM type: YTN; PAM sequence: TTC
ttttccaaagtatttgttat

SEQ ID NO: 216291 - DNA, 20 bp, Artificial Sequence
  Description of Artificial Sequence: Synthetic oligonucleotide
  Target: ATXN1; (-) strand; PAM type: YTN; PAM sequence: CTG
ttcttttccaaagtatttgt

SEQ ID NO: 216292 - DNA, 20 bp, Artificial Sequence
  Description of Artificial Sequence: Synthetic oligonucleotide
  Target: ATXN1; (-) strand; PAM type: YTN; PAM sequence: TTC
aaatatactgttcttttcca

SEQ ID NO: 216293 - DNA, 20 bp, Artificial Sequence
  Description of Artificial Sequence: Synthetic oligonucleotide
  Target: ATXN1; (-) strand; PAM type: YTN; PAM sequence: TTT
caaatatactgttcttttcc

SEQ ID NO: 216294 - DNA, 20 bp, Artificial Sequence
  Description of Artificial Sequence: Synthetic oligonucleotide
  Target: ATXN1; (-) strand; PAM type: YTN; PAM sequence: TTA
ataacagtgtttcaaatata

SEQ ID NO: 216295 - DNA, 20 bp, Artificial Sequence
  Description of Artificial Sequence: Synthetic oligonucleotide
  Target: ATXN1; (-) strand; PAM type: YTN; PAM sequence: TTT
aataacagtgtttcaaatat

SEQ ID NO: 216296 - DNA, 20 bp, Artificial Sequence
  Description of Artificial Sequence: Synthetic oligonucleotide
  Target: ATXN1; (-) strand; PAM type: YTN; PAM sequence: TTT
taataacagtgtttcaaata

SEQ ID NO: 216297 - DNA, 20 bp, Artificial Sequence
  Description of Artificial Sequence: Synthetic oligonucleotide
  Target: ATXN1; (-) strand; PAM type: YTN; PAM sequence: TTT
ttaataacagtgtttcaaat

SEQ ID NO: 216298 - DNA, 20 bp, Artificial Sequence
  Description of Artificial Sequence: Synthetic oligonucleotide
  Target: ATXN1; (-) strand; PAM type: YTN; PAM sequence: TTA
atttttaataacagtgtttc

SEQ ID NO: 216299 - DNA, 20 bp, Artificial Sequence
  Description of Artificial Sequence: Synthetic oligonucleotide
  Target: ATXN1; (-) strand; PAM type: YTN; PAM sequence: TTT
aatttttaataacagtgttt

SEQ ID NO: 216300 - DNA, 20 bp, Artificial Sequence
  Description of Artificial Sequence: Synthetic oligonucleotide
  Target: ATXN1; (-) strand; PAM type: YTN; PAM sequence: CTG
gcccataatttaatttttaa

SEQ ID NO: 216301 - DNA, 20 bp, Artificial Sequence
  Description of Artificial Sequence: Synthetic oligonucleotide
  Target: ATXN1; (-) strand; PAM type: YTN; PAM sequence: TTA
tgtctggcccataatttaat

SEQ ID NO: 216302 - DNA, 20 bp, Artificial Sequence
  Description of Artificial Sequence: Synthetic oligonucleotide
  Target: ATXN1; (-) strand; PAM type: YTN; PAM sequence: TTT
atgtctggcccataatttaa

SEQ ID NO: 216303 - DNA, 20 bp, Artificial Sequence
  Description of Artificial Sequence: Synthetic oligonucleotide
  Target: ATXN1; (-) strand; PAM type: YTN; PAM sequence: TTT
tatgtctggcccataattta

SEQ ID NO: 216304 - DNA, 20 bp, Artificial Sequence
  Description of Artificial Sequence: Synthetic oligonucleotide
  Target: ATXN1; (-) strand; PAM type: YTN; PAM sequence: CTT
ttatgtctggcccataattt

SEQ ID NO: 216305 - DNA, 20 bp, Artificial Sequence
  Description of Artificial Sequence: Synthetic oligonucleotide
  Target: ATXN1; (-) strand; PAM type: YTN; PAM sequence: TTG
tccttttatgtctggcccat

SEQ ID NO: 216306 - DNA, 20 bp, Artificial Sequence
  Description of Artificial Sequence: Synthetic oligonucleotide
  Target: ATXN1; (-) strand; PAM type: YTN; PAM sequence: TTT
gtccttttatgtctggccca

SEQ ID NO: 216307 - DNA, 20 bp, Artificial Sequence
  Description of Artificial Sequence: Synthetic oligonucleotide
  Target: ATXN1; (-) strand; PAM type: YTN; PAM sequence: TTA
gggaccacatggaatcatac

SEQ ID NO: 216308 - DNA, 20 bp, Artificial Sequence
  Description of Artificial Sequence: Synthetic oligonucleotide
  Target: ATXN1; (-) strand; PAM type: YTN; PAM sequence: TTT
agggaccacatggaatcata

SEQ ID NO: 216309 - DNA, 20 bp, Artificial Sequence
  Description of Artificial Sequence: Synthetic oligonucleotide
  Target: ATXN1; (-) strand; PAM type: YTN; PAM sequence: TTT
tagggaccacatggaatcat

SEQ ID NO: 216310 - DNA, 20 bp, Artificial Sequence
  Description of Artificial Sequence: Synthetic oligonucleotide
  Target: ATXN1; (-) strand; PAM type: YTN; PAM sequence: TTA
ttttagggaccacatggaat

SEQ ID NO: 216311 - DNA, 20 bp, Artificial Sequence
  Description of Artificial Sequence: Synthetic oligonucleotide
  Target: ATXN1; (-) strand; PAM type: YTN; PAM sequence: CTT
attttagggaccacatggaa

SEQ ID NO: 216312 - DNA, 20 bp, Artificial Sequence
  Description of Artificial Sequence: Synthetic oligonucleotide
  Target: ATXN1; (-) strand; PAM type: YTN; PAM sequence: TTC
ttattttagggaccacatgg

SEQ ID NO: 216313 - DNA, 20 bp, Artificial Sequence
  Description of Artificial Sequence: Synthetic oligonucleotide
  Target: ATXN1; (-) strand; PAM type: YTN; PAM sequence: TTT
cttattttagggaccacatg

SEQ ID NO: 216314 - DNA, 20 bp, Artificial Sequence
  Description of Artificial Sequence: Synthetic oligonucleotide
  Target: ATXN1; (-) strand; PAM type: YTN; PAM sequence: CTA
tgaagtttcttattttaggg

SEQ ID NO: 216315 - DNA, 20 bp, Artificial Sequence
  Description of Artificial Sequence: Synthetic oligonucleotide
  Target: ATXN1; (-) strand; PAM type: YTN; PAM sequence: CTC
tatgaagtttcttattttag

SEQ ID NO: 216316 - DNA, 20 bp, Artificial Sequence
  Description of Artificial Sequence: Synthetic oligonucleotide
  Target: ATXN1; (-) strand; PAM type: YTN; PAM sequence: CTG
tgtctctatgaagtttctta

SEQ ID NO: 216317 - DNA, 20 bp, Artificial Sequence
  Description of Artificial Sequence: Synthetic oligonucleotide
  Target: ATXN1; (-) strand; PAM type: YTN; PAM sequence: TTG
tacactgtgtctctatgaag

SEQ ID NO: 216318 - DNA, 20 bp, Artificial Sequence
  Description of Artificial Sequence: Synthetic oligonucleotide
  Target: ATXN1; (-) strand; PAM type: YTN; PAM sequence: CTA
ttgtacactgtgtctctatg

SEQ ID NO: 216319 - DNA, 20 bp, Artificial Sequence
  Description of Artificial Sequence: Synthetic oligonucleotide
  Target: ATXN1; (-) strand; PAM type: YTN; PAM sequence: CTC
tattgtacactgtgtctcta

SEQ ID NO: 216320 - DNA, 20 bp, Artificial Sequence
  Description of Artificial Sequence: Synthetic oligonucleotide
  Target: ATXN1; (-) strand; PAM type: YTN; PAM sequence: CTG
gtaacctctattgtacactg

SEQ ID NO: 216321 - DNA, 20 bp, Artificial Sequence
  Description of Artificial Sequence: Synthetic oligonucleotide
  Target: ATXN1; (-) strand; PAM type: YTN; PAM sequence: CTC
ccagcccctggtaacctcta

SEQ ID NO: 216322 - DNA, 20 bp, Artificial Sequence
  Description of Artificial Sequence: Synthetic oligonucleotide
  Target: ATXN1; (-) strand; PAM type: YTN; PAM sequence: CTC
ctcccagcccctggtaacct

SEQ ID NO: 216323 - DNA, 20 bp, Artificial Sequence
  Description of Artificial Sequence: Synthetic oligonucleotide
  Target: ATXN1; (-) strand; PAM type: YTN; PAM sequence: CTC
tcctcccagcccctggtaac

SEQ ID NO: 216324 - DNA, 20 bp, Artificial Sequence
  Description of Artificial Sequence: Synthetic oligonucleotide
  Target: ATXN1; (-) strand; PAM type: YTN; PAM sequence: TTC
tctcctcccagcccctggta

SEQ ID NO: 216325 - DNA, 20 bp, Artificial Sequence
  Description of Artificial Sequence: Synthetic oligonucleotide
  Target: ATXN1; (-) strand; PAM type: YTN; PAM sequence: CTC
cattctctcctcccagcccc

SEQ ID NO: 216326 - DNA, 20 bp, Artificial Sequence
  Description of Artificial Sequence: Synthetic oligonucleotide
  Target: ATXN1; (-) strand; PAM type: YTN; PAM sequence: TTA
gacaataacactccattctc

SEQ ID NO: 216327 - DNA, 20 bp, Artificial Sequence
  Description of Artificial Sequence: Synthetic oligonucleotide
  Target: ATXN1; (-) strand; PAM type: YTN; PAM sequence: TTC
attagacaataacactccat

SEQ ID NO: 216328 - DNA, 20 bp, Artificial Sequence
  Description of Artificial Sequence: Synthetic oligonucleotide
  Target: ATXN1; (-) strand; PAM type: YTN; PAM sequence: CTG
cattcattagacaataacac

SEQ ID NO: 216329 - DNA, 20 bp, Artificial Sequence
  Description of Artificial Sequence: Synthetic oligonucleotide
  Target: ATXN1; (-) strand; PAM type: YTN; PAM sequence: CTC
tgcattcattagacaataac

SEQ ID NO: 216330 - DNA, 20 bp, Artificial Sequence
  Description of Artificial Sequence: Synthetic oligonucleotide
  Target: ATXN1; (-) strand; PAM type: YTN; PAM sequence: TTC
atcatcccgaacagaagctc

SEQ ID NO: 216331 - DNA, 20 bp, Artificial Sequence
  Description of Artificial Sequence: Synthetic oligonucleotide
  Target: ATXN1; (-) strand; PAM type: YTN; PAM sequence: TTT
catcatcccgaacagaagct

SEQ ID NO: 216332 - DNA, 20 bp, Artificial Sequence
  Description of Artificial Sequence: Synthetic oligonucleotide
  Target: ATXN1; (-) strand; PAM type: YTN; PAM sequence: TTT
tcatcatcccgaacagaagc

SEQ ID NO: 216333 - DNA, 20 bp, Artificial Sequence
  Description of Artificial Sequence: Synthetic oligonucleotide
  Target: ATXN1; (-) strand; PAM type: YTN; PAM sequence: TTT
ttcatcatcccgaacagaag

SEQ ID NO: 216334 - DNA, 20 bp, Artificial Sequence
  Description of Artificial Sequence: Synthetic oligonucleotide
  Target: ATXN1; (-) strand; PAM type: YTN; PAM sequence: CTT
tttcatcatcccgaacagaa

SEQ ID NO: 216335 - DNA, 20 bp, Artificial Sequence
  Description of Artificial Sequence: Synthetic oligonucleotide
  Target: ATXN1; (-) strand; PAM type: YTN; PAM sequence: TTC
cagaactttttcatcatccc

SEQ ID NO: 216336 - DNA, 20 bp, Artificial Sequence
  Description of Artificial Sequence: Synthetic oligonucleotide
  Target: ATXN1; (-) strand; PAM type: YTN; PAM sequence: TTT
ccagaactttttcatcatcc

SEQ ID NO: 216337 - DNA, 20 bp, Artificial Sequence
  Description of Artificial Sequence: Synthetic oligonucleotide
  Target: ATXN1; (-) strand; PAM type: YTN; PAM sequence: CTA
tccatttccagaactttttc

SEQ ID NO: 216338 - DNA, 20 bp, Artificial Sequence
  Description of Artificial Sequence: Synthetic oligonucleotide
  Target: ATXN1; (-) strand; PAM type: YTN; PAM sequence: CTC
cactatccatttccagaact

SEQ ID NO: 216339 - DNA, 20 bp, Artificial Sequence
  Description of Artificial Sequence: Synthetic oligonucleotide
  Target: ATXN1; (-) strand; PAM type: YTN; PAM sequence: TTC
cagtgtagtgcaatcatctc

SEQ ID NO: 216340 - DNA, 20 bp, Artificial Sequence
  Description of Artificial Sequence: Synthetic oligonucleotide
  Target: ATXN1; (-) strand; PAM type: YTN; PAM sequence: TTT
ccagtgtagtgcaatcatct

SEQ ID NO: 216341 - DNA, 20 bp, Artificial Sequence
  Description of Artificial Sequence: Synthetic oligonucleotide
  Target: ATXN1; (-) strand; PAM type: YTN; PAM sequence: TTA
tgtacatttccagtgtagtg

SEQ ID NO: 216342 - DNA, 20 bp, Artificial Sequence
  Description of Artificial Sequence: Synthetic oligonucleotide
  Target: ATXN1; (-) strand; PAM type: YTN; PAM sequence: TTC
agtggcattatgtacatttc

SEQ ID NO: 216343 - DNA, 20 bp, Artificial Sequence
  Description of Artificial Sequence: Synthetic oligonucleotide
  Target: ATXN1; (-) strand; PAM type: YTN; PAM sequence: TTA
agtgtacaattcagtggcat

SEQ ID NO: 216344 - DNA, 20 bp, Artificial Sequence
  Description of Artificial Sequence: Synthetic oligonucleotide
  Target: ATXN1; (-) strand; PAM type: YTN; PAM sequence: TTT
aagtgtacaattcagtggca

SEQ ID NO: 216345 - DNA, 20 bp, Artificial Sequence
  Description of Artificial Sequence: Synthetic oligonucleotide
  Target: ATXN1; (-) strand; PAM type: YTN; PAM sequence: TTT
taagtgtacaattcagtggc

SEQ ID NO: 216346 - DNA, 20 bp, Artificial Sequence
  Description of Artificial Sequence: Synthetic oligonucleotide
  Target: ATXN1; (-) strand; PAM type: YTN; PAM sequence: TTT
ttaagtgtacaattcagtgg

SEQ ID NO: 216347 - DNA, 20 bp, Artificial Sequence
  Description of Artificial Sequence: Synthetic oligonucleotide
  Target: ATXN1; (-) strand; PAM type: YTN; PAM sequence: TTA
accatttttaagtgtacaat

SEQ ID NO: 216348 - DNA, 20 bp, Artificial Sequence
  Description of Artificial Sequence: Synthetic oligonucleotide
  Target: ATXN1; (-) strand; PAM type: YTN; PAM sequence: TTT
aaccatttttaagtgtacaa

SEQ ID NO: 216349 - DNA, 20 bp, Artificial Sequence
  Description of Artificial Sequence: Synthetic oligonucleotide
  Target: ATXN1; (-) strand; PAM type: YTN; PAM sequence: CTG
gcccagtttaaccattttta

SEQ ID NO: 216350 - DNA, 20 bp, Artificial Sequence
  Description of Artificial Sequence: Synthetic oligonucleotide
  Target: ATXN1; (-) strand; PAM type: YTN; PAM sequence: CTG
gggcgtgagccaccacacct

SEQ ID NO: 216351 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctggggcgtgag

SEQ ID NO: 216352 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctgggg

SEQ ID NO: 216353 - DNA, 20 bp, Artificial Sequence
  Description of Artificial Sequence: Synthetic oligonucleotide
  Target: ATXN1; (-) strand; PAM type: YTN; PAM sequence: CTG
cccgcctcagcctcccaaag

SEQ ID NO: 216354 - DNA, 20 bp, Artificial Sequence
  Description of Artificial Sequence: Synthetic oligonucleotide
  Target: ATXN1; (-) strand; PAM type: YTN; PAM sequence: CTC
gtgatctgcccgcctcagcc

SEQ ID NO: 216355 - DNA, 20 bp, Artificial Sequence
  Description of Artificial Sequence: Synthetic oligonucleotide
  Target: ATXN1; (-) strand; PAM type: YTN; PAM sequence: TTG
acctcgtgatctgcccgcct

SEQ ID NO: 216356 - DNA, 20 bp, Artificial Sequence
  Description of Artificial Sequence: Synthetic oligonucleotide
  Target: ATXN1; (-) strand; PAM type: YTN; PAM sequence: CTT
gacctcgtgatctgcccgcc

SEQ ID NO: 216357 - DNA, 20 bp, Artificial Sequence
  Description of Artificial Sequence: Synthetic oligonucleotide
  Target: ATXN1; (-) strand; PAM type: YTN; PAM sequence: CTC
ttgacctcgtgatctgcccg

SEQ ID NO: 216358 - DNA, 20 bp, Artificial Sequence
  Description of Artificial Sequence: Synthetic oligonucleotide
  Target: ATXN1; (-) strand; PAM type: YTN; PAM sequence: CTC
gatctcttgacctcgtgatc

SEQ ID NO: 216359 - DNA, 20 bp, Artificial Sequence
  Description of Artificial Sequence: Synthetic oligonucleotide
  Target: ATXN1; (-) strand; PAM type: YTN; PAM sequence: TTG
gccaggatggtctcgatctc

SEQ ID NO: 216360 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggatggt

SEQ ID NO: 216361 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggatgg

SEQ ID NO: 216362 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttcacca

SEQ ID NO: 216363 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttcacc

SEQ ID NO: 216364 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttcac

SEQ ID NO: 216365 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttca

SEQ ID NO: 216366 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 216367 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 216368 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 216369 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 216370 - DNA, 20 bp, Artificial Sequence
  Description of Artificial Sequence: Synthetic oligonucleotide
  Target: ATXN1; (-) strand; PAM type: YTN; PAM sequence: CTA
caggcgcatgccgccacgcc

SEQ ID NO: 216371 - DNA, 20 bp, Artificial Sequence
  Description of Artificial Sequence: Synthetic oligonucleotide
  Target: ATXN1; (-) strand; PAM type: YTN; PAM sequence: CTG
ggactacaggcgcatgccgc

SEQ ID NO: 216372 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggactacag

SEQ ID NO: 216373 - DNA, 20 bp, Artificial Sequence
  Description of Artificial Sequence: Synthetic oligonucleotide
  Target: ATXN1; (-) strand; PAM type: YTN; PAM sequence: CTC
ggcctcccgagtagctggga

SEQ ID NO: 216374 - DNA, 20 bp, Artificial Sequence
  Description of Artificial Sequence: Synthetic oligonucleotide
  Target: ATXN1; (-) strand; PAM type: YTN; PAM sequence: CTG
cctcggcctcccgagtagct

SEQ ID NO: 216375 - DNA, 20 bp, Artificial Sequence
  Description of Artificial Sequence: Synthetic oligonucleotide
  Target: ATXN1; (-) strand; PAM type: YTN; PAM sequence: CTC
ctgcctcggcctcccgagta

SEQ ID NO: 216376 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcggcctcccgag

SEQ ID NO: 216377 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcctgcctcgg

SEQ ID NO: 216378 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcaattctcctgc

SEQ ID NO: 216379 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcaattctcc

SEQ ID NO: 216380 - DNA, 20 bp, Artificial Sequence
  Description of Artificial Sequence: Synthetic oligonucleotide
  Target: ATXN1; (-) strand; PAM type: YTN; PAM sequence: CTC
cgcctcctgggttcaagcaa

SEQ ID NO: 216381 - DNA, 20 bp, Artificial Sequence
  Description of Artificial Sequence: Synthetic oligonucleotide
  Target: ATXN1; (-) strand; PAM type: YTN; PAM sequence: CTG
cagcctccgcctcctgggtt

SEQ ID NO: 216382 - DNA, 20 bp, Artificial Sequence
  Description of Artificial Sequence: Synthetic oligonucleotide
  Target: ATXN1; (-) strand; PAM type: YTN; PAM sequence: CTC
actgcagcctccgcctcctg

SEQ ID NO: 216383 - DNA, 20 bp, Artificial Sequence
  Description of Artificial Sequence: Synthetic oligonucleotide
  Target: ATXN1; (-) strand; PAM type: YTN; PAM sequence: CTC
agctcactgcagcctccgcc

SEQ ID NO: 216384 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcatgatctc

SEQ ID NO: 216385 - DNA, 20 bp, Artificial Sequence
  Description of Artificial Sequence: Synthetic oligonucleotide
  Target: ATXN1; (-) strand; PAM type: YTN; PAM sequence: CTG
tcgccaggctggagtgcagt

SEQ ID NO: 216386 - DNA, 20 bp, Artificial Sequence
  Description of Artificial Sequence: Synthetic oligonucleotide
  Target: ATXN1; (-) strand; PAM type: YTN; PAM sequence: CTC
tgtcgccaggctggagtgca

SEQ ID NO: 216387 - DNA, 20 bp, Artificial Sequence
  Description of Artificial Sequence: Synthetic oligonucleotide
  Target: ATXN1; (-) strand; PAM type: YTN; PAM sequence: TTG
ctctgtcgccaggctggagt

SEQ ID NO: 216388 - DNA, 20 bp, Artificial Sequence
  Description of Artificial Sequence: Synthetic oligonucleotide
  Target: ATXN1; (-) strand; PAM type: YTN; PAM sequence: CTT
gctctgtcgccaggctggag

SEQ ID NO: 216389 - DNA, 20 bp, Artificial Sequence
  Description of Artificial Sequence: Synthetic oligonucleotide
  Target: ATXN1; (-) strand; PAM type: YTN; PAM sequence: TTG
aaacggagtcttgctctgtc

SEQ ID NO: 216390 - DNA, 20 bp, Artificial Sequence
  Description of Artificial Sequence: Synthetic oligonucleotide
  Target: ATXN1; (-) strand; PAM type: YTN; PAM sequence: TTT
gaaacggagtcttgctctgt

SEQ ID NO: 216391 - DNA, 20 bp, Artificial Sequence
  Description of Artificial Sequence: Synthetic oligonucleotide
  Target: ATXN1; (-) strand; PAM type: YTN; PAM sequence: TTT
tgaaacggagtcttgctctg

SEQ ID NO: 216392 - DNA, 20 bp, Artificial Sequence
  Description of Artificial Sequence: Synthetic oligonucleotide
  Target: ATXN1; (-) strand; PAM type: YTN; PAM sequence: TTT
ttgaaacggagtcttgctct

SEQ ID NO: 216393 - DNA, 20 bp, Artificial Sequence
  Description of Artificial Sequence: Synthetic oligonucleotide
  Target: ATXN1; (-) strand; PAM type: YTN; PAM sequence: TTT
tttgaaacggagtcttgctc

SEQ ID NO: 216394 - DNA, 20 bp, Artificial Sequence
  Description of Artificial Sequence: Synthetic oligonucleotide
  Target: ATXN1; (-) strand; PAM type: YTN; PAM sequence: TTT
ttttgaaacggagtcttgct

SEQ ID NO: 216395 - DNA, 20 bp, Artificial Sequence
  Description of Artificial Sequence: Synthetic oligonucleotide
  Target: ATXN1; (-) strand; PAM type: YTN; PAM sequence: TTT
tttttgaaacggagtcttgc

SEQ ID NO: 216396 - DNA, 20 bp, Artificial Sequence
  Description of Artificial Sequence: Synthetic oligonucleotide
  Target: ATXN1; (-) strand; PAM type: YTN; PAM sequence: TTT
ttttttgaaacggagtcttg

SEQ ID NO: 216397 - DNA, 20 bp, Artificial Sequence
  Description of Artificial Sequence: Synthetic oligonucleotide
  Target: ATXN1; (-) strand; PAM type: YTN; PAM sequence: TTT
tttttttgaaacggagtctt

SEQ ID NO: 216398 - DNA, 20 bp, Artificial Sequence
  Description of Artificial Sequence: Synthetic oligonucleotide
  Target: ATXN1; (-) strand; PAM type: YTN; PAM sequence: TTT
ttttttttgaaacggagtct

SEQ ID NO: 216399 - DNA, 20 bp, Artificial Sequence
  Description of Artificial Sequence: Synthetic oligonucleotide
  Target: ATXN1; (-) strand; PAM type: YTN; PAM sequence: TTT
tttttttttgaaacggagtc

SEQ ID NO: 216400 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgaaacggagt

SEQ ID NO: 216401 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgaaacggag

SEQ ID NO: 216402 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgaaacgga

SEQ ID NO: 216403 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgaaacgg

SEQ ID NO: 216404 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgaaacg

SEQ ID NO: 216405 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttgaaac

SEQ ID NO: 216406 - DNA, 20 bp, Artificial Sequence
  Description of Artificial Sequence: Synthetic oligonucleotide
  Target: ATXN1; (-) strand; PAM type: YTN; PAM sequence: TTA
accttttttttttttttttt

SEQ ID NO: 216407 - DNA, 20 bp, Artificial Sequence
  Description of Artificial Sequence: Synthetic oligonucleotide
  Target: ATXN1; (-) strand; PAM type: YTN; PAM sequence: TTT
aacctttttttttttttttt

SEQ ID NO: 216408 - DNA, 20 bp, Artificial Sequence
  Description of Artificial Sequence: Synthetic oligonucleotide
  Target: ATXN1; (-) strand; PAM type: YTN; PAM sequence: TTT
taaccttttttttttttttt

SEQ ID NO: 216409 - DNA, 20 bp, Artificial Sequence
  Description of Artificial Sequence: Synthetic oligonucleotide
  Target: ATXN1; (-) strand; PAM type: YTN; PAM sequence: TTA
ccattttaaccttttttttt

SEQ ID NO: 216410 - DNA, 20 bp, Artificial Sequence
  Description of Artificial Sequence: Synthetic oligonucleotide
  Target: ATXN1; (-) strand; PAM type: YTN; PAM sequence: TTT
accattttaacctttttttt

SEQ ID NO: 216411 - DNA, 20 bp, Artificial Sequence
  Description of Artificial Sequence: Synthetic oligonucleotide
  Target: ATXN1; (-) strand; PAM type: YTN; PAM sequence: TTA
ccataaatttaccattttaa

SEQ ID NO: 216412 - DNA, 20 bp, Artificial Sequence
  Description of Artificial Sequence: Synthetic oligonucleotide
  Target: ATXN1; (-) strand; PAM type: YTN; PAM sequence: TTT
accataaatttaccatttta

SEQ ID NO: 216413 - DNA, 20 bp, Artificial Sequence
  Description of Artificial Sequence: Synthetic oligonucleotide
  Target: ATXN1; (-) strand; PAM type: YTN; PAM sequence: TTA
aaatatatataaatatatag

SEQ ID NO: 216414 - DNA, 20 bp, Artificial Sequence
  Description of Artificial Sequence: Synthetic oligonucleotide
  Target: ATXN1; (-) strand; PAM type: YTN; PAM sequence: TTT
aaaatatatataaatatata

SEQ ID NO: 216415 - DNA, 20 bp, Artificial Sequence
  Description of Artificial Sequence: Synthetic oligonucleotide
  Target: ATXN1; (-) strand; PAM type: YTN; PAM sequence: TTT
taaaatatatataaatatat

SEQ ID NO: 216416 - DNA, 20 bp, Artificial Sequence
  Description of Artificial Sequence: Synthetic oligonucleotide
  Target: ATXN1; (-) strand; PAM type: YTN; PAM sequence: TTT
ttaaaatatatataaatata

SEQ ID NO: 216417 - DNA, 20 bp, Artificial Sequence
  Description of Artificial Sequence: Synthetic oligonucleotide
  Target: ATXN1; (-) strand; PAM type: YTN; PAM sequence: TTG
atttttaaaatatatataaa

SEQ ID NO: 216418 - DNA, 20 bp, Artificial Sequence
  Description of Artificial Sequence: Synthetic oligonucleotide
  Target: ATXN1; (-) strand; PAM type: YTN; PAM sequence: TTT
gatttttaaaatatatataa

SEQ ID NO: 216419 - DNA, 20 bp, Artificial Sequence
  Description of Artificial Sequence: Synthetic oligonucleotide
  Target: ATXN1; (-) strand; PAM type: YTN; PAM sequence: TTA
atttgatttttaaaatatat

SEQ ID NO: 216420 - DNA, 20 bp, Artificial Sequence
  Description of Artificial Sequence: Synthetic oligonucleotide
  Target: ATXN1; (-) strand; PAM type: YTN; PAM sequence: CTT
aatttgatttttaaaatata

SEQ ID NO: 216421 - DNA, 20 bp, Artificial Sequence
  Description of Artificial Sequence: Synthetic oligonucleotide
  Target: ATXN1; (-) strand; PAM type: YTN; PAM sequence: CTG
aaagtgtccttaatttgatt

SEQ ID NO: 216422 - DNA, 20 bp, Artificial Sequence
  Description of Artificial Sequence: Synthetic oligonucleotide
  Target: ATXN1; (-) strand; PAM type: YTN; PAM sequence: CTC
tgaaagtgtccttaatttga

SEQ ID NO: 216423 - DNA, 20 bp, Artificial Sequence
  Description of Artificial Sequence: Synthetic oligonucleotide
  Target: ATXN1; (-) strand; PAM type: YTN; PAM sequence: CTA
ctctgaaagtgtccttaatt

SEQ ID NO: 216424 - DNA, 20 bp, Artificial Sequence
  Description of Artificial Sequence: Synthetic oligonucleotide
  Target: ATXN1; (-) strand; PAM type: YTN; PAM sequence: CTA
tccatcagataccctactct

SEQ ID NO: 216425 - DNA, 20 bp, Artificial Sequence
  Description of Artificial Sequence: Synthetic oligonucleotide
  Target: ATXN1; (-) strand; PAM type: YTN; PAM sequence: CTC
agggaccaggctatccatca

SEQ ID NO: 216426 - DNA, 20 bp, Artificial Sequence
  Description of Artificial Sequence: Synthetic oligonucleotide
  Target: ATXN1; (-) strand; PAM type: YTN; PAM sequence: CTG
tgtctcagggaccaggctat

SEQ ID NO: 216427 - DNA, 20 bp, Artificial Sequence
  Description of Artificial Sequence: Synthetic oligonucleotide
  Target: ATXN1; (-) strand; PAM type: YTN; PAM sequence: TTG
gagagccagcatagagcagc

SEQ ID NO: 216428 - DNA, 20 bp, Artificial Sequence
  Description of Artificial Sequence: Synthetic oligonucleotide
  Target: ATXN1; (-) strand; PAM type: YTN; PAM sequence: TTT
ggagagccagcatagagcag

SEQ ID NO: 216429 - DNA, 20 bp, Artificial Sequence
  Description of Artificial Sequence: Synthetic oligonucleotide
  Target: ATXN1; (-) strand; PAM type: YTN; PAM sequence: CTT
tggagagccagcatagagca

SEQ ID NO: 216430 - DNA, 20 bp, Artificial Sequence
  Description of Artificial Sequence: Synthetic oligonucleotide
  Target: ATXN1; (-) strand; PAM type: YTN; PAM sequence: CTC
acccactttggagagccagc

SEQ ID NO: 216431 - DNA, 20 bp, Artificial Sequence
  Description of Artificial Sequence: Synthetic oligonucleotide
  Target: ATXN1; (-) strand; PAM type: YTN; PAM sequence: CTC
tcacccactttggagagcca

SEQ ID NO: 216432 - DNA, 20 bp, Artificial Sequence
  Description of Artificial Sequence: Synthetic oligonucleotide
  Target: ATXN1; (-) strand; PAM type: YTN; PAM sequence: CTG
gcaccactctcacccacttt

SEQ ID NO: 216433 - DNA, 20 bp, Artificial Sequence
  Description of Artificial Sequence: Synthetic oligonucleotide
  Target: ATXN1; (-) strand; PAM type: YTN; PAM sequence: TTC
ctggcaccactctcacccac

SEQ ID NO: 216434 - DNA, 20 bp, Artificial Sequence
  Description of Artificial Sequence: Synthetic oligonucleotide
  Target: ATXN1; (-) strand; PAM type: YTN; PAM sequence: TTC
ccgttcctggcaccactctc

SEQ ID NO: 216435 - DNA, 20 bp, Artificial Sequence
  Description of Artificial Sequence: Synthetic oligonucleotide
  Target: ATXN1; (-) strand; PAM type: YTN; PAM sequence: CTT
cccgttcctggcaccactct

SEQ ID NO: 216436 - DNA, 20 bp, Artificial Sequence
  Description of Artificial Sequence: Synthetic oligonucleotide
  Target: ATXN1; (-) strand; PAM type: YTN; PAM sequence: CTG
gtgagtggccacgtcagtat

SEQ ID NO: 216437 - DNA, 20 bp, Artificial Sequence
  Description of Artificial Sequence: Synthetic oligonucleotide
  Target: ATXN1; (-) strand; PAM type: YTN; PAM sequence: TTC
ctggtgagtggccacgtcag

SEQ ID NO: 216438 - DNA, 20 bp, Artificial Sequence
  Description of Artificial Sequence: Synthetic oligonucleotide
  Target: ATXN1; (-) strand; PAM type: YTN; PAM sequence: TTT
cctggtgagtggccacgtca

SEQ ID NO: 216439 - DNA, 20 bp, Artificial Sequence
  Description of Artificial Sequence: Synthetic oligonucleotide
  Target: ATXN1; (-) strand; PAM type: YTN; PAM sequence: CTT
tcctggtgagtggccacgtc

SEQ ID NO: 216440 - DNA, 20 bp, Artificial Sequence
  Description of Artificial Sequence: Synthetic oligonucleotide
  Target: ATXN1; (-) strand; PAM type: YTN; PAM sequence: CTA
ctttcctggtgagtggccac

SEQ ID NO: 216441 - DNA, 20 bp, Artificial Sequence
  Description of Artificial Sequence: Synthetic oligonucleotide
  Target: ATXN1; (-) strand; PAM type: YTN; PAM sequence: CTC
tactttcctggtgagtggcc

SEQ ID NO: 216442 - DNA, 20 bp, Artificial Sequence
  Description of Artificial Sequence: Synthetic oligonucleotide
  Target: ATXN1; (-) strand; PAM type: YTN; PAM sequence: TTG
cgaaaatggacatggtgacc

SEQ ID NO: 216443 - DNA, 20 bp, Artificial Sequence
  Description of Artificial Sequence: Synthetic oligonucleotide
  Target: ATXN1; (-) strand; PAM type: YTN; PAM sequence: TTT
gcgaaaatggacatggtgac

SEQ ID NO: 216444 - DNA, 20 bp, Artificial Sequence
  Description of Artificial Sequence: Synthetic oligonucleotide
  Target: ATXN1; (-) strand; PAM type: YTN; PAM sequence: CTT
tgcgaaaatggacatggtga

SEQ ID NO: 216445 - DNA, 20 bp, Artificial Sequence
  Description of Artificial Sequence: Synthetic oligonucleotide
  Target: ATXN1; (-) strand; PAM type: YTN; PAM sequence: CTC
actttgcgaaaatggacatg

SEQ ID NO: 216446 - DNA, 20 bp, Artificial Sequence
  Description of Artificial Sequence: Synthetic oligonucleotide
  Target: ATXN1; (-) strand; PAM type: YTN; PAM sequence: CTG
tgctcactttgcgaaaatgg

SEQ ID NO: 216447 - DNA, 20 bp, Artificial Sequence
  Description of Artificial Sequence: Synthetic oligonucleotide
  Target: ATXN1; (-) strand; PAM type: YTN; PAM sequence: CTG
cagctgtgctcactttgcga

SEQ ID NO: 216448 - DNA, 20 bp, Artificial Sequence
  Description of Artificial Sequence: Synthetic oligonucleotide
  Target: ATXN1; (-) strand; PAM type: YTN; PAM sequence: CTC
acctgcagctgtgctcactt

SEQ ID NO: 216449 - DNA, 20 bp, Artificial Sequence
  Description of Artificial Sequence: Synthetic oligonucleotide
  Target: ATXN1; (-) strand; PAM type: YTN; PAM sequence: TTG
ctcacctgcagctgtgctca

SEQ ID NO: 216450 - DNA, 20 bp, Artificial Sequence
  Description of Artificial Sequence: Synthetic oligonucleotide
  Target: ATXN1; (-) strand; PAM type: YTN; PAM sequence: TTT
gctcacctgcagctgtgctc

SEQ ID NO: 216451 - DNA, 20 bp, Artificial Sequence
  Description of Artificial Sequence: Synthetic oligonucleotide
  Target: ATXN1; (-) strand; PAM type: YTN; PAM sequence: CTT
tgctcacctgcagctgtgct

SEQ ID NO: 216452 - DNA, 20 bp, Artificial Sequence
  Description of Artificial Sequence: Synthetic oligonucleotide
  Target: ATXN1; (-) strand; PAM type: YTN; PAM sequence: TTC
agaggctttgctcacctgca

SEQ ID NO: 216453 - DNA, 20 bp, Artificial Sequence
  Description of Artificial Sequence: Synthetic oligonucleotide
  Target: ATXN1; (-) strand; PAM type: YTN; PAM sequence: TTT
cagaggctttgctcacctgc

SEQ ID NO: 216454 - DNA, 20 bp, Artificial Sequence
  Description of Artificial Sequence: Synthetic oligonucleotide
  Target: ATXN1; (-) strand; PAM type: YTN; PAM sequence: TTT
tcagaggctttgctcacctg

SEQ ID NO: 216455 - DNA, 20 bp, Artificial Sequence
  Description of Artificial Sequence: Synthetic oligonucleotide
  Target: ATXN1; (-) strand; PAM type: YTN; PAM sequence: CTG
attttcagaggctttgctca

SEQ ID NO: 216456 - DNA, 20 bp, Artificial Sequence
  Description of Artificial Sequence: Synthetic oligonucleotide
  Target: ATXN1; (-) strand; PAM type: YTN; PAM sequence: CTA
gtgctgattttcagaggctt

SEQ ID NO: 216457 - DNA, 20 bp, Artificial Sequence
  Description of Artificial Sequence: Synthetic oligonucleotide
  Target: ATXN1; (-) strand; PAM type: YTN; PAM sequence: TTG
gcatccatgctagtgctgat

SEQ ID NO: 216458 - DNA, 20 bp, Artificial Sequence
  Description of Artificial Sequence: Synthetic oligonucleotide
  Target: ATXN1; (-) strand; PAM type: YTN; PAM sequence: TTT
ggcatccatgctagtgctga

SEQ ID NO: 216459 - DNA, 20 bp, Artificial Sequence
  Description of Artificial Sequence: Synthetic oligonucleotide
  Target: ATXN1; (-) strand; PAM type: YTN; PAM sequence: TTA
aatcaggaagcgtaaatatt

SEQ ID NO: 216460 - DNA, 20 bp, Artificial Sequence
  Description of Artificial Sequence: Synthetic oligonucleotide
  Target: ATXN1; (-) strand; PAM type: YTN; PAM sequence: TTT
aaatcaggaagcgtaaatat

SEQ ID NO: 216461 - DNA, 20 bp, Artificial Sequence
  Description of Artificial Sequence: Synthetic oligonucleotide
  Target: ATXN1; (-) strand; PAM type: YTN; PAM sequence: TTG
atgcatttaaatcaggaagc

SEQ ID NO: 216462 - DNA, 20 bp, Artificial Sequence
  Description of Artificial Sequence: Synthetic oligonucleotide
  Target: ATXN1; (-) strand; PAM type: YTN; PAM sequence: CTT
gatgcatttaaatcaggaag

SEQ ID NO: 216463 - DNA, 20 bp, Artificial Sequence
  Description of Artificial Sequence: Synthetic oligonucleotide
  Target: ATXN1; (-) strand; PAM type: YTN; PAM sequence: CTG
cttgatgcatttaaatcagg

SEQ ID NO: 216464 - DNA, 20 bp, Artificial Sequence
  Description of Artificial Sequence: Synthetic oligonucleotide
  Target: ATXN1; (-) strand; PAM type: YTN; PAM sequence: CTC
aaaaatatcaagtctgcttg

SEQ ID NO: 216465 - DNA, 20 bp, Artificial Sequence
  Description of Artificial Sequence: Synthetic oligonucleotide
  Target: ATXN1; (-) strand; PAM type: YTN; PAM sequence: TTA
agagtctcaaaaatatcaag

SEQ ID NO: 216466 - DNA, 20 bp, Artificial Sequence
  Description of Artificial Sequence: Synthetic oligonucleotide
  Target: ATXN1; (-) strand; PAM type: YTN; PAM sequence: CTA
ccgttaagagtctcaaaaat

SEQ ID NO: 216467 - DNA, 20 bp, Artificial Sequence
  Description of Artificial Sequence: Synthetic oligonucleotide
  Target: ATXN1; (-) strand; PAM type: YTN; PAM sequence: CTA
caaaaatgatctaccgttaa

SEQ ID NO: 216468 - DNA, 20 bp, Artificial Sequence
  Description of Artificial Sequence: Synthetic oligonucleotide
  Target: ATXN1; (-) strand; PAM type: YTN; PAM sequence: CTC
tacaaaaatgatctaccgtt

SEQ ID NO: 216469 - DNA, 20 bp, Artificial Sequence
  Description of Artificial Sequence: Synthetic oligonucleotide
  Target: ATXN1; (-) strand; PAM type: YTN; PAM sequence: CTG
ctctacaaaaatgatctacc

SEQ ID NO: 216470 - DNA, 20 bp, Artificial Sequence
  Description of Artificial Sequence: Synthetic oligonucleotide
  Target: ATXN1; (-) strand; PAM type: YTN; PAM sequence: TTA
tctgctctacaaaaatgatc

SEQ ID NO: 216471 - DNA, 20 bp, Artificial Sequence
  Description of Artificial Sequence: Synthetic oligonucleotide
  Target: ATXN1; (-) strand; PAM type: YTN; PAM sequence: TTG
gagtggttatctgctctaca

SEQ ID NO: 216472 - DNA, 20 bp, Artificial Sequence
  Description of Artificial Sequence: Synthetic oligonucleotide
  Target: ATXN1; (-) strand; PAM type: YTN; PAM sequence: TTT
ggagtggttatctgctctac

SEQ ID NO: 216473 - DNA, 20 bp, Artificial Sequence
  Description of Artificial Sequence: Synthetic oligonucleotide
  Target: ATXN1; (-) strand; PAM type: YTN; PAM sequence: TTT
tggagtggttatctgctcta

SEQ ID NO: 216474 - DNA, 20 bp, Artificial Sequence
  Description of Artificial Sequence: Synthetic oligonucleotide
  Target: ATXN1; (-) strand; PAM type: YTN; PAM sequence: TTG
aacagttttggagtggttat

SEQ ID NO: 216475 - DNA, 20 bp, Artificial Sequence
  Description of Artificial Sequence: Synthetic oligonucleotide
  Target: ATXN1; (-) strand; PAM type: YTN; PAM sequence: CTT
gaacagttttggagtggtta

SEQ ID NO: 216476 - DNA, 20 bp, Artificial Sequence
  Description of Artificial Sequence: Synthetic oligonucleotide
  Target: ATXN1; (-) strand; PAM type: YTN; PAM sequence: TTA
gcttgaacagttttggagtg

SEQ ID NO: 216477 - DNA, 20 bp, Artificial Sequence
  Description of Artificial Sequence: Synthetic oligonucleotide
  Target: ATXN1; (-) strand; PAM type: YTN; PAM sequence: TTA
ttagcttgaacagttttgga

SEQ ID NO: 216478 - DNA, 20 bp, Artificial Sequence
  Description of Artificial Sequence: Synthetic oligonucleotide
  Target: ATXN1; (-) strand; PAM type: YTN; PAM sequence: TTT
attagcttgaacagttttgg

SEQ ID NO: 216479 - DNA, 20 bp, Artificial Sequence
  Description of Artificial Sequence: Synthetic oligonucleotide
  Target: ATXN1; (-) strand; PAM type: YTN; PAM sequence: CTG
tatttattagcttgaacagt

SEQ ID NO: 216480 - DNA, 20 bp, Artificial Sequence
  Description of Artificial Sequence: Synthetic oligonucleotide
  Target: ATXN1; (-) strand; PAM type: YTN; PAM sequence: TTG
gcccaaatctgtatttatta

SEQ ID NO: 216481 - DNA, 20 bp, Artificial Sequence
  Description of Artificial Sequence: Synthetic oligonucleotide
  Target: ATXN1; (-) strand; PAM type: YTN; PAM sequence: TTT
ggcccaaatctgtatttatt

SEQ ID NO: 216482 - DNA, 20 bp, Artificial Sequence
  Description of Artificial Sequence: Synthetic oligonucleotide
  Target: ATXN1; (-) strand; PAM type: YTN; PAM sequence: TTA
tgtaaatttggcccaaatct

SEQ ID NO: 216483 - DNA, 20 bp, Artificial Sequence
  Description of Artificial Sequence: Synthetic oligonucleotide
  Target: ATXN1; (-) strand; PAM type: YTN; PAM sequence: CTA
caagcacatattatgtaaat

SEQ ID NO: 216484 - DNA, 20 bp, Artificial Sequence
  Description of Artificial Sequence: Synthetic oligonucleotide
  Target: ATXN1; (-) strand; PAM type: YTN; PAM sequence: CTA
tcaaaggtcatggccagtga

SEQ ID NO: 216485 - DNA, 20 bp, Artificial Sequence
  Description of Artificial Sequence: Synthetic oligonucleotide
  Target: ATXN1; (-) strand; PAM type: YTN; PAM sequence: TTC
agctatcaaaggtcatggcc

SEQ ID NO: 216486 - DNA, 20 bp, Artificial Sequence
  Description of Artificial Sequence: Synthetic oligonucleotide
  Target: ATXN1; (-) strand; PAM type: YTN; PAM sequence: TTT
cagctatcaaaggtcatggc

SEQ ID NO: 216487 - DNA, 20 bp, Artificial Sequence
  Description of Artificial Sequence: Synthetic oligonucleotide
  Target: ATXN1; (-) strand; PAM type: YTN; PAM sequence: TTC
aatttcagctatcaaaggtc

SEQ ID NO: 216488 - DNA, 20 bp, Artificial Sequence
  Description of Artificial Sequence: Synthetic oligonucleotide
  Target: ATXN1; (-) strand; PAM type: YTN; PAM sequence: TTA
gtgaaaggggaaagttcaat

SEQ ID NO: 216489 - DNA, 20 bp, Artificial Sequence
  Description of Artificial Sequence: Synthetic oligonucleotide
  Target: ATXN1; (-) strand; PAM type: YTN; PAM sequence: TTT
agtgaaaggggaaagttcaa

SEQ ID NO: 216490 - DNA, 20 bp, Artificial Sequence
  Description of Artificial Sequence: Synthetic oligonucleotide
  Target: ATXN1; (-) strand; PAM type: YTN; PAM sequence: TTG
gaatgacatttagtgaaagg

SEQ ID NO: 216491 - DNA, 20 bp, Artificial Sequence
  Description of Artificial Sequence: Synthetic oligonucleotide
  Target: ATXN1; (-) strand; PAM type: YTN; PAM sequence: TTT
ggaatgacatttagtgaaag

SEQ ID NO: 216492 - DNA, 20 bp, Artificial Sequence
  Description of Artificial Sequence: Synthetic oligonucleotide
  Target: ATXN1; (-) strand; PAM type: YTN; PAM sequence: CTG
gaatttggaatgacatttag

SEQ ID NO: 216493 - DNA, 20 bp, Artificial Sequence
  Description of Artificial Sequence: Synthetic oligonucleotide
  Target: ATXN1; (-) strand; PAM type: YTN; PAM sequence: TTC
caaagacagcctggaatttg

SEQ ID NO: 216494 - DNA, 20 bp, Artificial Sequence
  Description of Artificial Sequence: Synthetic oligonucleotide
  Target: ATXN1; (-) strand; PAM type: YTN; PAM sequence: CTT
ccaaagacagcctggaattt

SEQ ID NO: 216495 - DNA, 20 bp, Artificial Sequence
  Description of Artificial Sequence: Synthetic oligonucleotide
  Target: ATXN1; (-) strand; PAM type: YTN; PAM sequence: TTG
cttccaaagacagcctggaa

SEQ ID NO: 216496 - DNA, 20 bp, Artificial Sequence
  Description of Artificial Sequence: Synthetic oligonucleotide
  Target: ATXN1; (-) strand; PAM type: YTN; PAM sequence: TTT
gcttccaaagacagcctgga

SEQ ID NO: 216497 - DNA, 20 bp, Artificial Sequence
  Description of Artificial Sequence: Synthetic oligonucleotide
  Target: ATXN1; (-) strand; PAM type: YTN; PAM sequence: CTA
aaagacacatggcaacaggc

SEQ ID NO: 216498 - DNA, 20 bp, Artificial Sequence
  Description of Artificial Sequence: Synthetic oligonucleotide
  Target: ATXN1; (-) strand; PAM type: YTN; PAM sequence: TTA
tctaaaagacacatggcaac

SEQ ID NO: 216499 - DNA, 20 bp, Artificial Sequence
  Description of Artificial Sequence: Synthetic oligonucleotide
  Target: ATXN1; (-) strand; PAM type: YTN; PAM sequence: TTA
ttatctaaaagacacatggc

SEQ ID NO: 216500 - DNA, 20 bp, Artificial Sequence
  Description of Artificial Sequence: Synthetic oligonucleotide
  Target: ATXN1; (-) strand; PAM type: YTN; PAM sequence: TTT
attatctaaaagacacatgg

SEQ ID NO: 216501 - DNA, 20 bp, Artificial Sequence
  Description of Artificial Sequence: Synthetic oligonucleotide
  Target: ATXN1; (-) strand; PAM type: YTN; PAM sequence: CTG
gtggaacccacgtttattat

SEQ ID NO: 216502 - DNA, 20 bp, Artificial Sequence
  Description of Artificial Sequence: Synthetic oligonucleotide
  Target: ATXN1; (-) strand; PAM type: YTN; PAM sequence: TTC
catctggtggaacccacgtt

SEQ ID NO: 216503 - DNA, 20 bp, Artificial Sequence
  Description of Artificial Sequence: Synthetic oligonucleotide
  Target: ATXN1; (-) strand; PAM type: YTN; PAM sequence: CTT
ccatctggtggaacccacgt

SEQ ID NO: 216504 - DNA, 20 bp, Artificial Sequence
  Description of Artificial Sequence: Synthetic oligonucleotide
  Target: ATXN1; (-) strand; PAM type: YTN; PAM sequence: TTC
ttccatctggtggaacccac

SEQ ID NO: 216505 - DNA, 20 bp, Artificial Sequence
  Description of Artificial Sequence: Synthetic oligonucleotide
  Target: ATXN1; (-) strand; PAM type: YTN; PAM sequence: CTT
cttccatctggtggaaccca

SEQ ID NO: 216506 - DNA, 20 bp, Artificial Sequence
  Description of Artificial Sequence: Synthetic oligonucleotide
  Target: ATXN1; (-) strand; PAM type: YTN; PAM sequence: TTG
cttcttccatctggtggaac

SEQ ID NO: 216507 - DNA, 20 bp, Artificial Sequence
  Description of Artificial Sequence: Synthetic oligonucleotide
  Target: ATXN1; (-) strand; PAM type: YTN; PAM sequence: TTT
gcttcttccatctggtggaa

SEQ ID NO: 216508 - DNA, 20 bp, Artificial Sequence
  Description of Artificial Sequence: Synthetic oligonucleotide
  Target: ATXN1; (-) strand; PAM type: YTN; PAM sequence: CTT
tgcttcttccatctggtgga

SEQ ID NO: 216509 - DNA, 20 bp, Artificial Sequence
  Description of Artificial Sequence: Synthetic oligonucleotide
  Target: ATXN1; (-) strand; PAM type: YTN; PAM sequence: TTG
gggcaagcactttgcttctt

SEQ ID NO: 216510 - DNA, 20 bp, Artificial Sequence
  Description of Artificial Sequence: Synthetic oligonucleotide
  Target: ATXN1; (-) strand; PAM type: YTN; PAM sequence: TTT
ggggcaagcactttgcttct

SEQ ID NO: 216511 - DNA, 20 bp, Artificial Sequence
  Description of Artificial Sequence: Synthetic oligonucleotide
  Target: ATXN1; (-) strand; PAM type: YTN; PAM sequence: CTA
gatatttggggcaagcactt

SEQ ID NO: 216512 - DNA, 20 bp, Artificial Sequence
  Description of Artificial Sequence: Synthetic oligonucleotide
  Target: ATXN1; (-) strand; PAM type: YTN; PAM sequence: CTA
gcaggaaccctagatatttg

SEQ ID NO: 216513 - DNA, 20 bp, Artificial Sequence
  Description of Artificial Sequence: Synthetic oligonucleotide
  Target: ATXN1; (-) strand; PAM type: YTN; PAM sequence: TTG
ggcgtgagtacctagcagga

SEQ ID NO: 216514 - DNA, 20 bp, Artificial Sequence
  Description of Artificial Sequence: Synthetic oligonucleotide
  Target: ATXN1; (-) strand; PAM type: YTN; PAM sequence: TTT
gggcgtgagtacctagcagg

SEQ ID NO: 216515 - DNA, 20 bp, Artificial Sequence
  Description of Artificial Sequence: Synthetic oligonucleotide
  Target: ATXN1; (-) strand; PAM type: YTN; PAM sequence: TTC
acagtagatgcagtttgggc

SEQ ID NO: 216516 - DNA, 20 bp, Artificial Sequence
  Description of Artificial Sequence: Synthetic oligonucleotide
  Target: ATXN1; (-) strand; PAM type: YTN; PAM sequence: CTT
cacagtagatgcagtttggg

SEQ ID NO: 216517 - DNA, 20 bp, Artificial Sequence
  Description of Artificial Sequence: Synthetic oligonucleotide
  Target: ATXN1; (-) strand; PAM type: YTN; PAM sequence: CTC
ttcacagtagatgcagtttg

SEQ ID NO: 216518 - DNA, 20 bp, Artificial Sequence
  Description of Artificial Sequence: Synthetic oligonucleotide
  Target: ATXN1; (-) strand; PAM type: YTN; PAM sequence: CTA
actcttcacagtagatgcag

SEQ ID NO: 216519 - DNA, 20 bp, Artificial Sequence
  Description of Artificial Sequence: Synthetic oligonucleotide
  Target: ATXN1; (-) strand; PAM type: YTN; PAM sequence: TTG
ggtcagaatgcaaagtcaac

SEQ ID NO: 216520 - DNA, 20 bp, Artificial Sequence
  Description of Artificial Sequence: Synthetic oligonucleotide
  Target: ATXN1; (-) strand; PAM type: YTN; PAM sequence: CTG
cattgggtcagaatgcaaag

SEQ ID NO: 216521 - DNA, 20 bp, Artificial Sequence
  Description of Artificial Sequence: Synthetic oligonucleotide
  Target: ATXN1; (-) strand; PAM type: YTN; PAM sequence: TTG
taggagcccagcatcctgca

SEQ ID NO: 216522 - DNA, 20 bp, Artificial Sequence
  Description of Artificial Sequence: Synthetic oligonucleotide
  Target: ATXN1; (-) strand; PAM type: YTN; PAM sequence: CTT
gtaggagcccagcatcctgc

SEQ ID NO: 216523 - DNA, 20 bp, Artificial Sequence
  Description of Artificial Sequence: Synthetic oligonucleotide
  Target: ATXN1; (-) strand; PAM type: YTN; PAM sequence: CTG
ggagcccatcagacaaacca

SEQ ID NO: 216524 - DNA, 20 bp, Artificial Sequence
  Description of Artificial Sequence: Synthetic oligonucleotide
  Target: ATXN1; (-) strand; PAM type: YTN; PAM sequence: CTC
tgggagcccatcagacaaac

SEQ ID NO: 216525 - DNA, 20 bp, Artificial Sequence
  Description of Artificial Sequence: Synthetic oligonucleotide
  Target: ATXN1; (-) strand; PAM type: YTN; PAM sequence: CTG
gccatctctgggagcccatc

SEQ ID NO: 216526 - DNA, 20 bp, Artificial Sequence
  Description of Artificial Sequence: Synthetic oligonucleotide
  Target: ATXN1; (-) strand; PAM type: YTN; PAM sequence: CTG
gcagctggccatctctggga

SEQ ID NO: 216527 - DNA, 20 bp, Artificial Sequence
  Description of Artificial Sequence: Synthetic oligonucleotide
  Target: ATXN1; (-) strand; PAM type: YTN; PAM sequence: CTG
ctggcagctggccatctctg

SEQ ID NO: 216528 - DNA, 20 bp, Artificial Sequence
  Description of Artificial Sequence: Synthetic oligonucleotide
  Target: ATXN1; (-) strand; PAM type: YTN; PAM sequence: CTA
aatgatgctgctggcagctg

SEQ ID NO: 216529 - DNA, 20 bp, Artificial Sequence
  Description of Artificial Sequence: Synthetic oligonucleotide
  Target: ATXN1; (-) strand; PAM type: YTN; PAM sequence: TTC
taaatgatgctgctggcagc

SEQ ID NO: 216530 - DNA, 20 bp, Artificial Sequence
  Description of Artificial Sequence: Synthetic oligonucleotide
  Target: ATXN1; (-) strand; PAM type: YTN; PAM sequence: CTT
ctaaatgatgctgctggcag

SEQ ID NO: 216531 - DNA, 20 bp, Artificial Sequence
  Description of Artificial Sequence: Synthetic oligonucleotide
  Target: ATXN1; (-) strand; PAM type: YTN; PAM sequence: TTC
ttctaaatgatgctgctggc

SEQ ID NO: 216532 - DNA, 20 bp, Artificial Sequence
  Description of Artificial Sequence: Synthetic oligonucleotide
  Target: ATXN1; (-) strand; PAM type: YTN; PAM sequence: CTC
aggaccagaattcttctaaa

SEQ ID NO: 216533 - DNA, 20 bp, Artificial Sequence
  Description of Artificial Sequence: Synthetic oligonucleotide
  Target: ATXN1; (-) strand; PAM type: YTN; PAM sequence: CTG
tcctcaggaccagaattctt

SEQ ID NO: 216534 - DNA, 20 bp, Artificial Sequence
  Description of Artificial Sequence: Synthetic oligonucleotide
  Target: ATXN1; (-) strand; PAM type: YTN; PAM sequence: TTC
aataatctgtcctcaggacc

SEQ ID NO: 216535 - DNA, 20 bp, Artificial Sequence
  Description of Artificial Sequence: Synthetic oligonucleotide
  Target: ATXN1; (-) strand; PAM type: YTN; PAM sequence: TTT
caataatctgtcctcaggac

SEQ ID NO: 216536 - DNA, 20 bp, Artificial Sequence
  Description of Artificial Sequence: Synthetic oligonucleotide
  Target: ATXN1; (-) strand; PAM type: YTN; PAM sequence: TTT
tcaataatctgtcctcagga

SEQ ID NO: 216537 - DNA, 20 bp, Artificial Sequence
  Description of Artificial Sequence: Synthetic oligonucleotide
  Target: ATXN1; (-) strand; PAM type: YTN; PAM sequence: TTA
ttttcaataatctgtcctca

SEQ ID NO: 216538 - DNA, 20 bp, Artificial Sequence
  Description of Artificial Sequence: Synthetic oligonucleotide
  Target: ATXN1; (-) strand; PAM type: YTN; PAM sequence: TTA
aatggaaatagattattttc

SEQ ID NO: 216539 - DNA, 20 bp, Artificial Sequence
  Description of Artificial Sequence: Synthetic oligonucleotide
  Target: ATXN1; (-) strand; PAM type: YTN; PAM sequence: TTG
cagaggttaaatggaaatag

SEQ ID NO: 216540 - DNA, 20 bp, Artificial Sequence
  Description of Artificial Sequence: Synthetic oligonucleotide
  Target: ATXN1; (-) strand; PAM type: YTN; PAM sequence: TTT
gcagaggttaaatggaaata

SEQ ID NO: 216541 - DNA, 20 bp, Artificial Sequence
  Description of Artificial Sequence: Synthetic oligonucleotide
  Target: ATXN1; (-) strand; PAM type: YTN; PAM sequence: CTT
tgcagaggttaaatggaaat

SEQ ID NO: 216542 - DNA, 20 bp, Artificial Sequence
  Description of Artificial Sequence: Synthetic oligonucleotide
  Target: ATXN1; (-) strand; PAM type: YTN; PAM sequence: CTA
ctttgcagaggttaaatgga

SEQ ID NO: 216543 - DNA, 20 bp, Artificial Sequence
  Description of Artificial Sequence: Synthetic oligonucleotide
  Target: ATXN1; (-) strand; PAM type: YTN; PAM sequence: TTA
aggaaacgaaagccccacaa

SEQ ID NO: 216544 - DNA, 20 bp, Artificial Sequence
  Description of Artificial Sequence: Synthetic oligonucleotide
  Target: ATXN1; (-) strand; PAM type: YTN; PAM sequence: TTT
aaggaaacgaaagccccaca

SEQ ID NO: 216545 - DNA, 20 bp, Artificial Sequence
  Description of Artificial Sequence: Synthetic oligonucleotide
  Target: ATXN1; (-) strand; PAM type: YTN; PAM sequence: TTT
taaggaaacgaaagccccac

SEQ ID NO: 216546 - DNA, 20 bp, Artificial Sequence
  Description of Artificial Sequence: Synthetic oligonucleotide
  Target: ATXN1; (-) strand; PAM type: YTN; PAM sequence: CTT
ttaaggaaacgaaagcccca

SEQ ID NO: 216547 - DNA, 20 bp, Artificial Sequence
  Description of Artificial Sequence: Synthetic oligonucleotide
  Target: ATXN1; (-) strand; PAM type: YTN; PAM sequence: TTG
cttttaaggaaacgaaagcc

SEQ ID NO: 216548 - DNA, 20 bp, Artificial Sequence
  Description of Artificial Sequence: Synthetic oligonucleotide
  Target: ATXN1; (-) strand; PAM type: YTN; PAM sequence: CTA
agcaagtacacagttgcttt

SEQ ID NO: 216549 - DNA, 20 bp, Artificial Sequence
  Description of Artificial Sequence: Synthetic oligonucleotide
  Target: ATXN1; (-) strand; PAM type: YTN; PAM sequence: TTG
ctaagcaagtacacagttgc

SEQ ID NO: 216550 - DNA, 20 bp, Artificial Sequence
  Description of Artificial Sequence: Synthetic oligonucleotide
  Target: ATXN1; (-) strand; PAM type: YTN; PAM sequence: TTA
agtccacgttgctaagcaag

SEQ ID NO: 216551 - DNA, 20 bp, Artificial Sequence
  Description of Artificial Sequence: Synthetic oligonucleotide
  Target: ATXN1; (-) strand; PAM type: YTN; PAM sequence: TTT
aagtccacgttgctaagcaa

SEQ ID NO: 216552 - DNA, 20 bp, Artificial Sequence
  Description of Artificial Sequence: Synthetic oligonucleotide
  Target: ATXN1; (-) strand; PAM type: YTN; PAM sequence: CTG
gtttaagtccacgttgctaa

SEQ ID NO: 216553 - DNA, 20 bp, Artificial Sequence
  Description of Artificial Sequence: Synthetic oligonucleotide
  Target: ATXN1; (-) strand; PAM type: YTN; PAM sequence: TTC
cactggtttaagtccacgtt

SEQ ID NO: 216554 - DNA, 20 bp, Artificial Sequence
  Description of Artificial Sequence: Synthetic oligonucleotide
  Target: ATXN1; (-) strand; PAM type: YTN; PAM sequence: CTT
ccactggtttaagtccacgt

SEQ ID NO: 216555 - DNA, 20 bp, Artificial Sequence
  Description of Artificial Sequence: Synthetic oligonucleotide
  Target: ATXN1; (-) strand; PAM type: YTN; PAM sequence: TTC
ttccactggtttaagtccac

SEQ ID NO: 216556 - DNA, 20 bp, Artificial Sequence
  Description of Artificial Sequence: Synthetic oligonucleotide
  Target: ATXN1; (-) strand; PAM type: YTN; PAM sequence: TTT
cttccactggtttaagtcca

SEQ ID NO: 216557 - DNA, 20 bp, Artificial Sequence
  Description of Artificial Sequence: Synthetic oligonucleotide
  Target: ATXN1; (-) strand; PAM type: YTN; PAM sequence: CTA
agtatttcttccactggttt

SEQ ID NO: 216558 - DNA, 20 bp, Artificial Sequence
  Description of Artificial Sequence: Synthetic oligonucleotide
  Target: ATXN1; (-) strand; PAM type: YTN; PAM sequence: CTC
cactaagtatttcttccact

SEQ ID NO: 216559 - DNA, 20 bp, Artificial Sequence
  Description of Artificial Sequence: Synthetic oligonucleotide
  Target: ATXN1; (-) strand; PAM type: YTN; PAM sequence: TTC
cagtctccactaagtatttc

SEQ ID NO: 216560 - DNA, 20 bp, Artificial Sequence
  Description of Artificial Sequence: Synthetic oligonucleotide
  Target: ATXN1; (-) strand; PAM type: YTN; PAM sequence: TTT
ccagtctccactaagtattt

SEQ ID NO: 216561 - DNA, 20 bp, Artificial Sequence
  Description of Artificial Sequence: Synthetic oligonucleotide
  Target: ATXN1; (-) strand; PAM type: YTN; PAM sequence: TTT
tccagtctccactaagtatt

SEQ ID NO: 216562 - DNA, 20 bp, Artificial Sequence
  Description of Artificial Sequence: Synthetic oligonucleotide
  Target: ATXN1; (-) strand; PAM type: YTN; PAM sequence: CTG
ttttccagtctccactaagt

SEQ ID NO: 216563 - DNA, 20 bp, Artificial Sequence
  Description of Artificial Sequence: Synthetic oligonucleotide
  Target: ATXN1; (-) strand; PAM type: YTN; PAM sequence: TTG
ctgttttccagtctccacta

SEQ ID NO: 216564 - DNA, 20 bp, Artificial Sequence
  Description of Artificial Sequence: Synthetic oligonucleotide
  Target: ATXN1; (-) strand; PAM type: YTN; PAM sequence: TTA
ttgctgttttccagtctcca

SEQ ID NO: 216565 - DNA, 20 bp, Artificial Sequence
  Description of Artificial Sequence: Synthetic oligonucleotide
  Target: ATXN1; (-) strand; PAM type: YTN; PAM sequence: TTT
attgctgttttccagtctcc

SEQ ID NO: 216566 - DNA, 20 bp, Artificial Sequence
  Description of Artificial Sequence: Synthetic oligonucleotide
  Target: ATXN1; (-) strand; PAM type: YTN; PAM sequence: TTT
tattgctgttttccagtctc

SEQ ID NO: 216567 - DNA, 20 bp, Artificial Sequence
  Description of Artificial Sequence: Synthetic oligonucleotide
  Target: ATXN1; (-) strand; PAM type: YTN; PAM sequence: CTT
ttattgctgttttccagtct

SEQ ID NO: 216568 - DNA, 20 bp, Artificial Sequence
  Description of Artificial Sequence: Synthetic oligonucleotide
  Target: ATXN1; (-) strand; PAM type: YTN; PAM sequence: CTC
ttttattgctgttttccagt

SEQ ID NO: 216569 - DNA, 20 bp, Artificial Sequence
  Description of Artificial Sequence: Synthetic oligonucleotide
  Target: ATXN1; (-) strand; PAM type: YTN; PAM sequence: CTC
tcttttattgctgttttcca

SEQ ID NO: 216570 - DNA, 20 bp, Artificial Sequence
  Description of Artificial Sequence: Synthetic oligonucleotide
  Target: ATXN1; (-) strand; PAM type: YTN; PAM sequence: TTG
aacctctcttttattgctgt

SEQ ID NO: 216571 - DNA, 20 bp, Artificial Sequence
  Description of Artificial Sequence: Synthetic oligonucleotide
  Target: ATXN1; (-) strand; PAM type: YTN; PAM sequence: CTA
ttgaacctctcttttattgc

SEQ ID NO: 216572 - DNA, 20 bp, Artificial Sequence
  Description of Artificial Sequence: Synthetic oligonucleotide
  Target: ATXN1; (-) strand; PAM type: YTN; PAM sequence: CTC
tattgaacctctcttttatt

SEQ ID NO: 216573 - DNA, 20 bp, Artificial Sequence
  Description of Artificial Sequence: Synthetic oligonucleotide
  Target: ATXN1; (-) strand; PAM type: YTN; PAM sequence: CTC
cctctattgaacctctcttt

SEQ ID NO: 216574 - DNA, 20 bp, Artificial Sequence
  Description of Artificial Sequence: Synthetic oligonucleotide
  Target: ATXN1; (-) strand; PAM type: YTN; PAM sequence: CTG
tagtcggccaccacccctcc

SEQ ID NO: 216575 - DNA, 20 bp, Artificial Sequence
  Description of Artificial Sequence: Synthetic oligonucleotide
  Target: ATXN1; (-) strand; PAM type: YTN; PAM sequence: TTG
gtctgtagtcggccaccacc

SEQ ID NO: 216576 - DNA, 20 bp, Artificial Sequence
  Description of Artificial Sequence: Synthetic oligonucleotide
  Target: ATXN1; (-) strand; PAM type: YTN; PAM sequence: CTT
ggtctgtagtcggccaccac

SEQ ID NO: 216577 - DNA, 20 bp, Artificial Sequence
  Description of Artificial Sequence: Synthetic oligonucleotide
  Target: ATXN1; (-) strand; PAM type: YTN; PAM sequence: CTC
acccttggtctgtagtcggc

SEQ ID NO: 216578 - DNA, 20 bp, Artificial Sequence
  Description of Artificial Sequence: Synthetic oligonucleotide
  Target: ATXN1; (-) strand; PAM type: YTN; PAM sequence: CTC
cctcacccttggtctgtagt

SEQ ID NO: 216579 - DNA, 20 bp, Artificial Sequence
  Description of Artificial Sequence: Synthetic oligonucleotide
  Target: ATXN1; (-) strand; PAM type: YTN; PAM sequence: CTG
tggctccctcacccttggtc

SEQ ID NO: 216580 - DNA, 20 bp, Artificial Sequence
  Description of Artificial Sequence: Synthetic oligonucleotide
  Target: ATXN1; (-) strand; PAM type: YTN; PAM sequence: TTC
aatctgtggctccctcaccc

SEQ ID NO: 216581 - DNA, 20 bp, Artificial Sequence
  Description of Artificial Sequence: Synthetic oligonucleotide
  Target: ATXN1; (-) strand; PAM type: YTN; PAM sequence: CTG
ggattcaatctgtggctccc

SEQ ID NO: 216582 - DNA, 20 bp, Artificial Sequence
  Description of Artificial Sequence: Synthetic oligonucleotide
  Target: ATXN1; (-) strand; PAM type: YTN; PAM sequence: TTG
gagatggtaaagctgggatt

SEQ ID NO: 216583 - DNA, 20 bp, Artificial Sequence
  Description of Artificial Sequence: Synthetic oligonucleotide
  Target: ATXN1; (-) strand; PAM type: YTN; PAM sequence: CTT
ggagatggtaaagctgggat

SEQ ID NO: 216584 - DNA, 20 bp, Artificial Sequence
  Description of Artificial Sequence: Synthetic oligonucleotide
  Target: ATXN1; (-) strand; PAM type: YTN; PAM sequence: CTG
cttggagatggtaaagctgg

SEQ ID NO: 216585 - DNA, 20 bp, Artificial Sequence
  Description of Artificial Sequence: Synthetic oligonucleotide
  Target: ATXN1; (-) strand; PAM type: YTN; PAM sequence: CTG
aagaaagtaatgctgcttgg

SEQ ID NO: 216586 - DNA, 20 bp, Artificial Sequence
  Description of Artificial Sequence: Synthetic oligonucleotide
  Target: ATXN1; (-) strand; PAM type: YTN; PAM sequence: CTG
ggactgaagaaagtaatgct

SEQ ID NO: 216587 - DNA, 20 bp, Artificial Sequence
  Description of Artificial Sequence: Synthetic oligonucleotide
  Target: ATXN1; (-) strand; PAM type: YTN; PAM sequence: TTA
taatggatgaggtcactggg

SEQ ID NO: 216588 - DNA, 20 bp, Artificial Sequence
  Description of Artificial Sequence: Synthetic oligonucleotide
  Target: ATXN1; (-) strand; PAM type: YTN; PAM sequence: TTA
atattataatggatgaggtc

SEQ ID NO: 216589 - DNA, 20 bp, Artificial Sequence
  Description of Artificial Sequence: Synthetic oligonucleotide
  Target: ATXN1; (-) strand; PAM type: YTN; PAM sequence: TTA
ttaatattataatggatgag

SEQ ID NO: 216590 - DNA, 20 bp, Artificial Sequence
  Description of Artificial Sequence: Synthetic oligonucleotide
  Target: ATXN1; (-) strand; PAM type: YTN; PAM sequence: TTA
tatgttattaatattataat

SEQ ID NO: 216591 - DNA, 20 bp, Artificial Sequence
  Description of Artificial Sequence: Synthetic oligonucleotide
  Target: ATXN1; (-) strand; PAM type: YTN; PAM sequence: TTC
aattatatgttattaatatt

SEQ ID NO: 216592 - DNA, 20 bp, Artificial Sequence
  Description of Artificial Sequence: Synthetic oligonucleotide
  Target: ATXN1; (-) strand; PAM type: YTN; PAM sequence: TTT
caattatatgttattaatat

SEQ ID NO: 216593 - DNA, 20 bp, Artificial Sequence
  Description of Artificial Sequence: Synthetic oligonucleotide
  Target: ATXN1; (-) strand; PAM type: YTN; PAM sequence: TTG
catttcaattatatgttatt

SEQ ID NO: 216594 - DNA, 20 bp, Artificial Sequence
  Description of Artificial Sequence: Synthetic oligonucleotide
  Target: ATXN1; (-) strand; PAM type: YTN; PAM sequence: TTT
gcatttcaattatatgttat

SEQ ID NO: 216595 - DNA, 20 bp, Artificial Sequence
  Description of Artificial Sequence: Synthetic oligonucleotide
  Target: ATXN1; (-) strand; PAM type: YTN; PAM sequence: TTT
tgcatttcaattatatgtta

SEQ ID NO: 216596 - DNA, 20 bp, Artificial Sequence
  Description of Artificial Sequence: Synthetic oligonucleotide
  Target: ATXN1; (-) strand; PAM type: YTN; PAM sequence: TTT
ttgcatttcaattatatgtt

SEQ ID NO: 216597 - DNA, 20 bp, Artificial Sequence
  Description of Artificial Sequence: Synthetic oligonucleotide
  Target: ATXN1; (-) strand; PAM type: YTN; PAM sequence: TTA
aaggtagagagtgtaatttt

SEQ ID NO: 216598 - DNA, 20 bp, Artificial Sequence
  Description of Artificial Sequence: Synthetic oligonucleotide
  Target: ATXN1; (-) strand; PAM type: YTN; PAM sequence: CTT
aaaggtagagagtgtaattt

SEQ ID NO: 216599 - DNA, 20 bp, Artificial Sequence
  Description of Artificial Sequence: Synthetic oligonucleotide
  Target: ATXN1; (-) strand; PAM type: YTN; PAM sequence: TTG
atccccataggaaatcttaa

SEQ ID NO: 216600 - DNA, 20 bp, Artificial Sequence
  Description of Artificial Sequence: Synthetic oligonucleotide
  Target: ATXN1; (-) strand; PAM type: YTN; PAM sequence: TTT
gatccccataggaaatctta

SEQ ID NO: 216601 - DNA, 20 bp, Artificial Sequence
  Description of Artificial Sequence: Synthetic oligonucleotide
  Target: ATXN1; (-) strand; PAM type: YTN; PAM sequence: CTC
atttgatccccataggaaat

SEQ ID NO: 216602 - DNA, 20 bp, Artificial Sequence
  Description of Artificial Sequence: Synthetic oligonucleotide
  Target: ATXN1; (-) strand; PAM type: YTN; PAM sequence: TTC
atctcatttgatccccatag

SEQ ID NO: 216603 - DNA, 20 bp, Artificial Sequence
  Description of Artificial Sequence: Synthetic oligonucleotide
  Target: ATXN1; (-) strand; PAM type: YTN; PAM sequence: TTT
catctcatttgatccccata

SEQ ID NO: 216604 - DNA, 20 bp, Artificial Sequence
  Description of Artificial Sequence: Synthetic oligonucleotide
  Target: ATXN1; (-) strand; PAM type: YTN; PAM sequence: CTG
tgcatgtttcatctcatttg

SEQ ID NO: 216605 - DNA, 20 bp, Artificial Sequence
  Description of Artificial Sequence: Synthetic oligonucleotide
  Target: ATXN1; (-) strand; PAM type: YTN; PAM sequence: TTG
cctgtgcatgtttcatctca

SEQ ID NO: 216606 - DNA, 20 bp, Artificial Sequence
  Description of Artificial Sequence: Synthetic oligonucleotide
  Target: ATXN1; (-) strand; PAM type: YTN; PAM sequence: TTT
gcctgtgcatgtttcatctc

SEQ ID NO: 216607 - DNA, 20 bp, Artificial Sequence
  Description of Artificial Sequence: Synthetic oligonucleotide
  Target: ATXN1; (-) strand; PAM type: YTN; PAM sequence: TTT
tgcctgtgcatgtttcatct

SEQ ID NO: 216608 - DNA, 20 bp, Artificial Sequence
  Description of Artificial Sequence: Synthetic oligonucleotide
  Target: ATXN1; (-) strand; PAM type: YTN; PAM sequence: TTT
ttgcctgtgcatgtttcatc

SEQ ID NO: 216609 - DNA, 20 bp, Artificial Sequence
  Description of Artificial Sequence: Synthetic oligonucleotide
  Target: ATXN1; (-) strand; PAM type: YTN; PAM sequence: CTT
tttgcctgtgcatgtttcat

SEQ ID NO: 216610 - DNA, 20 bp, Artificial Sequence
  Description of Artificial Sequence: Synthetic oligonucleotide
  Target: ATXN1; (-) strand; PAM type: YTN; PAM sequence: CTC
ctttttgcctgtgcatgttt

SEQ ID NO: 216611 - DNA, 20 bp, Artificial Sequence
  Description of Artificial Sequence: Synthetic oligonucleotide
  Target: ATXN1; (-) strand; PAM type: YTN; PAM sequence: CTG
agcaactcctttttgcctgt

SEQ ID NO: 216612 - DNA, 20 bp, Artificial Sequence
  Description of Artificial Sequence: Synthetic oligonucleotide
  Target: ATXN1; (-) strand; PAM type: YTN; PAM sequence: TTA
ctgagcaactcctttttgcc

SEQ ID NO: 216613 - DNA, 20 bp, Artificial Sequence
  Description of Artificial Sequence: Synthetic oligonucleotide
  Target: ATXN1; (-) strand; PAM type: YTN; PAM sequence: TTA
agttactgagcaactccttt

SEQ ID NO: 216614 - DNA, 20 bp, Artificial Sequence
  Description of Artificial Sequence: Synthetic oligonucleotide
  Target: ATXN1; (-) strand; PAM type: YTN; PAM sequence: CTG
gttaagttactgagcaactc

SEQ ID NO: 216615 - DNA, 20 bp, Artificial Sequence
  Description of Artificial Sequence: Synthetic oligonucleotide
  Target: ATXN1; (-) strand; PAM type: YTN; PAM sequence: TTA
aagaagaaataaactggtta

SEQ ID NO: 216616 - DNA, 20 bp, Artificial Sequence
  Description of Artificial Sequence: Synthetic oligonucleotide
  Target: ATXN1; (-) strand; PAM type: YTN; PAM sequence: TTT
aaagaagaaataaactggtt

SEQ ID NO: 216617 - DNA, 20 bp, Artificial Sequence
  Description of Artificial Sequence: Synthetic oligonucleotide
  Target: ATXN1; (-) strand; PAM type: YTN; PAM sequence: TTT
taaagaagaaataaactggt

SEQ ID NO: 216618 - DNA, 20 bp, Artificial Sequence
  Description of Artificial Sequence: Synthetic oligonucleotide
  Target: ATXN1; (-) strand; PAM type: YTN; PAM sequence: TTT
ttaaagaagaaataaactgg

SEQ ID NO: 216619 - DNA, 20 bp, Artificial Sequence
  Description of Artificial Sequence: Synthetic oligonucleotide
  Target: ATXN1; (-) strand; PAM type: YTN; PAM sequence: CTT
tttaaagaagaaataaactg

SEQ ID NO: 216620 - DNA, 20 bp, Artificial Sequence
  Description of Artificial Sequence: Synthetic oligonucleotide
  Target: ATXN1; (-) strand; PAM type: YTN; PAM sequence: TTC
ctttttaaagaagaaataaa

SEQ ID NO: 216621 - DNA, 20 bp, Artificial Sequence
  Description of Artificial Sequence: Synthetic oligonucleotide
  Target: ATXN1; (-) strand; PAM type: YTN; PAM sequence: TTT
cctttttaaagaagaaataa

SEQ ID NO: 216622 - DNA, 20 bp, Artificial Sequence
  Description of Artificial Sequence: Synthetic oligonucleotide
  Target: ATXN1; (-) strand; PAM type: YTN; PAM sequence: TTG
tacaatttcctttttaaaga

SEQ ID NO: 216623 - DNA, 20 bp, Artificial Sequence
  Description of Artificial Sequence: Synthetic oligonucleotide
  Target: ATXN1; (-) strand; PAM type: YTN; PAM sequence: TTT
gtacaatttcctttttaaag

SEQ ID NO: 216624 - DNA, 20 bp, Artificial Sequence
  Description of Artificial Sequence: Synthetic oligonucleotide
  Target: ATXN1; (-) strand; PAM type: YTN; PAM sequence: TTT
tgtacaatttcctttttaaa

SEQ ID NO: 216625 - DNA, 20 bp, Artificial Sequence
  Description of Artificial Sequence: Synthetic oligonucleotide
  Target: ATXN1; (-) strand; PAM type: YTN; PAM sequence: CTG
gaaacatgttttgtacaatt

SEQ ID NO: 216626 - DNA, 20 bp, Artificial Sequence
  Description of Artificial Sequence: Synthetic oligonucleotide
  Target: ATXN1; (-) strand; PAM type: YTN; PAM sequence: CTC
tggaaacatgttttgtacaa

SEQ ID NO: 216627 - DNA, 20 bp, Artificial Sequence
  Description of Artificial Sequence: Synthetic oligonucleotide
  Target: ATXN1; (-) strand; PAM type: YTN; PAM sequence: TTA
acaaaactctggaaacatgt

SEQ ID NO: 216628 - DNA, 20 bp, Artificial Sequence
  Description of Artificial Sequence: Synthetic oligonucleotide
  Target: ATXN1; (-) strand; PAM type: YTN; PAM sequence: CTT
aacaaaactctggaaacatg

SEQ ID NO: 216629 - DNA, 20 bp, Artificial Sequence
  Description of Artificial Sequence: Synthetic oligonucleotide
  Target: ATXN1; (-) strand; PAM type: YTN; PAM sequence: TTC
cttaacaaaactctggaaac

SEQ ID NO: 216630 - DNA, 20 bp, Artificial Sequence
  Description of Artificial Sequence: Synthetic oligonucleotide
  Target: ATXN1; (-) strand; PAM type: YTN; PAM sequence: CTT
ccttaacaaaactctggaaa

SEQ ID NO: 216631 - DNA, 20 bp, Artificial Sequence
  Description of Artificial Sequence: Synthetic oligonucleotide
  Target: ATXN1; (-) strand; PAM type: YTN; PAM sequence: TTC
aaagcttccttaacaaaact

SEQ ID NO: 216632 - DNA, 20 bp, Artificial Sequence
  Description of Artificial Sequence: Synthetic oligonucleotide
  Target: ATXN1; (-) strand; PAM type: YTN; PAM sequence: TTT
caaagcttccttaacaaaac

SEQ ID NO: 216633 - DNA, 20 bp, Artificial Sequence
  Description of Artificial Sequence: Synthetic oligonucleotide
  Target: ATXN1; (-) strand; PAM type: YTN; PAM sequence: TTT
tcaaagcttccttaacaaaa

SEQ ID NO: 216634 - DNA, 20 bp, Artificial Sequence
  Description of Artificial Sequence: Synthetic oligonucleotide
  Target: ATXN1; (-) strand; PAM type: YTN; PAM sequence: CTG
ttttcaaagcttccttaaca

SEQ ID NO: 216635 - DNA, 20 bp, Artificial Sequence
  Description of Artificial Sequence: Synthetic oligonucleotide
  Target: ATXN1; (-) strand; PAM type: YTN; PAM sequence: CTG
gtggagtctgttttcaaagc

SEQ ID NO: 216636 - DNA, 20 bp, Artificial Sequence
  Description of Artificial Sequence: Synthetic oligonucleotide
  Target: ATXN1; (-) strand; PAM type: YTN; PAM sequence: CTC
cataaatactggtggagtct

SEQ ID NO: 216637 - DNA, 20 bp, Artificial Sequence
  Description of Artificial Sequence: Synthetic oligonucleotide
  Target: ATXN1; (-) strand; PAM type: YTN; PAM sequence: CTG
tcagtatggtgaatactcca

SEQ ID NO: 216638 - DNA, 20 bp, Artificial Sequence
  Description of Artificial Sequence: Synthetic oligonucleotide
  Target: ATXN1; (-) strand; PAM type: YTN; PAM sequence: TTA
gactgtcagtatggtgaata

SEQ ID NO: 216639 - DNA, 20 bp, Artificial Sequence
  Description of Artificial Sequence: Synthetic oligonucleotide
  Target: ATXN1; (-) strand; PAM type: YTN; PAM sequence: CTC
cccagaggagtggtattaga

SEQ ID NO: 216640 - DNA, 20 bp, Artificial Sequence
  Description of Artificial Sequence: Synthetic oligonucleotide
  Target: ATXN1; (-) strand; PAM type: YTN; PAM sequence: CTG
ggctccccagaggagtggta

SEQ ID NO: 216641 - DNA, 20 bp, Artificial Sequence
  Description of Artificial Sequence: Synthetic oligonucleotide
  Target: ATXN1; (-) strand; PAM type: YTN; PAM sequence: TTG
caccatcctgggctccccag

SEQ ID NO: 216642 - DNA, 20 bp, Artificial Sequence
  Description of Artificial Sequence: Synthetic oligonucleotide
  Target: ATXN1; (-) strand; PAM type: YTN; PAM sequence: CTT
gcaccatcctgggctcccca

SEQ ID NO: 216643 - DNA, 20 bp, Artificial Sequence
  Description of Artificial Sequence: Synthetic oligonucleotide
  Target: ATXN1; (-) strand; PAM type: YTN; PAM sequence: TTG
gagatacatcttgcaccatc

SEQ ID NO: 216644 - DNA, 20 bp, Artificial Sequence
  Description of Artificial Sequence: Synthetic oligonucleotide
  Target: ATXN1; (-) strand; PAM type: YTN; PAM sequence: CTT
ggagatacatcttgcaccat

SEQ ID NO: 216645 - DNA, 20 bp, Artificial Sequence
  Description of Artificial Sequence: Synthetic oligonucleotide
  Target: ATXN1; (-) strand; PAM type: YTN; PAM sequence: TTA
tgggcatgtgccaccacaca

SEQ ID NO: 216646 - DNA, 20 bp, Artificial Sequence
  Description of Artificial Sequence: Synthetic oligonucleotide
  Target: ATXN1; (-) strand; PAM type: YTN; PAM sequence: CTG
ggattatgggcatgtgccac

SEQ ID NO: 216647 - DNA, 20 bp, Artificial Sequence
  Description of Artificial Sequence: Synthetic oligonucleotide
  Target: ATXN1; (-) strand; PAM type: YTN; PAM sequence: CTC
agagtgctgggattatgggc

SEQ ID NO: 216648 - DNA, 20 bp, Artificial Sequence
  Description of Artificial Sequence: Synthetic oligonucleotide
  Target: ATXN1; (-) strand; PAM type: YTN; PAM sequence: CTC
tcagagtgctgggattatgg

SEQ ID NO: 216649 - DNA, 20 bp, Artificial Sequence
  Description of Artificial Sequence: Synthetic oligonucleotide
  Target: ATXN1; (-) strand; PAM type: YTN; PAM sequence: TTG
gcctctcagagtgctgggat

SEQ ID NO: 216650 - DNA, 20 bp, Artificial Sequence
  Description of Artificial Sequence: Synthetic oligonucleotide
  Target: ATXN1; (-) strand; PAM type: YTN; PAM sequence: TTT
ggcctctcagagtgctggga

SEQ ID NO: 216651 - DNA, 20 bp, Artificial Sequence
  Description of Artificial Sequence: Synthetic oligonucleotide
  Target: ATXN1; (-) strand; PAM type: YTN; PAM sequence: CTT
tggcctctcagagtgctggg

SEQ ID NO: 216652 - DNA, 20 bp, Artificial Sequence
  Description of Artificial Sequence: Synthetic oligonucleotide
  Target: ATXN1; (-) strand; PAM type: YTN; PAM sequence: CTG
ctttggcctctcagagtgct

SEQ ID NO: 216653 - DNA, 20 bp, Artificial Sequence
  Description of Artificial Sequence: Synthetic oligonucleotide
  Target: ATXN1; (-) strand; PAM type: YTN; PAM sequence: CTC
ctgctttggcctctcagagt

SEQ ID NO: 216654 - DNA, 20 bp, Artificial Sequence
  Description of Artificial Sequence: Synthetic oligonucleotide
  Target: ATXN1; (-) strand; PAM type: YTN; PAM sequence: TTC
tcctgctttggcctctcaga

SEQ ID NO: 216655 - DNA, 20 bp, Artificial Sequence
  Description of Artificial Sequence: Synthetic oligonucleotide
  Target: ATXN1; (-) strand; PAM type: YTN; PAM sequence: TTC
cagcaattctcctgctttgg

SEQ ID NO: 216656 - DNA, 20 bp, Artificial Sequence
  Description of Artificial Sequence: Synthetic oligonucleotide
  Target: ATXN1; (-) strand; PAM type: YTN; PAM sequence: CTG
tgttccagcaattctcctgc

SEQ ID NO: 216657 - DNA, 20 bp, Artificial Sequence
  Description of Artificial Sequence: Synthetic oligonucleotide
  Target: ATXN1; (-) strand; PAM type: YTN; PAM sequence: CTG
gagccctgtgttccagcaat

SEQ ID NO: 216658 - DNA, 20 bp, Artificial Sequence
  Description of Artificial Sequence: Synthetic oligonucleotide
  Target: ATXN1; (-) strand; PAM type: YTN; PAM sequence: TTC
tggagccctgtgttccagca

SEQ ID NO: 216659 - DNA, 20 bp, Artificial Sequence
  Description of Artificial Sequence: Synthetic oligonucleotide
  Target: ATXN1; (-) strand; PAM type: YTN; PAM sequence: CTG
ttctggagccctgtgttcca

SEQ ID NO: 216660 - DNA, 20 bp, Artificial Sequence
  Description of Artificial Sequence: Synthetic oligonucleotide
  Target: ATXN1; (-) strand; PAM type: YTN; PAM sequence: TTA
cccaggctgttctggagccc

SEQ ID NO: 216661 - DNA, 20 bp, Artificial Sequence
  Description of Artificial Sequence: Synthetic oligonucleotide
  Target: ATXN1; (-) strand; PAM type: YTN; PAM sequence: CTA
tgttacccaggctgttctgg

SEQ ID NO: 216662 - DNA, 20 bp, Artificial Sequence
  Description of Artificial Sequence: Synthetic oligonucleotide
  Target: ATXN1; (-) strand; PAM type: YTN; PAM sequence: TTG
ctatgttacccaggctgttc

SEQ ID NO: 216663 - DNA, 20 bp, Artificial Sequence
  Description of Artificial Sequence: Synthetic oligonucleotide
  Target: ATXN1; (-) strand; PAM type: YTN; PAM sequence: CTT
gctatgttacccaggctgtt

SEQ ID NO: 216664 - DNA, 20 bp, Artificial Sequence
  Description of Artificial Sequence: Synthetic oligonucleotide
  Target: ATXN1; (-) strand; PAM type: YTN; PAM sequence: TTC
ttgctatgttacccaggctg

SEQ ID NO: 216665 - DNA, 20 bp, Artificial Sequence
  Description of Artificial Sequence: Synthetic oligonucleotide
  Target: ATXN1; (-) strand; PAM type: YTN; PAM sequence: TTG
tagagatggattcttgctat

SEQ ID NO: 216666 - DNA, 20 bp, Artificial Sequence
  Description of Artificial Sequence: Synthetic oligonucleotide
  Target: ATXN1; (-) strand; PAM type: YTN; PAM sequence: TTT
gtagagatggattcttgcta

SEQ ID NO: 216667 - DNA, 20 bp, Artificial Sequence
  Description of Artificial Sequence: Synthetic oligonucleotide
  Target: ATXN1; (-) strand; PAM type: YTN; PAM sequence: TTT
tgtagagatggattcttgct

SEQ ID NO: 216668 - DNA, 20 bp, Artificial Sequence
  Description of Artificial Sequence: Synthetic oligonucleotide
  Target: ATXN1; (-) strand; PAM type: YTN; PAM sequence: TTT
ttgtagagatggattcttgc

SEQ ID NO: 216669 - DNA, 20 bp, Artificial Sequence
  Description of Artificial Sequence: Synthetic oligonucleotide
  Target: ATXN1; (-) strand; PAM type: YTN; PAM sequence: TTT
tttgtagagatggattcttg

SEQ ID NO: 216670 - DNA, 20 bp, Artificial Sequence
  Description of Artificial Sequence: Synthetic oligonucleotide
  Target: ATXN1; (-) strand; PAM type: YTN; PAM sequence: TTT
ttttgtagagatggattctt

SEQ ID NO: 216671 - DNA, 20 bp, Artificial Sequence
  Description of Artificial Sequence: Synthetic oligonucleotide
  Target: ATXN1; (-) strand; PAM type: YTN; PAM sequence: TTT
tttttgtagagatggattct

SEQ ID NO: 216672 - DNA, 20 bp, Artificial Sequence
  Description of Artificial Sequence: Synthetic oligonucleotide
  Target: ATXN1; (-) strand; PAM type: YTN; PAM sequence: TTT
ttttttgtagagatggattc

SEQ ID NO: 216673 - DNA, 20 bp, Artificial Sequence
  Description of Artificial Sequence: Synthetic oligonucleotide
  Target: ATXN1; (-) strand; PAM type: YTN; PAM sequence: TTT
tttttttgtagagatggatt

SEQ ID NO: 216674 - DNA, 20 bp, Artificial Sequence
  Description of Artificial Sequence: Synthetic oligonucleotide
  Target: ATXN1; (-) strand; PAM type: YTN; PAM sequence: TTA
attttttttttgtagagatg

SEQ ID NO: 216675 - DNA, 20 bp, Artificial Sequence
  Description of Artificial Sequence: Synthetic oligonucleotide
  Target: ATXN1; (-) strand; PAM type: YTN; PAM sequence: TTT
aattttttttttgtagagat

SEQ ID NO: 216676 - DNA, 20 bp, Artificial Sequence
  Description of Artificial Sequence: Synthetic oligonucleotide
  Target: ATXN1; (-) strand; PAM type: YTN; PAM sequence: TTT
taattttttttttgtagaga

SEQ ID NO: 216677 - DNA, 20 bp, Artificial Sequence
  Description of Artificial Sequence: Synthetic oligonucleotide
  Target: ATXN1; (-) strand; PAM type: YTN; PAM sequence: TTT
ttaattttttttttgtagag

SEQ ID NO: 216678 - DNA, 20 bp, Artificial Sequence
  Description of Artificial Sequence: Synthetic oligonucleotide
  Target: ATXN1; (-) strand; PAM type: YTN; PAM sequence: CTC
atttttaattttttttttgt

SEQ ID NO: 216679 - DNA, 20 bp, Artificial Sequence
  Description of Artificial Sequence: Synthetic oligonucleotide
  Target: ATXN1; (-) strand; PAM type: YTN; PAM sequence: CTG
gctcatttttaatttttttt

SEQ ID NO: 216680 - DNA, 20 bp, Artificial Sequence
  Description of Artificial Sequence: Synthetic oligonucleotide
  Target: ATXN1; (-) strand; PAM type: YTN; PAM sequence: TTA
gaggcatgtgccaccacacc

SEQ ID NO: 216681 - DNA, 20 bp, Artificial Sequence
  Description of Artificial Sequence: Synthetic oligonucleotide
  Target: ATXN1; (-) strand; PAM type: YTN; PAM sequence: CTG
gaattagaggcatgtgccac

SEQ ID NO: 216682 - DNA, 20 bp, Artificial Sequence
  Description of Artificial Sequence: Synthetic oligonucleotide
  Target: ATXN1; (-) strand; PAM type: YTN; PAM sequence: CTC
tggaattagaggcatgtgcc

SEQ ID NO: 216683 - DNA, 20 bp, Artificial Sequence
  Description of Artificial Sequence: Synthetic oligonucleotide
  Target: ATXN1; (-) strand; PAM type: YTN; PAM sequence: TTC
ccagagctctggaattagag

SEQ ID NO: 216684 - DNA, 20 bp, Artificial Sequence
  Description of Artificial Sequence: Synthetic oligonucleotide
  Target: ATXN1; (-) strand; PAM type: YTN; PAM sequence: CTT
cccagagctctggaattaga

SEQ ID NO: 216685 - DNA, 20 bp, Artificial Sequence
  Description of Artificial Sequence: Synthetic oligonucleotide
  Target: ATXN1; (-) strand; PAM type: YTN; PAM sequence: CTC
ccaccccaacttcccagagc

SEQ ID NO: 216686 - DNA, 20 bp, Artificial Sequence
  Description of Artificial Sequence: Synthetic oligonucleotide
  Target: ATXN1; (-) strand; PAM type: YTN; PAM sequence: CTG
agcccaggtgatcctcccac

SEQ ID NO: 216687 - DNA, 20 bp, Artificial Sequence
  Description of Artificial Sequence: Synthetic oligonucleotide
  Target: ATXN1; (-) strand; PAM type: YTN; PAM sequence: CTC
ctgagcccaggtgatcctcc

SEQ ID NO: 216688 - DNA, 20 bp, Artificial Sequence
  Description of Artificial Sequence: Synthetic oligonucleotide
  Target: ATXN1; (-) strand; PAM type: YTN; PAM sequence: TTG
acctcctgagcccaggtgat

SEQ ID NO: 216689 - DNA, 20 bp, Artificial Sequence
  Description of Artificial Sequence: Synthetic oligonucleotide
  Target: ATXN1; (-) strand; PAM type: YTN; PAM sequence: CTT
gacctcctgagcccaggtga

SEQ ID NO: 216690 - DNA, 20 bp, Artificial Sequence
  Description of Artificial Sequence: Synthetic oligonucleotide
  Target: ATXN1; (-) strand; PAM type: YTN; PAM sequence: CTG
catccttgacctcctgagcc

SEQ ID NO: 216691 - DNA, 20 bp, Artificial Sequence
  Description of Artificial Sequence: Synthetic oligonucleotide
  Target: ATXN1; (-) strand; PAM type: YTN; PAM sequence: CTC
actgcatccttgacctcctg

SEQ ID NO: 216692 - DNA, 20 bp, Artificial Sequence
  Description of Artificial Sequence: Synthetic oligonucleotide
  Target: ATXN1; (-) strand; PAM type: YTN; PAM sequence: CTG
agtacagtggtatcatcata

SEQ ID NO: 216693 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctgagtacagt

SEQ ID NO: 216694 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctgagtaca

SEQ ID NO: 216695 - DNA, 20 bp, Artificial Sequence
  Description of Artificial Sequence: Synthetic oligonucleotide
  Target: ATXN1; (-) strand; PAM type: YTN; PAM sequence: TTG
ctctgtcacccaggctgagt

SEQ ID NO: 216696 - DNA, 20 bp, Artificial Sequence
  Description of Artificial Sequence: Synthetic oligonucleotide
  Target: ATXN1; (-) strand; PAM type: YTN; PAM sequence: CTT
gctctgtcacccaggctgag

SEQ ID NO: 216697 - DNA, 20 bp, Artificial Sequence
  Description of Artificial Sequence: Synthetic oligonucleotide
  Target: ATXN1; (-) strand; PAM type: YTN; PAM sequence: TTA
agagacagagtcttgctctg

SEQ ID NO: 216698 - DNA, 20 bp, Artificial Sequence
  Description of Artificial Sequence: Synthetic oligonucleotide
  Target: ATXN1; (-) strand; PAM type: YTN; PAM sequence: TTT
aagagacagagtcttgctct

SEQ ID NO: 216699 - DNA, 20 bp, Artificial Sequence
  Description of Artificial Sequence: Synthetic oligonucleotide
  Target: ATXN1; (-) strand; PAM type: YTN; PAM sequence: TTG
tttaagagacagagtcttgc

SEQ ID NO: 216700 - DNA, 20 bp, Artificial Sequence
  Description of Artificial Sequence: Synthetic oligonucleotide
  Target: ATXN1; (-) strand; PAM type: YTN; PAM sequence: TTT
gtttaagagacagagtcttg

SEQ ID NO: 216701 - DNA, 20 bp, Artificial Sequence
  Description of Artificial Sequence: Synthetic oligonucleotide
  Target: ATXN1; (-) strand; PAM type: YTN; PAM sequence: TTT
tgtttaagagacagagtctt

SEQ ID NO: 216702 - DNA, 20 bp, Artificial Sequence
  Description of Artificial Sequence: Synthetic oligonucleotide
  Target: ATXN1; (-) strand; PAM type: YTN; PAM sequence: TTG
ttttgtttaagagacagagt

SEQ ID NO: 216703 - DNA, 20 bp, Artificial Sequence
  Description of Artificial Sequence: Synthetic oligonucleotide
  Target: ATXN1; (-) strand; PAM type: YTN; PAM sequence: TTT
gttttgtttaagagacagag

SEQ ID NO: 216704 - DNA, 20 bp, Artificial Sequence
  Description of Artificial Sequence: Synthetic oligonucleotide
  Target: ATXN1; (-) strand; PAM type: YTN; PAM sequence: TTT
tgttttgtttaagagacaga

SEQ ID NO: 216705 - DNA, 20 bp, Artificial Sequence
  Description of Artificial Sequence: Synthetic oligonucleotide
  Target: ATXN1; (-) strand; PAM type: YTN; PAM sequence: CTT
ttgttttgtttaagagacag

SEQ ID NO: 216706 - DNA, 20 bp, Artificial Sequence
  Description of Artificial Sequence: Synthetic oligonucleotide
  Target: ATXN1; (-) strand; PAM type: YTN; PAM sequence: CTG
gagtggtagacacgtctttt

SEQ ID NO: 216707 - DNA, 20 bp, Artificial Sequence
  Description of Artificial Sequence: Synthetic oligonucleotide
  Target: ATXN1; (-) strand; PAM type: YTN; PAM sequence: TTC
cctggagtggtagacacgtc

SEQ ID NO: 216708 - DNA, 20 bp, Artificial Sequence
  Description of Artificial Sequence: Synthetic oligonucleotide
  Target: ATXN1; (-) strand; PAM type: YTN; PAM sequence: CTT
ccctggagtggtagacacgt

SEQ ID NO: 216709 - DNA, 20 bp, Artificial Sequence
  Description of Artificial Sequence: Synthetic oligonucleotide
  Target: ATXN1; (-) strand; PAM type: YTN; PAM sequence: TTC
acttccctggagtggtagac

SEQ ID NO: 216710 - DNA, 20 bp, Artificial Sequence
  Description of Artificial Sequence: Synthetic oligonucleotide
  Target: ATXN1; (-) strand; PAM type: YTN; PAM sequence: TTT
cacttccctggagtggtaga

SEQ ID NO: 216711 - DNA, 20 bp, Artificial Sequence
  Description of Artificial Sequence: Synthetic oligonucleotide
  Target: ATXN1; (-) strand; PAM type: YTN; PAM sequence: TTT
tcacttccctggagtggtag

SEQ ID NO: 216712 - DNA, 20 bp, Artificial Sequence
  Description of Artificial Sequence: Synthetic oligonucleotide
  Target: ATXN1; (-) strand; PAM type: YTN; PAM sequence: TTT
ttcacttccctggagtggta

SEQ ID NO: 216713 - DNA, 20 bp, Artificial Sequence
  Description of Artificial Sequence: Synthetic oligonucleotide
  Target: ATXN1; (-) strand; PAM type: YTN; PAM sequence: CTT
tttcacttccctggagtggt

SEQ ID NO: 216714 - DNA, 20 bp, Artificial Sequence
  Description of Artificial Sequence: Synthetic oligonucleotide
  Target: ATXN1; (-) strand; PAM type: YTN; PAM sequence: CTG
ctttttcacttccctggagt

SEQ ID NO: 216715 - DNA, 20 bp, Artificial Sequence
  Description of Artificial Sequence: Synthetic oligonucleotide
  Target: ATXN1; (-) strand; PAM type: YTN; PAM sequence: TTA
tctgctttttcacttccctg

SEQ ID NO: 216716 - DNA, 20 bp, Artificial Sequence
  Description of Artificial Sequence: Synthetic oligonucleotide
  Target: ATXN1; (-) strand; PAM type: YTN; PAM sequence: CTT
atctgctttttcacttccct

SEQ ID NO: 216717 - DNA, 20 bp, Artificial Sequence
  Description of Artificial Sequence: Synthetic oligonucleotide
  Target: ATXN1; (-) strand; PAM type: YTN; PAM sequence: TTA
cttatctgctttttcacttc

SEQ ID NO: 216718 - DNA, 20 bp, Artificial Sequence
  Description of Artificial Sequence: Synthetic oligonucleotide
  Target: ATXN1; (-) strand; PAM type: YTN; PAM sequence: TTT
acttatctgctttttcactt

SEQ ID NO: 216719 - DNA, 20 bp, Artificial Sequence
  Description of Artificial Sequence: Synthetic oligonucleotide
  Target: ATXN1; (-) strand; PAM type: YTN; PAM sequence: TTA
gcaggaatttacttatctgc

SEQ ID NO: 216720 - DNA, 20 bp, Artificial Sequence
  Description of Artificial Sequence: Synthetic oligonucleotide
  Target: ATXN1; (-) strand; PAM type: YTN; PAM sequence: CTT
agcaggaatttacttatctg

SEQ ID NO: 216721 - DNA, 20 bp, Artificial Sequence
  Description of Artificial Sequence: Synthetic oligonucleotide
  Target: ATXN1; (-) strand; PAM type: YTN; PAM sequence: CTC
ttagcaggaatttacttatc

SEQ ID NO: 216722 - DNA, 20 bp, Artificial Sequence
  Description of Artificial Sequence: Synthetic oligonucleotide
  Target: ATXN1; (-) strand; PAM type: YTN; PAM sequence: TTG
aataggagagggtcatgatc

SEQ ID NO: 216723 - DNA, 20 bp, Artificial Sequence
  Description of Artificial Sequence: Synthetic oligonucleotide
  Target: ATXN1; (-) strand; PAM type: YTN; PAM sequence: TTG
ttgaataggagagggtcatg

SEQ ID NO: 216724 - DNA, 20 bp, Artificial Sequence
  Description of Artificial Sequence: Synthetic oligonucleotide
  Target: ATXN1; (-) strand; PAM type: YTN; PAM sequence: CTG
aaggttgttgaataggagag

SEQ ID NO: 216725 - DNA, 20 bp, Artificial Sequence
  Description of Artificial Sequence: Synthetic oligonucleotide
  Target: ATXN1; (-) strand; PAM type: YTN; PAM sequence: TTA
agtggcggagagccactgaa

SEQ ID NO: 216726 - DNA, 20 bp, Artificial Sequence
  Description of Artificial Sequence: Synthetic oligonucleotide
  Target: ATXN1; (-) strand; PAM type: YTN; PAM sequence: CTT
aagtggcggagagccactga

SEQ ID NO: 216727 - DNA, 20 bp, Artificial Sequence
  Description of Artificial Sequence: Synthetic oligonucleotide
  Target: ATXN1; (-) strand; PAM type: YTN; PAM sequence: TTC
ttaagtggcggagagccact

SEQ ID NO: 216728 - DNA, 20 bp, Artificial Sequence
  Description of Artificial Sequence: Synthetic oligonucleotide
  Target: ATXN1; (-) strand; PAM type: YTN; PAM sequence: TTT
cttaagtggcggagagccac

SEQ ID NO: 216729 - DNA, 20 bp, Artificial Sequence
  Description of Artificial Sequence: Synthetic oligonucleotide
  Target: ATXN1; (-) strand; PAM type: YTN; PAM sequence: TTT
tcttaagtggcggagagcca

SEQ ID NO: 216730 - DNA, 20 bp, Artificial Sequence
  Description of Artificial Sequence: Synthetic oligonucleotide
  Target: ATXN1; (-) strand; PAM type: YTN; PAM sequence: TTT
ttcttaagtggcggagagcc

SEQ ID NO: 216731 - DNA, 20 bp, Artificial Sequence
  Description of Artificial Sequence: Synthetic oligonucleotide
  Target: ATXN1; (-) strand; PAM type: YTN; PAM sequence: TTT
tttcttaagtggcggagagc

SEQ ID NO: 216732 - DNA, 20 bp, Artificial Sequence
  Description of Artificial Sequence: Synthetic oligonucleotide
  Target: ATXN1; (-) strand; PAM type: YTN; PAM sequence: TTC
cattttttcttaagtggcgg

SEQ ID NO: 216733 - DNA, 20 bp, Artificial Sequence
  Description of Artificial Sequence: Synthetic oligonucleotide
  Target: ATXN1; (-) strand; PAM type: YTN; PAM sequence: TTA
attccattttttcttaagtg

SEQ ID NO: 216734 - DNA, 20 bp, Artificial Sequence
  Description of Artificial Sequence: Synthetic oligonucleotide
  Target: ATXN1; (-) strand; PAM type: YTN; PAM sequence: TTA
cagatgagaaaatgggatta

SEQ ID NO: 216735 - DNA, 20 bp, Artificial Sequence
  Description of Artificial Sequence: Synthetic oligonucleotide
  Target: ATXN1; (-) strand; PAM type: YTN; PAM sequence: TTT
acagatgagaaaatgggatt

SEQ ID NO: 216736 - DNA, 20 bp, Artificial Sequence
  Description of Artificial Sequence: Synthetic oligonucleotide
  Target: ATXN1; (-) strand; PAM type: YTN; PAM sequence: TTT
tacagatgagaaaatgggat

SEQ ID NO: 216737 - DNA, 20 bp, Artificial Sequence
  Description of Artificial Sequence: Synthetic oligonucleotide
  Target: ATXN1; (-) strand; PAM type: YTN; PAM sequence: CTA
tccacattttacagatgaga

SEQ ID NO: 216738 - DNA, 20 bp, Artificial Sequence
  Description of Artificial Sequence: Synthetic oligonucleotide
  Target: ATXN1; (-) strand; PAM type: YTN; PAM sequence: TTC
aacatagctatccacatttt

SEQ ID NO: 216739 - DNA, 20 bp, Artificial Sequence
  Description of Artificial Sequence: Synthetic oligonucleotide
  Target: ATXN1; (-) strand; PAM type: YTN; PAM sequence: CTT
caacatagctatccacattt

SEQ ID NO: 216740 - DNA, 20 bp, Artificial Sequence
  Description of Artificial Sequence: Synthetic oligonucleotide
  Target: ATXN1; (-) strand; PAM type: YTN; PAM sequence: CTC
ccttcaacatagctatccac

SEQ ID NO: 216741 - DNA, 20 bp, Artificial Sequence
  Description of Artificial Sequence: Synthetic oligonucleotide
  Target: ATXN1; (-) strand; PAM type: YTN; PAM sequence: TTA
caactcccttcaacatagct

SEQ ID NO: 216742 - DNA, 20 bp, Artificial Sequence
  Description of Artificial Sequence: Synthetic oligonucleotide
  Target: ATXN1; (-) strand; PAM type: YTN; PAM sequence: CTG
attacaactcccttcaacat

SEQ ID NO: 216743 - DNA, 20 bp, Artificial Sequence
  Description of Artificial Sequence: Synthetic oligonucleotide
  Target: ATXN1; (-) strand; PAM type: YTN; PAM sequence: CTC
tgattacaactcccttcaac

SEQ ID NO: 216744 - DNA, 20 bp, Artificial Sequence
  Description of Artificial Sequence: Synthetic oligonucleotide
  Target: ATXN1; (-) strand; PAM type: YTN; PAM sequence: TTA
gctctgattacaactccctt

SEQ ID NO: 216745 - DNA, 20 bp, Artificial Sequence
  Description of Artificial Sequence: Synthetic oligonucleotide
  Target: ATXN1; (-) strand; PAM type: YTN; PAM sequence: TTA
cataaattagctctgattac

SEQ ID NO: 216746 - DNA, 20 bp, Artificial Sequence
  Description of Artificial Sequence: Synthetic oligonucleotide
  Target: ATXN1; (-) strand; PAM type: YTN; PAM sequence: TTT
acataaattagctctgatta

SEQ ID NO: 216747 - DNA, 20 bp, Artificial Sequence
  Description of Artificial Sequence: Synthetic oligonucleotide
  Target: ATXN1; (-) strand; PAM type: YTN; PAM sequence: CTT
tacataaattagctctgatt

SEQ ID NO: 216748 - DNA, 20 bp, Artificial Sequence
  Description of Artificial Sequence: Synthetic oligonucleotide
  Target: ATXN1; (-) strand; PAM type: YTN; PAM sequence: TTG
gggctttacataaattagct

SEQ ID NO: 216749 - DNA, 20 bp, Artificial Sequence
  Description of Artificial Sequence: Synthetic oligonucleotide
  Target: ATXN1; (-) strand; PAM type: YTN; PAM sequence: CTG
tggttggggctttacataaa

SEQ ID NO: 216750 - DNA, 20 bp, Artificial Sequence
  Description of Artificial Sequence: Synthetic oligonucleotide
  Target: ATXN1; (-) strand; PAM type: YTN; PAM sequence: TTC
tgtggttggggctttacata

SEQ ID NO: 216751 - DNA, 20 bp, Artificial Sequence
  Description of Artificial Sequence: Synthetic oligonucleotide
  Target: ATXN1; (-) strand; PAM type: YTN; PAM sequence: CTG
agtggtgccatatatcagat

SEQ ID NO: 216752 - DNA, 20 bp, Artificial Sequence
  Description of Artificial Sequence: Synthetic oligonucleotide
  Target: ATXN1; (-) strand; PAM type: YTN; PAM sequence: TTC
actgagtggtgccatatatc

SEQ ID NO: 216753 - DNA, 20 bp, Artificial Sequence
  Description of Artificial Sequence: Synthetic oligonucleotide
  Target: ATXN1; (-) strand; PAM type: YTN; PAM sequence: CTA
ttcactgagtggtgccatat

SEQ ID NO: 216754 - DNA, 20 bp, Artificial Sequence
  Description of Artificial Sequence: Synthetic oligonucleotide
  Target: ATXN1; (-) strand; PAM type: YTN; PAM sequence: TTA
atgataatgatgataacggt

SEQ ID NO: 216755 - DNA, 20 bp, Artificial Sequence
  Description of Artificial Sequence: Synthetic oligonucleotide
  Target: ATXN1; (-) strand; PAM type: YTN; PAM sequence: TTT
aatgataatgatgataacgg

SEQ ID NO: 216756 - DNA, 20 bp, Artificial Sequence
  Description of Artificial Sequence: Synthetic oligonucleotide
  Target: ATXN1; (-) strand; PAM type: YTN; PAM sequence: CTG
atttaatgataatgatgata

SEQ ID NO: 216757 - DNA, 20 bp, Artificial Sequence
  Description of Artificial Sequence: Synthetic oligonucleotide
  Target: ATXN1; (-) strand; PAM type: YTN; PAM sequence: CTG
ggaggaagatagtctgattt

SEQ ID NO: 216758 - DNA, 20 bp, Artificial Sequence
  Description of Artificial Sequence: Synthetic oligonucleotide
  Target: ATXN1; (-) strand; PAM type: YTN; PAM sequence: TTA
aggtgtgtgaggtggaacag

SEQ ID NO: 216759 - DNA, 20 bp, Artificial Sequence
  Description of Artificial Sequence: Synthetic oligonucleotide
  Target: ATXN1; (-) strand; PAM type: YTN; PAM sequence: TTG
agcccagggttaaggtgtgt

SEQ ID NO: 216760 - DNA, 20 bp, Artificial Sequence
  Description of Artificial Sequence: Synthetic oligonucleotide
  Target: ATXN1; (-) strand; PAM type: YTN; PAM sequence: TTT
gagcccagggttaaggtgtg

SEQ ID NO: 216761 - DNA, 20 bp, Artificial Sequence
  Description of Artificial Sequence: Synthetic oligonucleotide
  Target: ATXN1; (-) strand; PAM type: YTN; PAM sequence: CTG
tggaccagtttgagcccagg

SEQ ID NO: 216762 - DNA, 20 bp, Artificial Sequence
  Description of Artificial Sequence: Synthetic oligonucleotide
  Target: ATXN1; (-) strand; PAM type: YTN; PAM sequence: TTG
aggaaagctgtggaccagtt

SEQ ID NO: 216763 - DNA, 20 bp, Artificial Sequence
  Description of Artificial Sequence: Synthetic oligonucleotide
  Target: ATXN1; (-) strand; PAM type: YTN; PAM sequence: TTT
gaggaaagctgtggaccagt

SEQ ID NO: 216764 - DNA, 20 bp, Artificial Sequence
  Description of Artificial Sequence: Synthetic oligonucleotide
  Target: ATXN1; (-) strand; PAM type: YTN; PAM sequence: TTC
cacacgggagggcgtgtgcc

SEQ ID NO: 216765 - DNA, 20 bp, Artificial Sequence
  Description of Artificial Sequence: Synthetic oligonucleotide
  Target: ATXN1; (-) strand; PAM type: YTN; PAM sequence: CTG
ggagcaaggcattccacacg

SEQ ID NO: 216766 - DNA, 20 bp, Artificial Sequence
  Description of Artificial Sequence: Synthetic oligonucleotide
  Target: ATXN1; (-) strand; PAM type: YTN; PAM sequence: CTG
acagagctgggagcaaggca

SEQ ID NO: 216767 - DNA, 20 bp, Artificial Sequence
  Description of Artificial Sequence: Synthetic oligonucleotide
  Target: ATXN1; (-) strand; PAM type: YTN; PAM sequence: TTC
cacctgacagagctgggagc

SEQ ID NO: 216768 - DNA, 20 bp, Artificial Sequence
  Description of Artificial Sequence: Synthetic oligonucleotide
  Target: ATXN1; (-) strand; PAM type: YTN; PAM sequence: CTA
ggattccacctgacagagct

SEQ ID NO: 216769 - DNA, 20 bp, Artificial Sequence
  Description of Artificial Sequence: Synthetic oligonucleotide
  Target: ATXN1; (-) strand; PAM type: YTN; PAM sequence: TTG
gaagaatggctaggattcca

SEQ ID NO: 216770 - DNA, 20 bp, Artificial Sequence
  Description of Artificial Sequence: Synthetic oligonucleotide
  Target: ATXN1; (-) strand; PAM type: YTN; PAM sequence: CTT
ggaagaatggctaggattcc

SEQ ID NO: 216771 - DNA, 20 bp, Artificial Sequence
  Description of Artificial Sequence: Synthetic oligonucleotide
  Target: ATXN1; (-) strand; PAM type: YTN; PAM sequence: CTG
acttggaagaatggctagga

SEQ ID NO: 216772 - DNA, 20 bp, Artificial Sequence
  Description of Artificial Sequence: Synthetic oligonucleotide
  Target: ATXN1; (-) strand; PAM type: YTN; PAM sequence: TTG
gaggaagcatcagagctgac

SEQ ID NO: 216773 - DNA, 20 bp, Artificial Sequence
  Description of Artificial Sequence: Synthetic oligonucleotide
  Target: ATXN1; (-) strand; PAM type: YTN; PAM sequence: CTT
ggaggaagcatcagagctga

SEQ ID NO: 216774 - DNA, 20 bp, Artificial Sequence
  Description of Artificial Sequence: Synthetic oligonucleotide
  Target: ATXN1; (-) strand; PAM type: YTN; PAM sequence: TTG
ggagtggtgaggacttggag

SEQ ID NO: 216775 - DNA, 20 bp, Artificial Sequence
  Description of Artificial Sequence: Synthetic oligonucleotide
  Target: ATXN1; (-) strand; PAM type: YTN; PAM sequence: TTT
gggagtggtgaggacttgga

SEQ ID NO: 216776 - DNA, 20 bp, Artificial Sequence
  Description of Artificial Sequence: Synthetic oligonucleotide
  Target: ATXN1; (-) strand; PAM type: YTN; PAM sequence: CTG
atttgggagtggtgaggact

SEQ ID NO: 216777 - DNA, 20 bp, Artificial Sequence
  Description of Artificial Sequence: Synthetic oligonucleotide
  Target: ATXN1; (-) strand; PAM type: YTN; PAM sequence: TTA
gtctgatttgggagtggtga

SEQ ID NO: 216778 - DNA, 20 bp, Artificial Sequence
  Description of Artificial Sequence: Synthetic oligonucleotide
  Target: ATXN1; (-) strand; PAM type: YTN; PAM sequence: TTT
agtctgatttgggagtggtg

SEQ ID NO: 216779 - DNA, 20 bp, Artificial Sequence
  Description of Artificial Sequence: Synthetic oligonucleotide
  Target: ATXN1; (-) strand; PAM type: YTN; PAM sequence: CTG
tgggaacacaaaggagtggg

SEQ ID NO: 216780 - DNA, 20 bp, Artificial Sequence
  Description of Artificial Sequence: Synthetic oligonucleotide
  Target: ATXN1; (-) strand; PAM type: YTN; PAM sequence: CTA
gggaaggcgaagcaatgctg

SEQ ID NO: 216781 - DNA, 20 bp, Artificial Sequence
  Description of Artificial Sequence: Synthetic oligonucleotide
  Target: ATXN1; (-) strand; PAM type: YTN; PAM sequence: TTA
ggggaaacatgtaggtgaac

SEQ ID NO: 216782 - DNA, 20 bp, Artificial Sequence
  Description of Artificial Sequence: Synthetic oligonucleotide
  Target: ATXN1; (-) strand; PAM type: YTN; PAM sequence: CTG
ttaggggaaacatgtaggtg

SEQ ID NO: 216783 - DNA, 20 bp, Artificial Sequence
  Description of Artificial Sequence: Synthetic oligonucleotide
  Target: ATXN1; (-) strand; PAM type: YTN; PAM sequence: TTA
cactgttaggggaaacatgt

SEQ ID NO: 216784 - DNA, 20 bp, Artificial Sequence
  Description of Artificial Sequence: Synthetic oligonucleotide
  Target: ATXN1; (-) strand; PAM type: YTN; PAM sequence: TTT
acactgttaggggaaacatg

SEQ ID NO: 216785 - DNA, 20 bp, Artificial Sequence
  Description of Artificial Sequence: Synthetic oligonucleotide
  Target: ATXN1; (-) strand; PAM type: YTN; PAM sequence: TTA
ggaatttacactgttagggg

SEQ ID NO: 216786 - DNA, 20 bp, Artificial Sequence
  Description of Artificial Sequence: Synthetic oligonucleotide
  Target: ATXN1; (-) strand; PAM type: YTN; PAM sequence: TTT
aggaatttacactgttaggg

SEQ ID NO: 216787 - DNA, 20 bp, Artificial Sequence
  Description of Artificial Sequence: Synthetic oligonucleotide
  Target: ATXN1; (-) strand; PAM type: YTN; PAM sequence: TTG
gtttaggaatttacactgtt

SEQ ID NO: 216788 - DNA, 20 bp, Artificial Sequence
  Description of Artificial Sequence: Synthetic oligonucleotide
  Target: ATXN1; (-) strand; PAM type: YTN; PAM sequence: CTT
ggtttaggaatttacactgt

SEQ ID NO: 216789 - DNA, 20 bp, Artificial Sequence
  Description of Artificial Sequence: Synthetic oligonucleotide
  Target: ATXN1; (-) strand; PAM type: YTN; PAM sequence: CTA
caaacttggtttaggaattt

SEQ ID NO: 216790 - DNA, 20 bp, Artificial Sequence
  Description of Artificial Sequence: Synthetic oligonucleotide
  Target: ATXN1; (-) strand; PAM type: YTN; PAM sequence: TTC
ctacaaacttggtttaggaa

SEQ ID NO: 216791 - DNA, 20 bp, Artificial Sequence
  Description of Artificial Sequence: Synthetic oligonucleotide
  Target: ATXN1; (-) strand; PAM type: YTN; PAM sequence: CTT
cctacaaacttggtttagga

SEQ ID NO: 216792 - DNA, 20 bp, Artificial Sequence
  Description of Artificial Sequence: Synthetic oligonucleotide
  Target: ATXN1; (-) strand; PAM type: YTN; PAM sequence: TTC
atgccttcctacaaacttgg

SEQ ID NO: 216793 - DNA, 20 bp, Artificial Sequence
  Description of Artificial Sequence: Synthetic oligonucleotide
  Target: ATXN1; (-) strand; PAM type: YTN; PAM sequence: CTT
catgccttcctacaaacttg

SEQ ID NO: 216794 - DNA, 20 bp, Artificial Sequence
  Description of Artificial Sequence: Synthetic oligonucleotide
  Target: ATXN1; (-) strand; PAM type: YTN; PAM sequence: TTC
ttcatgccttcctacaaact

SEQ ID NO: 216795 - DNA, 20 bp, Artificial Sequence
  Description of Artificial Sequence: Synthetic oligonucleotide
  Target: ATXN1; (-) strand; PAM type: YTN; PAM sequence: TTA
ttcttcatgccttcctacaa

SEQ ID NO: 216796 - DNA, 20 bp, Artificial Sequence
  Description of Artificial Sequence: Synthetic oligonucleotide
  Target: ATXN1; (-) strand; PAM type: YTN; PAM sequence: TTT
attcttcatgccttcctaca

SEQ ID NO: 216797 - DNA, 20 bp, Artificial Sequence
  Description of Artificial Sequence: Synthetic oligonucleotide
  Target: ATXN1; (-) strand; PAM type: YTN; PAM sequence: TTC
cagtgtttattcttcatgcc

SEQ ID NO: 216798 - DNA, 20 bp, Artificial Sequence
  Description of Artificial Sequence: Synthetic oligonucleotide
  Target: ATXN1; (-) strand; PAM type: YTN; PAM sequence: TTT
ccagtgtttattcttcatgc

SEQ ID NO: 216799 - DNA, 20 bp, Artificial Sequence
  Description of Artificial Sequence: Synthetic oligonucleotide
  Target: ATXN1; (-) strand; PAM type: YTN; PAM sequence: TTT
tccagtgtttattcttcatg

SEQ ID NO: 216800 - DNA, 20 bp, Artificial Sequence
  Description of Artificial Sequence: Synthetic oligonucleotide
  Target: ATXN1; (-) strand; PAM type: YTN; PAM sequence: TTT
ttccagtgtttattcttcat

SEQ ID NO: 216801 - DNA, 20 bp, Artificial Sequence
  Description of Artificial Sequence: Synthetic oligonucleotide
  Target: ATXN1; (-) strand; PAM type: YTN; PAM sequence: TTG
tggtaaaatttttccagtgt

SEQ ID NO: 216802 - DNA, 20 bp, Artificial Sequence
  Description of Artificial Sequence: Synthetic oligonucleotide
  Target: ATXN1; (-) strand; PAM type: YTN; PAM sequence: TTT
gtggtaaaatttttccagtg

SEQ ID NO: 216803 - DNA, 20 bp, Artificial Sequence
  Description of Artificial Sequence: Synthetic oligonucleotide
  Target: ATXN1; (-) strand; PAM type: YTN; PAM sequence: CTC
agtttgtggtaaaatttttc

SEQ ID NO: 216804 - DNA, 20 bp, Artificial Sequence
  Description of Artificial Sequence: Synthetic oligonucleotide
  Target: ATXN1; (-) strand; PAM type: YTN; PAM sequence: TTA
ctcagtttgtggtaaaattt

SEQ ID NO: 216805 - DNA, 20 bp, Artificial Sequence
  Description of Artificial Sequence: Synthetic oligonucleotide
  Target: ATXN1; (-) strand; PAM type: YTN; PAM sequence: TTA
gttactcagtttgtggtaaa

SEQ ID NO: 216806 - DNA, 20 bp, Artificial Sequence
  Description of Artificial Sequence: Synthetic oligonucleotide
  Target: ATXN1; (-) strand; PAM type: YTN; PAM sequence: TTC
gttagttactcagtttgtgg

SEQ ID NO: 216807 - DNA, 20 bp, Artificial Sequence
  Description of Artificial Sequence: Synthetic oligonucleotide
  Target: ATXN1; (-) strand; PAM type: YTN; PAM sequence: TTT
cgttagttactcagtttgtg

SEQ ID NO: 216808 - DNA, 20 bp, Artificial Sequence
  Description of Artificial Sequence: Synthetic oligonucleotide
  Target: ATXN1; (-) strand; PAM type: YTN; PAM sequence: TTC
atggaatttcgttagttact

SEQ ID NO: 216809 - DNA, 20 bp, Artificial Sequence
  Description of Artificial Sequence: Synthetic oligonucleotide
  Target: ATXN1; (-) strand; PAM type: YTN; PAM sequence: TTT
catggaatttcgttagttac

SEQ ID NO: 216810 - DNA, 20 bp, Artificial Sequence
  Description of Artificial Sequence: Synthetic oligonucleotide
  Target: ATXN1; (-) strand; PAM type: YTN; PAM sequence: CTT
tcatggaatttcgttagtta

SEQ ID NO: 216811 - DNA, 20 bp, Artificial Sequence
  Description of Artificial Sequence: Synthetic oligonucleotide
  Target: ATXN1; (-) strand; PAM type: YTN; PAM sequence: TTA
tcataccactttcatggaat

SEQ ID NO: 216812 - DNA, 20 bp, Artificial Sequence
  Description of Artificial Sequence: Synthetic oligonucleotide
  Target: ATXN1; (-) strand; PAM type: YTN; PAM sequence: TTA
ttatcataccactttcatgg

SEQ ID NO: 216813 - DNA, 20 bp, Artificial Sequence
  Description of Artificial Sequence: Synthetic oligonucleotide
  Target: ATXN1; (-) strand; PAM type: YTN; PAM sequence: CTG
ttattatcataccactttca

SEQ ID NO: 216814 - DNA, 20 bp, Artificial Sequence
  Description of Artificial Sequence: Synthetic oligonucleotide
  Target: ATXN1; (-) strand; PAM type: YTN; PAM sequence: TTC
aaaaaatggtagctgttatt

SEQ ID NO: 216815 - DNA, 20 bp, Artificial Sequence
  Description of Artificial Sequence: Synthetic oligonucleotide
  Target: ATXN1; (-) strand; PAM type: YTN; PAM sequence: TTT
caaaaaatggtagctgttat

SEQ ID NO: 216816 - DNA, 20 bp, Artificial Sequence
  Description of Artificial Sequence: Synthetic oligonucleotide
  Target: ATXN1; (-) strand; PAM type: YTN; PAM sequence: CTT
tcaaaaaatggtagctgtta

SEQ ID NO: 216817 - DNA, 20 bp, Artificial Sequence
  Description of Artificial Sequence: Synthetic oligonucleotide
  Target: ATXN1; (-) strand; PAM type: YTN; PAM sequence: TTG
atgcacgtaaagctttcaaa

SEQ ID NO: 216818 - DNA, 20 bp, Artificial Sequence
  Description of Artificial Sequence: Synthetic oligonucleotide
  Target: ATXN1; (-) strand; PAM type: YTN; PAM sequence: CTT
gatgcacgtaaagctttcaa

SEQ ID NO: 216819 - DNA, 20 bp, Artificial Sequence
  Description of Artificial Sequence: Synthetic oligonucleotide
  Target: ATXN1; (-) strand; PAM type: YTN; PAM sequence: CTA
aatgagtcttgatgcacgta

SEQ ID NO: 216820 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaacaaaacaaacaa

SEQ ID NO: 216821 - DNA, 20 bp, Artificial Sequence
  Description of Artificial Sequence: Synthetic oligonucleotide
  Target: ATXN1; (-) strand; PAM type: YTN; PAM sequence: TTC
tcaaaaaaaacaaaacaaac

SEQ ID NO: 216822 - DNA, 20 bp, Artificial Sequence
  Description of Artificial Sequence: Synthetic oligonucleotide
  Target: ATXN1; (-) strand; PAM type: YTN; PAM sequence: CTT
ctcaaaaaaaacaaaacaaa

SEQ ID NO: 216823 - DNA, 20 bp, Artificial Sequence
  Description of Artificial Sequence: Synthetic oligonucleotide
  Target: ATXN1; (-) strand; PAM type: YTN; PAM sequence: TTC
ttctcaaaaaaaacaaaaca

SEQ ID NO: 216824 - DNA, 20 bp, Artificial Sequence
  Description of Artificial Sequence: Synthetic oligonucleotide
  Target: ATXN1; (-) strand; PAM type: YTN; PAM sequence: CTT
cttctcaaaaaaaacaaaac

SEQ ID NO: 216825 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagcgagacttct

SEQ ID NO: 216826 - DNA, 20 bp, Artificial Sequence
  Description of Artificial Sequence: Synthetic oligonucleotide
  Target: ATXN1; (-) strand; PAM type: YTN; PAM sequence: TTC
cagcctgggtgacagagcga

SEQ ID NO: 216827 - DNA, 20 bp, Artificial Sequence
  Description of Artificial Sequence: Synthetic oligonucleotide
  Target: ATXN1; (-) strand; PAM type: YTN; PAM sequence: CTG
cattccagcctgggtgacag

SEQ ID NO: 216828 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatggtgcc

SEQ ID NO: 216829 - DNA, 20 bp, Artificial Sequence
  Description of Artificial Sequence: Synthetic oligonucleotide
  Target: ATXN1; (-) strand; PAM type: YTN; PAM sequence: CTG
ggaggtggaggttgcagtga

SEQ ID NO: 216830 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggtggaggttg

SEQ ID NO: 216831 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggtggaggtt

SEQ ID NO: 216832 - DNA, 20 bp, Artificial Sequence
  Description of Artificial Sequence: Synthetic oligonucleotide
  Target: ATXN1; (-) strand; PAM type: YTN; PAM sequence: TTG
cttgaacctgggaggtggag

SEQ ID NO: 216833 - DNA, 20 bp, Artificial Sequence
  Description of Artificial Sequence: Synthetic oligonucleotide
  Target: ATXN1; (-) strand; PAM type: YTN; PAM sequence: CTG
agacaggagaattgcttgaa

SEQ ID NO: 216834 - DNA, 20 bp, Artificial Sequence
  Description of Artificial Sequence: Synthetic oligonucleotide
  Target: ATXN1; (-) strand; PAM type: YTN; PAM sequence: TTG
ggcgtctgagacaggagaat

SEQ ID NO: 216835 - DNA, 20 bp, Artificial Sequence
  Description of Artificial Sequence: Synthetic oligonucleotide
  Target: ATXN1; (-) strand; PAM type: YTN; PAM sequence: CTT
gggcgtctgagacaggagaa

SEQ ID NO: 216836 - DNA, 20 bp, Artificial Sequence
  Description of Artificial Sequence: Synthetic oligonucleotide
  Target: ATXN1; (-) strand; PAM type: YTN; PAM sequence: CTA
cttgggcgtctgagacagga

SEQ ID NO: 216837 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacttgggcg

SEQ ID NO: 216838 - DNA, 20 bp, Artificial Sequence
  Description of Artificial Sequence: Synthetic oligonucleotide
  Target: ATXN1; (-) strand; PAM type: YTN; PAM sequence: TTA
gccgggcgtggtggcaggtg

SEQ ID NO: 216839 - DNA, 20 bp, Artificial Sequence
  Description of Artificial Sequence: Synthetic oligonucleotide
  Target: ATXN1; (-) strand; PAM type: YTN; PAM sequence: CTA
aaaatataaaaattagccgg

SEQ ID NO: 216840 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatataaaaattagc

SEQ ID NO: 216841 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatataaaaatta

SEQ ID NO: 216842 - DNA, 20 bp, Artificial Sequence
  Description of Artificial Sequence: Synthetic oligonucleotide
  Target: ATXN1; (-) strand; PAM type: YTN; PAM sequence: CTG
gccaatatggtgaaacccca

SEQ ID NO: 216843 - DNA, 20 bp, Artificial Sequence
  Description of Artificial Sequence: Synthetic oligonucleotide
  Target: ATXN1; (-) strand; PAM type: YTN; PAM sequence: TTA
agaccaccctggccaatatg

SEQ ID NO: 216844 - DNA, 20 bp, Artificial Sequence
  Description of Artificial Sequence: Synthetic oligonucleotide
  Target: ATXN1; (-) strand; PAM type: YTN; PAM sequence: TTG
ggaggccatggtgggtggat

SEQ ID NO: 216845 - DNA, 20 bp, Artificial Sequence
  Description of Artificial Sequence: Synthetic oligonucleotide
  Target: ATXN1; (-) strand; PAM type: YTN; PAM sequence: TTT
gggaggccatggtgggtgga

SEQ ID NO: 216846 - DNA, 20 bp, Artificial Sequence
  Description of Artificial Sequence: Synthetic oligonucleotide
  Target: ATXN1; (-) strand; PAM type: YTN; PAM sequence: CTT
tgggaggccatggtgggtgg

SEQ ID NO: 216847 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 216848 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcact

SEQ ID NO: 216849 - DNA, 20 bp, Artificial Sequence
  Description of Artificial Sequence: Synthetic oligonucleotide
  Target: ATXN1; (-) strand; PAM type: YTN; PAM sequence: TTA
tcaatccatgaaataagaaa

SEQ ID NO: 216850 - DNA, 20 bp, Artificial Sequence
  Description of Artificial Sequence: Synthetic oligonucleotide
  Target: ATXN1; (-) strand; PAM type: YTN; PAM sequence: TTT
atcaatccatgaaataagaa

SEQ ID NO: 216851 - DNA, 20 bp, Artificial Sequence
  Description of Artificial Sequence: Synthetic oligonucleotide
  Target: ATXN1; (-) strand; PAM type: YTN; PAM sequence: CTC
agtttatcaatccatgaaat

SEQ ID NO: 216852 - DNA, 20 bp, Artificial Sequence
  Description of Artificial Sequence: Synthetic oligonucleotide
  Target: ATXN1; (-) strand; PAM type: YTN; PAM sequence: TTG
ggtctcagtttatcaatcca

SEQ ID NO: 216853 - DNA, 20 bp, Artificial Sequence
  Description of Artificial Sequence: Synthetic oligonucleotide
  Target: ATXN1; (-) strand; PAM type: YTN; PAM sequence: TTT
gggtctcagtttatcaatcc

SEQ ID NO: 216854 - DNA, 20 bp, Artificial Sequence
  Description of Artificial Sequence: Synthetic oligonucleotide
  Target: ATXN1; (-) strand; PAM type: YTN; PAM sequence: CTT
tgggtctcagtttatcaatc

SEQ ID NO: 216855 - DNA, 20 bp, Artificial Sequence
  Description of Artificial Sequence: Synthetic oligonucleotide
  Target: ATXN1; (-) strand; PAM type: YTN; PAM sequence: CTC
tttgggtctcagtttatcaa

SEQ ID NO: 216856 - DNA, 20 bp, Artificial Sequence
  Description of Artificial Sequence: Synthetic oligonucleotide
  Target: ATXN1; (-) strand; PAM type: YTN; PAM sequence: TTA
atctctttgggtctcagttt

SEQ ID NO: 216857 - DNA, 20 bp, Artificial Sequence
  Description of Artificial Sequence: Synthetic oligonucleotide
  Target: ATXN1; (-) strand; PAM type: YTN; PAM sequence: CTT
aatctctttgggtctcagtt

SEQ ID NO: 216858 - DNA, 20 bp, Artificial Sequence
  Description of Artificial Sequence: Synthetic oligonucleotide
  Target: ATXN1; (-) strand; PAM type: YTN; PAM sequence: TTG
agcaagtgacttaatctctt

SEQ ID NO: 216859 - DNA, 20 bp, Artificial Sequence
  Description of Artificial Sequence: Synthetic oligonucleotide
  Target: ATXN1; (-) strand; PAM type: YTN; PAM sequence: CTG
tgtaatgttgagcaagtgac

SEQ ID NO: 216860 - DNA, 20 bp, Artificial Sequence
  Description of Artificial Sequence: Synthetic oligonucleotide
  Target: ATXN1; (-) strand; PAM type: YTN; PAM sequence: TTA
atggctgtgtaatgttgagc

SEQ ID NO: 216861 - DNA, 20 bp, Artificial Sequence
  Description of Artificial Sequence: Synthetic oligonucleotide
  Target: ATXN1; (-) strand; PAM type: YTN; PAM sequence: CTT
aatggctgtgtaatgttgag

SEQ ID NO: 216862 - DNA, 20 bp, Artificial Sequence
  Description of Artificial Sequence: Synthetic oligonucleotide
  Target: ATXN1; (-) strand; PAM type: YTN; PAM sequence: TTC
cacttaatggctgtgtaatg

SEQ ID NO: 216863 - DNA, 20 bp, Artificial Sequence
  Description of Artificial Sequence: Synthetic oligonucleotide
  Target: ATXN1; (-) strand; PAM type: YTN; PAM sequence: CTT
ccacttaatggctgtgtaat

SEQ ID NO: 216864 - DNA, 20 bp, Artificial Sequence
  Description of Artificial Sequence: Synthetic oligonucleotide
  Target: ATXN1; (-) strand; PAM type: YTN; PAM sequence: TTG
aataccgaacttccacttaa

SEQ ID NO: 216865 - DNA, 20 bp, Artificial Sequence
  Description of Artificial Sequence: Synthetic oligonucleotide
  Target: ATXN1; (-) strand; PAM type: YTN; PAM sequence: TTT
gaataccgaacttccactta

SEQ ID NO: 216866 - DNA, 20 bp, Artificial Sequence
  Description of Artificial Sequence: Synthetic oligonucleotide
  Target: ATXN1; (-) strand; PAM type: YTN; PAM sequence: CTG
ggtttgaataccgaacttcc

SEQ ID NO: 216867 - DNA, 20 bp, Artificial Sequence
  Description of Artificial Sequence: Synthetic oligonucleotide
  Target: ATXN1; (-) strand; PAM type: YTN; PAM sequence: TTC
ctgggtttgaataccgaact

SEQ ID NO: 216868 - DNA, 20 bp, Artificial Sequence
  Description of Artificial Sequence: Synthetic oligonucleotide
  Target: ATXN1; (-) strand; PAM type: YTN; PAM sequence: CTT
cctgggtttgaataccgaac

SEQ ID NO: 216869 - DNA, 20 bp, Artificial Sequence
  Description of Artificial Sequence: Synthetic oligonucleotide
  Target: ATXN1; (-) strand; PAM type: YTN; PAM sequence: TTG
aggcaaacttcctgggtttg

SEQ ID NO: 216870 - DNA, 20 bp, Artificial Sequence
  Description of Artificial Sequence: Synthetic oligonucleotide
  Target: ATXN1; (-) strand; PAM type: YTN; PAM sequence: CTT
gaggcaaacttcctgggttt

SEQ ID NO: 216871 - DNA, 20 bp, Artificial Sequence
  Description of Artificial Sequence: Synthetic oligonucleotide
  Target: ATXN1; (-) strand; PAM type: YTN; PAM sequence: TTC
ttgaggcaaacttcctgggt

SEQ ID NO: 216872 - DNA, 20 bp, Artificial Sequence
  Description of Artificial Sequence: Synthetic oligonucleotide
  Target: ATXN1; (-) strand; PAM type: YTN; PAM sequence: TTG
aaaagtgtaggttcttgagg

SEQ ID NO: 216873 - DNA, 20 bp, Artificial Sequence
  Description of Artificial Sequence: Synthetic oligonucleotide
  Target: ATXN1; (-) strand; PAM type: YTN; PAM sequence: CTG
agaaacagtatgatgtgttg

SEQ ID NO: 216874 - DNA, 20 bp, Artificial Sequence
  Description of Artificial Sequence: Synthetic oligonucleotide
  Target: ATXN1; (-) strand; PAM type: YTN; PAM sequence: CTG
ctgagaaacagtatgatgtg

SEQ ID NO: 216875 - DNA, 20 bp, Artificial Sequence
  Description of Artificial Sequence: Synthetic oligonucleotide
  Target: ATXN1; (-) strand; PAM type: YTN; PAM sequence: TTA
taatgctgctgagaaacagt

SEQ ID NO: 216876 - DNA, 20 bp, Artificial Sequence
  Description of Artificial Sequence: Synthetic oligonucleotide
  Target: ATXN1; (-) strand; PAM type: YTN; PAM sequence: TTC
acaataaatagttataatgc

SEQ ID NO: 216877 - DNA, 20 bp, Artificial Sequence
  Description of Artificial Sequence: Synthetic oligonucleotide
  Target: ATXN1; (-) strand; PAM type: YTN; PAM sequence: TTA
ggtagttcacaataaatagt

SEQ ID NO: 216878 - DNA, 20 bp, Artificial Sequence
  Description of Artificial Sequence: Synthetic oligonucleotide
  Target: ATXN1; (-) strand; PAM type: YTN; PAM sequence: CTT
aggtagttcacaataaatag

SEQ ID NO: 216879 - DNA, 20 bp, Artificial Sequence
  Description of Artificial Sequence: Synthetic oligonucleotide
  Target: ATXN1; (-) strand; PAM type: YTN; PAM sequence: TTC
ttaggtagttcacaataaat

SEQ ID NO: 216880 - DNA, 20 bp, Artificial Sequence
  Description of Artificial Sequence: Synthetic oligonucleotide
  Target: ATXN1; (-) strand; PAM type: YTN; PAM sequence: TTT
cttaggtagttcacaataaa

SEQ ID NO: 216881 - DNA, 20 bp, Artificial Sequence
  Description of Artificial Sequence: Synthetic oligonucleotide
  Target: ATXN1; (-) strand; PAM type: YTN; PAM sequence: TTT
tcttaggtagttcacaataa

SEQ ID NO: 216882 - DNA, 20 bp, Artificial Sequence
  Description of Artificial Sequence: Synthetic oligonucleotide
  Target: ATXN1; (-) strand; PAM type: YTN; PAM sequence: TTA
cagccaccatatgttttctt

SEQ ID NO: 216883 - DNA, 20 bp, Artificial Sequence
  Description of Artificial Sequence: Synthetic oligonucleotide
  Target: ATXN1; (-) strand; PAM type: YTN; PAM sequence: CTG
attacagccaccatatgttt

SEQ ID NO: 216884 - DNA, 20 bp, Artificial Sequence
  Description of Artificial Sequence: Synthetic oligonucleotide
  Target: ATXN1; (-) strand; PAM type: YTN; PAM sequence: CTG
agacaactgattacagccac

SEQ ID NO: 216885 - DNA, 20 bp, Artificial Sequence
  Description of Artificial Sequence: Synthetic oligonucleotide
  Target: ATXN1; (-) strand; PAM type: YTN; PAM sequence: CTA
gccctgagacaactgattac

SEQ ID NO: 216886 - DNA, 20 bp, Artificial Sequence
  Description of Artificial Sequence: Synthetic oligonucleotide
  Target: ATXN1; (-) strand; PAM type: YTN; PAM sequence: TTA
aaatctagccctgagacaac

SEQ ID NO: 216887 - DNA, 20 bp, Artificial Sequence
  Description of Artificial Sequence: Synthetic oligonucleotide
  Target: ATXN1; (-) strand; PAM type: YTN; PAM sequence: TTT
aaaatctagccctgagacaa

SEQ ID NO: 216888 - DNA, 20 bp, Artificial Sequence
  Description of Artificial Sequence: Synthetic oligonucleotide
  Target: ATXN1; (-) strand; PAM type: YTN; PAM sequence: CTC
aaagatttaaaatctagccc

SEQ ID NO: 216889 - DNA, 20 bp, Artificial Sequence
  Description of Artificial Sequence: Synthetic oligonucleotide
  Target: ATXN1; (-) strand; PAM type: YTN; PAM sequence: TTC
aatccccagatctcaaagat

SEQ ID NO: 216890 - DNA, 20 bp, Artificial Sequence
  Description of Artificial Sequence: Synthetic oligonucleotide
  Target: ATXN1; (-) strand; PAM type: YTN; PAM sequence: CTG
tatattcaatccccagatct

SEQ ID NO: 216891 - DNA, 20 bp, Artificial Sequence
  Description of Artificial Sequence: Synthetic oligonucleotide
  Target: ATXN1; (-) strand; PAM type: YTN; PAM sequence: CTG
tgctgtatattcaatcccca

SEQ ID NO: 216892 - DNA, 20 bp, Artificial Sequence
  Description of Artificial Sequence: Synthetic oligonucleotide
  Target: ATXN1; (-) strand; PAM type: YTN; PAM sequence: TTA
accatagtcactgtgctgta

SEQ ID NO: 216893 - DNA, 20 bp, Artificial Sequence
  Description of Artificial Sequence: Synthetic oligonucleotide
  Target: ATXN1; (-) strand; PAM type: YTN; PAM sequence: TTA
ttaaccatagtcactgtgct

SEQ ID NO: 216894 - DNA, 20 bp, Artificial Sequence
  Description of Artificial Sequence: Synthetic oligonucleotide
  Target: ATXN1; (-) strand; PAM type: YTN; PAM sequence: TTC
aagtgtacaaatatcattat

SEQ ID NO: 216895 - DNA, 20 bp, Artificial Sequence
  Description of Artificial Sequence: Synthetic oligonucleotide
  Target: ATXN1; (-) strand; PAM type: YTN; PAM sequence: TTT
caagtgtacaaatatcatta

SEQ ID NO: 216896 - DNA, 20 bp, Artificial Sequence
  Description of Artificial Sequence: Synthetic oligonucleotide
  Target: ATXN1; (-) strand; PAM type: YTN; PAM sequence: CTC
agcaaatttcaagtgtacaa

SEQ ID NO: 216897 - DNA, 20 bp, Artificial Sequence
  Description of Artificial Sequence: Synthetic oligonucleotide
  Target: ATXN1; (-) strand; PAM type: YTN; PAM sequence: CTG
tctcagcaaatttcaagtgt

SEQ ID NO: 216898 - DNA, 20 bp, Artificial Sequence
  Description of Artificial Sequence: Synthetic oligonucleotide
  Target: ATXN1; (-) strand; PAM type: YTN; PAM sequence: TTA
ctgtctcagcaaatttcaag

SEQ ID NO: 216899 - DNA, 20 bp, Artificial Sequence
  Description of Artificial Sequence: Synthetic oligonucleotide
  Target: ATXN1; (-) strand; PAM type: YTN; PAM sequence: TTT
actgtctcagcaaatttcaa

SEQ ID NO: 216900 - DNA, 20 bp, Artificial Sequence
  Description of Artificial Sequence: Synthetic oligonucleotide
  Target: ATXN1; (-) strand; PAM type: YTN; PAM sequence: TTA
agatttactgtctcagcaaa

SEQ ID NO: 216901 - DNA, 20 bp, Artificial Sequence
  Description of Artificial Sequence: Synthetic oligonucleotide
  Target: ATXN1; (-) strand; PAM type: YTN; PAM sequence: TTT
aagatttactgtctcagcaa

SEQ ID NO: 216902 - DNA, 20 bp, Artificial Sequence
  Description of Artificial Sequence: Synthetic oligonucleotide
  Target: ATXN1; (-) strand; PAM type: YTN; PAM sequence: TTG
catggtgagaacatttaaga

SEQ ID NO: 216903 - DNA, 20 bp, Artificial Sequence
  Description of Artificial Sequence: Synthetic oligonucleotide
  Target: ATXN1; (-) strand; PAM type: YTN; PAM sequence: CTT
gcatggtgagaacatttaag

SEQ ID NO: 216904 - DNA, 20 bp, Artificial Sequence
  Description of Artificial Sequence: Synthetic oligonucleotide
  Target: ATXN1; (-) strand; PAM type: YTN; PAM sequence: TTC
ttgcatggtgagaacattta

SEQ ID NO: 216905 - DNA, 20 bp, Artificial Sequence
  Description of Artificial Sequence: Synthetic oligonucleotide
  Target: ATXN1; (-) strand; PAM type: YTN; PAM sequence: TTT
cttgcatggtgagaacattt

SEQ ID NO: 216906 - DNA, 20 bp, Artificial Sequence
  Description of Artificial Sequence: Synthetic oligonucleotide
  Target: ATXN1; (-) strand; PAM type: YTN; PAM sequence: TTT
tcttgcatggtgagaacatt

SEQ ID NO: 216907 - DNA, 20 bp, Artificial Sequence
  Description of Artificial Sequence: Synthetic oligonucleotide
  Target: ATXN1; (-) strand; PAM type: YTN; PAM sequence: TTT
ttcttgcatggtgagaacat

SEQ ID NO: 216908 - DNA, 20 bp, Artificial Sequence
  Description of Artificial Sequence: Synthetic oligonucleotide
  Target: ATXN1; (-) strand; PAM type: YTN; PAM sequence: TTT
tttcttgcatggtgagaaca

SEQ ID NO: 216909 - DNA, 20 bp, Artificial Sequence
  Description of Artificial Sequence: Synthetic oligonucleotide
  Target: ATXN1; (-) strand; PAM type: YTN; PAM sequence: TTA
ttttttcttgcatggtgaga

SEQ ID NO: 216910 - DNA, 20 bp, Artificial Sequence
  Description of Artificial Sequence: Synthetic oligonucleotide
  Target: ATXN1; (-) strand; PAM type: YTN; PAM sequence: CTC
acatagttattttttcttgc

SEQ ID NO: 216911 - DNA, 20 bp, Artificial Sequence
  Description of Artificial Sequence: Synthetic oligonucleotide
  Target: ATXN1; (-) strand; PAM type: YTN; PAM sequence: TTC
atcacctcacatagttattt

SEQ ID NO: 216912 - DNA, 20 bp, Artificial Sequence
  Description of Artificial Sequence: Synthetic oligonucleotide
  Target: ATXN1; (-) strand; PAM type: YTN; PAM sequence: TTT
catcacctcacatagttatt

SEQ ID NO: 216913 - DNA, 20 bp, Artificial Sequence
  Description of Artificial Sequence: Synthetic oligonucleotide
  Target: ATXN1; (-) strand; PAM type: YTN; PAM sequence: CTT
tcatcacctcacatagttat

SEQ ID NO: 216914 - DNA, 20 bp, Artificial Sequence
  Description of Artificial Sequence: Synthetic oligonucleotide
  Target: ATXN1; (-) strand; PAM type: YTN; PAM sequence: TTA
acactttcatcacctcacat

SEQ ID NO: 216915 - DNA, 20 bp, Artificial Sequence
  Description of Artificial Sequence: Synthetic oligonucleotide
  Target: ATXN1; (-) strand; PAM type: YTN; PAM sequence: TTA
gttaacactttcatcacctc

SEQ ID NO: 216916 - DNA, 20 bp, Artificial Sequence
  Description of Artificial Sequence: Synthetic oligonucleotide
  Target: ATXN1; (-) strand; PAM type: YTN; PAM sequence: TTA
tcatcaagttagttaacact

SEQ ID NO: 216917 - DNA, 20 bp, Artificial Sequence
  Description of Artificial Sequence: Synthetic oligonucleotide
  Target: ATXN1; (-) strand; PAM type: YTN; PAM sequence: TTA
ttatcatcaagttagttaac

SEQ ID NO: 216918 - DNA, 20 bp, Artificial Sequence
  Description of Artificial Sequence: Synthetic oligonucleotide
  Target: ATXN1; (-) strand; PAM type: YTN; PAM sequence: TTT
attatcatcaagttagttaa

SEQ ID NO: 216919 - DNA, 20 bp, Artificial Sequence
  Description of Artificial Sequence: Synthetic oligonucleotide
  Target: ATXN1; (-) strand; PAM type: YTN; PAM sequence: TTG
tgaaatgtttattatcatca

SEQ ID NO: 216920 - DNA, 20 bp, Artificial Sequence
  Description of Artificial Sequence: Synthetic oligonucleotide
  Target: ATXN1; (-) strand; PAM type: YTN; PAM sequence: TTG
atatacatatatattgtgaa

SEQ ID NO: 216921 - DNA, 20 bp, Artificial Sequence
  Description of Artificial Sequence: Synthetic oligonucleotide
  Target: ATXN1; (-) strand; PAM type: YTN; PAM sequence: TTT
gatatacatatatattgtga

SEQ ID NO: 216922 - DNA, 20 bp, Artificial Sequence
  Description of Artificial Sequence: Synthetic oligonucleotide
  Target: ATXN1; (-) strand; PAM type: YTN; PAM sequence: CTT
tgatatacatatatattgtg

SEQ ID NO: 216923 - DNA, 20 bp, Artificial Sequence
  Description of Artificial Sequence: Synthetic oligonucleotide
  Target: ATXN1; (-) strand; PAM type: YTN; PAM sequence: TTG
tgtacaacacgatgctttga

SEQ ID NO: 216924 - DNA, 20 bp, Artificial Sequence
  Description of Artificial Sequence: Synthetic oligonucleotide
  Target: ATXN1; (-) strand; PAM type: YTN; PAM sequence: TTT
gtgtacaacacgatgctttg

SEQ ID NO: 216925 - DNA, 20 bp, Artificial Sequence
  Description of Artificial Sequence: Synthetic oligonucleotide
  Target: ATXN1; (-) strand; PAM type: YTN; PAM sequence: TTG
acaaaatttgtgtacaacac

SEQ ID NO: 216926 - DNA, 20 bp, Artificial Sequence
  Description of Artificial Sequence: Synthetic oligonucleotide
  Target: ATXN1; (-) strand; PAM type: YTN; PAM sequence: TTA
tgattgacaaaatttgtgta

SEQ ID NO: 216927 - DNA, 20 bp, Artificial Sequence
  Description of Artificial Sequence: Synthetic oligonucleotide
  Target: ATXN1; (-) strand; PAM type: YTN; PAM sequence: TTG
agttatgattgacaaaattt

SEQ ID NO: 216928 - DNA, 20 bp, Artificial Sequence
  Description of Artificial Sequence: Synthetic oligonucleotide
  Target: ATXN1; (-) strand; PAM type: YTN; PAM sequence: TTA
ttgagttatgattgacaaaa

SEQ ID NO: 216929 - DNA, 20 bp, Artificial Sequence
  Description of Artificial Sequence: Synthetic oligonucleotide
  Target: ATXN1; (-) strand; PAM type: YTN; PAM sequence: TTC
cagcattattgagttatgat

SEQ ID NO: 216930 - DNA, 20 bp, Artificial Sequence
  Description of Artificial Sequence: Synthetic oligonucleotide
  Target: ATXN1; (-) strand; PAM type: YTN; PAM sequence: TTT
ccagcattattgagttatga

SEQ ID NO: 216931 - DNA, 20 bp, Artificial Sequence
  Description of Artificial Sequence: Synthetic oligonucleotide
  Target: ATXN1; (-) strand; PAM type: YTN; PAM sequence: TTT
tccagcattattgagttatg

SEQ ID NO: 216932 - DNA, 20 bp, Artificial Sequence
  Description of Artificial Sequence: Synthetic oligonucleotide
  Target: ATXN1; (-) strand; PAM type: YTN; PAM sequence: TTT
ttccagcattattgagttat

SEQ ID NO: 216933 - DNA, 20 bp, Artificial Sequence
  Description of Artificial Sequence: Synthetic oligonucleotide
  Target: ATXN1; (-) strand; PAM type: YTN; PAM sequence: TTA
tttttccagcattattgagt

SEQ ID NO: 216934 - DNA, 20 bp, Artificial Sequence
  Description of Artificial Sequence: Synthetic oligonucleotide
  Target: ATXN1; (-) strand; PAM type: YTN; PAM sequence: TTT
atttttccagcattattgag

SEQ ID NO: 216935 - DNA, 20 bp, Artificial Sequence
  Description of Artificial Sequence: Synthetic oligonucleotide
  Target: ATXN1; (-) strand; PAM type: YTN; PAM sequence: TTT
tatttttccagcattattga

SEQ ID NO: 216936 - DNA, 20 bp, Artificial Sequence
  Description of Artificial Sequence: Synthetic oligonucleotide
  Target: ATXN1; (-) strand; PAM type: YTN; PAM sequence: TTA
ttttatttttccagcattat

SEQ ID NO: 216937 - DNA, 20 bp, Artificial Sequence
  Description of Artificial Sequence: Synthetic oligonucleotide
  Target: ATXN1; (-) strand; PAM type: YTN; PAM sequence: CTT
attttatttttccagcatta

SEQ ID NO: 216938 - DNA, 20 bp, Artificial Sequence
  Description of Artificial Sequence: Synthetic oligonucleotide
  Target: ATXN1; (-) strand; PAM type: YTN; PAM sequence: CTG
cgcccggccttattttattt

SEQ ID NO: 216939 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccactgcgcc

SEQ ID NO: 216940 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 216941 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 216942 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 216943 - DNA, 20 bp, Artificial Sequence
  Description of Artificial Sequence: Synthetic oligonucleotide
  Target: ATXN1; (-) strand; PAM type: YTN; PAM sequence: CTC
agatgatccacccgtctcag

SEQ ID NO: 216944 - DNA, 20 bp, Artificial Sequence
  Description of Artificial Sequence: Synthetic oligonucleotide
  Target: ATXN1; (-) strand; PAM type: YTN; PAM sequence: CTG
acctcagatgatccacccgt

SEQ ID NO: 216945 - DNA, 20 bp, Artificial Sequence
  Description of Artificial Sequence: Synthetic oligonucleotide
  Target: ATXN1; (-) strand; PAM type: YTN; PAM sequence: CTC
ctgacctcagatgatccacc

SEQ ID NO: 216946 - DNA, 20 bp, Artificial Sequence
  Description of Artificial Sequence: Synthetic oligonucleotide
  Target: ATXN1; (-) strand; PAM type: YTN; PAM sequence: CTC
aaactcctgacctcagatga

SEQ ID NO: 216947 - DNA, 20 bp, Artificial Sequence
  Description of Artificial Sequence: Synthetic oligonucleotide
  Target: ATXN1; (-) strand; PAM type: YTN; PAM sequence: TTG
gccaggatggcctcaaactc

SEQ ID NO: 216948 - DNA, 20 bp, Artificial Sequence
  Description of Artificial Sequence: Synthetic oligonucleotide
  Target: ATXN1; (-) strand; PAM type: YTN; PAM sequence: CTC
accgtattggccaggatggc

SEQ ID NO: 216949 - DNA, 20 bp, Artificial Sequence
  Description of Artificial Sequence: Synthetic oligonucleotide
  Target: ATXN1; (-) strand; PAM type: YTN; PAM sequence: TTA
gtagagagggggtctcaccg

SEQ ID NO: 216950 - DNA, 20 bp, Artificial Sequence
  Description of Artificial Sequence: Synthetic oligonucleotide
  Target: ATXN1; (-) strand; PAM type: YTN; PAM sequence: TTT
agtagagagggggtctcacc

SEQ ID NO: 216951 - DNA, 20 bp, Artificial Sequence
  Description of Artificial Sequence: Synthetic oligonucleotide
  Target: ATXN1; (-) strand; PAM type: YTN; PAM sequence: TTT
tagtagagagggggtctcac

SEQ ID NO: 216952 - DNA, 20 bp, Artificial Sequence
  Description of Artificial Sequence: Synthetic oligonucleotide
  Target: ATXN1; (-) strand; PAM type: YTN; PAM sequence: TTT
ttagtagagagggggtctca

SEQ ID NO: 216953 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagaggggg

SEQ ID NO: 216954 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagagggg

SEQ ID NO: 216955 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagaggg

SEQ ID NO: 216956 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagagg

SEQ ID NO: 216957 - DNA, 20 bp, Artificial Sequence
  Description of Artificial Sequence: Synthetic oligonucleotide
  Target: ATXN1; (-) strand; PAM type: YTN; PAM sequence: CTA
cacccagataatttttgtat

SEQ ID NO: 216958 - DNA, 20 bp, Artificial Sequence
  Description of Artificial Sequence: Synthetic oligonucleotide
  Target: ATXN1; (-) strand; PAM type: YTN; PAM sequence: CTG
ccactacacccagataattt

SEQ ID NO: 216959 - DNA, 20 bp, Artificial Sequence
  Description of Artificial Sequence: Synthetic oligonucleotide
  Target: ATXN1; (-) strand; PAM type: YTN; PAM sequence: TTA
caggcacctgccactacacc

SEQ ID NO: 216960 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcacctgccac

SEQ ID NO: 216961 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 216962 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 216963 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 216964 - DNA, 20 bp, Artificial Sequence
  Description of Artificial Sequence: Synthetic oligonucleotide
  Target: ATXN1; (-) strand; PAM type: YTN; PAM sequence: TTC
tgcctcagcctcccaagtag

SEQ ID NO: 216965 - DNA, 20 bp, Artificial Sequence
  Description of Artificial Sequence: Synthetic oligonucleotide
  Target: ATXN1; (-) strand; PAM type: YTN; PAM sequence: CTT
ctgcctcagcctcccaagta

SEQ ID NO: 216966 - DNA, 20 bp, Artificial Sequence
  Description of Artificial Sequence: Synthetic oligonucleotide
  Target: ATXN1; (-) strand; PAM type: YTN; PAM sequence: TTC
aagagatcttctgcctcagc

SEQ ID NO: 216967 - DNA, 20 bp, Artificial Sequence
  Description of Artificial Sequence: Synthetic oligonucleotide
  Target: ATXN1; (-) strand; PAM type: YTN; PAM sequence: CTG
ggttcaagagatcttctgcc

SEQ ID NO: 216968 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagagatcttct

SEQ ID NO: 216969 - DNA, 20 bp, Artificial Sequence
  Description of Artificial Sequence: Synthetic oligonucleotide
  Target: ATXN1; (-) strand; PAM type: YTN; PAM sequence: CTC
cgcctcctgggttcaagaga

SEQ ID NO: 216970 - DNA, 20 bp, Artificial Sequence
  Description of Artificial Sequence: Synthetic oligonucleotide
  Target: ATXN1; (-) strand; PAM type: YTN; PAM sequence: CTG
cagcctccgcctcctgggtt

SEQ ID NO: 216971 - DNA, 20 bp, Artificial Sequence
  Description of Artificial Sequence: Synthetic oligonucleotide
  Target: ATXN1; (-) strand; PAM type: YTN; PAM sequence: CTC
actgcagcctccgcctcctg

SEQ ID NO: 216972 - DNA, 20 bp, Artificial Sequence
  Description of Artificial Sequence: Synthetic oligonucleotide
  Target: ATXN1; (-) strand; PAM type: YTN; PAM sequence: TTC
ggctcactgcagcctccgcc

SEQ ID NO: 216973 - DNA, 20 bp, Artificial Sequence
  Description of Artificial Sequence: Synthetic oligonucleotide
  Target: ATXN1; (-) strand; PAM type: YTN; PAM sequence: TTT
cggctcactgcagcctccgc

SEQ ID NO: 216974 - DNA, 20 bp, Artificial Sequence
  Description of Artificial Sequence: Synthetic oligonucleotide
  Target: ATXN1; (-) strand; PAM type: YTN; PAM sequence: CTG
gagtgcaatagcgcaatttc

SEQ ID NO: 216975 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcaatag

SEQ ID NO: 216976 - DNA, 20 bp, Artificial Sequence
  Description of Artificial Sequence: Synthetic oligonucleotide
  Target: ATXN1; (-) strand; PAM type: YTN; PAM sequence: TTG
ttgcccaggctggagtgcaa

SEQ ID NO: 216977 - DNA, 20 bp, Artificial Sequence
  Description of Artificial Sequence: Synthetic oligonucleotide
  Target: ATXN1; (-) strand; PAM type: YTN; PAM sequence: CTT
gttgcccaggctggagtgca

SEQ ID NO: 216978 - DNA, 20 bp, Artificial Sequence
  Description of Artificial Sequence: Synthetic oligonucleotide
  Target: ATXN1; (-) strand; PAM type: YTN; PAM sequence: TTC
ttgttgcccaggctggagtg

SEQ ID NO: 216979 - DNA, 20 bp, Artificial Sequence
  Description of Artificial Sequence: Synthetic oligonucleotide
  Target: ATXN1; (-) strand; PAM type: YTN; PAM sequence: TTC
gttcttgttgcccaggctgg

SEQ ID NO: 216980 - DNA, 20 bp, Artificial Sequence
  Description of Artificial Sequence: Synthetic oligonucleotide
  Target: ATXN1; (-) strand; PAM type: YTN; PAM sequence: TTT
cgttcttgttgcccaggctg

SEQ ID NO: 216981 - DNA, 20 bp, Artificial Sequence
  Description of Artificial Sequence: Synthetic oligonucleotide
  Target: ATXN1; (-) strand; PAM type: YTN; PAM sequence: TTG
agatggagtttcgttcttgt

SEQ ID NO: 216982 - DNA, 20 bp, Artificial Sequence
  Description of Artificial Sequence: Synthetic oligonucleotide
  Target: ATXN1; (-) strand; PAM type: YTN; PAM sequence: TTT
gagatggagtttcgttcttg

SEQ ID NO: 216983 - DNA, 20 bp, Artificial Sequence
  Description of Artificial Sequence: Synthetic oligonucleotide
  Target: ATXN1; (-) strand; PAM type: YTN; PAM sequence: TTT
tgagatggagtttcgttctt

SEQ ID NO: 216984 - DNA, 20 bp, Artificial Sequence
  Description of Artificial Sequence: Synthetic oligonucleotide
  Target: ATXN1; (-) strand; PAM type: YTN; PAM sequence: TTT
ttgagatggagtttcgttct

SEQ ID NO: 216985 - DNA, 20 bp, Artificial Sequence
  Description of Artificial Sequence: Synthetic oligonucleotide
  Target: ATXN1; (-) strand; PAM type: YTN; PAM sequence: TTG
tttttgagatggagtttcgt

SEQ ID NO: 216986 - DNA, 20 bp, Artificial Sequence
  Description of Artificial Sequence: Synthetic oligonucleotide
  Target: ATXN1; (-) strand; PAM type: YTN; PAM sequence: TTT
gtttttgagatggagtttcg

SEQ ID NO: 216987 - DNA, 20 bp, Artificial Sequence
  Description of Artificial Sequence: Synthetic oligonucleotide
  Target: ATXN1; (-) strand; PAM type: YTN; PAM sequence: TTT
tgtttttgagatggagtttc

SEQ ID NO: 216988 - DNA, 20 bp, Artificial Sequence
  Description of Artificial Sequence: Synthetic oligonucleotide
  Target: ATXN1; (-) strand; PAM type: YTN; PAM sequence: TTA
ttttgtttttgagatggagt

SEQ ID NO: 216989 - DNA, 20 bp, Artificial Sequence
  Description of Artificial Sequence: Synthetic oligonucleotide
  Target: ATXN1; (-) strand; PAM type: YTN; PAM sequence: TTT
attttgtttttgagatggag

SEQ ID NO: 216990 - DNA, 20 bp, Artificial Sequence
  Description of Artificial Sequence: Synthetic oligonucleotide
  Target: ATXN1; (-) strand; PAM type: YTN; PAM sequence: TTT
tattttgtttttgagatgga

SEQ ID NO: 216991 - DNA, 20 bp, Artificial Sequence
  Description of Artificial Sequence: Synthetic oligonucleotide
  Target: ATXN1; (-) strand; PAM type: YTN; PAM sequence: TTA
ttttattttgtttttgagat

SEQ ID NO: 216992 - DNA, 20 bp, Artificial Sequence
  Description of Artificial Sequence: Synthetic oligonucleotide
  Target: ATXN1; (-) strand; PAM type: YTN; PAM sequence: TTT
attttattttgtttttgaga

SEQ ID NO: 216993 - DNA, 20 bp, Artificial Sequence
  Description of Artificial Sequence: Synthetic oligonucleotide
  Target: ATXN1; (-) strand; PAM type: YTN; PAM sequence: TTT
tattttattttgtttttgag

SEQ ID NO: 216994 - DNA, 20 bp, Artificial Sequence
  Description of Artificial Sequence: Synthetic oligonucleotide
  Target: ATXN1; (-) strand; PAM type: YTN; PAM sequence: TTA
ttttattttattttgttttt

SEQ ID NO: 216995 - DNA, 20 bp, Artificial Sequence
  Description of Artificial Sequence: Synthetic oligonucleotide
  Target: ATXN1; (-) strand; PAM type: YTN; PAM sequence: TTT
attttattttattttgtttt

SEQ ID NO: 216996 - DNA, 20 bp, Artificial Sequence
  Description of Artificial Sequence: Synthetic oligonucleotide
  Target: ATXN1; (-) strand; PAM type: YTN; PAM sequence: TTT
tattttattttattttgttt

SEQ ID NO: 216997 - DNA, 20 bp, Artificial Sequence
  Description of Artificial Sequence: Synthetic oligonucleotide
  Target: ATXN1; (-) strand; PAM type: YTN; PAM sequence: TTG
atggatcccaaagttttatt

SEQ ID NO: 216998 - DNA, 20 bp, Artificial Sequence
  Description of Artificial Sequence: Synthetic oligonucleotide
  Target: ATXN1; (-) strand; PAM type: YTN; PAM sequence: CTT
gatggatcccaaagttttat

SEQ ID NO: 216999 - DNA, 20 bp, Artificial Sequence
  Description of Artificial Sequence: Synthetic oligonucleotide
  Target: ATXN1; (-) strand; PAM type: YTN; PAM sequence: CTA
catacagaccagagtacctt

SEQ ID NO: 217000 - DNA, 20 bp, Artificial Sequence
  Description of Artificial Sequence: Synthetic oligonucleotide
  Target: ATXN1; (-) strand; PAM type: YTN; PAM sequence: TTA
aggatctacatacagaccag

SEQ ID NO: 217001 - DNA, 20 bp, Artificial Sequence
  Description of Artificial Sequence: Synthetic oligonucleotide
  Target: ATXN1; (-) strand; PAM type: YTN; PAM sequence: CTT
aaggatctacatacagacca

SEQ ID NO: 217002 - DNA, 20 bp, Artificial Sequence
  Description of Artificial Sequence: Synthetic oligonucleotide
  Target: ATXN1; (-) strand; PAM type: YTN; PAM sequence: CTG
aaatcttaaggatctacata

SEQ ID NO: 217003 - DNA, 20 bp, Artificial Sequence
  Description of Artificial Sequence: Synthetic oligonucleotide
  Target: ATXN1; (-) strand; PAM type: YTN; PAM sequence: CTA
gtcctgaaatcttaaggatc

SEQ ID NO: 217004 - DNA, 20 bp, Artificial Sequence
  Description of Artificial Sequence: Synthetic oligonucleotide
  Target: ATXN1; (-) strand; PAM type: YTN; PAM sequence: TTC
aatgaggaaggatataaaag

SEQ ID NO: 217005 - DNA, 20 bp, Artificial Sequence
  Description of Artificial Sequence: Synthetic oligonucleotide
  Target: ATXN1; (-) strand; PAM type: YTN; PAM sequence: CTT
caatgaggaaggatataaaa

SEQ ID NO: 217006 - DNA, 20 bp, Artificial Sequence
  Description of Artificial Sequence: Synthetic oligonucleotide
  Target: ATXN1; (-) strand; PAM type: YTN; PAM sequence: CTG
taagcaatagtagcttcaat

SEQ ID NO: 217007 - DNA, 20 bp, Artificial Sequence
  Description of Artificial Sequence: Synthetic oligonucleotide
  Target: ATXN1; (-) strand; PAM type: YTN; PAM sequence: CTG
tagcaggaaaggaagtgtct

SEQ ID NO: 217008 - DNA, 20 bp, Artificial Sequence
  Description of Artificial Sequence: Synthetic oligonucleotide
  Target: ATXN1; (-) strand; PAM type: YTN; PAM sequence: TTG
gctgtagcaggaaaggaagt

SEQ ID NO: 217009 - DNA, 20 bp, Artificial Sequence
  Description of Artificial Sequence: Synthetic oligonucleotide
  Target: ATXN1; (-) strand; PAM type: YTN; PAM sequence: CTA
gtgttggctgtagcaggaaa

SEQ ID NO: 217010 - DNA, 20 bp, Artificial Sequence
  Description of Artificial Sequence: Synthetic oligonucleotide
  Target: ATXN1; (-) strand; PAM type: YTN; PAM sequence: TTG
cctagtgttggctgtagcag

SEQ ID NO: 217011 - DNA, 20 bp, Artificial Sequence
  Description of Artificial Sequence: Synthetic oligonucleotide
  Target: ATXN1; (-) strand; PAM type: YTN; PAM sequence: CTC
caaggttgcctagtgttggc

SEQ ID NO: 217012 - DNA, 20 bp, Artificial Sequence
  Description of Artificial Sequence: Synthetic oligonucleotide
  Target: ATXN1; (-) strand; PAM type: YTN; PAM sequence: CTC
tccaaggttgcctagtgttg

SEQ ID NO: 217013 - DNA, 20 bp, Artificial Sequence
  Description of Artificial Sequence: Synthetic oligonucleotide
  Target: ATXN1; (-) strand; PAM type: YTN; PAM sequence: CTG
taccctctccaaggttgcct

SEQ ID NO: 217014 - DNA, 20 bp, Artificial Sequence
  Description of Artificial Sequence: Synthetic oligonucleotide
  Target: ATXN1; (-) strand; PAM type: YTN; PAM sequence: TTG
tggctgtaccctctccaagg

SEQ ID NO: 217015 - DNA, 20 bp, Artificial Sequence
  Description of Artificial Sequence: Synthetic oligonucleotide
  Target: ATXN1; (-) strand; PAM type: YTN; PAM sequence: CTG
tatgtgtgggtccatgtggt

SEQ ID NO: 217016 - DNA, 20 bp, Artificial Sequence
  Description of Artificial Sequence: Synthetic oligonucleotide
  Target: ATXN1; (-) strand; PAM type: YTN; PAM sequence: CTG
cagactgtatgtgtgggtcc

SEQ ID NO: 217017 - DNA, 20 bp, Artificial Sequence
  Description of Artificial Sequence: Synthetic oligonucleotide
  Target: ATXN1; (-) strand; PAM type: YTN; PAM sequence: CTC
tgcagactgtatgtgtgggt

SEQ ID NO: 217018 - DNA, 20 bp, Artificial Sequence
  Description of Artificial Sequence: Synthetic oligonucleotide
  Target: ATXN1; (-) strand; PAM type: YTN; PAM sequence: CTG
ccctctgcagactgtatgtg

SEQ ID NO: 217019 - DNA, 20 bp, Artificial Sequence
  Description of Artificial Sequence: Synthetic oligonucleotide
  Target: ATXN1; (-) strand; PAM type: YTN; PAM sequence: TTG
aactgccctctgcagactgt

SEQ ID NO: 217020 - DNA, 20 bp, Artificial Sequence
  Description of Artificial Sequence: Synthetic oligonucleotide
  Target: ATXN1; (-) strand; PAM type: YTN; PAM sequence: TTA
tgttgaactgccctctgcag

SEQ ID NO: 217021 - DNA, 20 bp, Artificial Sequence
  Description of Artificial Sequence: Synthetic oligonucleotide
  Target: ATXN1; (-) strand; PAM type: YTN; PAM sequence: CTT
atgttgaactgccctctgca

SEQ ID NO: 217022 - DNA, 20 bp, Artificial Sequence
  Description of Artificial Sequence: Synthetic oligonucleotide
  Target: ATXN1; (-) strand; PAM type: YTN; PAM sequence: CTC
aatatagtaggtgcttatgt

SEQ ID NO: 217023 - DNA, 20 bp, Artificial Sequence
  Description of Artificial Sequence: Synthetic oligonucleotide
  Target: ATXN1; (-) strand; PAM type: YTN; PAM sequence: CTC
tcaatatagtaggtgcttat

SEQ ID NO: 217024 - DNA, 20 bp, Artificial Sequence
  Description of Artificial Sequence: Synthetic oligonucleotide
  Target: ATXN1; (-) strand; PAM type: YTN; PAM sequence: CTA
aggtgcctctcaatatagta

SEQ ID NO: 217025 - DNA, 20 bp, Artificial Sequence
  Description of Artificial Sequence: Synthetic oligonucleotide
  Target: ATXN1; (-) strand; PAM type: YTN; PAM sequence: TTA
caacctaaggtgcctctcaa

SEQ ID NO: 217026 - DNA, 20 bp, Artificial Sequence
  Description of Artificial Sequence: Synthetic oligonucleotide
  Target: ATXN1; (-) strand; PAM type: YTN; PAM sequence: TTC
attacaacctaaggtgcctc

SEQ ID NO: 217027 - DNA, 20 bp, Artificial Sequence
  Description of Artificial Sequence: Synthetic oligonucleotide
  Target: ATXN1; (-) strand; PAM type: YTN; PAM sequence: TTT
cattacaacctaaggtgcct

SEQ ID NO: 217028 - DNA, 20 bp, Artificial Sequence
  Description of Artificial Sequence: Synthetic oligonucleotide
  Target: ATXN1; (-) strand; PAM type: YTN; PAM sequence: TTT
tcattacaacctaaggtgcc

SEQ ID NO: 217029 - DNA, 20 bp, Artificial Sequence
  Description of Artificial Sequence: Synthetic oligonucleotide
  Target: ATXN1; (-) strand; PAM type: YTN; PAM sequence: CTT
ttcattacaacctaaggtgc

SEQ ID NO: 217030 - DNA, 20 bp, Artificial Sequence
  Description of Artificial Sequence: Synthetic oligonucleotide
  Target: ATXN1; (-) strand; PAM type: YTN; PAM sequence: CTA
tgacgcttttcattacaacc

SEQ ID NO: 217031 - DNA, 20 bp, Artificial Sequence
  Description of Artificial Sequence: Synthetic oligonucleotide
  Target: ATXN1; (-) strand; PAM type: YTN; PAM sequence: TTA
gactatgacgcttttcatta

SEQ ID NO: 217032 - DNA, 20 bp, Artificial Sequence
  Description of Artificial Sequence: Synthetic oligonucleotide
  Target: ATXN1; (-) strand; PAM type: YTN; PAM sequence: CTC
aggaaggcaattagactatg

SEQ ID NO: 217033 - DNA, 20 bp, Artificial Sequence
  Description of Artificial Sequence: Synthetic oligonucleotide
  Target: ATXN1; (-) strand; PAM type: YTN; PAM sequence: CTA
gtgacaaaaactcaggaagg

SEQ ID NO: 217034 - DNA, 20 bp, Artificial Sequence
  Description of Artificial Sequence: Synthetic oligonucleotide
  Target: ATXN1; (-) strand; PAM type: YTN; PAM sequence: CTA
agtacctagtgacaaaaact

SEQ ID NO: 217035 - DNA, 20 bp, Artificial Sequence
  Description of Artificial Sequence: Synthetic oligonucleotide
  Target: ATXN1; (-) strand; PAM type: YTN; PAM sequence: CTC
agaagcatcctaagtaccta

SEQ ID NO: 217036 - DNA, 20 bp, Artificial Sequence
  Description of Artificial Sequence: Synthetic oligonucleotide
  Target: ATXN1; (-) strand; PAM type: YTN; PAM sequence: TTC
atgagagccagggctcagaa

SEQ ID NO: 217037 - DNA, 20 bp, Artificial Sequence
  Description of Artificial Sequence: Synthetic oligonucleotide
  Target: ATXN1; (-) strand; PAM type: YTN; PAM sequence: TTT
catgagagccagggctcaga

SEQ ID NO: 217038 - DNA, 20 bp, Artificial Sequence
  Description of Artificial Sequence: Synthetic oligonucleotide
  Target: ATXN1; (-) strand; PAM type: YTN; PAM sequence: CTT
tcatgagagccagggctcag

SEQ ID NO: 217039 - DNA, 20 bp, Artificial Sequence
  Description of Artificial Sequence: Synthetic oligonucleotide
  Target: ATXN1; (-) strand; PAM type: YTN; PAM sequence: TTG
cactttcatgagagccaggg

SEQ ID NO: 217040 - DNA, 20 bp, Artificial Sequence
  Description of Artificial Sequence: Synthetic oligonucleotide
  Target: ATXN1; (-) strand; PAM type: YTN; PAM sequence: TTG
ttgcactttcatgagagcca

SEQ ID NO: 217041 - DNA, 20 bp, Artificial Sequence
  Description of Artificial Sequence: Synthetic oligonucleotide
  Target: ATXN1; (-) strand; PAM type: YTN; PAM sequence: TTT
gttgcactttcatgagagcc

SEQ ID NO: 217042 - DNA, 20 bp, Artificial Sequence
  Description of Artificial Sequence: Synthetic oligonucleotide
  Target: ATXN1; (-) strand; PAM type: YTN; PAM sequence: TTT
tgttgcactttcatgagagc

SEQ ID NO: 217043 - DNA, 20 bp, Artificial Sequence
  Description of Artificial Sequence: Synthetic oligonucleotide
  Target: ATXN1; (-) strand; PAM type: YTN; PAM sequence: CTA
tattttgttgcactttcatg

SEQ ID NO: 217044 - DNA, 20 bp, Artificial Sequence
  Description of Artificial Sequence: Synthetic oligonucleotide
  Target: ATXN1; (-) strand; PAM type: YTN; PAM sequence: CTG
actatattttgttgcacttt

SEQ ID NO: 217045 - DNA, 20 bp, Artificial Sequence
  Description of Artificial Sequence: Synthetic oligonucleotide
  Target: ATXN1; (-) strand; PAM type: YTN; PAM sequence: TTC
atcaggaggtactgactata

SEQ ID NO: 217046 - DNA, 20 bp, Artificial Sequence
  Description of Artificial Sequence: Synthetic oligonucleotide
  Target: ATXN1; (-) strand; PAM type: YTN; PAM sequence: TTC
attcatcaggaggtactgac

SEQ ID NO: 217047 - DNA, 20 bp, Artificial Sequence
  Description of Artificial Sequence: Synthetic oligonucleotide
  Target: ATXN1; (-) strand; PAM type: YTN; PAM sequence: TTA
cagttcattcatcaggaggt

SEQ ID NO: 217048 - DNA, 20 bp, Artificial Sequence
  Description of Artificial Sequence: Synthetic oligonucleotide
  Target: ATXN1; (-) strand; PAM type: YTN; PAM sequence: CTG
ttacagttcattcatcagga

SEQ ID NO: 217049 - DNA, 20 bp, Artificial Sequence
  Description of Artificial Sequence: Synthetic oligonucleotide
  Target: ATXN1; (-) strand; PAM type: YTN; PAM sequence: TTG
gtgactgttacagttcattc

SEQ ID NO: 217050 - DNA, 20 bp, Artificial Sequence
  Description of Artificial Sequence: Synthetic oligonucleotide
  Target: ATXN1; (-) strand; PAM type: YTN; PAM sequence: TTT
ggtgactgttacagttcatt

SEQ ID NO: 217051 - DNA, 20 bp, Artificial Sequence
  Description of Artificial Sequence: Synthetic oligonucleotide
  Target: ATXN1; (-) strand; PAM type: YTN; PAM sequence: TTT
tggtgactgttacagttcat

SEQ ID NO: 217052 - DNA, 20 bp, Artificial Sequence
  Description of Artificial Sequence: Synthetic oligonucleotide
  Target: ATXN1; (-) strand; PAM type: YTN; PAM sequence: TTT
ttggtgactgttacagttca

SEQ ID NO: 217053 - DNA, 20 bp, Artificial Sequence
  Description of Artificial Sequence: Synthetic oligonucleotide
  Target: ATXN1; (-) strand; PAM type: YTN; PAM sequence: TTT
tttggtgactgttacagttc

SEQ ID NO: 217054 - DNA, 20 bp, Artificial Sequence
  Description of Artificial Sequence: Synthetic oligonucleotide
  Target: ATXN1; (-) strand; PAM type: YTN; PAM sequence: CTT
ttttggtgactgttacagtt

SEQ ID NO: 217055 - DNA, 20 bp, Artificial Sequence
  Description of Artificial Sequence: Synthetic oligonucleotide
  Target: ATXN1; (-) strand; PAM type: YTN; PAM sequence: TTG
caaacttttttggtgactgt

SEQ ID NO: 217056 - DNA, 20 bp, Artificial Sequence
  Description of Artificial Sequence: Synthetic oligonucleotide
  Target: ATXN1; (-) strand; PAM type: YTN; PAM sequence: CTA
gccatggggttgcaaacttt

SEQ ID NO: 217057 - DNA, 20 bp, Artificial Sequence
  Description of Artificial Sequence: Synthetic oligonucleotide
  Target: ATXN1; (-) strand; PAM type: YTN; PAM sequence: TTG
cactagccatggggttgcaa

SEQ ID NO: 217058 - DNA, 20 bp, Artificial Sequence
  Description of Artificial Sequence: Synthetic oligonucleotide
  Target: ATXN1; (-) strand; PAM type: YTN; PAM sequence: CTG
ttgcactagccatggggttg

SEQ ID NO: 217059 - DNA, 20 bp, Artificial Sequence
  Description of Artificial Sequence: Synthetic oligonucleotide
  Target: ATXN1; (-) strand; PAM type: YTN; PAM sequence: TTC
tgttgcactagccatggggt

SEQ ID NO: 217060 - DNA, 20 bp, Artificial Sequence
  Description of Artificial Sequence: Synthetic oligonucleotide
  Target: ATXN1; (-) strand; PAM type: YTN; PAM sequence: CTA
ttctgttgcactagccatgg

SEQ ID NO: 217061 - DNA, 20 bp, Artificial Sequence
  Description of Artificial Sequence: Synthetic oligonucleotide
  Target: ATXN1; (-) strand; PAM type: YTN; PAM sequence: TTA
gctattctgttgcactagcc

SEQ ID NO: 217062 - DNA, 20 bp, Artificial Sequence
  Description of Artificial Sequence: Synthetic oligonucleotide
  Target: ATXN1; (-) strand; PAM type: YTN; PAM sequence: TTT
agctattctgttgcactagc

SEQ ID NO: 217063 - DNA, 20 bp, Artificial Sequence
  Description of Artificial Sequence: Synthetic oligonucleotide
  Target: ATXN1; (-) strand; PAM type: YTN; PAM sequence: CTT
tagctattctgttgcactag

SEQ ID NO: 217064 - DNA, 20 bp, Artificial Sequence
  Description of Artificial Sequence: Synthetic oligonucleotide
  Target: ATXN1; (-) strand; PAM type: YTN; PAM sequence: TTC
cctttagctattctgttgca

SEQ ID NO: 217065 - DNA, 20 bp, Artificial Sequence
  Description of Artificial Sequence: Synthetic oligonucleotide
  Target: ATXN1; (-) strand; PAM type: YTN; PAM sequence: TTT
ccctttagctattctgttgc

SEQ ID NO: 217066 - DNA, 20 bp, Artificial Sequence
  Description of Artificial Sequence: Synthetic oligonucleotide
  Target: ATXN1; (-) strand; PAM type: YTN; PAM sequence: CTC
ccagtttccctttagctatt

SEQ ID NO: 217067 - DNA, 20 bp, Artificial Sequence
  Description of Artificial Sequence: Synthetic oligonucleotide
  Target: ATXN1; (-) strand; PAM type: YTN; PAM sequence: CTA
aggtgaatgtgcagactccc

SEQ ID NO: 217068 - DNA, 20 bp, Artificial Sequence
  Description of Artificial Sequence: Synthetic oligonucleotide
  Target: ATXN1; (-) strand; PAM type: YTN; PAM sequence: TTA
caagatccatcatgaaatat

SEQ ID NO: 217069 - DNA, 20 bp, Artificial Sequence
  Description of Artificial Sequence: Synthetic oligonucleotide
  Target: ATXN1; (-) strand; PAM type: YTN; PAM sequence: TTT
acaagatccatcatgaaata

SEQ ID NO: 217070 - DNA, 20 bp, Artificial Sequence
  Description of Artificial Sequence: Synthetic oligonucleotide
  Target: ATXN1; (-) strand; PAM type: YTN; PAM sequence: CTG
tttacaagatccatcatgaa

SEQ ID NO: 217071 - DNA, 20 bp, Artificial Sequence
  Description of Artificial Sequence: Synthetic oligonucleotide
  Target: ATXN1; (-) strand; PAM type: YTN; PAM sequence: TTC
agctgtttacaagatccatc

SEQ ID NO: 217072 - DNA, 20 bp, Artificial Sequence
  Description of Artificial Sequence: Synthetic oligonucleotide
  Target: ATXN1; (-) strand; PAM type: YTN; PAM sequence: CTT
cagctgtttacaagatccat

SEQ ID NO: 217073 - DNA, 20 bp, Artificial Sequence
  Description of Artificial Sequence: Synthetic oligonucleotide
  Target: ATXN1; (-) strand; PAM type: YTN; PAM sequence: CTG
acccttcagctgtttacaag

SEQ ID NO: 217074 - DNA, 20 bp, Artificial Sequence
  Description of Artificial Sequence: Synthetic oligonucleotide
  Target: ATXN1; (-) strand; PAM type: YTN; PAM sequence: TTA
aaaacctgacccttcagctg

SEQ ID NO: 217075 - DNA, 20 bp, Artificial Sequence
  Description of Artificial Sequence: Synthetic oligonucleotide
  Target: ATXN1; (-) strand; PAM type: YTN; PAM sequence: TTT
aaaaacctgacccttcagct

SEQ ID NO: 217076 - DNA, 20 bp, Artificial Sequence
  Description of Artificial Sequence: Synthetic oligonucleotide
  Target: ATXN1; (-) strand; PAM type: YTN; PAM sequence: TTC
atttaaaaacctgacccttc

SEQ ID NO: 217077 - DNA, 20 bp, Artificial Sequence
  Description of Artificial Sequence: Synthetic oligonucleotide
  Target: ATXN1; (-) strand; PAM type: YTN; PAM sequence: TTG
cattcatttaaaaacctgac

SEQ ID NO: 217078 - DNA, 20 bp, Artificial Sequence
  Description of Artificial Sequence: Synthetic oligonucleotide
  Target: ATXN1; (-) strand; PAM type: YTN; PAM sequence: TTT
gcattcatttaaaaacctga

SEQ ID NO: 217079 - DNA, 20 bp, Artificial Sequence
  Description of Artificial Sequence: Synthetic oligonucleotide
  Target: ATXN1; (-) strand; PAM type: YTN; PAM sequence: CTT
tgcattcatttaaaaacctg

SEQ ID NO: 217080 - DNA, 20 bp, Artificial Sequence
  Description of Artificial Sequence: Synthetic oligonucleotide
  Target: ATXN1; (-) strand; PAM type: YTN; PAM sequence: CTG
atctttgcattcatttaaaa

SEQ ID NO: 217081 - DNA, 20 bp, Artificial Sequence
  Description of Artificial Sequence: Synthetic oligonucleotide
  Target: ATXN1; (-) strand; PAM type: YTN; PAM sequence: CTG
tcctgatctttgcattcatt

SEQ ID NO: 217082 - DNA, 20 bp, Artificial Sequence
  Description of Artificial Sequence: Synthetic oligonucleotide
  Target: ATXN1; (-) strand; PAM type: YTN; PAM sequence: TTG
tctgtcctgatctttgcatt

SEQ ID NO: 217083 - DNA, 20 bp, Artificial Sequence
  Description of Artificial Sequence: Synthetic oligonucleotide
  Target: ATXN1; (-) strand; PAM type: YTN; PAM sequence: TTT
gtctgtcctgatctttgcat

SEQ ID NO: 217084 - DNA, 20 bp, Artificial Sequence
  Description of Artificial Sequence: Synthetic oligonucleotide
  Target: ATXN1; (-) strand; PAM type: YTN; PAM sequence: TTT
tgtctgtcctgatctttgca

SEQ ID NO: 217085 - DNA, 20 bp, Artificial Sequence
  Description of Artificial Sequence: Synthetic oligonucleotide
  Target: ATXN1; (-) strand; PAM type: YTN; PAM sequence: TTT
ttgtctgtcctgatctttgc

SEQ ID NO: 217086 - DNA, 20 bp, Artificial Sequence
  Description of Artificial Sequence: Synthetic oligonucleotide
  Target: ATXN1; (-) strand; PAM type: YTN; PAM sequence: TTC
atttttgtctgtcctgatct

SEQ ID NO: 217087 - DNA, 20 bp, Artificial Sequence
  Description of Artificial Sequence: Synthetic oligonucleotide
  Target: ATXN1; (-) strand; PAM type: YTN; PAM sequence: TTT
catttttgtctgtcctgatc

SEQ ID NO: 217088 - DNA, 20 bp, Artificial Sequence
  Description of Artificial Sequence: Synthetic oligonucleotide
  Target: ATXN1; (-) strand; PAM type: YTN; PAM sequence: CTG
aatttcatttttgtctgtcc

SEQ ID NO: 217089 - DNA, 20 bp, Artificial Sequence
  Description of Artificial Sequence: Synthetic oligonucleotide
  Target: ATXN1; (-) strand; PAM type: YTN; PAM sequence: TTA
gctgaatttcatttttgtct

SEQ ID NO: 217090 - DNA, 20 bp, Artificial Sequence
  Description of Artificial Sequence: Synthetic oligonucleotide
  Target: ATXN1; (-) strand; PAM type: YTN; PAM sequence: CTT
agctgaatttcatttttgtc

SEQ ID NO: 217091 - DNA, 20 bp, Artificial Sequence
  Description of Artificial Sequence: Synthetic oligonucleotide
  Target: ATXN1; (-) strand; PAM type: YTN; PAM sequence: TTG
cagagtaaagaaccttagct

SEQ ID NO: 217092 - DNA, 20 bp, Artificial Sequence
  Description of Artificial Sequence: Synthetic oligonucleotide
  Target: ATXN1; (-) strand; PAM type: YTN; PAM sequence: TTT
gcagagtaaagaaccttagc

SEQ ID NO: 217093 - DNA, 20 bp, Artificial Sequence
  Description of Artificial Sequence: Synthetic oligonucleotide
  Target: ATXN1; (-) strand; PAM type: YTN; PAM sequence: TTT
tgcagagtaaagaaccttag

SEQ ID NO: 217094 - DNA, 20 bp, Artificial Sequence
  Description of Artificial Sequence: Synthetic oligonucleotide
  Target: ATXN1; (-) strand; PAM type: YTN; PAM sequence: CTG
ttttgcagagtaaagaacct

SEQ ID NO: 217095 - DNA, 20 bp, Artificial Sequence
  Description of Artificial Sequence: Synthetic oligonucleotide
  Target: ATXN1; (-) strand; PAM type: YTN; PAM sequence: TTG
tctgttttgcagagtaaaga

SEQ ID NO: 217096 - DNA, 20 bp, Artificial Sequence
  Description of Artificial Sequence: Synthetic oligonucleotide
  Target: ATXN1; (-) strand; PAM type: YTN; PAM sequence: CTT
gtctgttttgcagagtaaag

SEQ ID NO: 217097 - DNA, 20 bp, Artificial Sequence
  Description of Artificial Sequence: Synthetic oligonucleotide
  Target: ATXN1; (-) strand; PAM type: YTN; PAM sequence: TTG
atccttgtctgttttgcaga

SEQ ID NO: 217098 - DNA, 20 bp, Artificial Sequence
  Description of Artificial Sequence: Synthetic oligonucleotide
  Target: ATXN1; (-) strand; PAM type: YTN; PAM sequence: TTC
atgtaagttgatccttgtct

SEQ ID NO: 217099 - DNA, 20 bp, Artificial Sequence
  Description of Artificial Sequence: Synthetic oligonucleotide
  Target: ATXN1; (-) strand; PAM type: YTN; PAM sequence: TTT
catgtaagttgatccttgtc

SEQ ID NO: 217100 - DNA, 20 bp, Artificial Sequence
  Description of Artificial Sequence: Synthetic oligonucleotide
  Target: ATXN1; (-) strand; PAM type: YTN; PAM sequence: TTA
gcatttcatgtaagttgatc

SEQ ID NO: 217101 - DNA, 20 bp, Artificial Sequence
  Description of Artificial Sequence: Synthetic oligonucleotide
  Target: ATXN1; (-) strand; PAM type: YTN; PAM sequence: TTT
agcatttcatgtaagttgat

SEQ ID NO: 217102 - DNA, 20 bp, Artificial Sequence
  Description of Artificial Sequence: Synthetic oligonucleotide
  Target: ATXN1; (-) strand; PAM type: YTN; PAM sequence: TTT
tagcatttcatgtaagttga

SEQ ID NO: 217103 - DNA, 20 bp, Artificial Sequence
  Description of Artificial Sequence: Synthetic oligonucleotide
  Target: ATXN1; (-) strand; PAM type: YTN; PAM sequence: TTT
ttagcatttcatgtaagttg

SEQ ID NO: 217104 - DNA, 20 bp, Artificial Sequence
  Description of Artificial Sequence: Synthetic oligonucleotide
  Target: ATXN1; (-) strand; PAM type: YTN; PAM sequence: TTT
tttagcatttcatgtaagtt

SEQ ID NO: 217105 - DNA, 20 bp, Artificial Sequence
  Description of Artificial Sequence: Synthetic oligonucleotide
  Target: ATXN1; (-) strand; PAM type: YTN; PAM sequence: TTA
aatacccacatcatttttta

SEQ ID NO: 217106 - DNA, 20 bp, Artificial Sequence
  Description of Artificial Sequence: Synthetic oligonucleotide
  Target: ATXN1; (-) strand; PAM type: YTN; PAM sequence: TTG
gaaacattaaatacccacat

SEQ ID NO: 217107 - DNA, 20 bp, Artificial Sequence
  Description of Artificial Sequence: Synthetic oligonucleotide
  Target: ATXN1; (-) strand; PAM type: YTN; PAM sequence: CTG
attggaaacattaaataccc

SEQ ID NO: 217108 - DNA, 20 bp, Artificial Sequence
  Description of Artificial Sequence: Synthetic oligonucleotide
  Target: ATXN1; (-) strand; PAM type: YTN; PAM sequence: TTG
accactgattggaaacatta

SEQ ID NO: 217109 - DNA, 20 bp, Artificial Sequence
  Description of Artificial Sequence: Synthetic oligonucleotide
  Target: ATXN1; (-) strand; PAM type: YTN; PAM sequence: TTG
attgaccactgattggaaac

SEQ ID NO: 217110 - DNA, 20 bp, Artificial Sequence
  Description of Artificial Sequence: Synthetic oligonucleotide
  Target: ATXN1; (-) strand; PAM type: YTN; PAM sequence: TTA
ttgattgaccactgattgga

SEQ ID NO: 217111 - DNA, 20 bp, Artificial Sequence
  Description of Artificial Sequence: Synthetic oligonucleotide
  Target: ATXN1; (-) strand; PAM type: YTN; PAM sequence: TTT
attgattgaccactgattgg

SEQ ID NO: 217112 - DNA, 20 bp, Artificial Sequence
  Description of Artificial Sequence: Synthetic oligonucleotide
  Target: ATXN1; (-) strand; PAM type: YTN; PAM sequence: CTA
acatttattgattgaccact

SEQ ID NO: 217113 - DNA, 20 bp, Artificial Sequence
  Description of Artificial Sequence: Synthetic oligonucleotide
  Target: ATXN1; (-) strand; PAM type: YTN; PAM sequence: TTA
gtcagtcactaacatttatt

SEQ ID NO: 217114 - DNA, 20 bp, Artificial Sequence
  Description of Artificial Sequence: Synthetic oligonucleotide
  Target: ATXN1; (-) strand; PAM type: YTN; PAM sequence: TTA
agaaattagtcagtcactaa

SEQ ID NO: 217115 - DNA, 20 bp, Artificial Sequence
  Description of Artificial Sequence: Synthetic oligonucleotide
  Target: ATXN1; (-) strand; PAM type: YTN; PAM sequence: CTA
attaagaaattagtcagtca

SEQ ID NO: 217116 - DNA, 20 bp, Artificial Sequence
  Description of Artificial Sequence: Synthetic oligonucleotide
  Target: ATXN1; (-) strand; PAM type: YTN; PAM sequence: TTA
actaattaagaaattagtca

SEQ ID NO: 217117 - DNA, 20 bp, Artificial Sequence
  Description of Artificial Sequence: Synthetic oligonucleotide
  Target: ATXN1; (-) strand; PAM type: YTN; PAM sequence: CTG
gattaactaattaagaaatt

SEQ ID NO: 217118 - DNA, 20 bp, Artificial Sequence
  Description of Artificial Sequence: Synthetic oligonucleotide
  Target: ATXN1; (-) strand; PAM type: YTN; PAM sequence: CTG
tcactggattaactaattaa

SEQ ID NO: 217119 - DNA, 20 bp, Artificial Sequence
  Description of Artificial Sequence: Synthetic oligonucleotide
  Target: ATXN1; (-) strand; PAM type: YTN; PAM sequence: TTA
taaagtcatgccaaaaggtg

SEQ ID NO: 217120 - DNA, 20 bp, Artificial Sequence
  Description of Artificial Sequence: Synthetic oligonucleotide
  Target: ATXN1; (-) strand; PAM type: YTN; PAM sequence: TTT
ataaagtcatgccaaaaggt

SEQ ID NO: 217121 - DNA, 20 bp, Artificial Sequence
  Description of Artificial Sequence: Synthetic oligonucleotide
  Target: ATXN1; (-) strand; PAM type: YTN; PAM sequence: TTG
tttataaagtcatgccaaaa

SEQ ID NO: 217122 - DNA, 20 bp, Artificial Sequence
  Description of Artificial Sequence: Synthetic oligonucleotide
  Target: ATXN1; (-) strand; PAM type: YTN; PAM sequence: CTT
gtttataaagtcatgccaaa

SEQ ID NO: 217123 - DNA, 20 bp, Artificial Sequence
  Description of Artificial Sequence: Synthetic oligonucleotide
  Target: ATXN1; (-) strand; PAM type: YTN; PAM sequence: TTC
ttgtttataaagtcatgcca

SEQ ID NO: 217124 - DNA, 20 bp, Artificial Sequence
  Description of Artificial Sequence: Synthetic oligonucleotide
  Target: ATXN1; (-) strand; PAM type: YTN; PAM sequence: TTT
cttgtttataaagtcatgcc

SEQ ID NO: 217125 - DNA, 20 bp, Artificial Sequence
  Description of Artificial Sequence: Synthetic oligonucleotide
  Target: ATXN1; (-) strand; PAM type: YTN; PAM sequence: TTT
tcttgtttataaagtcatgc

SEQ ID NO: 217126 - DNA, 20 bp, Artificial Sequence
  Description of Artificial Sequence: Synthetic oligonucleotide
  Target: ATXN1; (-) strand; PAM type: YTN; PAM sequence: TTC
agttttcttgtttataaagt

SEQ ID NO: 217127 - DNA, 20 bp, Artificial Sequence
  Description of Artificial Sequence: Synthetic oligonucleotide
  Target: ATXN1; (-) strand; PAM type: YTN; PAM sequence: CTT
cagttttcttgtttataaag

SEQ ID NO: 217128 - DNA, 20 bp, Artificial Sequence
  Description of Artificial Sequence: Synthetic oligonucleotide
  Target: ATXN1; (-) strand; PAM type: YTN; PAM sequence: TTG
cccagccttcagttttcttg

SEQ ID NO: 217129 - DNA, 20 bp, Artificial Sequence
  Description of Artificial Sequence: Synthetic oligonucleotide
  Target: ATXN1; (-) strand; PAM type: YTN; PAM sequence: CTT
gcccagccttcagttttctt

SEQ ID NO: 217130 - DNA, 20 bp, Artificial Sequence
  Description of Artificial Sequence: Synthetic oligonucleotide
  Target: ATXN1; (-) strand; PAM type: YTN; PAM sequence: TTG
catgatagccttgcccagcc

SEQ ID NO: 217131 - DNA, 20 bp, Artificial Sequence
  Description of Artificial Sequence: Synthetic oligonucleotide
  Target: ATXN1; (-) strand; PAM type: YTN; PAM sequence: TTT
gcatgatagccttgcccagc

SEQ ID NO: 217132 - DNA, 20 bp, Artificial Sequence
  Description of Artificial Sequence: Synthetic oligonucleotide
  Target: ATXN1; (-) strand; PAM type: YTN; PAM sequence: TTT
tgcatgatagccttgcccag

SEQ ID NO: 217133 - DNA, 20 bp, Artificial Sequence
  Description of Artificial Sequence: Synthetic oligonucleotide
  Target: ATXN1; (-) strand; PAM type: YTN; PAM sequence: TTT
ttgcatgatagccttgccca

SEQ ID NO: 217134 - DNA, 20 bp, Artificial Sequence
  Description of Artificial Sequence: Synthetic oligonucleotide
  Target: ATXN1; (-) strand; PAM type: YTN; PAM sequence: TTT
tttgcatgatagccttgccc

SEQ ID NO: 217135 - DNA, 20 bp, Artificial Sequence
  Description of Artificial Sequence: Synthetic oligonucleotide
  Target: ATXN1; (-) strand; PAM type: YTN; PAM sequence: TTT
ttttgcatgatagccttgcc

SEQ ID NO: 217136 - DNA, 20 bp, Artificial Sequence
  Description of Artificial Sequence: Synthetic oligonucleotide
  Target: ATXN1; (-) strand; PAM type: YTN; PAM sequence: TTT
tttttgcatgatagccttgc

SEQ ID NO: 217137 - DNA, 20 bp, Artificial Sequence
  Description of Artificial Sequence: Synthetic oligonucleotide
  Target: ATXN1; (-) strand; PAM type: YTN; PAM sequence: TTG
tcattttttttgcatgatag

SEQ ID NO: 217138 - DNA, 20 bp, Artificial Sequence
  Description of Artificial Sequence: Synthetic oligonucleotide
  Target: ATXN1; (-) strand; PAM type: YTN; PAM sequence: TTT
gtcattttttttgcatgata

SEQ ID NO: 217139 - DNA, 20 bp, Artificial Sequence
  Description of Artificial Sequence: Synthetic oligonucleotide
  Target: ATXN1; (-) strand; PAM type: YTN; PAM sequence: TTG
agatttgtcattttttttgc

SEQ ID NO: 217140 - DNA, 20 bp, Artificial Sequence
  Description of Artificial Sequence: Synthetic oligonucleotide
  Target: ATXN1; (-) strand; PAM type: YTN; PAM sequence: TTT
gagatttgtcattttttttg

SEQ ID NO: 217141 - DNA, 20 bp, Artificial Sequence
  Description of Artificial Sequence: Synthetic oligonucleotide
  Target: ATXN1; (-) strand; PAM type: YTN; PAM sequence: TTC
agtttgagatttgtcatttt

SEQ ID NO: 217142 - DNA, 20 bp, Artificial Sequence
  Description of Artificial Sequence: Synthetic oligonucleotide
  Target: ATXN1; (-) strand; PAM type: YTN; PAM sequence: TTT
cagtttgagatttgtcattt

SEQ ID NO: 217143 - DNA, 20 bp, Artificial Sequence
  Description of Artificial Sequence: Synthetic oligonucleotide
  Target: ATXN1; (-) strand; PAM type: YTN; PAM sequence: TTG
taatggggaatttcagtttg

SEQ ID NO: 217144 - DNA, 20 bp, Artificial Sequence
  Description of Artificial Sequence: Synthetic oligonucleotide
  Target: ATXN1; (-) strand; PAM type: YTN; PAM sequence: TTA
gagtcaataagttgtaatgg

SEQ ID NO: 217145 - DNA, 20 bp, Artificial Sequence
  Description of Artificial Sequence: Synthetic oligonucleotide
  Target: ATXN1; (-) strand; PAM type: YTN; PAM sequence: TTT
agagtcaataagttgtaatg

SEQ ID NO: 217146 - DNA, 20 bp, Artificial Sequence
  Description of Artificial Sequence: Synthetic oligonucleotide
  Target: ATXN1; (-) strand; PAM type: YTN; PAM sequence: CTT
tagagtcaataagttgtaat

SEQ ID NO: 217147 - DNA, 20 bp, Artificial Sequence
  Description of Artificial Sequence: Synthetic oligonucleotide
  Target: ATXN1; (-) strand; PAM type: YTN; PAM sequence: TTA
atgctttagagtcaataagt

SEQ ID NO: 217148 - DNA, 20 bp, Artificial Sequence
  Description of Artificial Sequence: Synthetic oligonucleotide
  Target: ATXN1; (-) strand; PAM type: YTN; PAM sequence: CTA
ttaatgctttagagtcaata

SEQ ID NO: 217149 - DNA, 20 bp, Artificial Sequence
  Description of Artificial Sequence: Synthetic oligonucleotide
  Target: ATXN1; (-) strand; PAM type: YTN; PAM sequence: TTC
ctattaatgctttagagtca

SEQ ID NO: 217150 - DNA, 20 bp, Artificial Sequence
  Description of Artificial Sequence: Synthetic oligonucleotide
  Target: ATXN1; (-) strand; PAM type: YTN; PAM sequence: TTT
cctattaatgctttagagtc

SEQ ID NO: 217151 - DNA, 20 bp, Artificial Sequence
  Description of Artificial Sequence: Synthetic oligonucleotide
  Target: ATXN1; (-) strand; PAM type: YTN; PAM sequence: TTT
tcctattaatgctttagagt

SEQ ID NO: 217152 - DNA, 20 bp, Artificial Sequence
  Description of Artificial Sequence: Synthetic oligonucleotide
  Target: ATXN1; (-) strand; PAM type: YTN; PAM sequence: TTT
ttcctattaatgctttagag

SEQ ID NO: 217153 - DNA, 20 bp, Artificial Sequence
  Description of Artificial Sequence: Synthetic oligonucleotide
  Target: ATXN1; (-) strand; PAM type: YTN; PAM sequence: TTT
tttcctattaatgctttaga

SEQ ID NO: 217154 - DNA, 20 bp, Artificial Sequence
  Description of Artificial Sequence: Synthetic oligonucleotide
  Target: ATXN1; (-) strand; PAM type: YTN; PAM sequence: TTA
tatatgtatgcatatgtgta

SEQ ID NO: 217155 - DNA, 20 bp, Artificial Sequence
  Description of Artificial Sequence: Synthetic oligonucleotide
  Target: ATXN1; (-) strand; PAM type: YTN; PAM sequence: TTA
tattatatatgtatgcatat

SEQ ID NO: 217156 - DNA, 20 bp, Artificial Sequence
  Description of Artificial Sequence: Synthetic oligonucleotide
  Target: ATXN1; (-) strand; PAM type: YTN; PAM sequence: TTT
atattatatatgtatgcata

SEQ ID NO: 217157 - DNA, 20 bp, Artificial Sequence
  Description of Artificial Sequence: Synthetic oligonucleotide
  Target: ATXN1; (-) strand; PAM type: YTN; PAM sequence: TTT
tatattatatatgtatgcat

SEQ ID NO: 217158 - DNA, 20 bp, Artificial Sequence
  Description of Artificial Sequence: Synthetic oligonucleotide
  Target: ATXN1; (-) strand; PAM type: YTN; PAM sequence: TTA
ttttatattatatatgtatg

SEQ ID NO: 217159 - DNA, 20 bp, Artificial Sequence
  Description of Artificial Sequence: Synthetic oligonucleotide
  Target: ATXN1; (-) strand; PAM type: YTN; PAM sequence: CTA
tatattattttatattatat

SEQ ID NO: 217160 - DNA, 20 bp, Artificial Sequence
  Description of Artificial Sequence: Synthetic oligonucleotide
  Target: ATXN1; (-) strand; PAM type: YTN; PAM sequence: TTA
atactatatattattttata

SEQ ID NO: 217161 - DNA, 20 bp, Artificial Sequence
  Description of Artificial Sequence: Synthetic oligonucleotide
  Target: ATXN1; (-) strand; PAM type: YTN; PAM sequence: TTT
aatactatatattattttat

SEQ ID NO: 217162 - DNA, 20 bp, Artificial Sequence
  Description of Artificial Sequence: Synthetic oligonucleotide
  Target: ATXN1; (-) strand; PAM type: YTN; PAM sequence: TTA
tttaatactatatattattt

SEQ ID NO: 217163 - DNA, 20 bp, Artificial Sequence
  Description of Artificial Sequence: Synthetic oligonucleotide
  Target: ATXN1; (-) strand; PAM type: YTN; PAM sequence: TTG
atatcggggaagattattta

SEQ ID NO: 217164 - DNA, 20 bp, Artificial Sequence
  Description of Artificial Sequence: Synthetic oligonucleotide
  Target: ATXN1; (-) strand; PAM type: YTN; PAM sequence: TTT
gatatcggggaagattattt

SEQ ID NO: 217165 - DNA, 20 bp, Artificial Sequence
  Description of Artificial Sequence: Synthetic oligonucleotide
  Target: ATXN1; (-) strand; PAM type: YTN; PAM sequence: TTT
tgatatcggggaagattatt

SEQ ID NO: 217166 - DNA, 20 bp, Artificial Sequence
  Description of Artificial Sequence: Synthetic oligonucleotide
  Target: ATXN1; (-) strand; PAM type: YTN; PAM sequence: TTA
aaataatattttgatatcgg

SEQ ID NO: 217167 - DNA, 20 bp, Artificial Sequence
  Description of Artificial Sequence: Synthetic oligonucleotide
  Target: ATXN1; (-) strand; PAM type: YTN; PAM sequence: TTT
aaaataatattttgatatcg

SEQ ID NO: 217168 - DNA, 20 bp, Artificial Sequence
  Description of Artificial Sequence: Synthetic oligonucleotide
  Target: ATXN1; (-) strand; PAM type: YTN; PAM sequence: TTT
taaaataatattttgatatc

SEQ ID NO: 217169 - DNA, 20 bp, Artificial Sequence
  Description of Artificial Sequence: Synthetic oligonucleotide
  Target: ATXN1; (-) strand; PAM type: YTN; PAM sequence: CTT
ttaaaataatattttgatat

SEQ ID NO: 217170 - DNA, 20 bp, Artificial Sequence
  Description of Artificial Sequence: Synthetic oligonucleotide
  Target: ATXN1; (-) strand; PAM type: YTN; PAM sequence: CTC
acatcttttaaaataatatt

SEQ ID NO: 217171 - DNA, 20 bp, Artificial Sequence
  Description of Artificial Sequence: Synthetic oligonucleotide
  Target: ATXN1; (-) strand; PAM type: YTN; PAM sequence: CTG
ctcacatcttttaaaataat

SEQ ID NO: 217172 - DNA, 20 bp, Artificial Sequence
  Description of Artificial Sequence: Synthetic oligonucleotide
  Target: ATXN1; (-) strand; PAM type: YTN; PAM sequence: CTA
gtgtgtgaggcacgctgctc

SEQ ID NO: 217173 - DNA, 20 bp, Artificial Sequence
  Description of Artificial Sequence: Synthetic oligonucleotide
  Target: ATXN1; (-) strand; PAM type: YTN; PAM sequence: TTA
tgaaggctagtgtgtgaggc

SEQ ID NO: 217174 - DNA, 20 bp, Artificial Sequence
  Description of Artificial Sequence: Synthetic oligonucleotide
  Target: ATXN1; (-) strand; PAM type: YTN; PAM sequence: TTT
atgaaggctagtgtgtgagg

SEQ ID NO: 217175 - DNA, 20 bp, Artificial Sequence
  Description of Artificial Sequence: Synthetic oligonucleotide
  Target: ATXN1; (-) strand; PAM type: YTN; PAM sequence: TTT
tatgaaggctagtgtgtgag

SEQ ID NO: 217176 - DNA, 20 bp, Artificial Sequence
  Description of Artificial Sequence: Synthetic oligonucleotide
  Target: ATXN1; (-) strand; PAM type: YTN; PAM sequence: TTC
agaatggaattttatgaagg

SEQ ID NO: 217177 - DNA, 20 bp, Artificial Sequence
  Description of Artificial Sequence: Synthetic oligonucleotide
  Target: ATXN1; (-) strand; PAM type: YTN; PAM sequence: TTG
tacgtgtgacaaggaattca

SEQ ID NO: 217178 - DNA, 20 bp, Artificial Sequence
  Description of Artificial Sequence: Synthetic oligonucleotide
  Target: ATXN1; (-) strand; PAM type: YTN; PAM sequence: TTT
gtacgtgtgacaaggaattc

SEQ ID NO: 217179 - DNA, 20 bp, Artificial Sequence
  Description of Artificial Sequence: Synthetic oligonucleotide
  Target: ATXN1; (-) strand; PAM type: YTN; PAM sequence: CTA
aaaagaaaatcatcatttgt

SEQ ID NO: 217180 - DNA, 20 bp, Artificial Sequence
  Description of Artificial Sequence: Synthetic oligonucleotide
  Target: ATXN1; (-) strand; PAM type: YTN; PAM sequence: TTA
catgtcaaaaacaccactaa

SEQ ID NO: 217181 - DNA, 20 bp, Artificial Sequence
  Description of Artificial Sequence: Synthetic oligonucleotide
  Target: ATXN1; (-) strand; PAM type: YTN; PAM sequence: TTA
atattacatgtcaaaaacac

SEQ ID NO: 217182 - DNA, 20 bp, Artificial Sequence
  Description of Artificial Sequence: Synthetic oligonucleotide
  Target: ATXN1; (-) strand; PAM type: YTN; PAM sequence: TTT
aatattacatgtcaaaaaca

SEQ ID NO: 217183 - DNA, 20 bp, Artificial Sequence
  Description of Artificial Sequence: Synthetic oligonucleotide
  Target: ATXN1; (-) strand; PAM type: YTN; PAM sequence: CTA
tttaatattacatgtcaaaa

SEQ ID NO: 217184 - DNA, 20 bp, Artificial Sequence
  Description of Artificial Sequence: Synthetic oligonucleotide
  Target: ATXN1; (-) strand; PAM type: YTN; PAM sequence: TTC
caaaggaaggaataggatgc

SEQ ID NO: 217185 - DNA, 20 bp, Artificial Sequence
  Description of Artificial Sequence: Synthetic oligonucleotide
  Target: ATXN1; (-) strand; PAM type: YTN; PAM sequence: TTT
ccaaaggaaggaataggatg

SEQ ID NO: 217186 - DNA, 20 bp, Artificial Sequence
  Description of Artificial Sequence: Synthetic oligonucleotide
  Target: ATXN1; (-) strand; PAM type: YTN; PAM sequence: CTT
tccaaaggaaggaataggat

SEQ ID NO: 217187 - DNA, 20 bp, Artificial Sequence
  Description of Artificial Sequence: Synthetic oligonucleotide
  Target: ATXN1; (-) strand; PAM type: YTN; PAM sequence: TTC
tttccaaaggaaggaatagg

SEQ ID NO: 217188 - DNA, 20 bp, Artificial Sequence
  Description of Artificial Sequence: Synthetic oligonucleotide
  Target: ATXN1; (-) strand; PAM type: YTN; PAM sequence: CTC
aaaagttctttccaaaggaa

SEQ ID NO: 217189 - DNA, 20 bp, Artificial Sequence
  Description of Artificial Sequence: Synthetic oligonucleotide
  Target: ATXN1; (-) strand; PAM type: YTN; PAM sequence: CTC
ctcaaaagttctttccaaag

SEQ ID NO: 217190 - DNA, 20 bp, Artificial Sequence
  Description of Artificial Sequence: Synthetic oligonucleotide
  Target: ATXN1; (-) strand; PAM type: YTN; PAM sequence: TTC
ggctcctcaaaagttctttc

SEQ ID NO: 217191 - DNA, 20 bp, Artificial Sequence
  Description of Artificial Sequence: Synthetic oligonucleotide
  Target: ATXN1; (-) strand; PAM type: YTN; PAM sequence: TTA
attcggctcctcaaaagttc

SEQ ID NO: 217192 - DNA, 20 bp, Artificial Sequence
  Description of Artificial Sequence: Synthetic oligonucleotide
  Target: ATXN1; (-) strand; PAM type: YTN; PAM sequence: CTC
caaaattaattcggctcctc

SEQ ID NO: 217193 - DNA, 20 bp, Artificial Sequence
  Description of Artificial Sequence: Synthetic oligonucleotide
  Target: ATXN1; (-) strand; PAM type: YTN; PAM sequence: TTA
aataaaatgaaaagtcatct

SEQ ID NO: 217194 - DNA, 20 bp, Artificial Sequence
  Description of Artificial Sequence: Synthetic oligonucleotide
  Target: ATXN1; (-) strand; PAM type: YTN; PAM sequence: CTT
aaataaaatgaaaagtcatc

SEQ ID NO: 217195 - DNA, 20 bp, Artificial Sequence
  Description of Artificial Sequence: Synthetic oligonucleotide
  Target: ATXN1; (-) strand; PAM type: YTN; PAM sequence: TTG
gcttaaataaaatgaaaagt

SEQ ID NO: 217196 - DNA, 20 bp, Artificial Sequence
  Description of Artificial Sequence: Synthetic oligonucleotide
  Target: ATXN1; (-) strand; PAM type: YTN; PAM sequence: CTT
ggcttaaataaaatgaaaag

SEQ ID NO: 217197 - DNA, 20 bp, Artificial Sequence
  Description of Artificial Sequence: Synthetic oligonucleotide
  Target: ATXN1; (-) strand; PAM type: YTN; PAM sequence: CTA
aaataccaaaagagaaaaaa

SEQ ID NO: 217198 - DNA, 20 bp, Artificial Sequence
  Description of Artificial Sequence: Synthetic oligonucleotide
  Target: ATXN1; (-) strand; PAM type: YTN; PAM sequence: TTG
gctaaaataccaaaagagaa

SEQ ID NO: 217199 - DNA, 20 bp, Artificial Sequence
  Description of Artificial Sequence: Synthetic oligonucleotide
  Target: ATXN1; (-) strand; PAM type: YTN; PAM sequence: TTT
ggctaaaataccaaaagaga

SEQ ID NO: 217200 - DNA, 20 bp, Artificial Sequence
  Description of Artificial Sequence: Synthetic oligonucleotide
  Target: ATXN1; (-) strand; PAM type: YTN; PAM sequence: CTG
tttggctaaaataccaaaag

SEQ ID NO: 217201 - DNA, 20 bp, Artificial Sequence
  Description of Artificial Sequence: Synthetic oligonucleotide
  Target: ATXN1; (-) strand; PAM type: YTN; PAM sequence: TTC
tgtttggctaaaataccaaa

SEQ ID NO: 217202 - DNA, 20 bp, Artificial Sequence
  Description of Artificial Sequence: Synthetic oligonucleotide
  Target: ATXN1; (-) strand; PAM type: YTN; PAM sequence: CTA
agaattctgtttggctaaaa

SEQ ID NO: 217203 - DNA, 20 bp, Artificial Sequence
  Description of Artificial Sequence: Synthetic oligonucleotide
  Target: ATXN1; (-) strand; PAM type: YTN; PAM sequence: TTC
taagaattctgtttggctaa

SEQ ID NO: 217204 - DNA, 20 bp, Artificial Sequence
  Description of Artificial Sequence: Synthetic oligonucleotide
  Target: ATXN1; (-) strand; PAM type: YTN; PAM sequence: TTT
ctaagaattctgtttggcta

SEQ ID NO: 217205 - DNA, 20 bp, Artificial Sequence
  Description of Artificial Sequence: Synthetic oligonucleotide
  Target: ATXN1; (-) strand; PAM type: YTN; PAM sequence: TTC
atttctaagaattctgtttg

SEQ ID NO: 217206 - DNA, 20 bp, Artificial Sequence
  Description of Artificial Sequence: Synthetic oligonucleotide
  Target: ATXN1; (-) strand; PAM type: YTN; PAM sequence: TTT
catttctaagaattctgttt

SEQ ID NO: 217207 - DNA, 20 bp, Artificial Sequence
  Description of Artificial Sequence: Synthetic oligonucleotide
  Target: ATXN1; (-) strand; PAM type: YTN; PAM sequence: TTT
tcatttctaagaattctgtt

SEQ ID NO: 217208 - DNA, 20 bp, Artificial Sequence
  Description of Artificial Sequence: Synthetic oligonucleotide
  Target: ATXN1; (-) strand; PAM type: YTN; PAM sequence: TTT
ttcatttctaagaattctgt

SEQ ID NO: 217209 - DNA, 20 bp, Artificial Sequence
  Description of Artificial Sequence: Synthetic oligonucleotide
  Target: ATXN1; (-) strand; PAM type: YTN; PAM sequence: TTT
tttcatttctaagaattctg

SEQ ID NO: 217210 - DNA, 20 bp, Artificial Sequence
  Description of Artificial Sequence: Synthetic oligonucleotide
  Target: ATXN1; (-) strand; PAM type: YTN; PAM sequence: TTT
ttttcatttctaagaattct

SEQ ID NO: 217211 - DNA, 20 bp, Artificial Sequence
  Description of Artificial Sequence: Synthetic oligonucleotide
  Target: ATXN1; (-) strand; PAM type: YTN; PAM sequence: TTT
tttttcatttctaagaattc

SEQ ID NO: 217212 - DNA, 20 bp, Artificial Sequence
  Description of Artificial Sequence: Synthetic oligonucleotide
  Target: ATXN1; (-) strand; PAM type: YTN; PAM sequence: TTT
ttttttcatttctaagaatt

SEQ ID NO: 217213 - DNA, 20 bp, Artificial Sequence
  Description of Artificial Sequence: Synthetic oligonucleotide
  Target: ATXN1; (-) strand; PAM type: YTN; PAM sequence: TTT
tttttttcatttctaagaat

SEQ ID NO: 217214 - DNA, 20 bp, Artificial Sequence
  Description of Artificial Sequence: Synthetic oligonucleotide
  Target: ATXN1; (-) strand; PAM type: YTN; PAM sequence: CTA
ttttttttttcatttctaag

SEQ ID NO: 217215 - DNA, 20 bp, Artificial Sequence
  Description of Artificial Sequence: Synthetic oligonucleotide
  Target: ATXN1; (-) strand; PAM type: YTN; PAM sequence: TTA
ctattttttttttcatttct

SEQ ID NO: 217216 - DNA, 20 bp, Artificial Sequence
  Description of Artificial Sequence: Synthetic oligonucleotide
  Target: ATXN1; (-) strand; PAM type: YTN; PAM sequence: TTG
ttactattttttttttcatt

SEQ ID NO: 217217 - DNA, 20 bp, Artificial Sequence
  Description of Artificial Sequence: Synthetic oligonucleotide
  Target: ATXN1; (-) strand; PAM type: YTN; PAM sequence: CTT
gttactattttttttttcat

SEQ ID NO: 217218 - DNA, 20 bp, Artificial Sequence
  Description of Artificial Sequence: Synthetic oligonucleotide
  Target: ATXN1; (-) strand; PAM type: YTN; PAM sequence: CTA
ggaatatacttgttactatt

SEQ ID NO: 217219 - DNA, 20 bp, Artificial Sequence
  Description of Artificial Sequence: Synthetic oligonucleotide
  Target: ATXN1; (-) strand; PAM type: YTN; PAM sequence: CTC
taggaatatacttgttacta

SEQ ID NO: 217220 - DNA, 20 bp, Artificial Sequence
  Description of Artificial Sequence: Synthetic oligonucleotide
  Target: ATXN1; (-) strand; PAM type: YTN; PAM sequence: CTG
ctctaggaatatacttgtta

SEQ ID NO: 217221 - DNA, 20 bp, Artificial Sequence
  Description of Artificial Sequence: Synthetic oligonucleotide
  Target: ATXN1; (-) strand; PAM type: YTN; PAM sequence: CTC
tgctctaggaatatacttgt

SEQ ID NO: 217222 - DNA, 20 bp, Artificial Sequence
  Description of Artificial Sequence: Synthetic oligonucleotide
  Target: ATXN1; (-) strand; PAM type: YTN; PAM sequence: CTA
ctctgctctaggaatatact

SEQ ID NO: 217223 - DNA, 20 bp, Artificial Sequence
  Description of Artificial Sequence: Synthetic oligonucleotide
  Target: ATXN1; (-) strand; PAM type: YTN; PAM sequence: CTG
aaaggctactctgctctagg

SEQ ID NO: 217224 - DNA, 20 bp, Artificial Sequence
  Description of Artificial Sequence: Synthetic oligonucleotide
  Target: ATXN1; (-) strand; PAM type: YTN; PAM sequence: TTC
tgaaaggctactctgctcta

SEQ ID NO: 217225 - DNA, 20 bp, Artificial Sequence
  Description of Artificial Sequence: Synthetic oligonucleotide
  Target: ATXN1; (-) strand; PAM type: YTN; PAM sequence: TTC
aattctgaaaggctactctg

SEQ ID NO: 217226 - DNA, 20 bp, Artificial Sequence
  Description of Artificial Sequence: Synthetic oligonucleotide
  Target: ATXN1; (-) strand; PAM type: YTN; PAM sequence: TTT
caattctgaaaggctactct

SEQ ID NO: 217227 - DNA, 20 bp, Artificial Sequence
  Description of Artificial Sequence: Synthetic oligonucleotide
  Target: ATXN1; (-) strand; PAM type: YTN; PAM sequence: TTT
tcaattctgaaaggctactc

SEQ ID NO: 217228 - DNA, 20 bp, Artificial Sequence
  Description of Artificial Sequence: Synthetic oligonucleotide
  Target: ATXN1; (-) strand; PAM type: YTN; PAM sequence: TTG
atgtaacattttcaattctg

SEQ ID NO: 217229 - DNA, 20 bp, Artificial Sequence
  Description of Artificial Sequence: Synthetic oligonucleotide
  Target: ATXN1; (-) strand; PAM type: YTN; PAM sequence: TTA
aagggttgatgtaacatttt

SEQ ID NO: 217230 - DNA, 20 bp, Artificial Sequence
  Description of Artificial Sequence: Synthetic oligonucleotide
  Target: ATXN1; (-) strand; PAM type: YTN; PAM sequence: CTG
ggtaacattaaagggttgat

SEQ ID NO: 217231 - DNA, 20 bp, Artificial Sequence
  Description of Artificial Sequence: Synthetic oligonucleotide
  Target: ATXN1; (-) strand; PAM type: YTN; PAM sequence: TTA
aaaagactgggtaacattaa

SEQ ID NO: 217232 - DNA, 20 bp, Artificial Sequence
  Description of Artificial Sequence: Synthetic oligonucleotide
  Target: ATXN1; (-) strand; PAM type: YTN; PAM sequence: TTT
aaaaagactgggtaacatta

SEQ ID NO: 217233 - DNA, 20 bp, Artificial Sequence
  Description of Artificial Sequence: Synthetic oligonucleotide
  Target: ATXN1; (-) strand; PAM type: YTN; PAM sequence: TTA
agggaatttaaaaagactgg

SEQ ID NO: 217234 - DNA, 20 bp, Artificial Sequence
  Description of Artificial Sequence: Synthetic oligonucleotide
  Target: ATXN1; (-) strand; PAM type: YTN; PAM sequence: CTT
aagggaatttaaaaagactg

SEQ ID NO: 217235 - DNA, 20 bp, Artificial Sequence
  Description of Artificial Sequence: Synthetic oligonucleotide
  Target: ATXN1; (-) strand; PAM type: YTN; PAM sequence: TTC
ttaagggaatttaaaaagac

SEQ ID NO: 217236 - DNA, 20 bp, Artificial Sequence
  Description of Artificial Sequence: Synthetic oligonucleotide
  Target: ATXN1; (-) strand; PAM type: YTN; PAM sequence: TTT
cttaagggaatttaaaaaga

SEQ ID NO: 217237 - DNA, 20 bp, Artificial Sequence
  Description of Artificial Sequence: Synthetic oligonucleotide
  Target: ATXN1; (-) strand; PAM type: YTN; PAM sequence: TTT
tcttaagggaatttaaaaag

SEQ ID NO: 217238 - DNA, 20 bp, Artificial Sequence
  Description of Artificial Sequence: Synthetic oligonucleotide
  Target: ATXN1; (-) strand; PAM type: YTN; PAM sequence: TTT
ttcttaagggaatttaaaaa

SEQ ID NO: 217239 - DNA, 20 bp, Artificial Sequence
  Description of Artificial Sequence: Synthetic oligonucleotide
  Target: ATXN1; (-) strand; PAM type: YTN; PAM sequence: TTT
tttcttaagggaatttaaaa

SEQ ID NO: 217240 - DNA, 20 bp, Artificial Sequence
  Description of Artificial Sequence: Synthetic oligonucleotide
  Target: ATXN1; (-) strand; PAM type: YTN; PAM sequence: TTT
ttttcttaagggaatttaaa

SEQ ID NO: 217241 - DNA, 20 bp, Artificial Sequence
  Description of Artificial Sequence: Synthetic oligonucleotide
  Target: ATXN1; (-) strand; PAM type: YTN; PAM sequence: CTG
gtatttttttcttaagggaa

SEQ ID NO: 217242 - DNA, 20 bp, Artificial Sequence
  Description of Artificial Sequence: Synthetic oligonucleotide
  Target: ATXN1; (-) strand; PAM type: YTN; PAM sequence: TTG
tgaatatctggtattttttt

SEQ ID NO: 217243 - DNA, 20 bp, Artificial Sequence
  Description of Artificial Sequence: Synthetic oligonucleotide
  Target: ATXN1; (-) strand; PAM type: YTN; PAM sequence: TTT
gtgaatatctggtatttttt

SEQ ID NO: 217244 - DNA, 20 bp, Artificial Sequence
  Description of Artificial Sequence: Synthetic oligonucleotide
  Target: ATXN1; (-) strand; PAM type: YTN; PAM sequence: TTT
tgtgaatatctggtattttt

SEQ ID NO: 217245 - DNA, 20 bp, Artificial Sequence
  Description of Artificial Sequence: Synthetic oligonucleotide
  Target: ATXN1; (-) strand; PAM type: YTN; PAM sequence: CTG
gccacattttgtgaatatct

SEQ ID NO: 217246 - DNA, 20 bp, Artificial Sequence
  Description of Artificial Sequence: Synthetic oligonucleotide
  Target: ATXN1; (-) strand; PAM type: YTN; PAM sequence: TTC
tggccacattttgtgaatat

SEQ ID NO: 217247 - DNA, 20 bp, Artificial Sequence
  Description of Artificial Sequence: Synthetic oligonucleotide
  Target: ATXN1; (-) strand; PAM type: YTN; PAM sequence: TTA
tgtcatgcataaccatgtcg

SEQ ID NO: 217248 - DNA, 20 bp, Artificial Sequence
  Description of Artificial Sequence: Synthetic oligonucleotide
  Target: ATXN1; (-) strand; PAM type: YTN; PAM sequence: TTT
atgtcatgcataaccatgtc

SEQ ID NO: 217249 - DNA, 20 bp, Artificial Sequence
  Description of Artificial Sequence: Synthetic oligonucleotide
  Target: ATXN1; (-) strand; PAM type: YTN; PAM sequence: TTT
tatgtcatgcataaccatgt

SEQ ID NO: 217250 - DNA, 20 bp, Artificial Sequence
  Description of Artificial Sequence: Synthetic oligonucleotide
  Target: ATXN1; (-) strand; PAM type: YTN; PAM sequence: CTG
ttttatgtcatgcataacca

SEQ ID NO: 217251 - DNA, 20 bp, Artificial Sequence
  Description of Artificial Sequence: Synthetic oligonucleotide
  Target: ATXN1; (-) strand; PAM type: YTN; PAM sequence: TTA
aactgttttatgtcatgcat

SEQ ID NO: 217252 - DNA, 20 bp, Artificial Sequence
  Description of Artificial Sequence: Synthetic oligonucleotide
  Target: ATXN1; (-) strand; PAM type: YTN; PAM sequence: TTT
aaactgttttatgtcatgca

SEQ ID NO: 217253 - DNA, 20 bp, Artificial Sequence
  Description of Artificial Sequence: Synthetic oligonucleotide
  Target: ATXN1; (-) strand; PAM type: YTN; PAM sequence: TTT
taaactgttttatgtcatgc

SEQ ID NO: 217254 - DNA, 20 bp, Artificial Sequence
  Description of Artificial Sequence: Synthetic oligonucleotide
  Target: ATXN1; (-) strand; PAM type: YTN; PAM sequence: TTT
ttaaactgttttatgtcatg

SEQ ID NO: 217255 - DNA, 20 bp, Artificial Sequence
  Description of Artificial Sequence: Synthetic oligonucleotide
  Target: ATXN1; (-) strand; PAM type: YTN; PAM sequence: TTT
tttaaactgttttatgtcat

SEQ ID NO: 217256 - DNA, 20 bp, Artificial Sequence
  Description of Artificial Sequence: Synthetic oligonucleotide
  Target: ATXN1; (-) strand; PAM type: YTN; PAM sequence: TTT
ttttaaactgttttatgtca

SEQ ID NO: 217257 - DNA, 20 bp, Artificial Sequence
  Description of Artificial Sequence: Synthetic oligonucleotide
  Target: ATXN1; (-) strand; PAM type: YTN; PAM sequence: CTA
aaaaccatttttttaaactg

SEQ ID NO: 217258 - DNA, 20 bp, Artificial Sequence
  Description of Artificial Sequence: Synthetic oligonucleotide
  Target: ATXN1; (-) strand; PAM type: YTN; PAM sequence: TTA
ctaaaaaccatttttttaaa

SEQ ID NO: 217259 - DNA, 20 bp, Artificial Sequence
  Description of Artificial Sequence: Synthetic oligonucleotide
  Target: ATXN1; (-) strand; PAM type: YTN; PAM sequence: TTA
tgaagttactaaaaaccatt

SEQ ID NO: 217260 - DNA, 20 bp, Artificial Sequence
  Description of Artificial Sequence: Synthetic oligonucleotide
  Target: ATXN1; (-) strand; PAM type: YTN; PAM sequence: TTT
atgaagttactaaaaaccat

SEQ ID NO: 217261 - DNA, 20 bp, Artificial Sequence
  Description of Artificial Sequence: Synthetic oligonucleotide
  Target: ATXN1; (-) strand; PAM type: YTN; PAM sequence: CTG
taagccatatttatgaagtt

SEQ ID NO: 217262 - DNA, 20 bp, Artificial Sequence
  Description of Artificial Sequence: Synthetic oligonucleotide
  Target: ATXN1; (-) strand; PAM type: YTN; PAM sequence: TTC
actgtaagccatatttatga

SEQ ID NO: 217263 - DNA, 20 bp, Artificial Sequence
  Description of Artificial Sequence: Synthetic oligonucleotide
  Target: ATXN1; (-) strand; PAM type: YTN; PAM sequence: CTT
cactgtaagccatatttatg

SEQ ID NO: 217264 - DNA, 20 bp, Artificial Sequence
  Description of Artificial Sequence: Synthetic oligonucleotide
  Target: ATXN1; (-) strand; PAM type: YTN; PAM sequence: TTC
agcttcactgtaagccatat

SEQ ID NO: 217265 - DNA, 20 bp, Artificial Sequence
  Description of Artificial Sequence: Synthetic oligonucleotide
  Target: ATXN1; (-) strand; PAM type: YTN; PAM sequence: CTT
cagcttcactgtaagccata

SEQ ID NO: 217266 - DNA, 20 bp, Artificial Sequence
  Description of Artificial Sequence: Synthetic oligonucleotide
  Target: ATXN1; (-) strand; PAM type: YTN; PAM sequence: TTG
cttcagcttcactgtaagcc

SEQ ID NO: 217267 - DNA, 20 bp, Artificial Sequence
  Description of Artificial Sequence: Synthetic oligonucleotide
  Target: ATXN1; (-) strand; PAM type: YTN; PAM sequence: CTA
acatcagatagaattgcttc

SEQ ID NO: 217268 - DNA, 20 bp, Artificial Sequence
  Description of Artificial Sequence: Synthetic oligonucleotide
  Target: ATXN1; (-) strand; PAM type: YTN; PAM sequence: TTC
taacatcagatagaattgct

SEQ ID NO: 217269 - DNA, 20 bp, Artificial Sequence
  Description of Artificial Sequence: Synthetic oligonucleotide
  Target: ATXN1; (-) strand; PAM type: YTN; PAM sequence: TTA
gaaaattctaacatcagata

SEQ ID NO: 217270 - DNA, 20 bp, Artificial Sequence
  Description of Artificial Sequence: Synthetic oligonucleotide
  Target: ATXN1; (-) strand; PAM type: YTN; PAM sequence: TTG
gcattagaaaattctaacat

SEQ ID NO: 217271 - DNA, 20 bp, Artificial Sequence
  Description of Artificial Sequence: Synthetic oligonucleotide
  Target: ATXN1; (-) strand; PAM type: YTN; PAM sequence: TTT
ggcattagaaaattctaaca

SEQ ID NO: 217272 - DNA, 20 bp, Artificial Sequence
  Description of Artificial Sequence: Synthetic oligonucleotide
  Target: ATXN1; (-) strand; PAM type: YTN; PAM sequence: CTT
tggcattagaaaattctaac

SEQ ID NO: 217273 - DNA, 20 bp, Artificial Sequence
  Description of Artificial Sequence: Synthetic oligonucleotide
  Target: ATXN1; (-) strand; PAM type: YTN; PAM sequence: CTG
gcgtatatctttggcattag

SEQ ID NO: 217274 - DNA, 20 bp, Artificial Sequence
  Description of Artificial Sequence: Synthetic oligonucleotide
  Target: ATXN1; (-) strand; PAM type: YTN; PAM sequence: CTA
ctggcgtatatctttggcat

SEQ ID NO: 217275 - DNA, 20 bp, Artificial Sequence
  Description of Artificial Sequence: Synthetic oligonucleotide
  Target: ATXN1; (-) strand; PAM type: YTN; PAM sequence: CTA
aactactggcgtatatcttt

SEQ ID NO: 217276 - DNA, 20 bp, Artificial Sequence
  Description of Artificial Sequence: Synthetic oligonucleotide
  Target: ATXN1; (-) strand; PAM type: YTN; PAM sequence: TTA
aactaaactactggcgtata

SEQ ID NO: 217277 - DNA, 20 bp, Artificial Sequence
  Description of Artificial Sequence: Synthetic oligonucleotide
  Target: ATXN1; (-) strand; PAM type: YTN; PAM sequence: TTT
aaactaaactactggcgtat

SEQ ID NO: 217278 - DNA, 20 bp, Artificial Sequence
  Description of Artificial Sequence: Synthetic oligonucleotide
  Target: ATXN1; (-) strand; PAM type: YTN; PAM sequence: CTC
acatcatttaaactaaacta

SEQ ID NO: 217279 - DNA, 20 bp, Artificial Sequence
  Description of Artificial Sequence: Synthetic oligonucleotide
  Target: ATXN1; (-) strand; PAM type: YTN; PAM sequence: TTC
agcctcacatcatttaaact

SEQ ID NO: 217280 - DNA, 20 bp, Artificial Sequence
  Description of Artificial Sequence: Synthetic oligonucleotide
  Target: ATXN1; (-) strand; PAM type: YTN; PAM sequence: TTG
gattcagcctcacatcattt

SEQ ID NO: 217281 - DNA, 20 bp, Artificial Sequence
  Description of Artificial Sequence: Synthetic oligonucleotide
  Target: ATXN1; (-) strand; PAM type: YTN; PAM sequence: TTA
cagtaatagttggattcagc

SEQ ID NO: 217282 - DNA, 20 bp, Artificial Sequence
  Description of Artificial Sequence: Synthetic oligonucleotide
  Target: ATXN1; (-) strand; PAM type: YTN; PAM sequence: TTT
acagtaatagttggattcag

SEQ ID NO: 217283 - DNA, 20 bp, Artificial Sequence
  Description of Artificial Sequence: Synthetic oligonucleotide
  Target: ATXN1; (-) strand; PAM type: YTN; PAM sequence: TTT
tacagtaatagttggattca

SEQ ID NO: 217284 - DNA, 20 bp, Artificial Sequence
  Description of Artificial Sequence: Synthetic oligonucleotide
  Target: ATXN1; (-) strand; PAM type: YTN; PAM sequence: TTT
ttacagtaatagttggattc

SEQ ID NO: 217285 - DNA, 20 bp, Artificial Sequence
  Description of Artificial Sequence: Synthetic oligonucleotide
  Target: ATXN1; (-) strand; PAM type: YTN; PAM sequence: TTA
aacagtttttacagtaatag

SEQ ID NO: 217286 - DNA, 20 bp, Artificial Sequence
  Description of Artificial Sequence: Synthetic oligonucleotide
  Target: ATXN1; (-) strand; PAM type: YTN; PAM sequence: TTG
gttaaacagtttttacagta

SEQ ID NO: 217287 - DNA, 20 bp, Artificial Sequence
  Description of Artificial Sequence: Synthetic oligonucleotide
  Target: ATXN1; (-) strand; PAM type: YTN; PAM sequence: TTT
ggttaaacagtttttacagt

SEQ ID NO: 217288 - DNA, 20 bp, Artificial Sequence
  Description of Artificial Sequence: Synthetic oligonucleotide
  Target: ATXN1; (-) strand; PAM type: YTN; PAM sequence: TTT
tggttaaacagtttttacag

SEQ ID NO: 217289 - DNA, 20 bp, Artificial Sequence
  Description of Artificial Sequence: Synthetic oligonucleotide
  Target: ATXN1; (-) strand; PAM type: YTN; PAM sequence: TTT
ttggttaaacagtttttaca

SEQ ID NO: 217290 - DNA, 20 bp, Artificial Sequence
  Description of Artificial Sequence: Synthetic oligonucleotide
  Target: ATXN1; (-) strand; PAM type: YTN; PAM sequence: TTA
caaaaatagatgtttttggt

SEQ ID NO: 217291 - DNA, 20 bp, Artificial Sequence
  Description of Artificial Sequence: Synthetic oligonucleotide
  Target: ATXN1; (-) strand; PAM type: YTN; PAM sequence: TTC
ataaaaattacaaaaataga

SEQ ID NO: 217292 - DNA, 20 bp, Artificial Sequence
  Description of Artificial Sequence: Synthetic oligonucleotide
  Target: ATXN1; (-) strand; PAM type: YTN; PAM sequence: TTT
cataaaaattacaaaaatag

SEQ ID NO: 217293 - DNA, 20 bp, Artificial Sequence
  Description of Artificial Sequence: Synthetic oligonucleotide
  Target: ATXN1; (-) strand; PAM type: YTN; PAM sequence: CTA
tttcataaaaattacaaaaa

SEQ ID NO: 217294 - DNA, 20 bp, Artificial Sequence
  Description of Artificial Sequence: Synthetic oligonucleotide
  Target: ATXN1; (-) strand; PAM type: YTN; PAM sequence: TTA
ctatttcataaaaattacaa

SEQ ID NO: 217295 - DNA, 20 bp, Artificial Sequence
  Description of Artificial Sequence: Synthetic oligonucleotide
  Target: ATXN1; (-) strand; PAM type: YTN; PAM sequence: CTA
attactatttcataaaaatt

SEQ ID NO: 217296 - DNA, 20 bp, Artificial Sequence
  Description of Artificial Sequence: Synthetic oligonucleotide
  Target: ATXN1; (-) strand; PAM type: YTN; PAM sequence: TTA
gtactaattactatttcata

SEQ ID NO: 217297 - DNA, 20 bp, Artificial Sequence
  Description of Artificial Sequence: Synthetic oligonucleotide
  Target: ATXN1; (-) strand; PAM type: YTN; PAM sequence: CTT
agtactaattactatttcat

SEQ ID NO: 217298 - DNA, 20 bp, Artificial Sequence
  Description of Artificial Sequence: Synthetic oligonucleotide
  Target: ATXN1; (-) strand; PAM type: YTN; PAM sequence: TTG
gataagcttagtactaatta

SEQ ID NO: 217299 - DNA, 20 bp, Artificial Sequence
  Description of Artificial Sequence: Synthetic oligonucleotide
  Target: ATXN1; (-) strand; PAM type: YTN; PAM sequence: TTT
ggataagcttagtactaatt

SEQ ID NO: 217300 - DNA, 20 bp, Artificial Sequence
  Description of Artificial Sequence: Synthetic oligonucleotide
  Target: ATXN1; (-) strand; PAM type: YTN; PAM sequence: TTT
tggataagcttagtactaat

SEQ ID NO: 217301 - DNA, 20 bp, Artificial Sequence
  Description of Artificial Sequence: Synthetic oligonucleotide
  Target: ATXN1; (-) strand; PAM type: YTN; PAM sequence: TTT
ttggataagcttagtactaa

SEQ ID NO: 217302 - DNA, 20 bp, Artificial Sequence
  Description of Artificial Sequence: Synthetic oligonucleotide
  Target: ATXN1; (-) strand; PAM type: YTN; PAM sequence: TTA
aaaatgtttttggataagct

SEQ ID NO: 217303 - DNA, 20 bp, Artificial Sequence
  Description of Artificial Sequence: Synthetic oligonucleotide
  Target: ATXN1; (-) strand; PAM type: YTN; PAM sequence: TTC
aggtaagatattaaaaatgt

SEQ ID NO: 217304 - DNA, 20 bp, Artificial Sequence
  Description of Artificial Sequence: Synthetic oligonucleotide
  Target: ATXN1; (-) strand; PAM type: YTN; PAM sequence: CTT
caggtaagatattaaaaatg

SEQ ID NO: 217305 - DNA, 20 bp, Artificial Sequence
  Description of Artificial Sequence: Synthetic oligonucleotide
  Target: ATXN1; (-) strand; PAM type: YTN; PAM sequence: TTA
gaaatacagaaataatcctt

SEQ ID NO: 217306 - DNA, 20 bp, Artificial Sequence
  Description of Artificial Sequence: Synthetic oligonucleotide
  Target: ATXN1; (-) strand; PAM type: YTN; PAM sequence: TTT
agaaatacagaaataatcct

SEQ ID NO: 217307 - DNA, 20 bp, Artificial Sequence
  Description of Artificial Sequence: Synthetic oligonucleotide
  Target: ATXN1; (-) strand; PAM type: YTN; PAM sequence: TTA
caaaggtaagaagaaaggaa

SEQ ID NO: 217308 - DNA, 20 bp, Artificial Sequence
  Description of Artificial Sequence: Synthetic oligonucleotide
  Target: ATXN1; (-) strand; PAM type: YTN; PAM sequence: TTT
acaaaggtaagaagaaagga

SEQ ID NO: 217309 - DNA, 20 bp, Artificial Sequence
  Description of Artificial Sequence: Synthetic oligonucleotide
  Target: ATXN1; (-) strand; PAM type: YTN; PAM sequence: TTA
ataaatatttacaaaggtaa

SEQ ID NO: 217310 - DNA, 20 bp, Artificial Sequence
  Description of Artificial Sequence: Synthetic oligonucleotide
  Target: ATXN1; (-) strand; PAM type: YTN; PAM sequence: TTT
aataaatatttacaaaggta

SEQ ID NO: 217311 - DNA, 20 bp, Artificial Sequence
  Description of Artificial Sequence: Synthetic oligonucleotide
  Target: ATXN1; (-) strand; PAM type: YTN; PAM sequence: CTG
catataatacagtttaataa

SEQ ID NO: 217312 - DNA, 20 bp, Artificial Sequence
  Description of Artificial Sequence: Synthetic oligonucleotide
  Target: ATXN1; (-) strand; PAM type: YTN; PAM sequence: TTC
ctgcatataatacagtttaa

SEQ ID NO: 217313 - DNA, 20 bp, Artificial Sequence
  Description of Artificial Sequence: Synthetic oligonucleotide
  Target: ATXN1; (-) strand; PAM type: YTN; PAM sequence: TTA
agcccattcctgcatataat

SEQ ID NO: 217314 - DNA, 20 bp, Artificial Sequence
  Description of Artificial Sequence: Synthetic oligonucleotide
  Target: ATXN1; (-) strand; PAM type: YTN; PAM sequence: TTC
caagtgttaagcccattcct

SEQ ID NO: 217315 - DNA, 20 bp, Artificial Sequence
  Description of Artificial Sequence: Synthetic oligonucleotide
  Target: ATXN1; (-) strand; PAM type: YTN; PAM sequence: TTG
tattccaagtgttaagccca

SEQ ID NO: 217316 - DNA, 20 bp, Artificial Sequence
  Description of Artificial Sequence: Synthetic oligonucleotide
  Target: ATXN1; (-) strand; PAM type: YTN; PAM sequence: CTT
gtattccaagtgttaagccc

SEQ ID NO: 217317 - DNA, 20 bp, Artificial Sequence
  Description of Artificial Sequence: Synthetic oligonucleotide
  Target: ATXN1; (-) strand; PAM type: YTN; PAM sequence: TTA
aaccttgtattccaagtgtt

SEQ ID NO: 217318 - DNA, 20 bp, Artificial Sequence
  Description of Artificial Sequence: Synthetic oligonucleotide
  Target: ATXN1; (-) strand; PAM type: YTN; PAM sequence: CTT
aaaccttgtattccaagtgt

SEQ ID NO: 217319 - DNA, 20 bp, Artificial Sequence
  Description of Artificial Sequence: Synthetic oligonucleotide
  Target: ATXN1; (-) strand; PAM type: YTN; PAM sequence: TTA
tcttaaaccttgtattccaa

SEQ ID NO: 217320 - DNA, 20 bp, Artificial Sequence
  Description of Artificial Sequence: Synthetic oligonucleotide
  Target: ATXN1; (-) strand; PAM type: YTN; PAM sequence: CTT
atcttaaaccttgtattcca

SEQ ID NO: 217321 - DNA, 20 bp, Artificial Sequence
  Description of Artificial Sequence: Synthetic oligonucleotide
  Target: ATXN1; (-) strand; PAM type: YTN; PAM sequence: TTG
acttatcttaaaccttgtat

SEQ ID NO: 217322 - DNA, 20 bp, Artificial Sequence
  Description of Artificial Sequence: Synthetic oligonucleotide
  Target: ATXN1; (-) strand; PAM type: YTN; PAM sequence: TTC
atgaagacagaaattgactt

SEQ ID NO: 217323 - DNA, 20 bp, Artificial Sequence
  Description of Artificial Sequence: Synthetic oligonucleotide
  Target: ATXN1; (-) strand; PAM type: YTN; PAM sequence: TTG
gtaaatgattcatgaagaca

SEQ ID NO: 217324 - DNA, 20 bp, Artificial Sequence
  Description of Artificial Sequence: Synthetic oligonucleotide
  Target: ATXN1; (-) strand; PAM type: YTN; PAM sequence: CTT
ggtaaatgattcatgaagac

SEQ ID NO: 217325 - DNA, 20 bp, Artificial Sequence
  Description of Artificial Sequence: Synthetic oligonucleotide
  Target: ATXN1; (-) strand; PAM type: YTN; PAM sequence: CTA
tcttggtaaatgattcatga

SEQ ID NO: 217326 - DNA, 20 bp, Artificial Sequence
  Description of Artificial Sequence: Synthetic oligonucleotide
  Target: ATXN1; (-) strand; PAM type: YTN; PAM sequence: CTC
atatagctatcttggtaaat

SEQ ID NO: 217327 - DNA, 20 bp, Artificial Sequence
  Description of Artificial Sequence: Synthetic oligonucleotide
  Target: ATXN1; (-) strand; PAM type: YTN; PAM sequence: CTG
ctcatatagctatcttggta

SEQ ID NO: 217328 - DNA, 20 bp, Artificial Sequence
  Description of Artificial Sequence: Synthetic oligonucleotide
  Target: ATXN1; (-) strand; PAM type: YTN; PAM sequence: TTC
tgctcatatagctatcttgg

SEQ ID NO: 217329 - DNA, 20 bp, Artificial Sequence
  Description of Artificial Sequence: Synthetic oligonucleotide
  Target: ATXN1; (-) strand; PAM type: YTN; PAM sequence: TTT
ctgctcatatagctatcttg

SEQ ID NO: 217330 - DNA, 20 bp, Artificial Sequence
  Description of Artificial Sequence: Synthetic oligonucleotide
  Target: ATXN1; (-) strand; PAM type: YTN; PAM sequence: TTT
tctgctcatatagctatctt

SEQ ID NO: 217331 - DNA, 20 bp, Artificial Sequence
  Description of Artificial Sequence: Synthetic oligonucleotide
  Target: ATXN1; (-) strand; PAM type: YTN; PAM sequence: TTG
caattttctgctcatatagc

SEQ ID NO: 217332 - DNA, 20 bp, Artificial Sequence
  Description of Artificial Sequence: Synthetic oligonucleotide
  Target: ATXN1; (-) strand; PAM type: YTN; PAM sequence: TTA
tattgcaattttctgctcat

SEQ ID NO: 217333 - DNA, 20 bp, Artificial Sequence
  Description of Artificial Sequence: Synthetic oligonucleotide
  Target: ATXN1; (-) strand; PAM type: YTN; PAM sequence: CTA
ttatattgcaattttctgct

SEQ ID NO: 217334 - DNA, 20 bp, Artificial Sequence
  Description of Artificial Sequence: Synthetic oligonucleotide
  Target: ATXN1; (-) strand; PAM type: YTN; PAM sequence: TTA
ccgctattatattgcaattt

SEQ ID NO: 217335 - DNA, 20 bp, Artificial Sequence
  Description of Artificial Sequence: Synthetic oligonucleotide
  Target: ATXN1; (-) strand; PAM type: YTN; PAM sequence: CTG
tgttaccgctattatattgc

SEQ ID NO: 217336 - DNA, 20 bp, Artificial Sequence
  Description of Artificial Sequence: Synthetic oligonucleotide
  Target: ATXN1; (-) strand; PAM type: YTN; PAM sequence: TTG
ctgtgttaccgctattatat

SEQ ID NO: 217337 - DNA, 20 bp, Artificial Sequence
  Description of Artificial Sequence: Synthetic oligonucleotide
  Target: ATXN1; (-) strand; PAM type: YTN; PAM sequence: CTT
gctgtgttaccgctattata

SEQ ID NO: 217338 - DNA, 20 bp, Artificial Sequence
  Description of Artificial Sequence: Synthetic oligonucleotide
  Target: ATXN1; (-) strand; PAM type: YTN; PAM sequence: CTC
ttgctgtgttaccgctatta

SEQ ID NO: 217339 - DNA, 20 bp, Artificial Sequence
  Description of Artificial Sequence: Synthetic oligonucleotide
  Target: ATXN1; (-) strand; PAM type: YTN; PAM sequence: TTA
tcctcttgctgtgttaccgc

SEQ ID NO: 217340 - DNA, 20 bp, Artificial Sequence
  Description of Artificial Sequence: Synthetic oligonucleotide
  Target: ATXN1; (-) strand; PAM type: YTN; PAM sequence: CTC
aaggaaaaaaaaaaacaaaa

SEQ ID NO: 217341 - DNA, 20 bp, Artificial Sequence
  Description of Artificial Sequence: Synthetic oligonucleotide
  Target: ATXN1; (-) strand; PAM type: YTN; PAM sequence: CTC
gtctcaaggaaaaaaaaaaa

SEQ ID NO: 217342 - DNA, 20 bp, Artificial Sequence
  Description of Artificial Sequence: Synthetic oligonucleotide
  Target: ATXN1; (-) strand; PAM type: YTN; PAM sequence: CTG
ggcaacagatagagagctcg

SEQ ID NO: 217343 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcaacagataga

SEQ ID NO: 217344 - DNA, 20 bp, Artificial Sequence
  Description of Artificial Sequence: Synthetic oligonucleotide
  Target: ATXN1; (-) strand; PAM type: YTN; PAM sequence: TTC
cactccagcctgggcaacag

SEQ ID NO: 217345 - DNA, 20 bp, Artificial Sequence
  Description of Artificial Sequence: Synthetic oligonucleotide
  Target: ATXN1; (-) strand; PAM type: YTN; PAM sequence: CTG
caccattccactccagcctg

SEQ ID NO: 217346 - DNA, 20 bp, Artificial Sequence
  Description of Artificial Sequence: Synthetic oligonucleotide
  Target: ATXN1; (-) strand; PAM type: YTN; PAM sequence: TTA
gactgcaccattccactcca

SEQ ID NO: 217347 - DNA, 20 bp, Artificial Sequence
  Description of Artificial Sequence: Synthetic oligonucleotide
  Target: ATXN1; (-) strand; PAM type: YTN; PAM sequence: TTT
agactgcaccattccactcc

SEQ ID NO: 217348 - DNA, 20 bp, Artificial Sequence
  Description of Artificial Sequence: Synthetic oligonucleotide
  Target: ATXN1; (-) strand; PAM type: YTN; PAM sequence: TTG
agcccagaaagtttagactg

SEQ ID NO: 217349 - DNA, 20 bp, Artificial Sequence
  Description of Artificial Sequence: Synthetic oligonucleotide
  Target: ATXN1; (-) strand; PAM type: YTN; PAM sequence: CTT
gagcccagaaagtttagact

SEQ ID NO: 217350 - DNA, 20 bp, Artificial Sequence
  Description of Artificial Sequence: Synthetic oligonucleotide
  Target: ATXN1; (-) strand; PAM type: YTN; PAM sequence: TTC
ttgagcccagaaagtttaga

SEQ ID NO: 217351 - DNA, 20 bp, Artificial Sequence
  Description of Artificial Sequence: Synthetic oligonucleotide
  Target: ATXN1; (-) strand; PAM type: YTN; PAM sequence: TTT
cttgagcccagaaagtttag

SEQ ID NO: 217352 - DNA, 20 bp, Artificial Sequence
  Description of Artificial Sequence: Synthetic oligonucleotide
  Target: ATXN1; (-) strand; PAM type: YTN; PAM sequence: CTG
agggaagaggatttcttgag

SEQ ID NO: 217353 - DNA, 20 bp, Artificial Sequence
  Description of Artificial Sequence: Synthetic oligonucleotide
  Target: ATXN1; (-) strand; PAM type: YTN; PAM sequence: TTG
agaggctgagggaagaggat

SEQ ID NO: 217354 - DNA, 20 bp, Artificial Sequence
  Description of Artificial Sequence: Synthetic oligonucleotide
  Target: ATXN1; (-) strand; PAM type: YTN; PAM sequence: TTT
gagaggctgagggaagagga

SEQ ID NO: 217355 - DNA, 20 bp, Artificial Sequence
  Description of Artificial Sequence: Synthetic oligonucleotide
  Target: ATXN1; (-) strand; PAM type: YTN; PAM sequence: TTT
tgagaggctgagggaagagg

SEQ ID NO: 217356 - DNA, 20 bp, Artificial Sequence
  Description of Artificial Sequence: Synthetic oligonucleotide
  Target: ATXN1; (-) strand; PAM type: YTN; PAM sequence: CTG
taatgtcagcattttgagag

SEQ ID NO: 217357 - DNA, 20 bp, Artificial Sequence
  Description of Artificial Sequence: Synthetic oligonucleotide
  Target: ATXN1; (-) strand; PAM type: YTN; PAM sequence: CTC
acatctgtaatgtcagcatt

SEQ ID NO: 217358 - DNA, 20 bp, Artificial Sequence
  Description of Artificial Sequence: Synthetic oligonucleotide
  Target: ATXN1; (-) strand; PAM type: YTN; PAM sequence: CTG
gccaagcatggtgtctcaca

SEQ ID NO: 217359 - DNA, 20 bp, Artificial Sequence
  Description of Artificial Sequence: Synthetic oligonucleotide
  Target: ATXN1; (-) strand; PAM type: YTN; PAM sequence: TTC
ctggccaagcatggtgtctc

SEQ ID NO: 217360 - DNA, 20 bp, Artificial Sequence
  Description of Artificial Sequence: Synthetic oligonucleotide
  Target: ATXN1; (-) strand; PAM type: YTN; PAM sequence: TTG
aaattcctggccaagcatgg

SEQ ID NO: 217361 - DNA, 20 bp, Artificial Sequence
  Description of Artificial Sequence: Synthetic oligonucleotide
  Target: ATXN1; (-) strand; PAM type: YTN; PAM sequence: CTA
attgaaattcctggccaagc

SEQ ID NO: 217362 - DNA, 20 bp, Artificial Sequence
  Description of Artificial Sequence: Synthetic oligonucleotide
  Target: ATXN1; (-) strand; PAM type: YTN; PAM sequence: TTG
aggcctaattgaaattcctg

SEQ ID NO: 217363 - DNA, 20 bp, Artificial Sequence
  Description of Artificial Sequence: Synthetic oligonucleotide
  Target: ATXN1; (-) strand; PAM type: YTN; PAM sequence: TTC
gttgaggcctaattgaaatt

SEQ ID NO: 217364 - DNA, 20 bp, Artificial Sequence
  Description of Artificial Sequence: Synthetic oligonucleotide
  Target: ATXN1; (-) strand; PAM type: YTN; PAM sequence: CTC
attcgttgaggcctaattga

SEQ ID NO: 217365 - DNA, 20 bp, Artificial Sequence
  Description of Artificial Sequence: Synthetic oligonucleotide
  Target: ATXN1; (-) strand; PAM type: YTN; PAM sequence: CTC
ccactcattcgttgaggcct

SEQ ID NO: 217366 - DNA, 20 bp, Artificial Sequence
  Description of Artificial Sequence: Synthetic oligonucleotide
  Target: ATXN1; (-) strand; PAM type: YTN; PAM sequence: CTG
gtaaactcccactcattcgt

SEQ ID NO: 217367 - DNA, 20 bp, Artificial Sequence
  Description of Artificial Sequence: Synthetic oligonucleotide
  Target: ATXN1; (-) strand; PAM type: YTN; PAM sequence: CTG
cctggtaaactcccactcat

SEQ ID NO: 217368 - DNA, 20 bp, Artificial Sequence
  Description of Artificial Sequence: Synthetic oligonucleotide
  Target: ATXN1; (-) strand; PAM type: YTN; PAM sequence: CTC
tgcctggtaaactcccactc

SEQ ID NO: 217369 - DNA, 20 bp, Artificial Sequence
  Description of Artificial Sequence: Synthetic oligonucleotide
  Target: ATXN1; (-) strand; PAM type: YTN; PAM sequence: TTC
tctgcctggtaaactcccac

SEQ ID NO: 217370 - DNA, 20 bp, Artificial Sequence
  Description of Artificial Sequence: Synthetic oligonucleotide
  Target: ATXN1; (-) strand; PAM type: YTN; PAM sequence: TTG
ttctctgcctggtaaactcc

SEQ ID NO: 217371 - DNA, 20 bp, Artificial Sequence
  Description of Artificial Sequence: Synthetic oligonucleotide
  Target: ATXN1; (-) strand; PAM type: YTN; PAM sequence: CTT
gttctctgcctggtaaactc

SEQ ID NO: 217372 - DNA, 20 bp, Artificial Sequence
  Description of Artificial Sequence: Synthetic oligonucleotide
  Target: ATXN1; (-) strand; PAM type: YTN; PAM sequence: CTC
ttgttctctgcctggtaaac

SEQ ID NO: 217373 - DNA, 20 bp, Artificial Sequence
  Description of Artificial Sequence: Synthetic oligonucleotide
  Target: ATXN1; (-) strand; PAM type: YTN; PAM sequence: CTC
gcatgagactcttgttctct

SEQ ID NO: 217374 - DNA, 20 bp, Artificial Sequence
  Description of Artificial Sequence: Synthetic oligonucleotide
  Target: ATXN1; (-) strand; PAM type: YTN; PAM sequence: TTC
tcgcatgagactcttgttct

SEQ ID NO: 217375 - DNA, 20 bp, Artificial Sequence
  Description of Artificial Sequence: Synthetic oligonucleotide
  Target: ATXN1; (-) strand; PAM type: YTN; PAM sequence: CTT
ctcgcatgagactcttgttc

SEQ ID NO: 217376 - DNA, 20 bp, Artificial Sequence
  Description of Artificial Sequence: Synthetic oligonucleotide
  Target: ATXN1; (-) strand; PAM type: YTN; PAM sequence: TTC
ttctcgcatgagactcttgt

SEQ ID NO: 217377 - DNA, 20 bp, Artificial Sequence
  Description of Artificial Sequence: Synthetic oligonucleotide
  Target: ATXN1; (-) strand; PAM type: YTN; PAM sequence: TTT
cttctcgcatgagactcttg

SEQ ID NO: 217378 - DNA, 20 bp, Artificial Sequence
  Description of Artificial Sequence: Synthetic oligonucleotide
  Target: ATXN1; (-) strand; PAM type: YTN; PAM sequence: TTG
tttcttctcgcatgagactc

SEQ ID NO: 217379 - DNA, 20 bp, Artificial Sequence
  Description of Artificial Sequence: Synthetic oligonucleotide
  Target: ATXN1; (-) strand; PAM type: YTN; PAM sequence: CTG
ttgtttcttctcgcatgaga

SEQ ID NO: 217380 - DNA, 20 bp, Artificial Sequence
  Description of Artificial Sequence: Synthetic oligonucleotide
  Target: ATXN1; (-) strand; PAM type: YTN; PAM sequence: CTG
tccctgttgtttcttctcgc

SEQ ID NO: 217381 - DNA, 20 bp, Artificial Sequence
  Description of Artificial Sequence: Synthetic oligonucleotide
  Target: ATXN1; (-) strand; PAM type: YTN; PAM sequence: CTA
tgtatataataaccatgcac

SEQ ID NO: 217382 - DNA, 20 bp, Artificial Sequence
  Description of Artificial Sequence: Synthetic oligonucleotide
  Target: ATXN1; (-) strand; PAM type: YTN; PAM sequence: TTA
aacatactatgtatataata

SEQ ID NO: 217383 - DNA, 20 bp, Artificial Sequence
  Description of Artificial Sequence: Synthetic oligonucleotide
  Target: ATXN1; (-) strand; PAM type: YTN; PAM sequence: CTT
aaacatactatgtatataat

SEQ ID NO: 217384 - DNA, 20 bp, Artificial Sequence
  Description of Artificial Sequence: Synthetic oligonucleotide
  Target: ATXN1; (-) strand; PAM type: YTN; PAM sequence: TTC
ttaaacatactatgtatata

SEQ ID NO: 217385 - DNA, 20 bp, Artificial Sequence
  Description of Artificial Sequence: Synthetic oligonucleotide
  Target: ATXN1; (-) strand; PAM type: YTN; PAM sequence: CTT
cttaaacatactatgtatat

SEQ ID NO: 217386 - DNA, 20 bp, Artificial Sequence
  Description of Artificial Sequence: Synthetic oligonucleotide
  Target: ATXN1; (-) strand; PAM type: YTN; PAM sequence: TTC
ttcttaaacatactatgtat

SEQ ID NO: 217387 - DNA, 20 bp, Artificial Sequence
  Description of Artificial Sequence: Synthetic oligonucleotide
  Target: ATXN1; (-) strand; PAM type: YTN; PAM sequence: TTT
cttcttaaacatactatgta

SEQ ID NO: 217388 - DNA, 20 bp, Artificial Sequence
  Description of Artificial Sequence: Synthetic oligonucleotide
  Target: ATXN1; (-) strand; PAM type: YTN; PAM sequence: TTT
tcttcttaaacatactatgt

SEQ ID NO: 217389 - DNA, 20 bp, Artificial Sequence
  Description of Artificial Sequence: Synthetic oligonucleotide
  Target: ATXN1; (-) strand; PAM type: YTN; PAM sequence: TTG
ttttcttcttaaacatacta

SEQ ID NO: 217390 - DNA, 20 bp, Artificial Sequence
  Description of Artificial Sequence: Synthetic oligonucleotide
  Target: ATXN1; (-) strand; PAM type: YTN; PAM sequence: TTT
gttttcttcttaaacatact

SEQ ID NO: 217391 - DNA, 20 bp, Artificial Sequence
  Description of Artificial Sequence: Synthetic oligonucleotide
  Target: ATXN1; (-) strand; PAM type: YTN; PAM sequence: CTC
catataatatttgttttctt

SEQ ID NO: 217392 - DNA, 20 bp, Artificial Sequence
  Description of Artificial Sequence: Synthetic oligonucleotide
  Target: ATXN1; (-) strand; PAM type: YTN; PAM sequence: CTC
tccatataatatttgttttc

SEQ ID NO: 217393 - DNA, 20 bp, Artificial Sequence
  Description of Artificial Sequence: Synthetic oligonucleotide
  Target: ATXN1; (-) strand; PAM type: YTN; PAM sequence: TTC
catctctccatataatattt

SEQ ID NO: 217394 - DNA, 20 bp, Artificial Sequence
  Description of Artificial Sequence: Synthetic oligonucleotide
  Target: ATXN1; (-) strand; PAM type: YTN; PAM sequence: CTT
ccatctctccatataatatt

SEQ ID NO: 217395 - DNA, 20 bp, Artificial Sequence
  Description of Artificial Sequence: Synthetic oligonucleotide
  Target: ATXN1; (-) strand; PAM type: YTN; PAM sequence: CTC
ccatcccttccatctctcca

SEQ ID NO: 217396 - DNA, 20 bp, Artificial Sequence
  Description of Artificial Sequence: Synthetic oligonucleotide
  Target: ATXN1; (-) strand; PAM type: YTN; PAM sequence: CTC
ccgtgactcccatcccttcc

SEQ ID NO: 217397 - DNA, 20 bp, Artificial Sequence
  Description of Artificial Sequence: Synthetic oligonucleotide
  Target: ATXN1; (-) strand; PAM type: YTN; PAM sequence: CTC
atctcccgtgactcccatcc

SEQ ID NO: 217398 - DNA, 20 bp, Artificial Sequence
  Description of Artificial Sequence: Synthetic oligonucleotide
  Target: ATXN1; (-) strand; PAM type: YTN; PAM sequence: TTA
aatctcatctcccgtgactc

SEQ ID NO: 217399 - DNA, 20 bp, Artificial Sequence
  Description of Artificial Sequence: Synthetic oligonucleotide
  Target: ATXN1; (-) strand; PAM type: YTN; PAM sequence: TTT
aaatctcatctcccgtgact

SEQ ID NO: 217400 - DNA, 20 bp, Artificial Sequence
  Description of Artificial Sequence: Synthetic oligonucleotide
  Target: ATXN1; (-) strand; PAM type: YTN; PAM sequence: TTA
ccatttaaatctcatctccc

SEQ ID NO: 217401 - DNA, 20 bp, Artificial Sequence
  Description of Artificial Sequence: Synthetic oligonucleotide
  Target: ATXN1; (-) strand; PAM type: YTN; PAM sequence: CTT
accatttaaatctcatctcc

SEQ ID NO: 217402 - DNA, 20 bp, Artificial Sequence
  Description of Artificial Sequence: Synthetic oligonucleotide
  Target: ATXN1; (-) strand; PAM type: YTN; PAM sequence: TTA
tcaacttaccatttaaatct

SEQ ID NO: 217403 - DNA, 20 bp, Artificial Sequence
  Description of Artificial Sequence: Synthetic oligonucleotide
  Target: ATXN1; (-) strand; PAM type: YTN; PAM sequence: CTT
atcaacttaccatttaaatc

SEQ ID NO: 217404 - DNA, 20 bp, Artificial Sequence
  Description of Artificial Sequence: Synthetic oligonucleotide
  Target: ATXN1; (-) strand; PAM type: YTN; PAM sequence: TTC
cttatcaacttaccatttaa

SEQ ID NO: 217405 - DNA, 20 bp, Artificial Sequence
  Description of Artificial Sequence: Synthetic oligonucleotide
  Target: ATXN1; (-) strand; PAM type: YTN; PAM sequence: CTA
ggaattccttatcaacttac

SEQ ID NO: 217406 - DNA, 20 bp, Artificial Sequence
  Description of Artificial Sequence: Synthetic oligonucleotide
  Target: ATXN1; (-) strand; PAM type: YTN; PAM sequence: CTA
aggcccctaggaattcctta

SEQ ID NO: 217407 - DNA, 20 bp, Artificial Sequence
  Description of Artificial Sequence: Synthetic oligonucleotide
  Target: ATXN1; (-) strand; PAM type: YTN; PAM sequence: CTC
taaggcccctaggaattcct

SEQ ID NO: 217408 - DNA, 20 bp, Artificial Sequence
  Description of Artificial Sequence: Synthetic oligonucleotide
  Target: ATXN1; (-) strand; PAM type: YTN; PAM sequence: CTG
catggcctctaaggccccta

SEQ ID NO: 217409 - DNA, 20 bp, Artificial Sequence
  Description of Artificial Sequence: Synthetic oligonucleotide
  Target: ATXN1; (-) strand; PAM type: YTN; PAM sequence: TTC
actgcatggcctctaaggcc

SEQ ID NO: 217410 - DNA, 20 bp, Artificial Sequence
  Description of Artificial Sequence: Synthetic oligonucleotide
  Target: ATXN1; (-) strand; PAM type: YTN; PAM sequence: TTT
cactgcatggcctctaaggc

SEQ ID NO: 217411 - DNA, 20 bp, Artificial Sequence
  Description of Artificial Sequence: Synthetic oligonucleotide
  Target: ATXN1; (-) strand; PAM type: YTN; PAM sequence: CTG
ataaggtaaaatgtgaattt

SEQ ID NO: 217412 - DNA, 20 bp, Artificial Sequence
  Description of Artificial Sequence: Synthetic oligonucleotide
  Target: ATXN1; (-) strand; PAM type: YTN; PAM sequence: CTC
ctgataaggtaaaatgtgaa

SEQ ID NO: 217413 - DNA, 20 bp, Artificial Sequence
  Description of Artificial Sequence: Synthetic oligonucleotide
  Target: ATXN1; (-) strand; PAM type: YTN; PAM sequence: CTG
ctcctgataaggtaaaatgt

SEQ ID NO: 217414 - DNA, 20 bp, Artificial Sequence
  Description of Artificial Sequence: Synthetic oligonucleotide
  Target: ATXN1; (-) strand; PAM type: YTN; PAM sequence: TTC
tgctcctgataaggtaaaat

SEQ ID NO: 217415 - DNA, 20 bp, Artificial Sequence
  Description of Artificial Sequence: Synthetic oligonucleotide
  Target: ATXN1; (-) strand; PAM type: YTN; PAM sequence: TTT
ctgctcctgataaggtaaaa

SEQ ID NO: 217416 - DNA, 20 bp, Artificial Sequence
  Description of Artificial Sequence: Synthetic oligonucleotide
  Target: ATXN1; (-) strand; PAM type: YTN; PAM sequence: CTT
tctgctcctgataaggtaaa

SEQ ID NO: 217417 - DNA, 20 bp, Artificial Sequence
  Description of Artificial Sequence: Synthetic oligonucleotide
  Target: ATXN1; (-) strand; PAM type: YTN; PAM sequence: TTA
gctttctgctcctgataagg

SEQ ID NO: 217418 - DNA, 20 bp, Artificial Sequence
  Description of Artificial Sequence: Synthetic oligonucleotide
  Target: ATXN1; (-) strand; PAM type: YTN; PAM sequence: TTG
ttagctttctgctcctgata

SEQ ID NO: 217419 - DNA, 20 bp, Artificial Sequence
  Description of Artificial Sequence: Synthetic oligonucleotide
  Target: ATXN1; (-) strand; PAM type: YTN; PAM sequence: TTT
gttagctttctgctcctgat

SEQ ID NO: 217420 - DNA, 20 bp, Artificial Sequence
  Description of Artificial Sequence: Synthetic oligonucleotide
  Target: ATXN1; (-) strand; PAM type: YTN; PAM sequence: TTT
tgttagctttctgctcctga

SEQ ID NO: 217421 - DNA, 20 bp, Artificial Sequence
  Description of Artificial Sequence: Synthetic oligonucleotide
  Target: ATXN1; (-) strand; PAM type: YTN; PAM sequence: TTG
aaaggattttgttagctttc

SEQ ID NO: 217422 - DNA, 20 bp, Artificial Sequence
  Description of Artificial Sequence: Synthetic oligonucleotide
  Target: ATXN1; (-) strand; PAM type: YTN; PAM sequence: TTG
gtagcaaatgaatatggtga

SEQ ID NO: 217423 - DNA, 20 bp, Artificial Sequence
  Description of Artificial Sequence: Synthetic oligonucleotide
  Target: ATXN1; (-) strand; PAM type: YTN; PAM sequence: TTT
ggtagcaaatgaatatggtg

SEQ ID NO: 217424 - DNA, 20 bp, Artificial Sequence
  Description of Artificial Sequence: Synthetic oligonucleotide
  Target: ATXN1; (-) strand; PAM type: YTN; PAM sequence: CTT
tggtagcaaatgaatatggt

SEQ ID NO: 217425 - DNA, 20 bp, Artificial Sequence
  Description of Artificial Sequence: Synthetic oligonucleotide
  Target: ATXN1; (-) strand; PAM type: YTN; PAM sequence: CTC
ctttggtagcaaatgaatat

SEQ ID NO: 217426 - DNA, 20 bp, Artificial Sequence
  Description of Artificial Sequence: Synthetic oligonucleotide
  Target: ATXN1; (-) strand; PAM type: YTN; PAM sequence: TTA
atactcctttggtagcaaat

SEQ ID NO: 217427 - DNA, 20 bp, Artificial Sequence
  Description of Artificial Sequence: Synthetic oligonucleotide
  Target: ATXN1; (-) strand; PAM type: YTN; PAM sequence: TTT
aatactcctttggtagcaaa

SEQ ID NO: 217428 - DNA, 20 bp, Artificial Sequence
  Description of Artificial Sequence: Synthetic oligonucleotide
  Target: ATXN1; (-) strand; PAM type: YTN; PAM sequence: TTT
taatactcctttggtagcaa

SEQ ID NO: 217429 - DNA, 20 bp, Artificial Sequence
  Description of Artificial Sequence: Synthetic oligonucleotide
  Target: ATXN1; (-) strand; PAM type: YTN; PAM sequence: TTT
ttaatactcctttggtagca

SEQ ID NO: 217430 - DNA, 20 bp, Artificial Sequence
  Description of Artificial Sequence: Synthetic oligonucleotide
  Target: ATXN1; (-) strand; PAM type: YTN; PAM sequence: TTT
tttaatactcctttggtagc

SEQ ID NO: 217431 - DNA, 20 bp, Artificial Sequence
  Description of Artificial Sequence: Synthetic oligonucleotide
  Target: ATXN1; (-) strand; PAM type: YTN; PAM sequence: TTC
atgtgtgtgtgtgtttttta

SEQ ID NO: 217432 - DNA, 20 bp, Artificial Sequence
  Description of Artificial Sequence: Synthetic oligonucleotide
  Target: ATXN1; (-) strand; PAM type: YTN; PAM sequence: TTA
gggcaattcatgtgtgtgtg

SEQ ID NO: 217433 - DNA, 20 bp, Artificial Sequence
  Description of Artificial Sequence: Synthetic oligonucleotide
  Target: ATXN1; (-) strand; PAM type: YTN; PAM sequence: TTA
atattagggcaattcatgtg

SEQ ID NO: 217434 - DNA, 20 bp, Artificial Sequence
  Description of Artificial Sequence: Synthetic oligonucleotide
  Target: ATXN1; (-) strand; PAM type: YTN; PAM sequence: TTT
aatattagggcaattcatgt

SEQ ID NO: 217435 - DNA, 20 bp, Artificial Sequence
  Description of Artificial Sequence: Synthetic oligonucleotide
  Target: ATXN1; (-) strand; PAM type: YTN; PAM sequence: TTT
taatattagggcaattcatg

SEQ ID NO: 217436 - DNA, 20 bp, Artificial Sequence
  Description of Artificial Sequence: Synthetic oligonucleotide
  Target: ATXN1; (-) strand; PAM type: YTN; PAM sequence: TTT
ttaatattagggcaattcat

SEQ ID NO: 217437 - DNA, 20 bp, Artificial Sequence
  Description of Artificial Sequence: Synthetic oligonucleotide
  Target: ATXN1; (-) strand; PAM type: YTN; PAM sequence: CTA
gaagtaaagaaaacaagaat

SEQ ID NO: 217438 - DNA, 20 bp, Artificial Sequence
  Description of Artificial Sequence: Synthetic oligonucleotide
  Target: ATXN1; (-) strand; PAM type: YTN; PAM sequence: CTA
tccacaaaggctagaagtaa

SEQ ID NO: 217439 - DNA, 20 bp, Artificial Sequence
  Description of Artificial Sequence: Synthetic oligonucleotide
  Target: ATXN1; (-) strand; PAM type: YTN; PAM sequence: CTA
tgcctatccacaaaggctag

SEQ ID NO: 217440 - DNA, 20 bp, Artificial Sequence
  Description of Artificial Sequence: Synthetic oligonucleotide
  Target: ATXN1; (-) strand; PAM type: YTN; PAM sequence: TTA
caaagcagtgacaaaaatct

SEQ ID NO: 217441 - DNA, 20 bp, Artificial Sequence
  Description of Artificial Sequence: Synthetic oligonucleotide
  Target: ATXN1; (-) strand; PAM type: YTN; PAM sequence: TTG
attacaaagcagtgacaaaa

SEQ ID NO: 217442 - DNA, 20 bp, Artificial Sequence
  Description of Artificial Sequence: Synthetic oligonucleotide
  Target: ATXN1; (-) strand; PAM type: YTN; PAM sequence: TTG
tgcaaacacattgattacaa

SEQ ID NO: 217443 - DNA, 20 bp, Artificial Sequence
  Description of Artificial Sequence: Synthetic oligonucleotide
  Target: ATXN1; (-) strand; PAM type: YTN; PAM sequence: TTC
aaaattgtgcaaacacattg

SEQ ID NO: 217444 - DNA, 20 bp, Artificial Sequence
  Description of Artificial Sequence: Synthetic oligonucleotide
  Target: ATXN1; (-) strand; PAM type: YTN; PAM sequence: TTT
caaaattgtgcaaacacatt

SEQ ID NO: 217445 - DNA, 20 bp, Artificial Sequence
  Description of Artificial Sequence: Synthetic oligonucleotide
  Target: ATXN1; (-) strand; PAM type: YTN; PAM sequence: TTC
atatttcaaaattgtgcaaa

SEQ ID NO: 217446 - DNA, 20 bp, Artificial Sequence
  Description of Artificial Sequence: Synthetic oligonucleotide
  Target: ATXN1; (-) strand; PAM type: YTN; PAM sequence: TTA
agtataaaattcatatttca

SEQ ID NO: 217447 - DNA, 20 bp, Artificial Sequence
  Description of Artificial Sequence: Synthetic oligonucleotide
  Target: ATXN1; (-) strand; PAM type: YTN; PAM sequence: CTA
aacccaacaaatgttaagta

SEQ ID NO: 217448 - DNA, 20 bp, Artificial Sequence
  Description of Artificial Sequence: Synthetic oligonucleotide
  Target: ATXN1; (-) strand; PAM type: YTN; PAM sequence: TTC
ggctaaacccaacaaatgtt

SEQ ID NO: 217449 - DNA, 20 bp, Artificial Sequence
  Description of Artificial Sequence: Synthetic oligonucleotide
  Target: ATXN1; (-) strand; PAM type: YTN; PAM sequence: TTT
cggctaaacccaacaaatgt

SEQ ID NO: 217450 - DNA, 20 bp, Artificial Sequence
  Description of Artificial Sequence: Synthetic oligonucleotide
  Target: ATXN1; (-) strand; PAM type: YTN; PAM sequence: CTT
tcggctaaacccaacaaatg

SEQ ID NO: 217451 - DNA, 20 bp, Artificial Sequence
  Description of Artificial Sequence: Synthetic oligonucleotide
  Target: ATXN1; (-) strand; PAM type: YTN; PAM sequence: TTA
aaatatggaagaaggcagct

SEQ ID NO: 217452 - DNA, 20 bp, Artificial Sequence
  Description of Artificial Sequence: Synthetic oligonucleotide
  Target: ATXN1; (-) strand; PAM type: YTN; PAM sequence: CTT
aaaatatggaagaaggcagc

SEQ ID NO: 217453 - DNA, 20 bp, Artificial Sequence
  Description of Artificial Sequence: Synthetic oligonucleotide
  Target: ATXN1; (-) strand; PAM type: YTN; PAM sequence: TTA
ggccaaacttaaaatatgga

SEQ ID NO: 217454 - DNA, 20 bp, Artificial Sequence
  Description of Artificial Sequence: Synthetic oligonucleotide
  Target: ATXN1; (-) strand; PAM type: YTN; PAM sequence: TTT
aggccaaacttaaaatatgg

SEQ ID NO: 217455 - DNA, 20 bp, Artificial Sequence
  Description of Artificial Sequence: Synthetic oligonucleotide
  Target: ATXN1; (-) strand; PAM type: YTN; PAM sequence: CTT
taggccaaacttaaaatatg

SEQ ID NO: 217456 - DNA, 20 bp, Artificial Sequence
  Description of Artificial Sequence: Synthetic oligonucleotide
  Target: ATXN1; (-) strand; PAM type: YTN; PAM sequence: CTG
catgcggagaaacctttagg

SEQ ID NO: 217457 - DNA, 20 bp, Artificial Sequence
  Description of Artificial Sequence: Synthetic oligonucleotide
  Target: ATXN1; (-) strand; PAM type: YTN; PAM sequence: TTC
actgcatgcggagaaacctt

SEQ ID NO: 217458 - DNA, 20 bp, Artificial Sequence
  Description of Artificial Sequence: Synthetic oligonucleotide
  Target: ATXN1; (-) strand; PAM type: YTN; PAM sequence: TTA
cggttcactgcatgcggaga

SEQ ID NO: 217459 - DNA, 20 bp, Artificial Sequence
  Description of Artificial Sequence: Synthetic oligonucleotide
  Target: ATXN1; (-) strand; PAM type: YTN; PAM sequence: TTA
cacatccaggtaggttacgg

SEQ ID NO: 217460 - DNA, 20 bp, Artificial Sequence
  Description of Artificial Sequence: Synthetic oligonucleotide
  Target: ATXN1; (-) strand; PAM type: YTN; PAM sequence: TTT
acacatccaggtaggttacg

SEQ ID NO: 217461 - DNA, 20 bp, Artificial Sequence
  Description of Artificial Sequence: Synthetic oligonucleotide
  Target: ATXN1; (-) strand; PAM type: YTN; PAM sequence: CTG
tttacacatccaggtaggtt

SEQ ID NO: 217462 - DNA, 20 bp, Artificial Sequence
  Description of Artificial Sequence: Synthetic oligonucleotide
  Target: ATXN1; (-) strand; PAM type: YTN; PAM sequence: TTA
cagcctgtttacacatccag

SEQ ID NO: 217463 - DNA, 20 bp, Artificial Sequence
  Description of Artificial Sequence: Synthetic oligonucleotide
  Target: ATXN1; (-) strand; PAM type: YTN; PAM sequence: TTG
gtacaagaataggttacagc

SEQ ID NO: 217464 - DNA, 20 bp, Artificial Sequence
  Description of Artificial Sequence: Synthetic oligonucleotide
  Target: ATXN1; (-) strand; PAM type: YTN; PAM sequence: TTC
gccgaaacccagagattggt

SEQ ID NO: 217465 - DNA, 20 bp, Artificial Sequence
  Description of Artificial Sequence: Synthetic oligonucleotide
  Target: ATXN1; (-) strand; PAM type: YTN; PAM sequence: CTG
tgattcgccgaaacccagag

SEQ ID NO: 217466 - DNA, 20 bp, Artificial Sequence
  Description of Artificial Sequence: Synthetic oligonucleotide
  Target: ATXN1; (-) strand; PAM type: YTN; PAM sequence: CTG
cctgtgattcgccgaaaccc

SEQ ID NO: 217467 - DNA, 20 bp, Artificial Sequence
  Description of Artificial Sequence: Synthetic oligonucleotide
  Target: ATXN1; (-) strand; PAM type: YTN; PAM sequence: TTG
aacgataggctgcctgtgat

SEQ ID NO: 217468 - DNA, 20 bp, Artificial Sequence
  Description of Artificial Sequence: Synthetic oligonucleotide
  Target: ATXN1; (-) strand; PAM type: YTN; PAM sequence: TTT
gaacgataggctgcctgtga

SEQ ID NO: 217469 - DNA, 20 bp, Artificial Sequence
  Description of Artificial Sequence: Synthetic oligonucleotide
  Target: ATXN1; (-) strand; PAM type: YTN; PAM sequence: TTG
aacagggtttgaacgatagg

SEQ ID NO: 217470 - DNA, 20 bp, Artificial Sequence
  Description of Artificial Sequence: Synthetic oligonucleotide
  Target: ATXN1; (-) strand; PAM type: YTN; PAM sequence: TTT
gaacagggtttgaacgatag

SEQ ID NO: 217471 - DNA, 20 bp, Artificial Sequence
  Description of Artificial Sequence: Synthetic oligonucleotide
  Target: ATXN1; (-) strand; PAM type: YTN; PAM sequence: TTA
tttgaacagggtttgaacga

SEQ ID NO: 217472 - DNA, 20 bp, Artificial Sequence
  Description of Artificial Sequence: Synthetic oligonucleotide
  Target: ATXN1; (-) strand; PAM type: YTN; PAM sequence: CTT
atttgaacagggtttgaacg

SEQ ID NO: 217473 - DNA, 20 bp, Artificial Sequence
  Description of Artificial Sequence: Synthetic oligonucleotide
  Target: ATXN1; (-) strand; PAM type: YTN; PAM sequence: TTC
gccttatttgaacagggttt

SEQ ID NO: 217474 - DNA, 20 bp, Artificial Sequence
  Description of Artificial Sequence: Synthetic oligonucleotide
  Target: ATXN1; (-) strand; PAM type: YTN; PAM sequence: CTC
agcgttcgccttatttgaac

SEQ ID NO: 217475 - DNA, 20 bp, Artificial Sequence
  Description of Artificial Sequence: Synthetic oligonucleotide
  Target: ATXN1; (-) strand; PAM type: YTN; PAM sequence: TTC
agctcagcgttcgccttatt

SEQ ID NO: 217476 - DNA, 20 bp, Artificial Sequence
  Description of Artificial Sequence: Synthetic oligonucleotide
  Target: ATXN1; (-) strand; PAM type: YTN; PAM sequence: TTT
cagctcagcgttcgccttat

SEQ ID NO: 217477 - DNA, 20 bp, Artificial Sequence
  Description of Artificial Sequence: Synthetic oligonucleotide
  Target: ATXN1; (-) strand; PAM type: YTN; PAM sequence: TTG
gtttcagctcagcgttcgcc

SEQ ID NO: 217478 - DNA, 20 bp, Artificial Sequence
  Description of Artificial Sequence: Synthetic oligonucleotide
  Target: ATXN1; (-) strand; PAM type: YTN; PAM sequence: TTA
tagacagaaaaaggaaaacg

SEQ ID NO: 217479 - DNA, 20 bp, Artificial Sequence
  Description of Artificial Sequence: Synthetic oligonucleotide
  Target: ATXN1; (-) strand; PAM type: YTN; PAM sequence: TTT
atagacagaaaaaggaaaac

SEQ ID NO: 217480 - DNA, 20 bp, Artificial Sequence
  Description of Artificial Sequence: Synthetic oligonucleotide
  Target: ATXN1; (-) strand; PAM type: YTN; PAM sequence: TTG
gagaggatttatagacagaa

SEQ ID NO: 217481 - DNA, 20 bp, Artificial Sequence
  Description of Artificial Sequence: Synthetic oligonucleotide
  Target: ATXN1; (-) strand; PAM type: YTN; PAM sequence: TTG
tgtggttggagaggatttat

SEQ ID NO: 217482 - DNA, 20 bp, Artificial Sequence
  Description of Artificial Sequence: Synthetic oligonucleotide
  Target: ATXN1; (-) strand; PAM type: YTN; PAM sequence: CTG
ttgtgtggttggagaggatt

SEQ ID NO: 217483 - DNA, 20 bp, Artificial Sequence
  Description of Artificial Sequence: Synthetic oligonucleotide
  Target: ATXN1; (-) strand; PAM type: YTN; PAM sequence: CTG
acatgctgttgtgtggttgg

SEQ ID NO: 217484 - DNA, 20 bp, Artificial Sequence
  Description of Artificial Sequence: Synthetic oligonucleotide
  Target: ATXN1; (-) strand; PAM type: YTN; PAM sequence: TTC
tgacatgctgttgtgtggtt

SEQ ID NO: 217485 - DNA, 20 bp, Artificial Sequence
  Description of Artificial Sequence: Synthetic oligonucleotide
  Target: ATXN1; (-) strand; PAM type: YTN; PAM sequence: TTT
ctgacatgctgttgtgtggt

SEQ ID NO: 217486 - DNA, 20 bp, Artificial Sequence
  Description of Artificial Sequence: Synthetic oligonucleotide
  Target: ATXN1; (-) strand; PAM type: YTN; PAM sequence: TTC
agggcatttctgacatgctg

SEQ ID NO: 217487 - DNA, 20 bp, Artificial Sequence
  Description of Artificial Sequence: Synthetic oligonucleotide
  Target: ATXN1; (-) strand; PAM type: YTN; PAM sequence: CTA
gaatagattcagggcatttc

SEQ ID NO: 217488 - DNA, 20 bp, Artificial Sequence
  Description of Artificial Sequence: Synthetic oligonucleotide
  Target: ATXN1; (-) strand; PAM type: YTN; PAM sequence: CTC
ccgaactagaatagattcag

SEQ ID NO: 217489 - DNA, 20 bp, Artificial Sequence
  Description of Artificial Sequence: Synthetic oligonucleotide
  Target: ATXN1; (-) strand; PAM type: YTN; PAM sequence: TTC
ctcccgaactagaatagatt

SEQ ID NO: 217490 - DNA, 20 bp, Artificial Sequence
  Description of Artificial Sequence: Synthetic oligonucleotide
  Target: ATXN1; (-) strand; PAM type: YTN; PAM sequence: TTT
cctcccgaactagaatagat

SEQ ID NO: 217491 - DNA, 20 bp, Artificial Sequence
  Description of Artificial Sequence: Synthetic oligonucleotide
  Target: ATXN1; (-) strand; PAM type: YTN; PAM sequence: CTT
tcctcccgaactagaataga

SEQ ID NO: 217492 - DNA, 20 bp, Artificial Sequence
  Description of Artificial Sequence: Synthetic oligonucleotide
  Target: ATXN1; (-) strand; PAM type: YTN; PAM sequence: CTC
ctttcctcccgaactagaat

SEQ ID NO: 217493 - DNA, 20 bp, Artificial Sequence
  Description of Artificial Sequence: Synthetic oligonucleotide
  Target: ATXN1; (-) strand; PAM type: YTN; PAM sequence: CTA
ctcctttcctcccgaactag

SEQ ID NO: 217494 - DNA, 20 bp, Artificial Sequence
  Description of Artificial Sequence: Synthetic oligonucleotide
  Target: ATXN1; (-) strand; PAM type: YTN; PAM sequence: CTC
tactcctttcctcccgaact

SEQ ID NO: 217495 - DNA, 20 bp, Artificial Sequence
  Description of Artificial Sequence: Synthetic oligonucleotide
  Target: ATXN1; (-) strand; PAM type: YTN; PAM sequence: CTC
tctactcctttcctcccgaa

SEQ ID NO: 217496 - DNA, 20 bp, Artificial Sequence
  Description of Artificial Sequence: Synthetic oligonucleotide
  Target: ATXN1; (-) strand; PAM type: YTN; PAM sequence: CTC
ctctctactcctttcctccc

SEQ ID NO: 217497 - DNA, 20 bp, Artificial Sequence
  Description of Artificial Sequence: Synthetic oligonucleotide
  Target: ATXN1; (-) strand; PAM type: YTN; PAM sequence: TTG
caaatcaggcagctcctctc

SEQ ID NO: 217498 - DNA, 20 bp, Artificial Sequence
  Description of Artificial Sequence: Synthetic oligonucleotide
  Target: ATXN1; (-) strand; PAM type: YTN; PAM sequence: TTT
gcaaatcaggcagctcctct

SEQ ID NO: 217499 - DNA, 20 bp, Artificial Sequence
  Description of Artificial Sequence: Synthetic oligonucleotide
  Target: ATXN1; (-) strand; PAM type: YTN; PAM sequence: CTA
tttgcaaatcaggcagctcc

SEQ ID NO: 217500 - DNA, 20 bp, Artificial Sequence
  Description of Artificial Sequence: Synthetic oligonucleotide
  Target: ATXN1; (-) strand; PAM type: YTN; PAM sequence: TTC
agcaaagaactatttgcaaa

SEQ ID NO: 217501 - DNA, 20 bp, Artificial Sequence
  Description of Artificial Sequence: Synthetic oligonucleotide
  Target: ATXN1; (-) strand; PAM type: YTN; PAM sequence: TTA
attcagcaaagaactatttg

SEQ ID NO: 217502 - DNA, 20 bp, Artificial Sequence
  Description of Artificial Sequence: Synthetic oligonucleotide
  Target: ATXN1; (-) strand; PAM type: YTN; PAM sequence: TTT
aattcagcaaagaactattt

SEQ ID NO: 217503 - DNA, 20 bp, Artificial Sequence
  Description of Artificial Sequence: Synthetic oligonucleotide
  Target: ATXN1; (-) strand; PAM type: YTN; PAM sequence: TTA
acagagtttaattcagcaaa

SEQ ID NO: 217504 - DNA, 20 bp, Artificial Sequence
  Description of Artificial Sequence: Synthetic oligonucleotide
  Target: ATXN1; (-) strand; PAM type: YTN; PAM sequence: TTT
aacagagtttaattcagcaa

SEQ ID NO: 217505 - DNA, 20 bp, Artificial Sequence
  Description of Artificial Sequence: Synthetic oligonucleotide
  Target: ATXN1; (-) strand; PAM type: YTN; PAM sequence: TTA
aatttaacagagtttaattc

SEQ ID NO: 217506 - DNA, 20 bp, Artificial Sequence
  Description of Artificial Sequence: Synthetic oligonucleotide
  Target: ATXN1; (-) strand; PAM type: YTN; PAM sequence: TTA
gacaaattaaatttaacaga

SEQ ID NO: 217507 - DNA, 20 bp, Artificial Sequence
  Description of Artificial Sequence: Synthetic oligonucleotide
  Target: ATXN1; (-) strand; PAM type: YTN; PAM sequence: TTT
agacaaattaaatttaacag

SEQ ID NO: 217508 - DNA, 20 bp, Artificial Sequence
  Description of Artificial Sequence: Synthetic oligonucleotide
  Target: ATXN1; (-) strand; PAM type: YTN; PAM sequence: CTT
tagacaaattaaatttaaca

SEQ ID NO: 217509 - DNA, 20 bp, Artificial Sequence
  Description of Artificial Sequence: Synthetic oligonucleotide
  Target: ATXN1; (-) strand; PAM type: YTN; PAM sequence: TTA
aaagaaaaactttagacaaa

SEQ ID NO: 217510 - DNA, 20 bp, Artificial Sequence
  Description of Artificial Sequence: Synthetic oligonucleotide
  Target: ATXN1; (-) strand; PAM type: YTN; PAM sequence: CTA
atgtgttaaaagaaaaactt

SEQ ID NO: 217511 - DNA, 20 bp, Artificial Sequence
  Description of Artificial Sequence: Synthetic oligonucleotide
  Target: ATXN1; (-) strand; PAM type: YTN; PAM sequence: CTC
ataatctaatgtgttaaaag

SEQ ID NO: 217512 - DNA, 20 bp, Artificial Sequence
  Description of Artificial Sequence: Synthetic oligonucleotide
  Target: ATXN1; (-) strand; PAM type: YTN; PAM sequence: TTG
gtagtatgtggaaatatgga

SEQ ID NO: 217513 - DNA, 20 bp, Artificial Sequence
  Description of Artificial Sequence: Synthetic oligonucleotide
  Target: ATXN1; (-) strand; PAM type: YTN; PAM sequence: CTT
ggtagtatgtggaaatatgg

SEQ ID NO: 217514 - DNA, 20 bp, Artificial Sequence
  Description of Artificial Sequence: Synthetic oligonucleotide
  Target: ATXN1; (-) strand; PAM type: YTN; PAM sequence: TTG
aaaatccttggtagtatgtg

SEQ ID NO: 217515 - DNA, 20 bp, Artificial Sequence
  Description of Artificial Sequence: Synthetic oligonucleotide
  Target: ATXN1; (-) strand; PAM type: YTN; PAM sequence: CTT
gaaaatccttggtagtatgt

SEQ ID NO: 217516 - DNA, 20 bp, Artificial Sequence
  Description of Artificial Sequence: Synthetic oligonucleotide
  Target: ATXN1; (-) strand; PAM type: YTN; PAM sequence: CTA
cacttgaaaatccttggtag

SEQ ID NO: 217517 - DNA, 20 bp, Artificial Sequence
  Description of Artificial Sequence: Synthetic oligonucleotide
  Target: ATXN1; (-) strand; PAM type: YTN; PAM sequence: CTC
ctacacttgaaaatccttgg

SEQ ID NO: 217518 - DNA, 20 bp, Artificial Sequence
  Description of Artificial Sequence: Synthetic oligonucleotide
  Target: ATXN1; (-) strand; PAM type: YTN; PAM sequence: TTA
ctcctacacttgaaaatcct

SEQ ID NO: 217519 - DNA, 20 bp, Artificial Sequence
  Description of Artificial Sequence: Synthetic oligonucleotide
  Target: ATXN1; (-) strand; PAM type: YTN; PAM sequence: TTG
aattactcctacacttgaaa

SEQ ID NO: 217520 - DNA, 20 bp, Artificial Sequence
  Description of Artificial Sequence: Synthetic oligonucleotide
  Target: ATXN1; (-) strand; PAM type: YTN; PAM sequence: CTG
attgaattactcctacactt

SEQ ID NO: 217521 - DNA, 20 bp, Artificial Sequence
  Description of Artificial Sequence: Synthetic oligonucleotide
  Target: ATXN1; (-) strand; PAM type: YTN; PAM sequence: CTC
atatgaaagaaagggtctga

SEQ ID NO: 217522 - DNA, 20 bp, Artificial Sequence
  Description of Artificial Sequence: Synthetic oligonucleotide
  Target: ATXN1; (-) strand; PAM type: YTN; PAM sequence: TTC
tcatatgaaagaaagggtct

SEQ ID NO: 217523 - DNA, 20 bp, Artificial Sequence
  Description of Artificial Sequence: Synthetic oligonucleotide
  Target: ATXN1; (-) strand; PAM type: YTN; PAM sequence: TTG
agaattctcatatgaaagaa

SEQ ID NO: 217524 - DNA, 20 bp, Artificial Sequence
  Description of Artificial Sequence: Synthetic oligonucleotide
  Target: ATXN1; (-) strand; PAM type: YTN; PAM sequence: TTT
gagaattctcatatgaaaga

SEQ ID NO: 217525 - DNA, 20 bp, Artificial Sequence
  Description of Artificial Sequence: Synthetic oligonucleotide
  Target: ATXN1; (-) strand; PAM type: YTN; PAM sequence: TTT
tgagaattctcatatgaaag

SEQ ID NO: 217526 - DNA, 20 bp, Artificial Sequence
  Description of Artificial Sequence: Synthetic oligonucleotide
  Target: ATXN1; (-) strand; PAM type: YTN; PAM sequence: CTT
ttgagaattctcatatgaaa

SEQ ID NO: 217527 - DNA, 20 bp, Artificial Sequence
  Description of Artificial Sequence: Synthetic oligonucleotide
  Target: ATXN1; (-) strand; PAM type: YTN; PAM sequence: CTC
ttttgagaattctcatatga

SEQ ID NO: 217528 - DNA, 20 bp, Artificial Sequence
  Description of Artificial Sequence: Synthetic oligonucleotide
  Target: ATXN1; (-) strand; PAM type: YTN; PAM sequence: CTA
ctcttttgagaattctcata

SEQ ID NO: 217529 - DNA, 20 bp, Artificial Sequence
  Description of Artificial Sequence: Synthetic oligonucleotide
  Target: ATXN1; (-) strand; PAM type: YTN; PAM sequence: TTC
tactcttttgagaattctca

SEQ ID NO: 217530 - DNA, 20 bp, Artificial Sequence
  Description of Artificial Sequence: Synthetic oligonucleotide
  Target: ATXN1; (-) strand; PAM type: YTN; PAM sequence: TTA
ttctactcttttgagaattc

SEQ ID NO: 217531 - DNA, 20 bp, Artificial Sequence
  Description of Artificial Sequence: Synthetic oligonucleotide
  Target: ATXN1; (-) strand; PAM type: YTN; PAM sequence: TTT
attctactcttttgagaatt

SEQ ID NO: 217532 - DNA, 20 bp, Artificial Sequence
  Description of Artificial Sequence: Synthetic oligonucleotide
  Target: ATXN1; (-) strand; PAM type: YTN; PAM sequence: TTC
catttattctactcttttga

SEQ ID NO: 217533 - DNA, 20 bp, Artificial Sequence
  Description of Artificial Sequence: Synthetic oligonucleotide
  Target: ATXN1; (-) strand; PAM type: YTN; PAM sequence: CTG
tgttccatttattctactct

SEQ ID NO: 217534 - DNA, 20 bp, Artificial Sequence
  Description of Artificial Sequence: Synthetic oligonucleotide
  Target: ATXN1; (-) strand; PAM type: YTN; PAM sequence: TTC
tgtgttccatttattctact

SEQ ID NO: 217535 - DNA, 20 bp, Artificial Sequence
  Description of Artificial Sequence: Synthetic oligonucleotide
  Target: ATXN1; (-) strand; PAM type: YTN; PAM sequence: TTT
ctgtgttccatttattctac

SEQ ID NO: 217536 - DNA, 20 bp, Artificial Sequence
  Description of Artificial Sequence: Synthetic oligonucleotide
  Target: ATXN1; (-) strand; PAM type: YTN; PAM sequence: CTT
tctgtgttccatttattcta

SEQ ID NO: 217537 - DNA, 20 bp, Artificial Sequence
  Description of Artificial Sequence: Synthetic oligonucleotide
  Target: ATXN1; (-) strand; PAM type: YTN; PAM sequence: TTC
tttctgtgttccatttattc

SEQ ID NO: 217538 - DNA, 20 bp, Artificial Sequence
  Description of Artificial Sequence: Synthetic oligonucleotide
  Target: ATXN1; (-) strand; PAM type: YTN; PAM sequence: TTT
ctttctgtgttccatttatt

SEQ ID NO: 217539 - DNA, 20 bp, Artificial Sequence
  Description of Artificial Sequence: Synthetic oligonucleotide
  Target: ATXN1; (-) strand; PAM type: YTN; PAM sequence: TTT
tctttctgtgttccatttat

SEQ ID NO: 217540 - DNA, 20 bp, Artificial Sequence
  Description of Artificial Sequence: Synthetic oligonucleotide
  Target: ATXN1; (-) strand; PAM type: YTN; PAM sequence: CTT
ttctttctgtgttccattta

SEQ ID NO: 217541 - DNA, 20 bp, Artificial Sequence
  Description of Artificial Sequence: Synthetic oligonucleotide
  Target: ATXN1; (-) strand; PAM type: YTN; PAM sequence: TTA
aagtcttttctttctgtgtt

SEQ ID NO: 217542 - DNA, 20 bp, Artificial Sequence
  Description of Artificial Sequence: Synthetic oligonucleotide
  Target: ATXN1; (-) strand; PAM type: YTN; PAM sequence: CTT
aaagtcttttctttctgtgt

SEQ ID NO: 217543 - DNA, 20 bp, Artificial Sequence
  Description of Artificial Sequence: Synthetic oligonucleotide
  Target: ATXN1; (-) strand; PAM type: YTN; PAM sequence: TTG
cttaaagtcttttctttctg

SEQ ID NO: 217544 - DNA, 20 bp, Artificial Sequence
  Description of Artificial Sequence: Synthetic oligonucleotide
  Target: ATXN1; (-) strand; PAM type: YTN; PAM sequence: CTT
gcttaaagtcttttctttct

SEQ ID NO: 217545 - DNA, 20 bp, Artificial Sequence
  Description of Artificial Sequence: Synthetic oligonucleotide
  Target: ATXN1; (-) strand; PAM type: YTN; PAM sequence: TTC
caagaagccccttgcttaaa

SEQ ID NO: 217546 - DNA, 20 bp, Artificial Sequence
  Description of Artificial Sequence: Synthetic oligonucleotide
  Target: ATXN1; (-) strand; PAM type: YTN; PAM sequence: CTT
ccaagaagccccttgcttaa

SEQ ID NO: 217547 - DNA, 20 bp, Artificial Sequence
  Description of Artificial Sequence: Synthetic oligonucleotide
  Target: ATXN1; (-) strand; PAM type: YTN; PAM sequence: CTG
cagtggcttccaagaagccc

SEQ ID NO: 217548 - DNA, 20 bp, Artificial Sequence
  Description of Artificial Sequence: Synthetic oligonucleotide
  Target: ATXN1; (-) strand; PAM type: YTN; PAM sequence: CTG
ctgcagtggcttccaagaag

SEQ ID NO: 217549 - DNA, 20 bp, Artificial Sequence
  Description of Artificial Sequence: Synthetic oligonucleotide
  Target: ATXN1; (-) strand; PAM type: YTN; PAM sequence: CTG
gactgctgcagtggcttcca

SEQ ID NO: 217550 - DNA, 20 bp, Artificial Sequence
  Description of Artificial Sequence: Synthetic oligonucleotide
  Target: ATXN1; (-) strand; PAM type: YTN; PAM sequence: TTG
cctggactgctgcagtggct

SEQ ID NO: 217551 - DNA, 20 bp, Artificial Sequence
  Description of Artificial Sequence: Synthetic oligonucleotide
  Target: ATXN1; (-) strand; PAM type: YTN; PAM sequence: CTT
gcctggactgctgcagtggc

SEQ ID NO: 217552 - DNA, 20 bp, Artificial Sequence
  Description of Artificial Sequence: Synthetic oligonucleotide
  Target: ATXN1; (-) strand; PAM type: YTN; PAM sequence: TTC
agcatcacttgcctggactg

SEQ ID NO: 217553 - DNA, 20 bp, Artificial Sequence
  Description of Artificial Sequence: Synthetic oligonucleotide
  Target: ATXN1; (-) strand; PAM type: YTN; PAM sequence: CTT
cagcatcacttgcctggact

SEQ ID NO: 217554 - DNA, 20 bp, Artificial Sequence
  Description of Artificial Sequence: Synthetic oligonucleotide
  Target: ATXN1; (-) strand; PAM type: YTN; PAM sequence: TTG
cagaccttcagcatcacttg

SEQ ID NO: 217555 - DNA, 20 bp, Artificial Sequence
  Description of Artificial Sequence: Synthetic oligonucleotide
  Target: ATXN1; (-) strand; PAM type: YTN; PAM sequence: CTG
ttgcagaccttcagcatcac

SEQ ID NO: 217556 - DNA, 20 bp, Artificial Sequence
  Description of Artificial Sequence: Synthetic oligonucleotide
  Target: ATXN1; (-) strand; PAM type: YTN; PAM sequence: TTC
tgttgcagaccttcagcatc

SEQ ID NO: 217557 - DNA, 20 bp, Artificial Sequence
  Description of Artificial Sequence: Synthetic oligonucleotide
  Target: ATXN1; (-) strand; PAM type: YTN; PAM sequence: CTG
ttctgttgcagaccttcagc

SEQ ID NO: 217558 - DNA, 20 bp, Artificial Sequence
  Description of Artificial Sequence: Synthetic oligonucleotide
  Target: ATXN1; (-) strand; PAM type: YTN; PAM sequence: CTC
gggcccctgttctgttgcag

SEQ ID NO: 217559 - DNA, 20 bp, Artificial Sequence
  Description of Artificial Sequence: Synthetic oligonucleotide
  Target: ATXN1; (-) strand; PAM type: YTN; PAM sequence: CTC
tcgggcccctgttctgttgc

SEQ ID NO: 217560 - DNA, 20 bp, Artificial Sequence
  Description of Artificial Sequence: Synthetic oligonucleotide
  Target: ATXN1; (-) strand; PAM type: YTN; PAM sequence: CTC
cactctcgggcccctgttct

SEQ ID NO: 217561 - DNA, 20 bp, Artificial Sequence
  Description of Artificial Sequence: Synthetic oligonucleotide
  Target: ATXN1; (-) strand; PAM type: YTN; PAM sequence: TTC
tccactctcgggcccctgtt

SEQ ID NO: 217562 - DNA, 20 bp, Artificial Sequence
  Description of Artificial Sequence: Synthetic oligonucleotide
  Target: ATXN1; (-) strand; PAM type: YTN; PAM sequence: CTT
ctccactctcgggcccctgt

SEQ ID NO: 217563 - DNA, 20 bp, Artificial Sequence
  Description of Artificial Sequence: Synthetic oligonucleotide
  Target: ATXN1; (-) strand; PAM type: YTN; PAM sequence: CTC
ttctccactctcgggcccct

SEQ ID NO: 217564 - DNA, 20 bp, Artificial Sequence
  Description of Artificial Sequence: Synthetic oligonucleotide
  Target: ATXN1; (-) strand; PAM type: YTN; PAM sequence: TTA
cccactcttctccactctcg

SEQ ID NO: 217565 - DNA, 20 bp, Artificial Sequence
  Description of Artificial Sequence: Synthetic oligonucleotide
  Target: ATXN1; (-) strand; PAM type: YTN; PAM sequence: TTT
acccactcttctccactctc

SEQ ID NO: 217566 - DNA, 20 bp, Artificial Sequence
  Description of Artificial Sequence: Synthetic oligonucleotide
  Target: ATXN1; (-) strand; PAM type: YTN; PAM sequence: TTA
atatgatagtttacccactc

SEQ ID NO: 217567 - DNA, 20 bp, Artificial Sequence
  Description of Artificial Sequence: Synthetic oligonucleotide
  Target: ATXN1; (-) strand; PAM type: YTN; PAM sequence: TTT
aatatgatagtttacccact

SEQ ID NO: 217568 - DNA, 20 bp, Artificial Sequence
  Description of Artificial Sequence: Synthetic oligonucleotide
  Target: ATXN1; (-) strand; PAM type: YTN; PAM sequence: CTT
taatatgatagtttacccac

SEQ ID NO: 217569 - DNA, 20 bp, Artificial Sequence
  Description of Artificial Sequence: Synthetic oligonucleotide
  Target: ATXN1; (-) strand; PAM type: YTN; PAM sequence: CTC
tttaatatgatagtttaccc

SEQ ID NO: 217570 - DNA, 20 bp, Artificial Sequence
  Description of Artificial Sequence: Synthetic oligonucleotide
  Target: ATXN1; (-) strand; PAM type: YTN; PAM sequence: TTG
gcctctttaatatgatagtt

SEQ ID NO: 217571 - DNA, 20 bp, Artificial Sequence
  Description of Artificial Sequence: Synthetic oligonucleotide
  Target: ATXN1; (-) strand; PAM type: YTN; PAM sequence: TTT
ggcctctttaatatgatagt

SEQ ID NO: 217572 - DNA, 20 bp, Artificial Sequence
  Description of Artificial Sequence: Synthetic oligonucleotide
  Target: ATXN1; (-) strand; PAM type: YTN; PAM sequence: CTG
agtttggcctctttaatatg

SEQ ID NO: 217573 - DNA, 20 bp, Artificial Sequence
  Description of Artificial Sequence: Synthetic oligonucleotide
  Target: ATXN1; (-) strand; PAM type: YTN; PAM sequence: CTG
cccccagtctgagtttggcc

SEQ ID NO: 217574 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccactgcccc

SEQ ID NO: 217575 - DNA, 20 bp, Artificial Sequence
  Description of Artificial Sequence: Synthetic oligonucleotide
  Target: ATXN1; (-) strand; PAM type: YTN; PAM sequence: TTG
ggattacaggcgtgagccac

SEQ ID NO: 217576 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgttgggattacag

SEQ ID NO: 217577 - DNA, 20 bp, Artificial Sequence
  Description of Artificial Sequence: Synthetic oligonucleotide
  Target: ATXN1; (-) strand; PAM type: YTN; PAM sequence: CTA
agcctcccaaagtgttggga

SEQ ID NO: 217578 - DNA, 20 bp, Artificial Sequence
  Description of Artificial Sequence: Synthetic oligonucleotide
  Target: ATXN1; (-) strand; PAM type: YTN; PAM sequence: CTG
cctaagcctcccaaagtgtt

SEQ ID NO: 217579 - DNA, 20 bp, Artificial Sequence
  Description of Artificial Sequence: Synthetic oligonucleotide
  Target: ATXN1; (-) strand; PAM type: YTN; PAM sequence: CTC
atgatccgcctgcctaagcc

SEQ ID NO: 217580 - DNA, 20 bp, Artificial Sequence
  Description of Artificial Sequence: Synthetic oligonucleotide
  Target: ATXN1; (-) strand; PAM type: YTN; PAM sequence: CTG
acctcatgatccgcctgcct

SEQ ID NO: 217581 - DNA, 20 bp, Artificial Sequence
  Description of Artificial Sequence: Synthetic oligonucleotide
  Target: ATXN1; (-) strand; PAM type: YTN; PAM sequence: CTC
ctgacctcatgatccgcctg

SEQ ID NO: 217582 - DNA, 20 bp, Artificial Sequence
  Description of Artificial Sequence: Synthetic oligonucleotide
  Target: ATXN1; (-) strand; PAM type: YTN; PAM sequence: CTC
aaactcctgacctcatgatc

SEQ ID NO: 217583 - DNA, 20 bp, Artificial Sequence
  Description of Artificial Sequence: Synthetic oligonucleotide
  Target: ATXN1; (-) strand; PAM type: YTN; PAM sequence: TTG
gtctcaaactcctgacctca

SEQ ID NO: 217584 - DNA, 20 bp, Artificial Sequence
  Description of Artificial Sequence: Synthetic oligonucleotide
  Target: ATXN1; (-) strand; PAM type: YTN; PAM sequence: TTG
gtcaggttggtctcaaactc

SEQ ID NO: 217585 - DNA, 20 bp, Artificial Sequence
  Description of Artificial Sequence: Synthetic oligonucleotide
  Target: ATXN1; (-) strand; PAM type: YTN; PAM sequence: TTC
accatgttggtcaggttggt

SEQ ID NO: 217586 - DNA, 20 bp, Artificial Sequence
  Description of Artificial Sequence: Synthetic oligonucleotide
  Target: ATXN1; (-) strand; PAM type: YTN; PAM sequence: TTT
caccatgttggtcaggttgg

SEQ ID NO: 217587 - DNA, 20 bp, Artificial Sequence
  Description of Artificial Sequence: Synthetic oligonucleotide
  Target: ATXN1; (-) strand; PAM type: YTN; PAM sequence: TTG
gtagagatggggtttcacca

SEQ ID NO: 217588 - DNA, 20 bp, Artificial Sequence
  Description of Artificial Sequence: Synthetic oligonucleotide
  Target: ATXN1; (-) strand; PAM type: YTN; PAM sequence: TTT
ggtagagatggggtttcacc

SEQ ID NO: 217589 - DNA, 20 bp, Artificial Sequence
  Description of Artificial Sequence: Synthetic oligonucleotide
  Target: ATXN1; (-) strand; PAM type: YTN; PAM sequence: TTT
tggtagagatggggtttcac

SEQ ID NO: 217590 - DNA, 20 bp, Artificial Sequence
  Description of Artificial Sequence: Synthetic oligonucleotide
  Target: ATXN1; (-) strand; PAM type: YTN; PAM sequence: TTT
ttggtagagatggggtttca

SEQ ID NO: 217591 - DNA, 20 bp, Artificial Sequence
  Description of Artificial Sequence: Synthetic oligonucleotide
  Target: ATXN1; (-) strand; PAM type: YTN; PAM sequence: TTG
tatttttggtagagatgggg

SEQ ID NO: 217592 - DNA, 20 bp, Artificial Sequence
  Description of Artificial Sequence: Synthetic oligonucleotide
  Target: ATXN1; (-) strand; PAM type: YTN; PAM sequence: TTT
gtatttttggtagagatggg

SEQ ID NO: 217593 - DNA, 20 bp, Artificial Sequence
  Description of Artificial Sequence: Synthetic oligonucleotide
  Target: ATXN1; (-) strand; PAM type: YTN; PAM sequence: TTT
tgtatttttggtagagatgg

SEQ ID NO: 217594 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttggtagagatg

SEQ ID NO: 217595 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttggtagagat

SEQ ID NO: 217596 - DNA, 20 bp, Artificial Sequence
  Description of Artificial Sequence: Synthetic oligonucleotide
  Target: ATXN1; (-) strand; PAM type: YTN; PAM sequence: CTA
attttttgtatttttggtag

SEQ ID NO: 217597 - DNA, 20 bp, Artificial Sequence
  Description of Artificial Sequence: Synthetic oligonucleotide
  Target: ATXN1; (-) strand; PAM type: YTN; PAM sequence: CTG
gctaattttttgtatttttg

SEQ ID NO: 217598 - DNA, 20 bp, Artificial Sequence
  Description of Artificial Sequence: Synthetic oligonucleotide
  Target: ATXN1; (-) strand; PAM type: YTN; PAM sequence: TTA
caggtgcgcaccaccacacc

SEQ ID NO: 217599 - DNA, 20 bp, Artificial Sequence
  Description of Artificial Sequence: Synthetic oligonucleotide
  Target: ATXN1; (-) strand; PAM type: YTN; PAM sequence: TTG
gattacaggtgcgcaccacc

SEQ ID NO: 217600 - DNA, 20 bp, Artificial Sequence
  Description of Artificial Sequence: Synthetic oligonucleotide
  Target: ATXN1; (-) strand; PAM type: YTN; PAM sequence: CTT
ggattacaggtgcgcaccac

SEQ ID NO: 217601 - DNA, 20 bp, Artificial Sequence
  Description of Artificial Sequence: Synthetic oligonucleotide
  Target: ATXN1; (-) strand; PAM type: YTN; PAM sequence: CTG
agtagcttggattacaggtg

SEQ ID NO: 217602 - DNA, 20 bp, Artificial Sequence
  Description of Artificial Sequence: Synthetic oligonucleotide
  Target: ATXN1; (-) strand; PAM type: YTN; PAM sequence: CTC
ctgagtagcttggattacag

SEQ ID NO: 217603 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagcttgga

SEQ ID NO: 217604 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagct

SEQ ID NO: 217605 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgagta

SEQ ID NO: 217606 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcctgag

SEQ ID NO: 217607 - DNA, 20 bp, Artificial Sequence
  Description of Artificial Sequence: Synthetic oligonucleotide
  Target: ATXN1; (-) strand; PAM type: YTN; PAM sequence: TTC
aagggattctcctgcctcag

SEQ ID NO: 217608 - DNA, 20 bp, Artificial Sequence
  Description of Artificial Sequence: Synthetic oligonucleotide
  Target: ATXN1; (-) strand; PAM type: YTN; PAM sequence: TTC
ccaggttcaagggattctcc

SEQ ID NO: 217609 - DNA, 20 bp, Artificial Sequence
  Description of Artificial Sequence: Synthetic oligonucleotide
  Target: ATXN1; (-) strand; PAM type: YTN; PAM sequence: CTT
cccaggttcaagggattctc

SEQ ID NO: 217610 - DNA, 20 bp, Artificial Sequence
  Description of Artificial Sequence: Synthetic oligonucleotide
  Target: ATXN1; (-) strand; PAM type: YTN; PAM sequence: CTG
cttcccaggttcaagggatt

SEQ ID NO: 217611 - DNA, 20 bp, Artificial Sequence
  Description of Artificial Sequence: Synthetic oligonucleotide
  Target: ATXN1; (-) strand; PAM type: YTN; PAM sequence: CTC
tgcttcccaggttcaaggga

SEQ ID NO: 217612 - DNA, 20 bp, Artificial Sequence
  Description of Artificial Sequence: Synthetic oligonucleotide
  Target: ATXN1; (-) strand; PAM type: YTN; PAM sequence: CTG
caacctctgcttcccaggtt

SEQ ID NO: 217613 - DNA, 20 bp, Artificial Sequence
  Description of Artificial Sequence: Synthetic oligonucleotide
  Target: ATXN1; (-) strand; PAM type: YTN; PAM sequence: TTA
ctgcaacctctgcttcccag

SEQ ID NO: 217614 - DNA, 20 bp, Artificial Sequence
  Description of Artificial Sequence: Synthetic oligonucleotide
  Target: ATXN1; (-) strand; PAM type: YTN; PAM sequence: CTT
actgcaacctctgcttccca

SEQ ID NO: 217615 - DNA, 20 bp, Artificial Sequence
  Description of Artificial Sequence: Synthetic oligonucleotide
  Target: ATXN1; (-) strand; PAM type: YTN; PAM sequence: CTC
agcttactgcaacctctgct

SEQ ID NO: 217616 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcaccatctc

SEQ ID NO: 217617 - DNA, 20 bp, Artificial Sequence
  Description of Artificial Sequence: Synthetic oligonucleotide
  Target: ATXN1; (-) strand; PAM type: YTN; PAM sequence: CTG
tcacccacgctggagtgcag

SEQ ID NO: 217618 - DNA, 20 bp, Artificial Sequence
  Description of Artificial Sequence: Synthetic oligonucleotide
  Target: ATXN1; (-) strand; PAM type: YTN; PAM sequence: CTC
tgtcacccacgctggagtgc

SEQ ID NO: 217619 - DNA, 20 bp, Artificial Sequence
  Description of Artificial Sequence: Synthetic oligonucleotide
  Target: ATXN1; (-) strand; PAM type: YTN; PAM sequence: CTC
tctgtcacccacgctggagt

SEQ ID NO: 217620 - DNA, 20 bp, Artificial Sequence
  Description of Artificial Sequence: Synthetic oligonucleotide
  Target: ATXN1; (-) strand; PAM type: YTN; PAM sequence: CTC
tctctgtcacccacgctgga

SEQ ID NO: 217621 - DNA, 20 bp, Artificial Sequence
  Description of Artificial Sequence: Synthetic oligonucleotide
  Target: ATXN1; (-) strand; PAM type: YTN; PAM sequence: TTG
agacagagtctctctctgtc

SEQ ID NO: 217622 - DNA, 20 bp, Artificial Sequence
  Description of Artificial Sequence: Synthetic oligonucleotide
  Target: ATXN1; (-) strand; PAM type: YTN; PAM sequence: TTT
gagacagagtctctctctgt

SEQ ID NO: 217623 - DNA, 20 bp, Artificial Sequence
  Description of Artificial Sequence: Synthetic oligonucleotide
  Target: ATXN1; (-) strand; PAM type: YTN; PAM sequence: TTT
tgagacagagtctctctctg

SEQ ID NO: 217624 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagtctctctct

SEQ ID NO: 217625 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagtctctctc

SEQ ID NO: 217626 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagtctctct

SEQ ID NO: 217627 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagtctctc

SEQ ID NO: 217628 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagagtctct

SEQ ID NO: 217629 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagagtctc

SEQ ID NO: 217630 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagagtct

SEQ ID NO: 217631 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacagagtc

SEQ ID NO: 217632 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacagagt

SEQ ID NO: 217633 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacagag

SEQ ID NO: 217634 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttgagacaga

SEQ ID NO: 217635 - DNA, 20 bp, Artificial Sequence
  Description of Artificial Sequence: Synthetic oligonucleotide
  Target: ATXN1; (-) strand; PAM type: YTN; PAM sequence: CTG
ccttttttttttttttgaga

SEQ ID NO: 217636 - DNA, 20 bp, Artificial Sequence
  Description of Artificial Sequence: Synthetic oligonucleotide
  Target: ATXN1; (-) strand; PAM type: YTN; PAM sequence: TTC
tgccttttttttttttttga

SEQ ID NO: 217637 - DNA, 20 bp, Artificial Sequence
  Description of Artificial Sequence: Synthetic oligonucleotide
  Target: ATXN1; (-) strand; PAM type: YTN; PAM sequence: CTG
gagttctgcctttttttttt

SEQ ID NO: 217638 - DNA, 20 bp, Artificial Sequence
  Description of Artificial Sequence: Synthetic oligonucleotide
  Target: ATXN1; (-) strand; PAM type: YTN; PAM sequence: CTC
atatgctggagttctgcctt

SEQ ID NO: 217639 - DNA, 20 bp, Artificial Sequence
  Description of Artificial Sequence: Synthetic oligonucleotide
  Target: ATXN1; (-) strand; PAM type: YTN; PAM sequence: CTA
gctcatatgctggagttctg

SEQ ID NO: 217640 - DNA, 20 bp, Artificial Sequence
  Description of Artificial Sequence: Synthetic oligonucleotide
  Target: ATXN1; (-) strand; PAM type: YTN; PAM sequence: TTC
atccctagctcatatgctgg

SEQ ID NO: 217641 - DNA, 20 bp, Artificial Sequence
  Description of Artificial Sequence: Synthetic oligonucleotide
  Target: ATXN1; (-) strand; PAM type: YTN; PAM sequence: CTT
catccctagctcatatgctg

SEQ ID NO: 217642 - DNA, 20 bp, Artificial Sequence
  Description of Artificial Sequence: Synthetic oligonucleotide
  Target: ATXN1; (-) strand; PAM type: YTN; PAM sequence: CTG
cttcatccctagctcatatg

SEQ ID NO: 217643 - DNA, 20 bp, Artificial Sequence
  Description of Artificial Sequence: Synthetic oligonucleotide
  Target: ATXN1; (-) strand; PAM type: YTN; PAM sequence: CTC
tgcttcatccctagctcata

SEQ ID NO: 217644 - DNA, 20 bp, Artificial Sequence
  Description of Artificial Sequence: Synthetic oligonucleotide
  Target: ATXN1; (-) strand; PAM type: YTN; PAM sequence: TTC
ctctgcttcatccctagctc

SEQ ID NO: 217645 - DNA, 20 bp, Artificial Sequence
  Description of Artificial Sequence: Synthetic oligonucleotide
  Target: ATXN1; (-) strand; PAM type: YTN; PAM sequence: CTT
cctctgcttcatccctagct

SEQ ID NO: 217646 - DNA, 20 bp, Artificial Sequence
  Description of Artificial Sequence: Synthetic oligonucleotide
  Target: ATXN1; (-) strand; PAM type: YTN; PAM sequence: CTC
ttcctctgcttcatccctag

SEQ ID NO: 217647 - DNA, 20 bp, Artificial Sequence
  Description of Artificial Sequence: Synthetic oligonucleotide
  Target: ATXN1; (-) strand; PAM type: YTN; PAM sequence: CTC
ctcttcctctgcttcatccc

SEQ ID NO: 217648 - DNA, 20 bp, Artificial Sequence
  Description of Artificial Sequence: Synthetic oligonucleotide
  Target: ATXN1; (-) strand; PAM type: YTN; PAM sequence: CTG
gacacctcctcttcctctgc

SEQ ID NO: 217649 - DNA, 20 bp, Artificial Sequence
  Description of Artificial Sequence: Synthetic oligonucleotide
  Target: ATXN1; (-) strand; PAM type: YTN; PAM sequence: TTG
atgctggacacctcctcttc

SEQ ID NO: 217650 - DNA, 20 bp, Artificial Sequence
  Description of Artificial Sequence: Synthetic oligonucleotide
  Target: ATXN1; (-) strand; PAM type: YTN; PAM sequence: TTG
ttgatgctggacacctcctc

SEQ ID NO: 217651 - DNA, 20 bp, Artificial Sequence
  Description of Artificial Sequence: Synthetic oligonucleotide
  Target: ATXN1; (-) strand; PAM type: YTN; PAM sequence: TTT
gttgatgctggacacctcct

SEQ ID NO: 217652 - DNA, 20 bp, Artificial Sequence
  Description of Artificial Sequence: Synthetic oligonucleotide
  Target: ATXN1; (-) strand; PAM type: YTN; PAM sequence: CTC
accatttgttgatgctggac

SEQ ID NO: 217653 - DNA, 20 bp, Artificial Sequence
  Description of Artificial Sequence: Synthetic oligonucleotide
  Target: ATXN1; (-) strand; PAM type: YTN; PAM sequence: CTA
gctcaccatttgttgatgct

SEQ ID NO: 217654 - DNA, 20 bp, Artificial Sequence
  Description of Artificial Sequence: Synthetic oligonucleotide
  Target: ATXN1; (-) strand; PAM type: YTN; PAM sequence: CTC
cagggtcactagctcaccat

SEQ ID NO: 217655 - DNA, 20 bp, Artificial Sequence
  Description of Artificial Sequence: Synthetic oligonucleotide
  Target: ATXN1; (-) strand; PAM type: YTN; PAM sequence: TTA
tgggctccagggtcactagc

SEQ ID NO: 217656 - DNA, 20 bp, Artificial Sequence
  Description of Artificial Sequence: Synthetic oligonucleotide
  Target: ATXN1; (-) strand; PAM type: YTN; PAM sequence: TTT
atgggctccagggtcactag

SEQ ID NO: 217657 - DNA, 20 bp, Artificial Sequence
  Description of Artificial Sequence: Synthetic oligonucleotide
  Target: ATXN1; (-) strand; PAM type: YTN; PAM sequence: CTA
cgtttatgggctccagggtc

SEQ ID NO: 217658 - DNA, 20 bp, Artificial Sequence
  Description of Artificial Sequence: Synthetic oligonucleotide
  Target: ATXN1; (-) strand; PAM type: YTN; PAM sequence: TTG
tcctacgtttatgggctcca

SEQ ID NO: 217659 - DNA, 20 bp, Artificial Sequence
  Description of Artificial Sequence: Synthetic oligonucleotide
  Target: ATXN1; (-) strand; PAM type: YTN; PAM sequence: TTG
tcattgtcctacgtttatgg

SEQ ID NO: 217660 - DNA, 20 bp, Artificial Sequence
  Description of Artificial Sequence: Synthetic oligonucleotide
  Target: ATXN1; (-) strand; PAM type: YTN; PAM sequence: TTT
gtcattgtcctacgtttatg

SEQ ID NO: 217661 - DNA, 20 bp, Artificial Sequence
  Description of Artificial Sequence: Synthetic oligonucleotide
  Target: ATXN1; (-) strand; PAM type: YTN; PAM sequence: CTT
tgtcattgtcctacgtttat

SEQ ID NO: 217662 - DNA, 20 bp, Artificial Sequence
  Description of Artificial Sequence: Synthetic oligonucleotide
  Target: ATXN1; (-) strand; PAM type: YTN; PAM sequence: CTG
actttgtcattgtcctacgt

SEQ ID NO: 217663 - DNA, 20 bp, Artificial Sequence
  Description of Artificial Sequence: Synthetic oligonucleotide
  Target: ATXN1; (-) strand; PAM type: YTN; PAM sequence: CTA
aacctgactttgtcattgtc

SEQ ID NO: 217664 - DNA, 20 bp, Artificial Sequence
  Description of Artificial Sequence: Synthetic oligonucleotide
  Target: ATXN1; (-) strand; PAM type: YTN; PAM sequence: TTG
aatctaaacctgactttgtc

SEQ ID NO: 217665 - DNA, 20 bp, Artificial Sequence
  Description of Artificial Sequence: Synthetic oligonucleotide
  Target: ATXN1; (-) strand; PAM type: YTN; PAM sequence: TTT
gaatctaaacctgactttgt

SEQ ID NO: 217666 - DNA, 20 bp, Artificial Sequence
  Description of Artificial Sequence: Synthetic oligonucleotide
  Target: ATXN1; (-) strand; PAM type: YTN; PAM sequence: TTC
aatttgaatctaaacctgac

SEQ ID NO: 217667 - DNA, 20 bp, Artificial Sequence
  Description of Artificial Sequence: Synthetic oligonucleotide
  Target: ATXN1; (-) strand; PAM type: YTN; PAM sequence: CTT
caatttgaatctaaacctga

SEQ ID NO: 217668 - DNA, 20 bp, Artificial Sequence
  Description of Artificial Sequence: Synthetic oligonucleotide
  Target: ATXN1; (-) strand; PAM type: YTN; PAM sequence: CTG
gatatcacataggtgtcttc

SEQ ID NO: 217669 - DNA, 20 bp, Artificial Sequence
  Description of Artificial Sequence: Synthetic oligonucleotide
  Target: ATXN1; (-) strand; PAM type: YTN; PAM sequence: CTC
cagctggatatcacataggt

SEQ ID NO: 217670 - DNA, 20 bp, Artificial Sequence
  Description of Artificial Sequence: Synthetic oligonucleotide
  Target: ATXN1; (-) strand; PAM type: YTN; PAM sequence: CTC
ccacatgactccagctggat

SEQ ID NO: 217671 - DNA, 20 bp, Artificial Sequence
  Description of Artificial Sequence: Synthetic oligonucleotide
  Target: ATXN1; (-) strand; PAM type: YTN; PAM sequence: TTC
ctcccacatgactccagctg

SEQ ID NO: 217672 - DNA, 20 bp, Artificial Sequence
  Description of Artificial Sequence: Synthetic oligonucleotide
  Target: ATXN1; (-) strand; PAM type: YTN; PAM sequence: CTT
cctcccacatgactccagct

SEQ ID NO: 217673 - DNA, 20 bp, Artificial Sequence
  Description of Artificial Sequence: Synthetic oligonucleotide
  Target: ATXN1; (-) strand; PAM type: YTN; PAM sequence: TTC
caacttcctcccacatgact

SEQ ID NO: 217674 - DNA, 20 bp, Artificial Sequence
  Description of Artificial Sequence: Synthetic oligonucleotide
  Target: ATXN1; (-) strand; PAM type: YTN; PAM sequence: TTT
ccaacttcctcccacatgac

SEQ ID NO: 217675 - DNA, 20 bp, Artificial Sequence
  Description of Artificial Sequence: Synthetic oligonucleotide
  Target: ATXN1; (-) strand; PAM type: YTN; PAM sequence: CTC
aatgatttccaacttcctcc

SEQ ID NO: 217676 - DNA, 20 bp, Artificial Sequence
  Description of Artificial Sequence: Synthetic oligonucleotide
  Target: ATXN1; (-) strand; PAM type: YTN; PAM sequence: TTA
agctcaatgatttccaactt

SEQ ID NO: 217677 - DNA, 20 bp, Artificial Sequence
  Description of Artificial Sequence: Synthetic oligonucleotide
  Target: ATXN1; (-) strand; PAM type: YTN; PAM sequence: TTT
aagctcaatgatttccaact

SEQ ID NO: 217678 - DNA, 20 bp, Artificial Sequence
  Description of Artificial Sequence: Synthetic oligonucleotide
  Target: ATXN1; (-) strand; PAM type: YTN; PAM sequence: TTC
agagtttaagctcaatgatt

SEQ ID NO: 217679 - DNA, 20 bp, Artificial Sequence
  Description of Artificial Sequence: Synthetic oligonucleotide
  Target: ATXN1; (-) strand; PAM type: YTN; PAM sequence: CTT
cagagtttaagctcaatgat

SEQ ID NO: 217680 - DNA, 20 bp, Artificial Sequence
  Description of Artificial Sequence: Synthetic oligonucleotide
  Target: ATXN1; (-) strand; PAM type: YTN; PAM sequence: CTC
ttcagagtttaagctcaatg

SEQ ID NO: 217681 - DNA, 20 bp, Artificial Sequence
  Description of Artificial Sequence: Synthetic oligonucleotide
  Target: ATXN1; (-) strand; PAM type: YTN; PAM sequence: TTC
tcttcagagtttaagctcaa

SEQ ID NO: 217682 - DNA, 20 bp, Artificial Sequence
  Description of Artificial Sequence: Synthetic oligonucleotide
  Target: ATXN1; (-) strand; PAM type: YTN; PAM sequence: TTT
ctcttcagagtttaagctca

SEQ ID NO: 217683 - DNA, 20 bp, Artificial Sequence
  Description of Artificial Sequence: Synthetic oligonucleotide
  Target: ATXN1; (-) strand; PAM type: YTN; PAM sequence: CTT
tctcttcagagtttaagctc

SEQ ID NO: 217684 - DNA, 20 bp, Artificial Sequence
  Description of Artificial Sequence: Synthetic oligonucleotide
  Target: ATXN1; (-) strand; PAM type: YTN; PAM sequence: CTC
tttctcttcagagtttaagc

SEQ ID NO: 217685 - DNA, 20 bp, Artificial Sequence
  Description of Artificial Sequence: Synthetic oligonucleotide
  Target: ATXN1; (-) strand; PAM type: YTN; PAM sequence: CTG
tctctttctcttcagagttt

SEQ ID NO: 217686 - DNA, 20 bp, Artificial Sequence
  Description of Artificial Sequence: Synthetic oligonucleotide
  Target: ATXN1; (-) strand; PAM type: YTN; PAM sequence: TTC
tgtctctttctcttcagagt

SEQ ID NO: 217687 - DNA, 20 bp, Artificial Sequence
  Description of Artificial Sequence: Synthetic oligonucleotide
  Target: ATXN1; (-) strand; PAM type: YTN; PAM sequence: TTT
ctgtctctttctcttcagag

SEQ ID NO: 217688 - DNA, 20 bp, Artificial Sequence
  Description of Artificial Sequence: Synthetic oligonucleotide
  Target: ATXN1; (-) strand; PAM type: YTN; PAM sequence: CTA
gtatttctgtctctttctct

SEQ ID NO: 217689 - DNA, 20 bp, Artificial Sequence
  Description of Artificial Sequence: Synthetic oligonucleotide
  Target: ATXN1; (-) strand; PAM type: YTN; PAM sequence: CTG
cacacacaactagtatttct

SEQ ID NO: 217690 - DNA, 20 bp, Artificial Sequence
  Description of Artificial Sequence: Synthetic oligonucleotide
  Target: ATXN1; (-) strand; PAM type: YTN; PAM sequence: CTC
tgcacacacaactagtattt

SEQ ID NO: 217691 - DNA, 20 bp, Artificial Sequence
  Description of Artificial Sequence: Synthetic oligonucleotide
  Target: ATXN1; (-) strand; PAM type: YTN; PAM sequence: CTC
atcaactctgcacacacaac

SEQ ID NO: 217692 - DNA, 20 bp, Artificial Sequence
  Description of Artificial Sequence: Synthetic oligonucleotide
  Target: ATXN1; (-) strand; PAM type: YTN; PAM sequence: CTG
caccatcatgatgtcctcat

SEQ ID NO: 217693 - DNA, 20 bp, Artificial Sequence
  Description of Artificial Sequence: Synthetic oligonucleotide
  Target: ATXN1; (-) strand; PAM type: YTN; PAM sequence: CTG
aaggcatctgcaccatcatg

SEQ ID NO: 217694 - DNA, 20 bp, Artificial Sequence
  Description of Artificial Sequence: Synthetic oligonucleotide
  Target: ATXN1; (-) strand; PAM type: YTN; PAM sequence: TTC
cctgaaggcatctgcaccat

SEQ ID NO: 217695 - DNA, 20 bp, Artificial Sequence
  Description of Artificial Sequence: Synthetic oligonucleotide
  Target: ATXN1; (-) strand; PAM type: YTN; PAM sequence: TTT
ccctgaaggcatctgcacca

SEQ ID NO: 217696 - DNA, 20 bp, Artificial Sequence
  Description of Artificial Sequence: Synthetic oligonucleotide
  Target: ATXN1; (-) strand; PAM type: YTN; PAM sequence: CTT
tccctgaaggcatctgcacc

SEQ ID NO: 217697 - DNA, 20 bp, Artificial Sequence
  Description of Artificial Sequence: Synthetic oligonucleotide
  Target: ATXN1; (-) strand; PAM type: YTN; PAM sequence: TTA
ccgcacatgctttccctgaa

SEQ ID NO: 217698 - DNA, 20 bp, Artificial Sequence
  Description of Artificial Sequence: Synthetic oligonucleotide
  Target: ATXN1; (-) strand; PAM type: YTN; PAM sequence: TTG
ttaccgcacatgctttccct

SEQ ID NO: 217699 - DNA, 20 bp, Artificial Sequence
  Description of Artificial Sequence: Synthetic oligonucleotide
  Target: ATXN1; (-) strand; PAM type: YTN; PAM sequence: TTT
gttaccgcacatgctttccc

SEQ ID NO: 217700 - DNA, 20 bp, Artificial Sequence
  Description of Artificial Sequence: Synthetic oligonucleotide
  Target: ATXN1; (-) strand; PAM type: YTN; PAM sequence: CTA
gagtttgttaccgcacatgc

SEQ ID NO: 217701 - DNA, 20 bp, Artificial Sequence
  Description of Artificial Sequence: Synthetic oligonucleotide
  Target: ATXN1; (-) strand; PAM type: YTN; PAM sequence: TTG
gagtaaaaaggaaaagcagt

SEQ ID NO: 217702 - DNA, 20 bp, Artificial Sequence
  Description of Artificial Sequence: Synthetic oligonucleotide
  Target: ATXN1; (-) strand; PAM type: YTN; PAM sequence: TTG
ttggagtaaaaaggaaaagc

SEQ ID NO: 217703 - DNA, 20 bp, Artificial Sequence
  Description of Artificial Sequence: Synthetic oligonucleotide
  Target: ATXN1; (-) strand; PAM type: YTN; PAM sequence: CTG
gcacacgtgcacattgttgg

SEQ ID NO: 217704 - DNA, 20 bp, Artificial Sequence
  Description of Artificial Sequence: Synthetic oligonucleotide
  Target: ATXN1; (-) strand; PAM type: YTN; PAM sequence: TTA
aactggcacacgtgcacatt

SEQ ID NO: 217705 - DNA, 20 bp, Artificial Sequence
  Description of Artificial Sequence: Synthetic oligonucleotide
  Target: ATXN1; (-) strand; PAM type: YTN; PAM sequence: TTG
ccgtgcatcagaagaaatca

SEQ ID NO: 217706 - DNA, 20 bp, Artificial Sequence
  Description of Artificial Sequence: Synthetic oligonucleotide
  Target: ATXN1; (-) strand; PAM type: YTN; PAM sequence: TTT
gccgtgcatcagaagaaatc

SEQ ID NO: 217707 - DNA, 20 bp, Artificial Sequence
  Description of Artificial Sequence: Synthetic oligonucleotide
  Target: ATXN1; (-) strand; PAM type: YTN; PAM sequence: TTG
aagggaggcatttgccgtgc

SEQ ID NO: 217708 - DNA, 20 bp, Artificial Sequence
  Description of Artificial Sequence: Synthetic oligonucleotide
  Target: ATXN1; (-) strand; PAM type: YTN; PAM sequence: TTT
gaagggaggcatttgccgtg

SEQ ID NO: 217709 - DNA, 20 bp, Artificial Sequence
  Description of Artificial Sequence: Synthetic oligonucleotide
  Target: ATXN1; (-) strand; PAM type: YTN; PAM sequence: CTT
tgaagggaggcatttgccgt

SEQ ID NO: 217710 - DNA, 20 bp, Artificial Sequence
  Description of Artificial Sequence: Synthetic oligonucleotide
  Target: ATXN1; (-) strand; PAM type: YTN; PAM sequence: TTG
agagctttgaagggaggcat

SEQ ID NO: 217711 - DNA, 20 bp, Artificial Sequence
  Description of Artificial Sequence: Synthetic oligonucleotide
  Target: ATXN1; (-) strand; PAM type: YTN; PAM sequence: TTT
gagagctttgaagggaggca

SEQ ID NO: 217712 - DNA, 20 bp, Artificial Sequence
  Description of Artificial Sequence: Synthetic oligonucleotide
  Target: ATXN1; (-) strand; PAM type: YTN; PAM sequence: TTA
gtgacaatttgagagctttg

SEQ ID NO: 217713 - DNA, 20 bp, Artificial Sequence
  Description of Artificial Sequence: Synthetic oligonucleotide
  Target: ATXN1; (-) strand; PAM type: YTN; PAM sequence: TTT
agtgacaatttgagagcttt

SEQ ID NO: 217714 - DNA, 20 bp, Artificial Sequence
  Description of Artificial Sequence: Synthetic oligonucleotide
  Target: ATXN1; (-) strand; PAM type: YTN; PAM sequence: CTT
tagtgacaatttgagagctt

SEQ ID NO: 217715 - DNA, 20 bp, Artificial Sequence
  Description of Artificial Sequence: Synthetic oligonucleotide
  Target: ATXN1; (-) strand; PAM type: YTN; PAM sequence: TTC
tttagtgacaatttgagagc

SEQ ID NO: 217716 - DNA, 20 bp, Artificial Sequence
  Description of Artificial Sequence: Synthetic oligonucleotide
  Target: ATXN1; (-) strand; PAM type: YTN; PAM sequence: CTT
ctttagtgacaatttgagag

SEQ ID NO: 217717 - DNA, 20 bp, Artificial Sequence
  Description of Artificial Sequence: Synthetic oligonucleotide
  Target: ATXN1; (-) strand; PAM type: YTN; PAM sequence: TTA
catggtaggtccccttcttt

SEQ ID NO: 217718 - DNA, 20 bp, Artificial Sequence
  Description of Artificial Sequence: Synthetic oligonucleotide
  Target: ATXN1; (-) strand; PAM type: YTN; PAM sequence: TTT
acatggtaggtccccttctt

SEQ ID NO: 217719 - DNA, 20 bp, Artificial Sequence
  Description of Artificial Sequence: Synthetic oligonucleotide
  Target: ATXN1; (-) strand; PAM type: YTN; PAM sequence: CTG
atttacatggtaggtcccct

SEQ ID NO: 217720 - DNA, 20 bp, Artificial Sequence
  Description of Artificial Sequence: Synthetic oligonucleotide
  Target: ATXN1; (-) strand; PAM type: YTN; PAM sequence: CTA
acaggcatcatcaaaacaga

SEQ ID NO: 217721 - DNA, 20 bp, Artificial Sequence
  Description of Artificial Sequence: Synthetic oligonucleotide
  Target: ATXN1; (-) strand; PAM type: YTN; PAM sequence: TTC
taacaggcatcatcaaaaca

SEQ ID NO: 217722 - DNA, 20 bp, Artificial Sequence
  Description of Artificial Sequence: Synthetic oligonucleotide
  Target: ATXN1; (-) strand; PAM type: YTN; PAM sequence: CTT
ctaacaggcatcatcaaaac

SEQ ID NO: 217723 - DNA, 20 bp, Artificial Sequence
  Description of Artificial Sequence: Synthetic oligonucleotide
  Target: ATXN1; (-) strand; PAM type: YTN; PAM sequence: TTC
ttctaacaggcatcatcaaa

SEQ ID NO: 217724 - DNA, 20 bp, Artificial Sequence
  Description of Artificial Sequence: Synthetic oligonucleotide
  Target: ATXN1; (-) strand; PAM type: YTN; PAM sequence: TTT
cttctaacaggcatcatcaa

SEQ ID NO: 217725 - DNA, 20 bp, Artificial Sequence
  Description of Artificial Sequence: Synthetic oligonucleotide
  Target: ATXN1; (-) strand; PAM type: YTN; PAM sequence: CTT
tcttctaacaggcatcatca

SEQ ID NO: 217726 - DNA, 20 bp, Artificial Sequence
  Description of Artificial Sequence: Synthetic oligonucleotide
  Target: ATXN1; (-) strand; PAM type: YTN; PAM sequence: TTC
aggaaatgcaatgtactttc

SEQ ID NO: 217727 - DNA, 20 bp, Artificial Sequence
  Description of Artificial Sequence: Synthetic oligonucleotide
  Target: ATXN1; (-) strand; PAM type: YTN; PAM sequence: CTG
tgagtaaaaccacacccatt

SEQ ID NO: 217728 - DNA, 20 bp, Artificial Sequence
  Description of Artificial Sequence: Synthetic oligonucleotide
  Target: ATXN1; (-) strand; PAM type: YTN; PAM sequence: TTG
tatagctgtgagtaaaacca

SEQ ID NO: 217729 - DNA, 20 bp, Artificial Sequence
  Description of Artificial Sequence: Synthetic oligonucleotide
  Target: ATXN1; (-) strand; PAM type: YTN; PAM sequence: TTT
gtatagctgtgagtaaaacc

SEQ ID NO: 217730 - DNA, 20 bp, Artificial Sequence
  Description of Artificial Sequence: Synthetic oligonucleotide
  Target: ATXN1; (-) strand; PAM type: YTN; PAM sequence: TTT
tgtatagctgtgagtaaaac

SEQ ID NO: 217731 - DNA, 20 bp, Artificial Sequence
  Description of Artificial Sequence: Synthetic oligonucleotide
  Target: ATXN1; (-) strand; PAM type: YTN; PAM sequence: CTG
tgtggttttgtatagctgtg

SEQ ID NO: 217732 - DNA, 20 bp, Artificial Sequence
  Description of Artificial Sequence: Synthetic oligonucleotide
  Target: ATXN1; (-) strand; PAM type: YTN; PAM sequence: TTC
agagaagctgtgtggttttg

SEQ ID NO: 217733 - DNA, 20 bp, Artificial Sequence
  Description of Artificial Sequence: Synthetic oligonucleotide
  Target: ATXN1; (-) strand; PAM type: YTN; PAM sequence: CTT
cagagaagctgtgtggtttt

SEQ ID NO: 217734 - DNA, 20 bp, Artificial Sequence
  Description of Artificial Sequence: Synthetic oligonucleotide
  Target: ATXN1; (-) strand; PAM type: YTN; PAM sequence: CTA
agtccttcagagaagctgtg

SEQ ID NO: 217735 - DNA, 20 bp, Artificial Sequence
  Description of Artificial Sequence: Synthetic oligonucleotide
  Target: ATXN1; (-) strand; PAM type: YTN; PAM sequence: TTG
tctaagtccttcagagaagc

SEQ ID NO: 217736 - DNA, 20 bp, Artificial Sequence
  Description of Artificial Sequence: Synthetic oligonucleotide
  Target: ATXN1; (-) strand; PAM type: YTN; PAM sequence: CTA
atgattgtctaagtccttca

SEQ ID NO: 217737 - DNA, 20 bp, Artificial Sequence
  Description of Artificial Sequence: Synthetic oligonucleotide
  Target: ATXN1; (-) strand; PAM type: YTN; PAM sequence: CTA
tcacaggctaatgattgtct

SEQ ID NO: 217738 - DNA, 20 bp, Artificial Sequence
  Description of Artificial Sequence: Synthetic oligonucleotide
  Target: ATXN1; (-) strand; PAM type: YTN; PAM sequence: CTG
atgctatcacaggctaatga

SEQ ID NO: 217739 - DNA, 20 bp, Artificial Sequence
  Description of Artificial Sequence: Synthetic oligonucleotide
  Target: ATXN1; (-) strand; PAM type: YTN; PAM sequence: TTG
ctgatgctatcacaggctaa

SEQ ID NO: 217740 - DNA, 20 bp, Artificial Sequence
  Description of Artificial Sequence: Synthetic oligonucleotide
  Target: ATXN1; (-) strand; PAM type: YTN; PAM sequence: CTT
gctgatgctatcacaggcta

SEQ ID NO: 217741 - DNA, 20 bp, Artificial Sequence
  Description of Artificial Sequence: Synthetic oligonucleotide
  Target: ATXN1; (-) strand; PAM type: YTN; PAM sequence: CTC
ttgctgatgctatcacaggc

SEQ ID NO: 217742 - DNA, 20 bp, Artificial Sequence
  Description of Artificial Sequence: Synthetic oligonucleotide
  Target: ATXN1; (-) strand; PAM type: YTN; PAM sequence: TTC
ctcttgctgatgctatcaca

SEQ ID NO: 217743 - DNA, 20 bp, Artificial Sequence
  Description of Artificial Sequence: Synthetic oligonucleotide
  Target: ATXN1; (-) strand; PAM type: YTN; PAM sequence: CTC
gttcctcttgctgatgctat

SEQ ID NO: 217744 - DNA, 20 bp, Artificial Sequence
  Description of Artificial Sequence: Synthetic oligonucleotide
  Target: ATXN1; (-) strand; PAM type: YTN; PAM sequence: CTA
actcgttcctcttgctgatg

SEQ ID NO: 217745 - DNA, 20 bp, Artificial Sequence
  Description of Artificial Sequence: Synthetic oligonucleotide
  Target: ATXN1; (-) strand; PAM type: YTN; PAM sequence: TTC
taactcgttcctcttgctga

SEQ ID NO: 217746 - DNA, 20 bp, Artificial Sequence
  Description of Artificial Sequence: Synthetic oligonucleotide
  Target: ATXN1; (-) strand; PAM type: YTN; PAM sequence: TTA
aatgtgttctaactcgttcc

SEQ ID NO: 217747 - DNA, 20 bp, Artificial Sequence
  Description of Artificial Sequence: Synthetic oligonucleotide
  Target: ATXN1; (-) strand; PAM type: YTN; PAM sequence: TTG
ttaaatgtgttctaactcgt

SEQ ID NO: 217748 - DNA, 20 bp, Artificial Sequence
  Description of Artificial Sequence: Synthetic oligonucleotide
  Target: ATXN1; (-) strand; PAM type: YTN; PAM sequence: TTT
gttaaatgtgttctaactcg

SEQ ID NO: 217749 - DNA, 20 bp, Artificial Sequence
  Description of Artificial Sequence: Synthetic oligonucleotide
  Target: ATXN1; (-) strand; PAM type: YTN; PAM sequence: TTT
tgttaaatgtgttctaactc

SEQ ID NO: 217750 - DNA, 20 bp, Artificial Sequence
  Description of Artificial Sequence: Synthetic oligonucleotide
  Target: ATXN1; (-) strand; PAM type: YTN; PAM sequence: CTT
ttgttaaatgtgttctaact

SEQ ID NO: 217751 - DNA, 20 bp, Artificial Sequence
  Description of Artificial Sequence: Synthetic oligonucleotide
  Target: ATXN1; (-) strand; PAM type: YTN; PAM sequence: TTC
ggtaaagcagcacccaaaat

SEQ ID NO: 217752 - DNA, 20 bp, Artificial Sequence
  Description of Artificial Sequence: Synthetic oligonucleotide
  Target: ATXN1; (-) strand; PAM type: YTN; PAM sequence: TTA
agccagtgttcggtaaagca

SEQ ID NO: 217753 - DNA, 20 bp, Artificial Sequence
  Description of Artificial Sequence: Synthetic oligonucleotide
  Target: ATXN1; (-) strand; PAM type: YTN; PAM sequence: CTT
aagccagtgttcggtaaagc

SEQ ID NO: 217754 - DNA, 20 bp, Artificial Sequence
  Description of Artificial Sequence: Synthetic oligonucleotide
  Target: ATXN1; (-) strand; PAM type: YTN; PAM sequence: TTC
aggtacttaagccagtgttc

SEQ ID NO: 217755 - DNA, 20 bp, Artificial Sequence
  Description of Artificial Sequence: Synthetic oligonucleotide
  Target: ATXN1; (-) strand; PAM type: YTN; PAM sequence: CTT
caggtacttaagccagtgtt

SEQ ID NO: 217756 - DNA, 20 bp, Artificial Sequence
  Description of Artificial Sequence: Synthetic oligonucleotide
  Target: ATXN1; (-) strand; PAM type: YTN; PAM sequence: TTC
ccttcaggtacttaagccag

SEQ ID NO: 217757 - DNA, 20 bp, Artificial Sequence
  Description of Artificial Sequence: Synthetic oligonucleotide
  Target: ATXN1; (-) strand; PAM type: YTN; PAM sequence: TTA
gaggagtgtagttcccttca

SEQ ID NO: 217758 - DNA, 20 bp, Artificial Sequence
  Description of Artificial Sequence: Synthetic oligonucleotide
  Target: ATXN1; (-) strand; PAM type: YTN; PAM sequence: CTT
agaggagtgtagttcccttc

SEQ ID NO: 217759 - DNA, 20 bp, Artificial Sequence
  Description of Artificial Sequence: Synthetic oligonucleotide
  Target: ATXN1; (-) strand; PAM type: YTN; PAM sequence: TTC
cagcttagaggagtgtagtt

SEQ ID NO: 217760 - DNA, 20 bp, Artificial Sequence
  Description of Artificial Sequence: Synthetic oligonucleotide
  Target: ATXN1; (-) strand; PAM type: YTN; PAM sequence: TTT
ccagcttagaggagtgtagt

SEQ ID NO: 217761 - DNA, 20 bp, Artificial Sequence
  Description of Artificial Sequence: Synthetic oligonucleotide
  Target: ATXN1; (-) strand; PAM type: YTN; PAM sequence: CTT
tccagcttagaggagtgtag

SEQ ID NO: 217762 - DNA, 20 bp, Artificial Sequence
  Description of Artificial Sequence: Synthetic oligonucleotide
  Target: ATXN1; (-) strand; PAM type: YTN; PAM sequence: CTC
gcagtgctttccagcttaga

SEQ ID NO: 217763 - DNA, 20 bp, Artificial Sequence
  Description of Artificial Sequence: Synthetic oligonucleotide
  Target: ATXN1; (-) strand; PAM type: YTN; PAM sequence: CTC
tcgcagtgctttccagctta

SEQ ID NO: 217764 - DNA, 20 bp, Artificial Sequence
  Description of Artificial Sequence: Synthetic oligonucleotide
  Target: ATXN1; (-) strand; PAM type: YTN; PAM sequence: TTA
gaaagctctcgcagtgcttt

SEQ ID NO: 217765 - DNA, 20 bp, Artificial Sequence
  Description of Artificial Sequence: Synthetic oligonucleotide
  Target: ATXN1; (-) strand; PAM type: YTN; PAM sequence: CTA
aagaccatcgttagaaagct

SEQ ID NO: 217766 - DNA, 20 bp, Artificial Sequence
  Description of Artificial Sequence: Synthetic oligonucleotide
  Target: ATXN1; (-) strand; PAM type: YTN; PAM sequence: TTG
gaacagatgtaaataggaaa

SEQ ID NO: 217767 - DNA, 20 bp, Artificial Sequence
  Description of Artificial Sequence: Synthetic oligonucleotide
  Target: ATXN1; (-) strand; PAM type: YTN; PAM sequence: TTT
ggaacagatgtaaataggaa

SEQ ID NO: 217768 - DNA, 20 bp, Artificial Sequence
  Description of Artificial Sequence: Synthetic oligonucleotide
  Target: ATXN1; (-) strand; PAM type: YTN; PAM sequence: TTT
tggaacagatgtaaatagga

SEQ ID NO: 217769 - DNA, 20 bp, Artificial Sequence
  Description of Artificial Sequence: Synthetic oligonucleotide
  Target: ATXN1; (-) strand; PAM type: YTN; PAM sequence: CTT
ttggaacagatgtaaatagg

SEQ ID NO: 217770 - DNA, 20 bp, Artificial Sequence
  Description of Artificial Sequence: Synthetic oligonucleotide
  Target: ATXN1; (-) strand; PAM type: YTN; PAM sequence: CTG
cttttggaacagatgtaaat

SEQ ID NO: 217771 - DNA, 20 bp, Artificial Sequence
  Description of Artificial Sequence: Synthetic oligonucleotide
  Target: ATXN1; (-) strand; PAM type: YTN; PAM sequence: CTA
aatcataggtactgcttttg

SEQ ID NO: 217772 - DNA, 20 bp, Artificial Sequence
  Description of Artificial Sequence: Synthetic oligonucleotide
  Target: ATXN1; (-) strand; PAM type: YTN; PAM sequence: TTC
caaacagccacctaaatcat

SEQ ID NO: 217773 - DNA, 20 bp, Artificial Sequence
  Description of Artificial Sequence: Synthetic oligonucleotide
  Target: ATXN1; (-) strand; PAM type: YTN; PAM sequence: TTT
ccaaacagccacctaaatca

SEQ ID NO: 217774 - DNA, 20 bp, Artificial Sequence
  Description of Artificial Sequence: Synthetic oligonucleotide
  Target: ATXN1; (-) strand; PAM type: YTN; PAM sequence: TTG
agaggtacatgatttccaaa

SEQ ID NO: 217775 - DNA, 20 bp, Artificial Sequence
  Description of Artificial Sequence: Synthetic oligonucleotide
  Target: ATXN1; (-) strand; PAM type: YTN; PAM sequence: CTT
gagaggtacatgatttccaa

SEQ ID NO: 217776 - DNA, 20 bp, Artificial Sequence
  Description of Artificial Sequence: Synthetic oligonucleotide
  Target: ATXN1; (-) strand; PAM type: YTN; PAM sequence: TTA
ccgtgaggcatccttgagag

SEQ ID NO: 217777 - DNA, 20 bp, Artificial Sequence
  Description of Artificial Sequence: Synthetic oligonucleotide
  Target: ATXN1; (-) strand; PAM type: YTN; PAM sequence: TTT
accgtgaggcatccttgaga

SEQ ID NO: 217778 - DNA, 20 bp, Artificial Sequence
  Description of Artificial Sequence: Synthetic oligonucleotide
  Target: ATXN1; (-) strand; PAM type: YTN; PAM sequence: TTG
tatcgtttaccgtgaggcat

SEQ ID NO: 217779 - DNA, 20 bp, Artificial Sequence
  Description of Artificial Sequence: Synthetic oligonucleotide
  Target: ATXN1; (-) strand; PAM type: YTN; PAM sequence: CTT
gtatcgtttaccgtgaggca

SEQ ID NO: 217780 - DNA, 20 bp, Artificial Sequence
  Description of Artificial Sequence: Synthetic oligonucleotide
  Target: ATXN1; (-) strand; PAM type: YTN; PAM sequence: CTG
tgtcacttgtatcgtttacc

SEQ ID NO: 217781 - DNA, 20 bp, Artificial Sequence
  Description of Artificial Sequence: Synthetic oligonucleotide
  Target: ATXN1; (-) strand; PAM type: YTN; PAM sequence: TTA
gaaactgtgtcacttgtatc

SEQ ID NO: 217782 - DNA, 20 bp, Artificial Sequence
  Description of Artificial Sequence: Synthetic oligonucleotide
  Target: ATXN1; (-) strand; PAM type: YTN; PAM sequence: CTA
gttagaaactgtgtcacttg

SEQ ID NO: 217783 - DNA, 20 bp, Artificial Sequence
  Description of Artificial Sequence: Synthetic oligonucleotide
  Target: ATXN1; (-) strand; PAM type: YTN; PAM sequence: TTG
tctagttagaaactgtgtca

SEQ ID NO: 217784 - DNA, 20 bp, Artificial Sequence
  Description of Artificial Sequence: Synthetic oligonucleotide
  Target: ATXN1; (-) strand; PAM type: YTN; PAM sequence: TTT
gtctagttagaaactgtgtc

SEQ ID NO: 217785 - DNA, 20 bp, Artificial Sequence
  Description of Artificial Sequence: Synthetic oligonucleotide
  Target: ATXN1; (-) strand; PAM type: YTN; PAM sequence: CTA
aaagagcatttgtctagtta

SEQ ID NO: 217786 - DNA, 20 bp, Artificial Sequence
  Description of Artificial Sequence: Synthetic oligonucleotide
  Target: ATXN1; (-) strand; PAM type: YTN; PAM sequence: TTC
taaaagagcatttgtctagt

SEQ ID NO: 217787 - DNA, 20 bp, Artificial Sequence
  Description of Artificial Sequence: Synthetic oligonucleotide
  Target: ATXN1; (-) strand; PAM type: YTN; PAM sequence: TTG
caagtaaccatccatggtag

SEQ ID NO: 217788 - DNA, 20 bp, Artificial Sequence
  Description of Artificial Sequence: Synthetic oligonucleotide
  Target: ATXN1; (-) strand; PAM type: YTN; PAM sequence: CTT
gcaagtaaccatccatggta

SEQ ID NO: 217789 - DNA, 20 bp, Artificial Sequence
  Description of Artificial Sequence: Synthetic oligonucleotide
  Target: ATXN1; (-) strand; PAM type: YTN; PAM sequence: TTC
cttgcaagtaaccatccatg

SEQ ID NO: 217790 - DNA, 20 bp, Artificial Sequence
  Description of Artificial Sequence: Synthetic oligonucleotide
  Target: ATXN1; (-) strand; PAM type: YTN; PAM sequence: TTT
ccttgcaagtaaccatccat

SEQ ID NO: 217791 - DNA, 20 bp, Artificial Sequence
  Description of Artificial Sequence: Synthetic oligonucleotide
  Target: ATXN1; (-) strand; PAM type: YTN; PAM sequence: CTA
tttccttgcaagtaaccatc

SEQ ID NO: 217792 - DNA, 20 bp, Artificial Sequence
  Description of Artificial Sequence: Synthetic oligonucleotide
  Target: ATXN1; (-) strand; PAM type: YTN; PAM sequence: TTA
gtggtccatgtaaactattt

SEQ ID NO: 217793 - DNA, 20 bp, Artificial Sequence
  Description of Artificial Sequence: Synthetic oligonucleotide
  Target: ATXN1; (-) strand; PAM type: YTN; PAM sequence: TTT
agtggtccatgtaaactatt

SEQ ID NO: 217794 - DNA, 20 bp, Artificial Sequence
  Description of Artificial Sequence: Synthetic oligonucleotide
  Target: ATXN1; (-) strand; PAM type: YTN; PAM sequence: CTT
tagtggtccatgtaaactat

SEQ ID NO: 217795 - DNA, 20 bp, Artificial Sequence
  Description of Artificial Sequence: Synthetic oligonucleotide
  Target: ATXN1; (-) strand; PAM type: YTN; PAM sequence: TTG
gaggtctttagtggtccatg

SEQ ID NO: 217796 - DNA, 20 bp, Artificial Sequence
  Description of Artificial Sequence: Synthetic oligonucleotide
  Target: ATXN1; (-) strand; PAM type: YTN; PAM sequence: TTT
ggaggtctttagtggtccat

SEQ ID NO: 217797 - DNA, 20 bp, Artificial Sequence
  Description of Artificial Sequence: Synthetic oligonucleotide
  Target: ATXN1; (-) strand; PAM type: YTN; PAM sequence: TTT
tggaggtctttagtggtcca

SEQ ID NO: 217798 - DNA, 20 bp, Artificial Sequence
  Description of Artificial Sequence: Synthetic oligonucleotide
  Target: ATXN1; (-) strand; PAM type: YTN; PAM sequence: CTG
ttttggaggtctttagtggt

SEQ ID NO: 217799 - DNA, 20 bp, Artificial Sequence
  Description of Artificial Sequence: Synthetic oligonucleotide
  Target: ATXN1; (-) strand; PAM type: YTN; PAM sequence: TTC
tgttttggaggtctttagtg

SEQ ID NO: 217800 - DNA, 20 bp, Artificial Sequence
  Description of Artificial Sequence: Synthetic oligonucleotide
  Target: ATXN1; (-) strand; PAM type: YTN; PAM sequence: TTT
ctgttttggaggtctttagt

SEQ ID NO: 217801 - DNA, 20 bp, Artificial Sequence
  Description of Artificial Sequence: Synthetic oligonucleotide
  Target: ATXN1; (-) strand; PAM type: YTN; PAM sequence: TTG
gcatttctgttttggaggtc

SEQ ID NO: 217802 - DNA, 20 bp, Artificial Sequence
  Description of Artificial Sequence: Synthetic oligonucleotide
  Target: ATXN1; (-) strand; PAM type: YTN; PAM sequence: TTA
gcaaaatgccagatgttggc

SEQ ID NO: 217803 - DNA, 20 bp, Artificial Sequence
  Description of Artificial Sequence: Synthetic oligonucleotide
  Target: ATXN1; (-) strand; PAM type: YTN; PAM sequence: TTT
agcaaaatgccagatgttgg

SEQ ID NO: 217804 - DNA, 20 bp, Artificial Sequence
  Description of Artificial Sequence: Synthetic oligonucleotide
  Target: ATXN1; (-) strand; PAM type: YTN; PAM sequence: TTT
tagcaaaatgccagatgttg

SEQ ID NO: 217805 - DNA, 20 bp, Artificial Sequence
  Description of Artificial Sequence: Synthetic oligonucleotide
  Target: ATXN1; (-) strand; PAM type: YTN; PAM sequence: TTA
tagagtacaggattttagca

SEQ ID NO: 217806 - DNA, 20 bp, Artificial Sequence
  Description of Artificial Sequence: Synthetic oligonucleotide
  Target: ATXN1; (-) strand; PAM type: YTN; PAM sequence: TTA
aaaaattatagagtacagga

SEQ ID NO: 217807 - DNA, 20 bp, Artificial Sequence
  Description of Artificial Sequence: Synthetic oligonucleotide
  Target: ATXN1; (-) strand; PAM type: YTN; PAM sequence: TTT
aaaaaattatagagtacagg

SEQ ID NO: 217808 - DNA, 20 bp, Artificial Sequence
  Description of Artificial Sequence: Synthetic oligonucleotide
  Target: ATXN1; (-) strand; PAM type: YTN; PAM sequence: TTT
taaaaaattatagagtacag

SEQ ID NO: 217809 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaattatagagtaca

SEQ ID NO: 217810 - DNA, 20 bp, Artificial Sequence
  Description of Artificial Sequence: Synthetic oligonucleotide
  Target: ATXN1; (-) strand; PAM type: YTN; PAM sequence: CTA
aaaggatgtcaggtggagga

SEQ ID NO: 217811 - DNA, 20 bp, Artificial Sequence
  Description of Artificial Sequence: Synthetic oligonucleotide
  Target: ATXN1; (-) strand; PAM type: YTN; PAM sequence: TTG
tctaaaaggatgtcaggtgg

SEQ ID NO: 217812 - DNA, 20 bp, Artificial Sequence
  Description of Artificial Sequence: Synthetic oligonucleotide
  Target: ATXN1; (-) strand; PAM type: YTN; PAM sequence: TTT
gtctaaaaggatgtcaggtg

SEQ ID NO: 217813 - DNA, 20 bp, Artificial Sequence
  Description of Artificial Sequence: Synthetic oligonucleotide
  Target: ATXN1; (-) strand; PAM type: YTN; PAM sequence: CTT
tgtctaaaaggatgtcaggt

SEQ ID NO: 217814 - DNA, 20 bp, Artificial Sequence
  Description of Artificial Sequence: Synthetic oligonucleotide
  Target: ATXN1; (-) strand; PAM type: YTN; PAM sequence: TTG
agcctttgtctaaaaggatg

SEQ ID NO: 217815 - DNA, 20 bp, Artificial Sequence
  Description of Artificial Sequence: Synthetic oligonucleotide
  Target: ATXN1; (-) strand; PAM type: YTN; PAM sequence: TTT
gagcctttgtctaaaaggat

SEQ ID NO: 217816 - DNA, 20 bp, Artificial Sequence
  Description of Artificial Sequence: Synthetic oligonucleotide
  Target: ATXN1; (-) strand; PAM type: YTN; PAM sequence: CTT
tgagcctttgtctaaaagga

SEQ ID NO: 217817 - DNA, 20 bp, Artificial Sequence
  Description of Artificial Sequence: Synthetic oligonucleotide
  Target: ATXN1; (-) strand; PAM type: YTN; PAM sequence: TTG
actttgagcctttgtctaaa

SEQ ID NO: 217818 - DNA, 20 bp, Artificial Sequence
  Description of Artificial Sequence: Synthetic oligonucleotide
  Target: ATXN1; (-) strand; PAM type: YTN; PAM sequence: CTG
cataattgactttgagcctt

SEQ ID NO: 217819 - DNA, 20 bp, Artificial Sequence
  Description of Artificial Sequence: Synthetic oligonucleotide
  Target: ATXN1; (-) strand; PAM type: YTN; PAM sequence: TTG
tctgcataattgactttgag

SEQ ID NO: 217820 - DNA, 20 bp, Artificial Sequence
  Description of Artificial Sequence: Synthetic oligonucleotide
  Target: ATXN1; (-) strand; PAM type: YTN; PAM sequence: CTA
cagaagagaaaggtgccatt

SEQ ID NO: 217821 - DNA, 20 bp, Artificial Sequence
  Description of Artificial Sequence: Synthetic oligonucleotide
  Target: ATXN1; (-) strand; PAM type: YTN; PAM sequence: TTG
tcagctacagaagagaaagg

SEQ ID NO: 217822 - DNA, 20 bp, Artificial Sequence
  Description of Artificial Sequence: Synthetic oligonucleotide
  Target: ATXN1; (-) strand; PAM type: YTN; PAM sequence: TTG
cagaaggcaagagccaggtt

SEQ ID NO: 217823 - DNA, 20 bp, Artificial Sequence
  Description of Artificial Sequence: Synthetic oligonucleotide
  Target: ATXN1; (-) strand; PAM type: YTN; PAM sequence: TTG
ggttgcagaaggcaagagcc

SEQ ID NO: 217824 - DNA, 20 bp, Artificial Sequence
  Description of Artificial Sequence: Synthetic oligonucleotide
  Target: ATXN1; (-) strand; PAM type: YTN; PAM sequence: TTT
gggttgcagaaggcaagagc

SEQ ID NO: 217825 - DNA, 20 bp, Artificial Sequence
  Description of Artificial Sequence: Synthetic oligonucleotide
  Target: ATXN1; (-) strand; PAM type: YTN; PAM sequence: TTT
tgggttgcagaaggcaagag

SEQ ID NO: 217826 - DNA, 20 bp, Artificial Sequence
  Description of Artificial Sequence: Synthetic oligonucleotide
  Target: ATXN1; (-) strand; PAM type: YTN; PAM sequence: TTT
ttgggttgcagaaggcaaga

SEQ ID NO: 217827 - DNA, 20 bp, Artificial Sequence
  Description of Artificial Sequence: Synthetic oligonucleotide
  Target: ATXN1; (-) strand; PAM type: YTN; PAM sequence: CTG
tttttgggttgcagaaggca

SEQ ID NO: 217828 - DNA, 20 bp, Artificial Sequence
  Description of Artificial Sequence: Synthetic oligonucleotide
  Target: ATXN1; (-) strand; PAM type: YTN; PAM sequence: CTG
atgggagcgagggctgtttt

SEQ ID NO: 217829 - DNA, 20 bp, Artificial Sequence
  Description of Artificial Sequence: Synthetic oligonucleotide
  Target: ATXN1; (-) strand; PAM type: YTN; PAM sequence: TTC
catctgatgggagcgagggc

SEQ ID NO: 217830 - DNA, 20 bp, Artificial Sequence
  Description of Artificial Sequence: Synthetic oligonucleotide
  Target: ATXN1; (-) strand; PAM type: YTN; PAM sequence: TTT
ccatctgatgggagcgaggg

SEQ ID NO: 217831 - DNA, 20 bp, Artificial Sequence
  Description of Artificial Sequence: Synthetic oligonucleotide
  Target: ATXN1; (-) strand; PAM type: YTN; PAM sequence: CTT
tccatctgatgggagcgagg

SEQ ID NO: 217832 - DNA, 20 bp, Artificial Sequence
  Description of Artificial Sequence: Synthetic oligonucleotide
  Target: ATXN1; (-) strand; PAM type: YTN; PAM sequence: TTC
tttccatctgatgggagcga

SEQ ID NO: 217833 - DNA, 20 bp, Artificial Sequence
  Description of Artificial Sequence: Synthetic oligonucleotide
  Target: ATXN1; (-) strand; PAM type: YTN; PAM sequence: CTG
cgtagttctttccatctgat

SEQ ID NO: 217834 - DNA, 20 bp, Artificial Sequence
  Description of Artificial Sequence: Synthetic oligonucleotide
  Target: ATXN1; (-) strand; PAM type: YTN; PAM sequence: CTC
tgcgtagttctttccatctg

SEQ ID NO: 217835 - DNA, 20 bp, Artificial Sequence
  Description of Artificial Sequence: Synthetic oligonucleotide
  Target: ATXN1; (-) strand; PAM type: YTN; PAM sequence: TTC
ctctgcgtagttctttccat

SEQ ID NO: 217836 - DNA, 20 bp, Artificial Sequence
  Description of Artificial Sequence: Synthetic oligonucleotide
  Target: ATXN1; (-) strand; PAM type: YTN; PAM sequence: TTT
cctctgcgtagttctttcca

SEQ ID NO: 217837 - DNA, 20 bp, Artificial Sequence
  Description of Artificial Sequence: Synthetic oligonucleotide
  Target: ATXN1; (-) strand; PAM type: YTN; PAM sequence: TTT
tcctctgcgtagttctttcc

SEQ ID NO: 217838 - DNA, 20 bp, Artificial Sequence
  Description of Artificial Sequence: Synthetic oligonucleotide
  Target: ATXN1; (-) strand; PAM type: YTN; PAM sequence: CTA
gattttcctctgcgtagttc

SEQ ID NO: 217839 - DNA, 20 bp, Artificial Sequence
  Description of Artificial Sequence: Synthetic oligonucleotide
  Target: ATXN1; (-) strand; PAM type: YTN; PAM sequence: TTA
ctagattttcctctgcgtag

SEQ ID NO: 217840 - DNA, 20 bp, Artificial Sequence
  Description of Artificial Sequence: Synthetic oligonucleotide
  Target: ATXN1; (-) strand; PAM type: YTN; PAM sequence: CTT
actagattttcctctgcgta

SEQ ID NO: 217841 - DNA, 20 bp, Artificial Sequence
  Description of Artificial Sequence: Synthetic oligonucleotide
  Target: ATXN1; (-) strand; PAM type: YTN; PAM sequence: TTC
atggagaccttactagattt

SEQ ID NO: 217842 - DNA, 20 bp, Artificial Sequence
  Description of Artificial Sequence: Synthetic oligonucleotide
  Target: ATXN1; (-) strand; PAM type: YTN; PAM sequence: CTT
catggagaccttactagatt

SEQ ID NO: 217843 - DNA, 20 bp, Artificial Sequence
  Description of Artificial Sequence: Synthetic oligonucleotide
  Target: ATXN1; (-) strand; PAM type: YTN; PAM sequence: TTA
atatgtgcttcatggagacc

SEQ ID NO: 217844 - DNA, 20 bp, Artificial Sequence
  Description of Artificial Sequence: Synthetic oligonucleotide
  Target: ATXN1; (-) strand; PAM type: YTN; PAM sequence: TTT
aatatgtgcttcatggagac

SEQ ID NO: 217845 - DNA, 20 bp, Artificial Sequence
  Description of Artificial Sequence: Synthetic oligonucleotide
  Target: ATXN1; (-) strand; PAM type: YTN; PAM sequence: TTT
taatatgtgcttcatggaga

SEQ ID NO: 217846 - DNA, 20 bp, Artificial Sequence
  Description of Artificial Sequence: Synthetic oligonucleotide
  Target: ATXN1; (-) strand; PAM type: YTN; PAM sequence: CTT
ttaatatgtgcttcatggag

SEQ ID NO: 217847 - DNA, 20 bp, Artificial Sequence
  Description of Artificial Sequence: Synthetic oligonucleotide
  Target: ATXN1; (-) strand; PAM type: YTN; PAM sequence: TTA
ggcttttaatatgtgcttca

SEQ ID NO: 217848 - DNA, 20 bp, Artificial Sequence
  Description of Artificial Sequence: Synthetic oligonucleotide
  Target: ATXN1; (-) strand; PAM type: YTN; PAM sequence: TTA
agggcacattaggcttttaa

SEQ ID NO: 217849 - DNA, 20 bp, Artificial Sequence
  Description of Artificial Sequence: Synthetic oligonucleotide
  Target: ATXN1; (-) strand; PAM type: YTN; PAM sequence: CTG
aagccatgttaagggcacat

SEQ ID NO: 217850 - DNA, 20 bp, Artificial Sequence
  Description of Artificial Sequence: Synthetic oligonucleotide
  Target: ATXN1; (-) strand; PAM type: YTN; PAM sequence: TTG
ctgaagccatgttaagggca

SEQ ID NO: 217851 - DNA, 20 bp, Artificial Sequence
  Description of Artificial Sequence: Synthetic oligonucleotide
  Target: ATXN1; (-) strand; PAM type: YTN; PAM sequence: TTT
gctgaagccatgttaagggc

SEQ ID NO: 217852 - DNA, 20 bp, Artificial Sequence
  Description of Artificial Sequence: Synthetic oligonucleotide
  Target: ATXN1; (-) strand; PAM type: YTN; PAM sequence: CTA
agtgaaggaaaaaagcccag

SEQ ID NO: 217853 - DNA, 20 bp, Artificial Sequence
  Description of Artificial Sequence: Synthetic oligonucleotide
  Target: ATXN1; (-) strand; PAM type: YTN; PAM sequence: CTC
atctaagtgaaggaaaaaag

SEQ ID NO: 217854 - DNA, 20 bp, Artificial Sequence
  Description of Artificial Sequence: Synthetic oligonucleotide
  Target: ATXN1; (-) strand; PAM type: YTN; PAM sequence: TTC
tcatctaagtgaaggaaaaa

SEQ ID NO: 217855 - DNA, 20 bp, Artificial Sequence
  Description of Artificial Sequence: Synthetic oligonucleotide
  Target: ATXN1; (-) strand; PAM type: YTN; PAM sequence: CTC
aaattctcatctaagtgaag

SEQ ID NO: 217856 - DNA, 20 bp, Artificial Sequence
  Description of Artificial Sequence: Synthetic oligonucleotide
  Target: ATXN1; (-) strand; PAM type: YTN; PAM sequence: TTC
tcaaattctcatctaagtga

SEQ ID NO: 217857 - DNA, 20 bp, Artificial Sequence
  Description of Artificial Sequence: Synthetic oligonucleotide
  Target: ATXN1; (-) strand; PAM type: YTN; PAM sequence: CTT
ctcaaattctcatctaagtg

SEQ ID NO: 217858 - DNA, 20 bp, Artificial Sequence
  Description of Artificial Sequence: Synthetic oligonucleotide
  Target: ATXN1; (-) strand; PAM type: YTN; PAM sequence: TTC
ttctcaaattctcatctaag

SEQ ID NO: 217859 - DNA, 20 bp, Artificial Sequence
  Description of Artificial Sequence: Synthetic oligonucleotide
  Target: ATXN1; (-) strand; PAM type: YTN; PAM sequence: TTA
ccgagtggattcttctcaaa

SEQ ID NO: 217860 - DNA, 20 bp, Artificial Sequence
  Description of Artificial Sequence: Synthetic oligonucleotide
  Target: ATXN1; (-) strand; PAM type: YTN; PAM sequence: TTG
gcgagcagaaaggtattacc

SEQ ID NO: 217861 - DNA, 20 bp, Artificial Sequence
  Description of Artificial Sequence: Synthetic oligonucleotide
  Target: ATXN1; (-) strand; PAM type: YTN; PAM sequence: TTT
ggcgagcagaaaggtattac

SEQ ID NO: 217862 - DNA, 20 bp, Artificial Sequence
  Description of Artificial Sequence: Synthetic oligonucleotide
  Target: ATXN1; (-) strand; PAM type: YTN; PAM sequence: CTA
aaggaggtttggcgagcaga

SEQ ID NO: 217863 - DNA, 20 bp, Artificial Sequence
  Description of Artificial Sequence: Synthetic oligonucleotide
  Target: ATXN1; (-) strand; PAM type: YTN; PAM sequence: TTG
actaaaggaggtttggcgag

SEQ ID NO: 217864 - DNA, 20 bp, Artificial Sequence
  Description of Artificial Sequence: Synthetic oligonucleotide
  Target: ATXN1; (-) strand; PAM type: YTN; PAM sequence: TTT
gactaaaggaggtttggcga

SEQ ID NO: 217865 - DNA, 20 bp, Artificial Sequence
  Description of Artificial Sequence: Synthetic oligonucleotide
  Target: ATXN1; (-) strand; PAM type: YTN; PAM sequence: TTT
tgactaaaggaggtttggcg

SEQ ID NO: 217866 - DNA, 20 bp, Artificial Sequence
  Description of Artificial Sequence: Synthetic oligonucleotide
  Target: ATXN1; (-) strand; PAM type: YTN; PAM sequence: TTC
agttttgactaaaggaggtt

SEQ ID NO: 217867 - DNA, 20 bp, Artificial Sequence
  Description of Artificial Sequence: Synthetic oligonucleotide
  Target: ATXN1; (-) strand; PAM type: YTN; PAM sequence: CTA
ttcagttttgactaaaggag

SEQ ID NO: 217868 - DNA, 20 bp, Artificial Sequence
  Description of Artificial Sequence: Synthetic oligonucleotide
  Target: ATXN1; (-) strand; PAM type: YTN; PAM sequence: CTC
tattcagttttgactaaagg

SEQ ID NO: 217869 - DNA, 20 bp, Artificial Sequence
  Description of Artificial Sequence: Synthetic oligonucleotide
  Target: ATXN1; (-) strand; PAM type: YTN; PAM sequence: CTC
ccaggtctctattcagtttt

SEQ ID NO: 217870 - DNA, 20 bp, Artificial Sequence
  Description of Artificial Sequence: Synthetic oligonucleotide
  Target: ATXN1; (-) strand; PAM type: YTN; PAM sequence: TTC
tcccaggtctctattcagtt

SEQ ID NO: 217871 - DNA, 20 bp, Artificial Sequence
  Description of Artificial Sequence: Synthetic oligonucleotide
  Target: ATXN1; (-) strand; PAM type: YTN; PAM sequence: CTT
ctcccaggtctctattcagt

SEQ ID NO: 217872 - DNA, 20 bp, Artificial Sequence
  Description of Artificial Sequence: Synthetic oligonucleotide
  Target: ATXN1; (-) strand; PAM type: YTN; PAM sequence: TTG
gagaagtatcttctcccagg

SEQ ID NO: 217873 - DNA, 20 bp, Artificial Sequence
  Description of Artificial Sequence: Synthetic oligonucleotide
  Target: ATXN1; (-) strand; PAM type: YTN; PAM sequence: TTC
aagcccagtgttggagaagt

SEQ ID NO: 217874 - DNA, 20 bp, Artificial Sequence
  Description of Artificial Sequence: Synthetic oligonucleotide
  Target: ATXN1; (-) strand; PAM type: YTN; PAM sequence: CTT
caagcccagtgttggagaag

SEQ ID NO: 217875 - DNA, 20 bp, Artificial Sequence
  Description of Artificial Sequence: Synthetic oligonucleotide
  Target: ATXN1; (-) strand; PAM type: YTN; PAM sequence: TTG
tgtgaaaaagcaagcacctt

SEQ ID NO: 217876 - DNA, 20 bp, Artificial Sequence
  Description of Artificial Sequence: Synthetic oligonucleotide
  Target: ATXN1; (-) strand; PAM type: YTN; PAM sequence: TTT
gtgtgaaaaagcaagcacct

SEQ ID NO: 217877 - DNA, 20 bp, Artificial Sequence
  Description of Artificial Sequence: Synthetic oligonucleotide
  Target: ATXN1; (-) strand; PAM type: YTN; PAM sequence: TTC
agtttgtgtgaaaaagcaag

SEQ ID NO: 217878 - DNA, 20 bp, Artificial Sequence
  Description of Artificial Sequence: Synthetic oligonucleotide
  Target: ATXN1; (-) strand; PAM type: YTN; PAM sequence: CTG
aattcagtttgtgtgaaaaa

SEQ ID NO: 217879 - DNA, 20 bp, Artificial Sequence
  Description of Artificial Sequence: Synthetic oligonucleotide
  Target: ATXN1; (-) strand; PAM type: YTN; PAM sequence: TTG
tggcaatcctgaattcagtt

SEQ ID NO: 217880 - DNA, 20 bp, Artificial Sequence
  Description of Artificial Sequence: Synthetic oligonucleotide
  Target: ATXN1; (-) strand; PAM type: YTN; PAM sequence: TTG
gagaagttgtggcaatcctg

SEQ ID NO: 217881 - DNA, 20 bp, Artificial Sequence
  Description of Artificial Sequence: Synthetic oligonucleotide
  Target: ATXN1; (-) strand; PAM type: YTN; PAM sequence: CTT
ggagaagttgtggcaatcct

SEQ ID NO: 217882 - DNA, 20 bp, Artificial Sequence
  Description of Artificial Sequence: Synthetic oligonucleotide
  Target: ATXN1; (-) strand; PAM type: YTN; PAM sequence: TTG
cttggagaagttgtggcaat

SEQ ID NO: 217883 - DNA, 20 bp, Artificial Sequence
  Description of Artificial Sequence: Synthetic oligonucleotide
  Target: ATXN1; (-) strand; PAM type: YTN; PAM sequence: TTT
gcttggagaagttgtggcaa

SEQ ID NO: 217884 - DNA, 20 bp, Artificial Sequence
  Description of Artificial Sequence: Synthetic oligonucleotide
  Target: ATXN1; (-) strand; PAM type: YTN; PAM sequence: TTT
tgcttggagaagttgtggca

SEQ ID NO: 217885 - DNA, 20 bp, Artificial Sequence
  Description of Artificial Sequence: Synthetic oligonucleotide
  Target: ATXN1; (-) strand; PAM type: YTN; PAM sequence: TTC
agttttgcttggagaagttg

SEQ ID NO: 217886 - DNA, 20 bp, Artificial Sequence
  Description of Artificial Sequence: Synthetic oligonucleotide
  Target: ATXN1; (-) strand; PAM type: YTN; PAM sequence: TTA
gttcagttttgcttggagaa

SEQ ID NO: 217887 - DNA, 20 bp, Artificial Sequence
  Description of Artificial Sequence: Synthetic oligonucleotide
  Target: ATXN1; (-) strand; PAM type: YTN; PAM sequence: CTT
agttcagttttgcttggaga

SEQ ID NO: 217888 - DNA, 20 bp, Artificial Sequence
  Description of Artificial Sequence: Synthetic oligonucleotide
  Target: ATXN1; (-) strand; PAM type: YTN; PAM sequence: TTG
cttagttcagttttgcttgg

SEQ ID NO: 217889 - DNA, 20 bp, Artificial Sequence
  Description of Artificial Sequence: Synthetic oligonucleotide
  Target: ATXN1; (-) strand; PAM type: YTN; PAM sequence: CTG
ttgcttagttcagttttgct

SEQ ID NO: 217890 - DNA, 20 bp, Artificial Sequence
  Description of Artificial Sequence: Synthetic oligonucleotide
  Target: ATXN1; (-) strand; PAM type: YTN; PAM sequence: TTG
gctgttgcttagttcagttt

SEQ ID NO: 217891 - DNA, 20 bp, Artificial Sequence
  Description of Artificial Sequence: Synthetic oligonucleotide
  Target: ATXN1; (-) strand; PAM type: YTN; PAM sequence: TTT
ggctgttgcttagttcagtt

SEQ ID NO: 217892 - DNA, 20 bp, Artificial Sequence
  Description of Artificial Sequence: Synthetic oligonucleotide
  Target: ATXN1; (-) strand; PAM type: YTN; PAM sequence: TTA
tttggctgttgcttagttca

SEQ ID NO: 217893 - DNA, 20 bp, Artificial Sequence
  Description of Artificial Sequence: Synthetic oligonucleotide
  Target: ATXN1; (-) strand; PAM type: YTN; PAM sequence: TTT
atttggctgttgcttagttc

SEQ ID NO: 217894 - DNA, 20 bp, Artificial Sequence
  Description of Artificial Sequence: Synthetic oligonucleotide
  Target: ATXN1; (-) strand; PAM type: YTN; PAM sequence: TTT
tatttggctgttgcttagtt

SEQ ID NO: 217895 - DNA, 20 bp, Artificial Sequence
  Description of Artificial Sequence: Synthetic oligonucleotide
  Target: ATXN1; (-) strand; PAM type: YTN; PAM sequence: CTT
ttatttggctgttgcttagt

SEQ ID NO: 217896 - DNA, 20 bp, Artificial Sequence
  Description of Artificial Sequence: Synthetic oligonucleotide
  Target: ATXN1; (-) strand; PAM type: YTN; PAM sequence: CTC
ttttatttggctgttgctta

SEQ ID NO: 217897 - DNA, 20 bp, Artificial Sequence
  Description of Artificial Sequence: Synthetic oligonucleotide
  Target: ATXN1; (-) strand; PAM type: YTN; PAM sequence: TTC
tcttttatttggctgttgct

SEQ ID NO: 217898 - DNA, 20 bp, Artificial Sequence
  Description of Artificial Sequence: Synthetic oligonucleotide
  Target: ATXN1; (-) strand; PAM type: YTN; PAM sequence: TTT
ctcttttatttggctgttgc

SEQ ID NO: 217899 - DNA, 20 bp, Artificial Sequence
  Description of Artificial Sequence: Synthetic oligonucleotide
  Target: ATXN1; (-) strand; PAM type: YTN; PAM sequence: TTT
tctcttttatttggctgttg

SEQ ID NO: 217900 - DNA, 20 bp, Artificial Sequence
  Description of Artificial Sequence: Synthetic oligonucleotide
  Target: ATXN1; (-) strand; PAM type: YTN; PAM sequence: TTT
ttctcttttatttggctgtt

SEQ ID NO: 217901 - DNA, 20 bp, Artificial Sequence
  Description of Artificial Sequence: Synthetic oligonucleotide
  Target: ATXN1; (-) strand; PAM type: YTN; PAM sequence: CTT
tttctcttttatttggctgt

SEQ ID NO: 217902 - DNA, 20 bp, Artificial Sequence
  Description of Artificial Sequence: Synthetic oligonucleotide
  Target: ATXN1; (-) strand; PAM type: YTN; PAM sequence: TTG
acaactttttctcttttatt

SEQ ID NO: 217903 - DNA, 20 bp, Artificial Sequence
  Description of Artificial Sequence: Synthetic oligonucleotide
  Target: ATXN1; (-) strand; PAM type: YTN; PAM sequence: TTT
gacaactttttctcttttat

SEQ ID NO: 217904 - DNA, 20 bp, Artificial Sequence
  Description of Artificial Sequence: Synthetic oligonucleotide
  Target: ATXN1; (-) strand; PAM type: YTN; PAM sequence: TTT
tgacaactttttctctttta

SEQ ID NO: 217905 - DNA, 20 bp, Artificial Sequence
  Description of Artificial Sequence: Synthetic oligonucleotide
  Target: ATXN1; (-) strand; PAM type: YTN; PAM sequence: TTT
ttgacaactttttctctttt

SEQ ID NO: 217906 - DNA, 20 bp, Artificial Sequence
  Description of Artificial Sequence: Synthetic oligonucleotide
  Target: ATXN1; (-) strand; PAM type: YTN; PAM sequence: TTT
tttgacaactttttctcttt

SEQ ID NO: 217907 - DNA, 20 bp, Artificial Sequence
  Description of Artificial Sequence: Synthetic oligonucleotide
  Target: ATXN1; (-) strand; PAM type: YTN; PAM sequence: TTT
ttttgacaactttttctctt

SEQ ID NO: 217908 - DNA, 20 bp, Artificial Sequence
  Description of Artificial Sequence: Synthetic oligonucleotide
  Target: ATXN1; (-) strand; PAM type: YTN; PAM sequence: TTT
tttttgacaactttttctct

SEQ ID NO: 217909 - DNA, 20 bp, Artificial Sequence
  Description of Artificial Sequence: Synthetic oligonucleotide
  Target: ATXN1; (-) strand; PAM type: YTN; PAM sequence: TTA
acacattttttttgacaact

SEQ ID NO: 217910 - DNA, 20 bp, Artificial Sequence
  Description of Artificial Sequence: Synthetic oligonucleotide
  Target: ATXN1; (-) strand; PAM type: YTN; PAM sequence: CTA
ccaaatgcattaacacattt

SEQ ID NO: 217911 - DNA, 20 bp, Artificial Sequence
  Description of Artificial Sequence: Synthetic oligonucleotide
  Target: ATXN1; (-) strand; PAM type: YTN; PAM sequence: CTA
accactaccaaatgcattaa

SEQ ID NO: 217912 - DNA, 20 bp, Artificial Sequence
  Description of Artificial Sequence: Synthetic oligonucleotide
  Target: ATXN1; (-) strand; PAM type: YTN; PAM sequence: TTA
atctaaccactaccaaatgc

SEQ ID NO: 217913 - DNA, 20 bp, Artificial Sequence
  Description of Artificial Sequence: Synthetic oligonucleotide
  Target: ATXN1; (-) strand; PAM type: YTN; PAM sequence: CTG
ttaatctaaccactaccaaa

SEQ ID NO: 217914 - DNA, 20 bp, Artificial Sequence
  Description of Artificial Sequence: Synthetic oligonucleotide
  Target: ATXN1; (-) strand; PAM type: YTN; PAM sequence: TTA
gctgttaatctaaccactac

SEQ ID NO: 217915 - DNA, 20 bp, Artificial Sequence
  Description of Artificial Sequence: Synthetic oligonucleotide
  Target: ATXN1; (-) strand; PAM type: YTN; PAM sequence: TTA
ttagctgttaatctaaccac

SEQ ID NO: 217916 - DNA, 20 bp, Artificial Sequence
  Description of Artificial Sequence: Synthetic oligonucleotide
  Target: ATXN1; (-) strand; PAM type: YTN; PAM sequence: TTT
attagctgttaatctaacca

SEQ ID NO: 217917 - DNA, 20 bp, Artificial Sequence
  Description of Artificial Sequence: Synthetic oligonucleotide
  Target: ATXN1; (-) strand; PAM type: YTN; PAM sequence: CTA
gaaaggaaccagcgtggcca

SEQ ID NO: 217918 - DNA, 20 bp, Artificial Sequence
  Description of Artificial Sequence: Synthetic oligonucleotide
  Target: ATXN1; (-) strand; PAM type: YTN; PAM sequence: CTA
gcctagaaaggaaccagcgt

SEQ ID NO: 217919 - DNA, 20 bp, Artificial Sequence
  Description of Artificial Sequence: Synthetic oligonucleotide
  Target: ATXN1; (-) strand; PAM type: YTN; PAM sequence: TTA
gctagcctagaaaggaacca

SEQ ID NO: 217920 - DNA, 20 bp, Artificial Sequence
  Description of Artificial Sequence: Synthetic oligonucleotide
  Target: ATXN1; (-) strand; PAM type: YTN; PAM sequence: CTT
agctagcctagaaaggaacc

SEQ ID NO: 217921 - DNA, 20 bp, Artificial Sequence
  Description of Artificial Sequence: Synthetic oligonucleotide
  Target: ATXN1; (-) strand; PAM type: YTN; PAM sequence: CTC
acagaagcttagctagccta

SEQ ID NO: 217922 - DNA, 20 bp, Artificial Sequence
  Description of Artificial Sequence: Synthetic oligonucleotide
  Target: ATXN1; (-) strand; PAM type: YTN; PAM sequence: CTG
gtagatggaatccaaacaga

SEQ ID NO: 217923 - DNA, 20 bp, Artificial Sequence
  Description of Artificial Sequence: Synthetic oligonucleotide
  Target: ATXN1; (-) strand; PAM type: YTN; PAM sequence: CTC
cagccctggtagatggaatc

SEQ ID NO: 217924 - DNA, 20 bp, Artificial Sequence
  Description of Artificial Sequence: Synthetic oligonucleotide
  Target: ATXN1; (-) strand; PAM type: YTN; PAM sequence: CTG
gtggctccagccctggtaga

SEQ ID NO: 217925 - DNA, 20 bp, Artificial Sequence
  Description of Artificial Sequence: Synthetic oligonucleotide
  Target: ATXN1; (-) strand; PAM type: YTN; PAM sequence: TTG
ctggtggctccagccctggt

SEQ ID NO: 217926 - DNA, 20 bp, Artificial Sequence
  Description of Artificial Sequence: Synthetic oligonucleotide
  Target: ATXN1; (-) strand; PAM type: YTN; PAM sequence: CTT
gctggtggctccagccctgg

SEQ ID NO: 217927 - DNA, 20 bp, Artificial Sequence
  Description of Artificial Sequence: Synthetic oligonucleotide
  Target: ATXN1; (-) strand; PAM type: YTN; PAM sequence: CTG
aatgcccttgctggtggctc

SEQ ID NO: 217928 - DNA, 20 bp, Artificial Sequence
  Description of Artificial Sequence: Synthetic oligonucleotide
  Target: ATXN1; (-) strand; PAM type: YTN; PAM sequence: CTC
ctgaatgcccttgctggtgg

SEQ ID NO: 217929 - DNA, 20 bp, Artificial Sequence
  Description of Artificial Sequence: Synthetic oligonucleotide
  Target: ATXN1; (-) strand; PAM type: YTN; PAM sequence: CTG
gtgcacctcctgaatgccct

SEQ ID NO: 217930 - DNA, 20 bp, Artificial Sequence
  Description of Artificial Sequence: Synthetic oligonucleotide
  Target: ATXN1; (-) strand; PAM type: YTN; PAM sequence: TTC
tggtgcacctcctgaatgcc

SEQ ID NO: 217931 - DNA, 20 bp, Artificial Sequence
  Description of Artificial Sequence: Synthetic oligonucleotide
  Target: ATXN1; (-) strand; PAM type: YTN; PAM sequence: CTT
ctggtgcacctcctgaatgc

SEQ ID NO: 217932 - DNA, 20 bp, Artificial Sequence
  Description of Artificial Sequence: Synthetic oligonucleotide
  Target: ATXN1; (-) strand; PAM type: YTN; PAM sequence: CTG
cttctggtgcacctcctgaa

SEQ ID NO: 217933 - DNA, 20 bp, Artificial Sequence
  Description of Artificial Sequence: Synthetic oligonucleotide
  Target: ATXN1; (-) strand; PAM type: YTN; PAM sequence: TTG
ctgcttctggtgcacctcct

SEQ ID NO: 217934 - DNA, 20 bp, Artificial Sequence
  Description of Artificial Sequence: Synthetic oligonucleotide
  Target: ATXN1; (-) strand; PAM type: YTN; PAM sequence: TTG
cagggcgttgctgcttctgg

SEQ ID NO: 217935 - DNA, 20 bp, Artificial Sequence
  Description of Artificial Sequence: Synthetic oligonucleotide
  Target: ATXN1; (-) strand; PAM type: YTN; PAM sequence: TTT
gcagggcgttgctgcttctg

SEQ ID NO: 217936 - DNA, 20 bp, Artificial Sequence
  Description of Artificial Sequence: Synthetic oligonucleotide
  Target: ATXN1; (-) strand; PAM type: YTN; PAM sequence: TTG
gatgatccaggagagatttg

SEQ ID NO: 217937 - DNA, 20 bp, Artificial Sequence
  Description of Artificial Sequence: Synthetic oligonucleotide
  Target: ATXN1; (-) strand; PAM type: YTN; PAM sequence: CTT
ggatgatccaggagagattt

SEQ ID NO: 217938 - DNA, 20 bp, Artificial Sequence
  Description of Artificial Sequence: Synthetic oligonucleotide
  Target: ATXN1; (-) strand; PAM type: YTN; PAM sequence: CTG
gtcttggatgatccaggaga

SEQ ID NO: 217939 - DNA, 20 bp, Artificial Sequence
  Description of Artificial Sequence: Synthetic oligonucleotide
  Target: ATXN1; (-) strand; PAM type: YTN; PAM sequence: TTC
cagcaagggcatgcctggtc

SEQ ID NO: 217940 - DNA, 20 bp, Artificial Sequence
  Description of Artificial Sequence: Synthetic oligonucleotide
  Target: ATXN1; (-) strand; PAM type: YTN; PAM sequence: TTG
ttccagcaagggcatgcctg

SEQ ID NO: 217941 - DNA, 20 bp, Artificial Sequence
  Description of Artificial Sequence: Synthetic oligonucleotide
  Target: ATXN1; (-) strand; PAM type: YTN; PAM sequence: CTT
gttccagcaagggcatgcct

SEQ ID NO: 217942 - DNA, 20 bp, Artificial Sequence
  Description of Artificial Sequence: Synthetic oligonucleotide
  Target: ATXN1; (-) strand; PAM type: YTN; PAM sequence: CTC
ttgttccagcaagggcatgc

SEQ ID NO: 217943 - DNA, 20 bp, Artificial Sequence
  Description of Artificial Sequence: Synthetic oligonucleotide
  Target: ATXN1; (-) strand; PAM type: YTN; PAM sequence: TTC
cgtccgcctcttgttccagc

SEQ ID NO: 217944 - DNA, 20 bp, Artificial Sequence
  Description of Artificial Sequence: Synthetic oligonucleotide
  Target: ATXN1; (-) strand; PAM type: YTN; PAM sequence: CTT
ccgtccgcctcttgttccag

SEQ ID NO: 217945 - DNA, 20 bp, Artificial Sequence
  Description of Artificial Sequence: Synthetic oligonucleotide
  Target: ATXN1; (-) strand; PAM type: YTN; PAM sequence: CTC
cttccgtccgcctcttgttc

SEQ ID NO: 217946 - DNA, 20 bp, Artificial Sequence
  Description of Artificial Sequence: Synthetic oligonucleotide
  Target: ATXN1; (-) strand; PAM type: YTN; PAM sequence: CTC
tccttccgtccgcctcttgt

SEQ ID NO: 217947 - DNA, 20 bp, Artificial Sequence
  Description of Artificial Sequence: Synthetic oligonucleotide
  Target: ATXN1; (-) strand; PAM type: YTN; PAM sequence: TTG
gccctctccttccgtccgcc

SEQ ID NO: 217948 - DNA, 20 bp, Artificial Sequence
  Description of Artificial Sequence: Synthetic oligonucleotide
  Target: ATXN1; (-) strand; PAM type: YTN; PAM sequence: CTT
ggccctctccttccgtccgc

SEQ ID NO: 217949 - DNA, 20 bp, Artificial Sequence
  Description of Artificial Sequence: Synthetic oligonucleotide
  Target: ATXN1; (-) strand; PAM type: YTN; PAM sequence: CTG
cagtggtgacacttggccct

SEQ ID NO: 217950 - DNA, 20 bp, Artificial Sequence
  Description of Artificial Sequence: Synthetic oligonucleotide
  Target: ATXN1; (-) strand; PAM type: YTN; PAM sequence: TTA
gcagactgcagtggtgacac

SEQ ID NO: 217951 - DNA, 20 bp, Artificial Sequence
  Description of Artificial Sequence: Synthetic oligonucleotide
  Target: ATXN1; (-) strand; PAM type: YTN; PAM sequence: TTG
aatccaatgttagcagactg

SEQ ID NO: 217952 - DNA, 20 bp, Artificial Sequence
  Description of Artificial Sequence: Synthetic oligonucleotide
  Target: ATXN1; (-) strand; PAM type: YTN; PAM sequence: TTT
gaatccaatgttagcagact

SEQ ID NO: 217953 - DNA, 20 bp, Artificial Sequence
  Description of Artificial Sequence: Synthetic oligonucleotide
  Target: ATXN1; (-) strand; PAM type: YTN; PAM sequence: TTC
aggatttgaatccaatgtta

SEQ ID NO: 217954 - DNA, 20 bp, Artificial Sequence
  Description of Artificial Sequence: Synthetic oligonucleotide
  Target: ATXN1; (-) strand; PAM type: YTN; PAM sequence: CTA
cagtgcacagtggtggattc

SEQ ID NO: 217955 - DNA, 20 bp, Artificial Sequence
  Description of Artificial Sequence: Synthetic oligonucleotide
  Target: ATXN1; (-) strand; PAM type: YTN; PAM sequence: CTA
gtggacgcacatcaaagcac

SEQ ID NO: 217956 - DNA, 20 bp, Artificial Sequence
  Description of Artificial Sequence: Synthetic oligonucleotide
  Target: ATXN1; (-) strand; PAM type: YTN; PAM sequence: CTC
tagtggacgcacatcaaagc

SEQ ID NO: 217957 - DNA, 20 bp, Artificial Sequence
  Description of Artificial Sequence: Synthetic oligonucleotide
  Target: ATXN1; (-) strand; PAM type: YTN; PAM sequence: TTA
gctctagtggacgcacatca

SEQ ID NO: 217958 - DNA, 20 bp, Artificial Sequence
  Description of Artificial Sequence: Synthetic oligonucleotide
  Target: ATXN1; (-) strand; PAM type: YTN; PAM sequence: TTT
agctctagtggacgcacatc

SEQ ID NO: 217959 - DNA, 20 bp, Artificial Sequence
  Description of Artificial Sequence: Synthetic oligonucleotide
  Target: ATXN1; (-) strand; PAM type: YTN; PAM sequence: CTG
aaaaggatcaagtttagctc

SEQ ID NO: 217960 - DNA, 20 bp, Artificial Sequence
  Description of Artificial Sequence: Synthetic oligonucleotide
  Target: ATXN1; (-) strand; PAM type: YTN; PAM sequence: CTG
ctgaaaaggatcaagtttag

SEQ ID NO: 217961 - DNA, 20 bp, Artificial Sequence
  Description of Artificial Sequence: Synthetic oligonucleotide
  Target: ATXN1; (-) strand; PAM type: YTN; PAM sequence: TTG
gtggcagaagagcggtcccg

SEQ ID NO: 217962 - DNA, 20 bp, Artificial Sequence
  Description of Artificial Sequence: Synthetic oligonucleotide
  Target: ATXN1; (-) strand; PAM type: YTN; PAM sequence: TTT
ggtggcagaagagcggtccc

SEQ ID NO: 217963 - DNA, 20 bp, Artificial Sequence
  Description of Artificial Sequence: Synthetic oligonucleotide
  Target: ATXN1; (-) strand; PAM type: YTN; PAM sequence: TTT
tggtggcagaagagcggtcc

SEQ ID NO: 217964 - DNA, 20 bp, Artificial Sequence
  Description of Artificial Sequence: Synthetic oligonucleotide
  Target: ATXN1; (-) strand; PAM type: YTN; PAM sequence: TTG
tcagttttggtggcagaaga

SEQ ID NO: 217965 - DNA, 20 bp, Artificial Sequence
  Description of Artificial Sequence: Synthetic oligonucleotide
  Target: ATXN1; (-) strand; PAM type: YTN; PAM sequence: CTC
gcaggttgtcagttttggtg

SEQ ID NO: 217966 - DNA, 20 bp, Artificial Sequence
  Description of Artificial Sequence: Synthetic oligonucleotide
  Target: ATXN1; (-) strand; PAM type: YTN; PAM sequence: TTA
ggcctcgcaggttgtcagtt

SEQ ID NO: 217967 - DNA, 20 bp, Artificial Sequence
  Description of Artificial Sequence: Synthetic oligonucleotide
  Target: ATXN1; (-) strand; PAM type: YTN; PAM sequence: CTG
ttaggcctcgcaggttgtca

SEQ ID NO: 217968 - DNA, 20 bp, Artificial Sequence
  Description of Artificial Sequence: Synthetic oligonucleotide
  Target: ATXN1; (-) strand; PAM type: YTN; PAM sequence: TTC
agctgttaggcctcgcaggt

SEQ ID NO: 217969 - DNA, 20 bp, Artificial Sequence
  Description of Artificial Sequence: Synthetic oligonucleotide
  Target: ATXN1; (-) strand; PAM type: YTN; PAM sequence: TTT
cagctgttaggcctcgcagg

SEQ ID NO: 217970 - DNA, 20 bp, Artificial Sequence
  Description of Artificial Sequence: Synthetic oligonucleotide
  Target: ATXN1; (-) strand; PAM type: YTN; PAM sequence: CTT
tcagctgttaggcctcgcag

SEQ ID NO: 217971 - DNA, 20 bp, Artificial Sequence
  Description of Artificial Sequence: Synthetic oligonucleotide
  Target: ATXN1; (-) strand; PAM type: YTN; PAM sequence: TTC
tttcagctgttaggcctcgc

SEQ ID NO: 217972 - DNA, 20 bp, Artificial Sequence
  Description of Artificial Sequence: Synthetic oligonucleotide
  Target: ATXN1; (-) strand; PAM type: YTN; PAM sequence: TTT
ctttcagctgttaggcctcg

SEQ ID NO: 217973 - DNA, 20 bp, Artificial Sequence
  Description of Artificial Sequence: Synthetic oligonucleotide
  Target: ATXN1; (-) strand; PAM type: YTN; PAM sequence: CTG
agtggtatttctttcagctg

SEQ ID NO: 217974 - DNA, 20 bp, Artificial Sequence
  Description of Artificial Sequence: Synthetic oligonucleotide
  Target: ATXN1; (-) strand; PAM type: YTN; PAM sequence: TTC
tgagtggtatttctttcagc

SEQ ID NO: 217975 - DNA, 20 bp, Artificial Sequence
  Description of Artificial Sequence: Synthetic oligonucleotide
  Target: ATXN1; (-) strand; PAM type: YTN; PAM sequence: TTA
ttctgagtggtatttctttc

SEQ ID NO: 217976 - DNA, 20 bp, Artificial Sequence
  Description of Artificial Sequence: Synthetic oligonucleotide
  Target: ATXN1; (-) strand; PAM type: YTN; PAM sequence: TTT
attctgagtggtatttcttt

SEQ ID NO: 217977 - DNA, 20 bp, Artificial Sequence
  Description of Artificial Sequence: Synthetic oligonucleotide
  Target: ATXN1; (-) strand; PAM type: YTN; PAM sequence: TTG
gcagtttattctgagtggta

SEQ ID NO: 217978 - DNA, 20 bp, Artificial Sequence
  Description of Artificial Sequence: Synthetic oligonucleotide
  Target: ATXN1; (-) strand; PAM type: YTN; PAM sequence: CTT
ggcagtttattctgagtggt

SEQ ID NO: 217979 - DNA, 20 bp, Artificial Sequence
  Description of Artificial Sequence: Synthetic oligonucleotide
  Target: ATXN1; (-) strand; PAM type: YTN; PAM sequence: CTA
cccttggcagtttattctga

SEQ ID NO: 217980 - DNA, 20 bp, Artificial Sequence
  Description of Artificial Sequence: Synthetic oligonucleotide
  Target: ATXN1; (-) strand; PAM type: YTN; PAM sequence: CTG
ctacccttggcagtttattc

SEQ ID NO: 217981 - DNA, 20 bp, Artificial Sequence
  Description of Artificial Sequence: Synthetic oligonucleotide
  Target: ATXN1; (-) strand; PAM type: YTN; PAM sequence: CTC
ccaaagccacacctgctacc

SEQ ID NO: 217982 - DNA, 20 bp, Artificial Sequence
  Description of Artificial Sequence: Synthetic oligonucleotide
  Target: ATXN1; (-) strand; PAM type: YTN; PAM sequence: TTG
gctcccaaagccacacctgc

SEQ ID NO: 217983 - DNA, 20 bp, Artificial Sequence
  Description of Artificial Sequence: Synthetic oligonucleotide
  Target: ATXN1; (-) strand; PAM type: YTN; PAM sequence: CTT
ggctcccaaagccacacctg

SEQ ID NO: 217984 - DNA, 20 bp, Artificial Sequence
  Description of Artificial Sequence: Synthetic oligonucleotide
  Target: ATXN1; (-) strand; PAM type: YTN; PAM sequence: TTA
tccttggctcccaaagccac

SEQ ID NO: 217985 - DNA, 20 bp, Artificial Sequence
  Description of Artificial Sequence: Synthetic oligonucleotide
  Target: ATXN1; (-) strand; PAM type: YTN; PAM sequence: TTT
atccttggctcccaaagcca

SEQ ID NO: 217986 - DNA, 20 bp, Artificial Sequence
  Description of Artificial Sequence: Synthetic oligonucleotide
  Target: ATXN1; (-) strand; PAM type: YTN; PAM sequence: CTT
tatccttggctcccaaagcc

SEQ ID NO: 217987 - DNA, 20 bp, Artificial Sequence
  Description of Artificial Sequence: Synthetic oligonucleotide
  Target: ATXN1; (-) strand; PAM type: YTN; PAM sequence: CTA
gaagctttatccttggctcc

SEQ ID NO: 217988 - DNA, 20 bp, Artificial Sequence
  Description of Artificial Sequence: Synthetic oligonucleotide
  Target: ATXN1; (-) strand; PAM type: YTN; PAM sequence: CTA
aactagaagctttatccttg

SEQ ID NO: 217989 - DNA, 20 bp, Artificial Sequence
  Description of Artificial Sequence: Synthetic oligonucleotide
  Target: ATXN1; (-) strand; PAM type: YTN; PAM sequence: CTG
tgctaaactagaagctttat

SEQ ID NO: 217990 - DNA, 20 bp, Artificial Sequence
  Description of Artificial Sequence: Synthetic oligonucleotide
  Target: ATXN1; (-) strand; PAM type: YTN; PAM sequence: CTG
aggataggaaccggactgtg

SEQ ID NO: 217991 - DNA, 20 bp, Artificial Sequence
  Description of Artificial Sequence: Synthetic oligonucleotide
  Target: ATXN1; (-) strand; PAM type: YTN; PAM sequence: CTA
ggagaaagatctgaggatag

SEQ ID NO: 217992 - DNA, 20 bp, Artificial Sequence
  Description of Artificial Sequence: Synthetic oligonucleotide
  Target: ATXN1; (-) strand; PAM type: YTN; PAM sequence: CTG
gagcagcaggctaggagaaa

SEQ ID NO: 217993 - DNA, 20 bp, Artificial Sequence
  Description of Artificial Sequence: Synthetic oligonucleotide
  Target: ATXN1; (-) strand; PAM type: YTN; PAM sequence: CTG
ggctggagcagcaggctagg

SEQ ID NO: 217994 - DNA, 20 bp, Artificial Sequence
  Description of Artificial Sequence: Synthetic oligonucleotide
  Target: ATXN1; (-) strand; PAM type: YTN; PAM sequence: CTA
tgaggagctgggctggagca

SEQ ID NO: 217995 - DNA, 20 bp, Artificial Sequence
  Description of Artificial Sequence: Synthetic oligonucleotide
  Target: ATXN1; (-) strand; PAM type: YTN; PAM sequence: TTG
ggatagtggggacatcagct

SEQ ID NO: 217996 - DNA, 20 bp, Artificial Sequence
  Description of Artificial Sequence: Synthetic oligonucleotide
  Target: ATXN1; (-) strand; PAM type: YTN; PAM sequence: CTA
agattgggatagtggggaca

SEQ ID NO: 217997 - DNA, 20 bp, Artificial Sequence
  Description of Artificial Sequence: Synthetic oligonucleotide
  Target: ATXN1; (-) strand; PAM type: YTN; PAM sequence: CTG
actaagattgggatagtggg

SEQ ID NO: 217998 - DNA, 20 bp, Artificial Sequence
  Description of Artificial Sequence: Synthetic oligonucleotide
  Target: ATXN1; (-) strand; PAM type: YTN; PAM sequence: TTG
gtggtaatgacaggagcccc

SEQ ID NO: 217999 - DNA, 20 bp, Artificial Sequence
  Description of Artificial Sequence: Synthetic oligonucleotide
  Target: ATXN1; (-) strand; PAM type: YTN; PAM sequence: CTG
ttggtggtaatgacaggagc

SEQ ID NO: 218000 - DNA, 20 bp, Artificial Sequence
  Description of Artificial Sequence: Synthetic oligonucleotide
  Target: ATXN1; (-) strand; PAM type: YTN; PAM sequence: CTC
tgttggtggtaatgacagga

SEQ ID NO: 218001 - DNA, 20 bp, Artificial Sequence
  Description of Artificial Sequence: Synthetic oligonucleotide
  Target: ATXN1; (-) strand; PAM type: YTN; PAM sequence: CTA
actctgttggtggtaatgac

SEQ ID NO: 218002 - DNA, 20 bp, Artificial Sequence
  Description of Artificial Sequence: Synthetic oligonucleotide
  Target: ATXN1; (-) strand; PAM type: YTN; PAM sequence: TTG
taatcactaactctgttggt

SEQ ID NO: 218003 - DNA, 20 bp, Artificial Sequence
  Description of Artificial Sequence: Synthetic oligonucleotide
  Target: ATXN1; (-) strand; PAM type: YTN; PAM sequence: TTT
gtaatcactaactctgttgg

SEQ ID NO: 218004 - DNA, 20 bp, Artificial Sequence
  Description of Artificial Sequence: Synthetic oligonucleotide
  Target: ATXN1; (-) strand; PAM type: YTN; PAM sequence: TTT
tgtaatcactaactctgttg

SEQ ID NO: 218005 - DNA, 20 bp, Artificial Sequence
  Description of Artificial Sequence: Synthetic oligonucleotide
  Target: ATXN1; (-) strand; PAM type: YTN; PAM sequence: CTT
ttgtaatcactaactctgtt

SEQ ID NO: 218006 - DNA, 20 bp, Artificial Sequence
  Description of Artificial Sequence: Synthetic oligonucleotide
  Target: ATXN1; (-) strand; PAM type: YTN; PAM sequence: TTA
tcttttgtaatcactaactc

SEQ ID NO: 218007 - DNA, 20 bp, Artificial Sequence
  Description of Artificial Sequence: Synthetic oligonucleotide
  Target: ATXN1; (-) strand; PAM type: YTN; PAM sequence: TTT
atcttttgtaatcactaact

SEQ ID NO: 218008 - DNA, 20 bp, Artificial Sequence
  Description of Artificial Sequence: Synthetic oligonucleotide
  Target: ATXN1; (-) strand; PAM type: YTN; PAM sequence: CTT
tatcttttgtaatcactaac

SEQ ID NO: 218009 - DNA, 20 bp, Artificial Sequence
  Description of Artificial Sequence: Synthetic oligonucleotide
  Target: ATXN1; (-) strand; PAM type: YTN; PAM sequence: CTC
tttatcttttgtaatcacta

SEQ ID NO: 218010 - DNA, 20 bp, Artificial Sequence
  Description of Artificial Sequence: Synthetic oligonucleotide
  Target: ATXN1; (-) strand; PAM type: YTN; PAM sequence: TTG
tctctttatcttttgtaatc

SEQ ID NO: 218011 - DNA, 20 bp, Artificial Sequence
  Description of Artificial Sequence: Synthetic oligonucleotide
  Target: ATXN1; (-) strand; PAM type: YTN; PAM sequence: TTT
gtctctttatcttttgtaat

SEQ ID NO: 218012 - DNA, 20 bp, Artificial Sequence
  Description of Artificial Sequence: Synthetic oligonucleotide
  Target: ATXN1; (-) strand; PAM type: YTN; PAM sequence: TTT
tgtctctttatcttttgtaa

SEQ ID NO: 218013 - DNA, 20 bp, Artificial Sequence
  Description of Artificial Sequence: Synthetic oligonucleotide
  Target: ATXN1; (-) strand; PAM type: YTN; PAM sequence: TTT
ttgtctctttatcttttgta

SEQ ID NO: 218014 - DNA, 20 bp, Artificial Sequence
  Description of Artificial Sequence: Synthetic oligonucleotide
  Target: ATXN1; (-) strand; PAM type: YTN; PAM sequence: TTT
tttgtctctttatcttttgt

SEQ ID NO: 218015 - DNA, 20 bp, Artificial Sequence
  Description of Artificial Sequence: Synthetic oligonucleotide
  Target: ATXN1; (-) strand; PAM type: YTN; PAM sequence: TTT
ttttgtctctttatcttttg

SEQ ID NO: 218016 - DNA, 20 bp, Artificial Sequence
  Description of Artificial Sequence: Synthetic oligonucleotide
  Target: ATXN1; (-) strand; PAM type: YTN; PAM sequence: CTT
tttttgtctctttatctttt

SEQ ID NO: 218017 - DNA, 20 bp, Artificial Sequence
  Description of Artificial Sequence: Synthetic oligonucleotide
  Target: ATXN1; (-) strand; PAM type: YTN; PAM sequence: TTG
gaaatctttttttgtctctt

SEQ ID NO: 218018 - DNA, 20 bp, Artificial Sequence
  Description of Artificial Sequence: Synthetic oligonucleotide
  Target: ATXN1; (-) strand; PAM type: YTN; PAM sequence: TTT
ggaaatctttttttgtctct

SEQ ID NO: 218019 - DNA, 20 bp, Artificial Sequence
  Description of Artificial Sequence: Synthetic oligonucleotide
  Target: ATXN1; (-) strand; PAM type: YTN; PAM sequence: TTT
tggaaatctttttttgtctc

SEQ ID NO: 218020 - DNA, 20 bp, Artificial Sequence
  Description of Artificial Sequence: Synthetic oligonucleotide
  Target: ATXN1; (-) strand; PAM type: YTN; PAM sequence: CTT
ttggaaatctttttttgtct

SEQ ID NO: 218021 - DNA, 20 bp, Artificial Sequence
  Description of Artificial Sequence: Synthetic oligonucleotide
  Target: ATXN1; (-) strand; PAM type: YTN; PAM sequence: CTC
ttttggaaatctttttttgt

SEQ ID NO: 218022 - DNA, 20 bp, Artificial Sequence
  Description of Artificial Sequence: Synthetic oligonucleotide
  Target: ATXN1; (-) strand; PAM type: YTN; PAM sequence: CTA
gggcagaggctcttttggaa

SEQ ID NO: 218023 - DNA, 20 bp, Artificial Sequence
  Description of Artificial Sequence: Synthetic oligonucleotide
  Target: ATXN1; (-) strand; PAM type: YTN; PAM sequence: TTC
ccctagggcagaggctcttt

SEQ ID NO: 218024 - DNA, 20 bp, Artificial Sequence
  Description of Artificial Sequence: Synthetic oligonucleotide
  Target: ATXN1; (-) strand; PAM type: YTN; PAM sequence: TTC
caaatacgtaaagtgttccc

SEQ ID NO: 218025 - DNA, 20 bp, Artificial Sequence
  Description of Artificial Sequence: Synthetic oligonucleotide
  Target: ATXN1; (-) strand; PAM type: YTN; PAM sequence: CTT
ccaaatacgtaaagtgttcc

SEQ ID NO: 218026 - DNA, 20 bp, Artificial Sequence
  Description of Artificial Sequence: Synthetic oligonucleotide
  Target: ATXN1; (-) strand; PAM type: YTN; PAM sequence: TTC
ttccaaatacgtaaagtgtt

SEQ ID NO: 218027 - DNA, 20 bp, Artificial Sequence
  Description of Artificial Sequence: Synthetic oligonucleotide
  Target: ATXN1; (-) strand; PAM type: YTN; PAM sequence: TTT
cttccaaatacgtaaagtgt

SEQ ID NO: 218028 - DNA, 20 bp, Artificial Sequence
  Description of Artificial Sequence: Synthetic oligonucleotide
  Target: ATXN1; (-) strand; PAM type: YTN; PAM sequence: CTT
tcttccaaatacgtaaagtg

SEQ ID NO: 218029 - DNA, 20 bp, Artificial Sequence
  Description of Artificial Sequence: Synthetic oligonucleotide
  Target: ATXN1; (-) strand; PAM type: YTN; PAM sequence: TTA
gaaacccactttcttccaaa

SEQ ID NO: 218030 - DNA, 20 bp, Artificial Sequence
  Description of Artificial Sequence: Synthetic oligonucleotide
  Target: ATXN1; (-) strand; PAM type: YTN; PAM sequence: TTT
agaaacccactttcttccaa

SEQ ID NO: 218031 - DNA, 20 bp, Artificial Sequence
  Description of Artificial Sequence: Synthetic oligonucleotide
  Target: ATXN1; (-) strand; PAM type: YTN; PAM sequence: CTT
tagaaacccactttcttcca

SEQ ID NO: 218032 - DNA, 20 bp, Artificial Sequence
  Description of Artificial Sequence: Synthetic oligonucleotide
  Target: ATXN1; (-) strand; PAM type: YTN; PAM sequence: CTG
aacctttagaaacccacttt

SEQ ID NO: 218033 - DNA, 20 bp, Artificial Sequence
  Description of Artificial Sequence: Synthetic oligonucleotide
  Target: ATXN1; (-) strand; PAM type: YTN; PAM sequence: CTC
tgaacctttagaaacccact

SEQ ID NO: 218034 - DNA, 20 bp, Artificial Sequence
  Description of Artificial Sequence: Synthetic oligonucleotide
  Target: ATXN1; (-) strand; PAM type: YTN; PAM sequence: TTC
tctgaacctttagaaaccca

SEQ ID NO: 218035 - DNA, 20 bp, Artificial Sequence
  Description of Artificial Sequence: Synthetic oligonucleotide
  Target: ATXN1; (-) strand; PAM type: YTN; PAM sequence: TTC
aggatgtgaggtcagcatat

SEQ ID NO: 218036 - DNA, 20 bp, Artificial Sequence
  Description of Artificial Sequence: Synthetic oligonucleotide
  Target: ATXN1; (-) strand; PAM type: YTN; PAM sequence: TTT
caggatgtgaggtcagcata

SEQ ID NO: 218037 - DNA, 20 bp, Artificial Sequence
  Description of Artificial Sequence: Synthetic oligonucleotide
  Target: ATXN1; (-) strand; PAM type: YTN; PAM sequence: TTT
tcaggatgtgaggtcagcat

SEQ ID NO: 218038 - DNA, 20 bp, Artificial Sequence
  Description of Artificial Sequence: Synthetic oligonucleotide
  Target: ATXN1; (-) strand; PAM type: YTN; PAM sequence: TTT
ttcaggatgtgaggtcagca

SEQ ID NO: 218039 - DNA, 20 bp, Artificial Sequence
  Description of Artificial Sequence: Synthetic oligonucleotide
  Target: ATXN1; (-) strand; PAM type: YTN; PAM sequence: CTT
tttcaggatgtgaggtcagc

SEQ ID NO: 218040 - DNA, 20 bp, Artificial Sequence
  Description of Artificial Sequence: Synthetic oligonucleotide
  Target: ATXN1; (-) strand; PAM type: YTN; PAM sequence: TTG
ccaagctttttcaggatgtg

SEQ ID NO: 218041 - DNA, 20 bp, Artificial Sequence
  Description of Artificial Sequence: Synthetic oligonucleotide
  Target: ATXN1; (-) strand; PAM type: YTN; PAM sequence: TTC
agttgccaagctttttcagg

SEQ ID NO: 218042 - DNA, 20 bp, Artificial Sequence
  Description of Artificial Sequence: Synthetic oligonucleotide
  Target: ATXN1; (-) strand; PAM type: YTN; PAM sequence: CTT
cagttgccaagctttttcag

SEQ ID NO: 218043 - DNA, 20 bp, Artificial Sequence
  Description of Artificial Sequence: Synthetic oligonucleotide
  Target: ATXN1; (-) strand; PAM type: YTN; PAM sequence: CTC
ttcagttgccaagctttttc

SEQ ID NO: 218044 - DNA, 20 bp, Artificial Sequence
  Description of Artificial Sequence: Synthetic oligonucleotide
  Target: ATXN1; (-) strand; PAM type: YTN; PAM sequence: TTC
cctcttcagttgccaagctt

SEQ ID NO: 218045 - DNA, 20 bp, Artificial Sequence
  Description of Artificial Sequence: Synthetic oligonucleotide
  Target: ATXN1; (-) strand; PAM type: YTN; PAM sequence: TTG
cattccctcttcagttgcca

SEQ ID NO: 218046 - DNA, 20 bp, Artificial Sequence
  Description of Artificial Sequence: Synthetic oligonucleotide
  Target: ATXN1; (-) strand; PAM type: YTN; PAM sequence: CTA
agcaacatcaagccatgagg

SEQ ID NO: 218047 - DNA, 20 bp, Artificial Sequence
  Description of Artificial Sequence: Synthetic oligonucleotide
  Target: ATXN1; (-) strand; PAM type: YTN; PAM sequence: TTG
acctaagcaacatcaagcca

SEQ ID NO: 218048 - DNA, 20 bp, Artificial Sequence
  Description of Artificial Sequence: Synthetic oligonucleotide
  Target: ATXN1; (-) strand; PAM type: YTN; PAM sequence: TTG
ttgacctaagcaacatcaag

SEQ ID NO: 218049 - DNA, 20 bp, Artificial Sequence
  Description of Artificial Sequence: Synthetic oligonucleotide
  Target: ATXN1; (-) strand; PAM type: YTN; PAM sequence: CTT
gttgacctaagcaacatcaa

SEQ ID NO: 218050 - DNA, 20 bp, Artificial Sequence
  Description of Artificial Sequence: Synthetic oligonucleotide
  Target: ATXN1; (-) strand; PAM type: YTN; PAM sequence: TTG
cttgttgacctaagcaacat

SEQ ID NO: 218051 - DNA, 20 bp, Artificial Sequence
  Description of Artificial Sequence: Synthetic oligonucleotide
  Target: ATXN1; (-) strand; PAM type: YTN; PAM sequence: TTT
gcttgttgacctaagcaaca

SEQ ID NO: 218052 - DNA, 20 bp, Artificial Sequence
  Description of Artificial Sequence: Synthetic oligonucleotide
  Target: ATXN1; (-) strand; PAM type: YTN; PAM sequence: CTA
tggtaggtgtccaggaaata

SEQ ID NO: 218053 - DNA, 20 bp, Artificial Sequence
  Description of Artificial Sequence: Synthetic oligonucleotide
  Target: ATXN1; (-) strand; PAM type: YTN; PAM sequence: CTG
agcctatggtaggtgtccag

SEQ ID NO: 218054 - DNA, 20 bp, Artificial Sequence
  Description of Artificial Sequence: Synthetic oligonucleotide
  Target: ATXN1; (-) strand; PAM type: YTN; PAM sequence: CTC
ccacagcaaagggtccaggt

SEQ ID NO: 218055 - DNA, 20 bp, Artificial Sequence
  Description of Artificial Sequence: Synthetic oligonucleotide
  Target: ATXN1; (-) strand; PAM type: YTN; PAM sequence: CTC
tcccacagcaaagggtccag

SEQ ID NO: 218056 - DNA, 20 bp, Artificial Sequence
  Description of Artificial Sequence: Synthetic oligonucleotide
  Target: ATXN1; (-) strand; PAM type: YTN; PAM sequence: CTC
ctctcccacagcaaagggtc

SEQ ID NO: 218057 - DNA, 20 bp, Artificial Sequence
  Description of Artificial Sequence: Synthetic oligonucleotide
  Target: ATXN1; (-) strand; PAM type: YTN; PAM sequence: TTG
cctcctctcccacagcaaag

SEQ ID NO: 218058 - DNA, 20 bp, Artificial Sequence
  Description of Artificial Sequence: Synthetic oligonucleotide
  Target: ATXN1; (-) strand; PAM type: YTN; PAM sequence: TTT
gcctcctctcccacagcaaa

SEQ ID NO: 218059 - DNA, 20 bp, Artificial Sequence
  Description of Artificial Sequence: Synthetic oligonucleotide
  Target: ATXN1; (-) strand; PAM type: YTN; PAM sequence: CTT
tgcctcctctcccacagcaa

SEQ ID NO: 218060 - DNA, 20 bp, Artificial Sequence
  Description of Artificial Sequence: Synthetic oligonucleotide
  Target: ATXN1; (-) strand; PAM type: YTN; PAM sequence: CTC
tttgcctcctctcccacagc

SEQ ID NO: 218061 - DNA, 20 bp, Artificial Sequence
  Description of Artificial Sequence: Synthetic oligonucleotide
  Target: ATXN1; (-) strand; PAM type: YTN; PAM sequence: CTC
ctctttgcctcctctcccac

SEQ ID NO: 218062 - DNA, 20 bp, Artificial Sequence
  Description of Artificial Sequence: Synthetic oligonucleotide
  Target: ATXN1; (-) strand; PAM type: YTN; PAM sequence: TTG
tgcatcctcctctttgcctc

SEQ ID NO: 218063 - DNA, 20 bp, Artificial Sequence
  Description of Artificial Sequence: Synthetic oligonucleotide
  Target: ATXN1; (-) strand; PAM type: YTN; PAM sequence: CTG
aaaataattgtgcatcctcc

SEQ ID NO: 218064 - DNA, 20 bp, Artificial Sequence
  Description of Artificial Sequence: Synthetic oligonucleotide
  Target: ATXN1; (-) strand; PAM type: YTN; PAM sequence: CTA
tctgaaaataattgtgcatc

SEQ ID NO: 218065 - DNA, 20 bp, Artificial Sequence
  Description of Artificial Sequence: Synthetic oligonucleotide
  Target: ATXN1; (-) strand; PAM type: YTN; PAM sequence: TTG
agaataactatctgaaaata

SEQ ID NO: 218066 - DNA, 20 bp, Artificial Sequence
  Description of Artificial Sequence: Synthetic oligonucleotide
  Target: ATXN1; (-) strand; PAM type: YTN; PAM sequence: TTT
gagaataactatctgaaaat

SEQ ID NO: 218067 - DNA, 20 bp, Artificial Sequence
  Description of Artificial Sequence: Synthetic oligonucleotide
  Target: ATXN1; (-) strand; PAM type: YTN; PAM sequence: CTG
aggtttgagaataactatct

SEQ ID NO: 218068 - DNA, 20 bp, Artificial Sequence
  Description of Artificial Sequence: Synthetic oligonucleotide
  Target: ATXN1; (-) strand; PAM type: YTN; PAM sequence: TTG
cacactgaggtttgagaata

SEQ ID NO: 218069 - DNA, 20 bp, Artificial Sequence
  Description of Artificial Sequence: Synthetic oligonucleotide
  Target: ATXN1; (-) strand; PAM type: YTN; PAM sequence: TTT
gcacactgaggtttgagaat

SEQ ID NO: 218070 - DNA, 20 bp, Artificial Sequence
  Description of Artificial Sequence: Synthetic oligonucleotide
  Target: ATXN1; (-) strand; PAM type: YTN; PAM sequence: TTT
tgcacactgaggtttgagaa

SEQ ID NO: 218071 - DNA, 20 bp, Artificial Sequence
  Description of Artificial Sequence: Synthetic oligonucleotide
  Target: ATXN1; (-) strand; PAM type: YTN; PAM sequence: CTT
ttgcacactgaggtttgaga

SEQ ID NO: 218072 - DNA, 20 bp, Artificial Sequence
  Description of Artificial Sequence: Synthetic oligonucleotide
  Target: ATXN1; (-) strand; PAM type: YTN; PAM sequence: TTA
acttttgcacactgaggttt

SEQ ID NO: 218073 - DNA, 20 bp, Artificial Sequence
  Description of Artificial Sequence: Synthetic oligonucleotide
  Target: ATXN1; (-) strand; PAM type: YTN; PAM sequence: TTA
gttaacttttgcacactgag

SEQ ID NO: 218074 - DNA, 20 bp, Artificial Sequence
  Description of Artificial Sequence: Synthetic oligonucleotide
  Target: ATXN1; (-) strand; PAM type: YTN; PAM sequence: CTT
agttaacttttgcacactga

SEQ ID NO: 218075 - DNA, 20 bp, Artificial Sequence
  Description of Artificial Sequence: Synthetic oligonucleotide
  Target: ATXN1; (-) strand; PAM type: YTN; PAM sequence: CTC
accttagttaacttttgcac

SEQ ID NO: 218076 - DNA, 20 bp, Artificial Sequence
  Description of Artificial Sequence: Synthetic oligonucleotide
  Target: ATXN1; (-) strand; PAM type: YTN; PAM sequence: CTG
gggatgtagaacccaggaaa

SEQ ID NO: 218077 - DNA, 20 bp, Artificial Sequence
  Description of Artificial Sequence: Synthetic oligonucleotide
  Target: ATXN1; (-) strand; PAM type: YTN; PAM sequence: TTC
tggggatgtagaacccagga

SEQ ID NO: 218078 - DNA, 20 bp, Artificial Sequence
  Description of Artificial Sequence: Synthetic oligonucleotide
  Target: ATXN1; (-) strand; PAM type: YTN; PAM sequence: TTA
tgaatcagaagttctgggga

SEQ ID NO: 218079 - DNA, 20 bp, Artificial Sequence
  Description of Artificial Sequence: Synthetic oligonucleotide
  Target: ATXN1; (-) strand; PAM type: YTN; PAM sequence: CTT
atgaatcagaagttctgggg

SEQ ID NO: 218080 - DNA, 20 bp, Artificial Sequence
  Description of Artificial Sequence: Synthetic oligonucleotide
  Target: ATXN1; (-) strand; PAM type: YTN; PAM sequence: TTC
agcaacaccaggcttatgaa

SEQ ID NO: 218081 - DNA, 20 bp, Artificial Sequence
  Description of Artificial Sequence: Synthetic oligonucleotide
  Target: ATXN1; (-) strand; PAM type: YTN; PAM sequence: TTG
cagattcagcaacaccaggc

SEQ ID NO: 218082 - DNA, 20 bp, Artificial Sequence
  Description of Artificial Sequence: Synthetic oligonucleotide
  Target: ATXN1; (-) strand; PAM type: YTN; PAM sequence: TTA
aagttgcagattcagcaaca

SEQ ID NO: 218083 - DNA, 20 bp, Artificial Sequence
  Description of Artificial Sequence: Synthetic oligonucleotide
  Target: ATXN1; (-) strand; PAM type: YTN; PAM sequence: TTA
ttaaagttgcagattcagca

SEQ ID NO: 218084 - DNA, 20 bp, Artificial Sequence
  Description of Artificial Sequence: Synthetic oligonucleotide
  Target: ATXN1; (-) strand; PAM type: YTN; PAM sequence: TTT
attaaagttgcagattcagc

SEQ ID NO: 218085 - DNA, 20 bp, Artificial Sequence
  Description of Artificial Sequence: Synthetic oligonucleotide
  Target: ATXN1; (-) strand; PAM type: YTN; PAM sequence: TTG
gatatgtttattaaagttgc

SEQ ID NO: 218086 - DNA, 20 bp, Artificial Sequence
  Description of Artificial Sequence: Synthetic oligonucleotide
  Target: ATXN1; (-) strand; PAM type: YTN; PAM sequence: CTT
ggatatgtttattaaagttg

SEQ ID NO: 218087 - DNA, 20 bp, Artificial Sequence
  Description of Artificial Sequence: Synthetic oligonucleotide
  Target: ATXN1; (-) strand; PAM type: YTN; PAM sequence: CTC
ttggatatgtttattaaagt

SEQ ID NO: 218088 - DNA, 20 bp, Artificial Sequence
  Description of Artificial Sequence: Synthetic oligonucleotide
  Target: ATXN1; (-) strand; PAM type: YTN; PAM sequence: TTC
cgaatctcttggatatgttt

SEQ ID NO: 218089 - DNA, 20 bp, Artificial Sequence
  Description of Artificial Sequence: Synthetic oligonucleotide
  Target: ATXN1; (-) strand; PAM type: YTN; PAM sequence: CTT
ccgaatctcttggatatgtt

SEQ ID NO: 218090 - DNA, 20 bp, Artificial Sequence
  Description of Artificial Sequence: Synthetic oligonucleotide
  Target: ATXN1; (-) strand; PAM type: YTN; PAM sequence: CTG
cttccgaatctcttggatat

SEQ ID NO: 218091 - DNA, 20 bp, Artificial Sequence
  Description of Artificial Sequence: Synthetic oligonucleotide
  Target: ATXN1; (-) strand; PAM type: YTN; PAM sequence: CTC
ctgcttccgaatctcttgga

SEQ ID NO: 218092 - DNA, 20 bp, Artificial Sequence
  Description of Artificial Sequence: Synthetic oligonucleotide
  Target: ATXN1; (-) strand; PAM type: YTN; PAM sequence: CTA
atcccagtacctcctgcttc

SEQ ID NO: 218093 - DNA, 20 bp, Artificial Sequence
  Description of Artificial Sequence: Synthetic oligonucleotide
  Target: ATXN1; (-) strand; PAM type: YTN; PAM sequence: TTC
ccaagggtggtctaatccca

SEQ ID NO: 218094 - DNA, 20 bp, Artificial Sequence
  Description of Artificial Sequence: Synthetic oligonucleotide
  Target: ATXN1; (-) strand; PAM type: YTN; PAM sequence: TTT
cccaagggtggtctaatccc

SEQ ID NO: 218095 - DNA, 20 bp, Artificial Sequence
  Description of Artificial Sequence: Synthetic oligonucleotide
  Target: ATXN1; (-) strand; PAM type: YTN; PAM sequence: TTC
aaggcaggaatcaaatcaca

SEQ ID NO: 218096 - DNA, 20 bp, Artificial Sequence
  Description of Artificial Sequence: Synthetic oligonucleotide
  Target: ATXN1; (-) strand; PAM type: YTN; PAM sequence: CTT
caaggcaggaatcaaatcac

SEQ ID NO: 218097 - DNA, 20 bp, Artificial Sequence
  Description of Artificial Sequence: Synthetic oligonucleotide
  Target: ATXN1; (-) strand; PAM type: YTN; PAM sequence: TTG
cacatggcttcaaggcagga

SEQ ID NO: 218098 - DNA, 20 bp, Artificial Sequence
  Description of Artificial Sequence: Synthetic oligonucleotide
  Target: ATXN1; (-) strand; PAM type: YTN; PAM sequence: TTG
cacatgggttgcacatggct

SEQ ID NO: 218099 - DNA, 20 bp, Artificial Sequence
  Description of Artificial Sequence: Synthetic oligonucleotide
  Target: ATXN1; (-) strand; PAM type: YTN; PAM sequence: TTG
ccatcagcacaattgcacat

SEQ ID NO: 218100 - DNA, 20 bp, Artificial Sequence
  Description of Artificial Sequence: Synthetic oligonucleotide
  Target: ATXN1; (-) strand; PAM type: YTN; PAM sequence: TTT
gccatcagcacaattgcaca

SEQ ID NO: 218101 - DNA, 20 bp, Artificial Sequence
  Description of Artificial Sequence: Synthetic oligonucleotide
  Target: ATXN1; (-) strand; PAM type: YTN; PAM sequence: CTG
tgagtgtttgccatcagcac

SEQ ID NO: 218102 - DNA, 20 bp, Artificial Sequence
  Description of Artificial Sequence: Synthetic oligonucleotide
  Target: ATXN1; (-) strand; PAM type: YTN; PAM sequence: CTC
tgtgagtgtttgccatcagc

SEQ ID NO: 218103 - DNA, 20 bp, Artificial Sequence
  Description of Artificial Sequence: Synthetic oligonucleotide
  Target: ATXN1; (-) strand; PAM type: YTN; PAM sequence: TTA
ctctgtgagtgtttgccatc

SEQ ID NO: 218104 - DNA, 20 bp, Artificial Sequence
  Description of Artificial Sequence: Synthetic oligonucleotide
  Target: ATXN1; (-) strand; PAM type: YTN; PAM sequence: CTG
tgcattactctgtgagtgtt

SEQ ID NO: 218105 - DNA, 20 bp, Artificial Sequence
  Description of Artificial Sequence: Synthetic oligonucleotide
  Target: ATXN1; (-) strand; PAM type: YTN; PAM sequence: CTG
ctgtgcattactctgtgagt

SEQ ID NO: 218106 - DNA, 20 bp, Artificial Sequence
  Description of Artificial Sequence: Synthetic oligonucleotide
  Target: ATXN1; (-) strand; PAM type: YTN; PAM sequence: TTA
cagaatgtactgctgtgcat

SEQ ID NO: 218107 - DNA, 20 bp, Artificial Sequence
  Description of Artificial Sequence: Synthetic oligonucleotide
  Target: ATXN1; (-) strand; PAM type: YTN; PAM sequence: CTT
acagaatgtactgctgtgca

SEQ ID NO: 218108 - DNA, 20 bp, Artificial Sequence
  Description of Artificial Sequence: Synthetic oligonucleotide
  Target: ATXN1; (-) strand; PAM type: YTN; PAM sequence: TTC
ttacagaatgtactgctgtg

SEQ ID NO: 218109 - DNA, 20 bp, Artificial Sequence
  Description of Artificial Sequence: Synthetic oligonucleotide
  Target: ATXN1; (-) strand; PAM type: YTN; PAM sequence: CTT
cttacagaatgtactgctgt

SEQ ID NO: 218110 - DNA, 20 bp, Artificial Sequence
  Description of Artificial Sequence: Synthetic oligonucleotide
  Target: ATXN1; (-) strand; PAM type: YTN; PAM sequence: CTG
cttcttacagaatgtactgc

SEQ ID NO: 218111 - DNA, 20 bp, Artificial Sequence
  Description of Artificial Sequence: Synthetic oligonucleotide
  Target: ATXN1; (-) strand; PAM type: YTN; PAM sequence: TTA
gggcctgcttcttacagaat

SEQ ID NO: 218112 - DNA, 20 bp, Artificial Sequence
  Description of Artificial Sequence: Synthetic oligonucleotide
  Target: ATXN1; (-) strand; PAM type: YTN; PAM sequence: TTT
agggcctgcttcttacagaa

SEQ ID NO: 218113 - DNA, 20 bp, Artificial Sequence
  Description of Artificial Sequence: Synthetic oligonucleotide
  Target: ATXN1; (-) strand; PAM type: YTN; PAM sequence: CTA
tcacatttagggcctgcttc

SEQ ID NO: 218114 - DNA, 20 bp, Artificial Sequence
  Description of Artificial Sequence: Synthetic oligonucleotide
  Target: ATXN1; (-) strand; PAM type: YTN; PAM sequence: TTC
tatcacatttagggcctgct

SEQ ID NO: 218115 - DNA, 20 bp, Artificial Sequence
  Description of Artificial Sequence: Synthetic oligonucleotide
  Target: ATXN1; (-) strand; PAM type: YTN; PAM sequence: CTT
ctatcacatttagggcctgc

SEQ ID NO: 218116 - DNA, 20 bp, Artificial Sequence
  Description of Artificial Sequence: Synthetic oligonucleotide
  Target: ATXN1; (-) strand; PAM type: YTN; PAM sequence: TTA
tgaacttctatcacatttag

SEQ ID NO: 218117 - DNA, 20 bp, Artificial Sequence
  Description of Artificial Sequence: Synthetic oligonucleotide
  Target: ATXN1; (-) strand; PAM type: YTN; PAM sequence: TTT
atgaacttctatcacattta

SEQ ID NO: 218118 - DNA, 20 bp, Artificial Sequence
  Description of Artificial Sequence: Synthetic oligonucleotide
  Target: ATXN1; (-) strand; PAM type: YTN; PAM sequence: CTT
tatgaacttctatcacattt

SEQ ID NO: 218119 - DNA, 20 bp, Artificial Sequence
  Description of Artificial Sequence: Synthetic oligonucleotide
  Target: ATXN1; (-) strand; PAM type: YTN; PAM sequence: CTC
tttatgaacttctatcacat

SEQ ID NO: 218120 - DNA, 20 bp, Artificial Sequence
  Description of Artificial Sequence: Synthetic oligonucleotide
  Target: ATXN1; (-) strand; PAM type: YTN; PAM sequence: CTC
tctttatgaacttctatcac

SEQ ID NO: 218121 - DNA, 20 bp, Artificial Sequence
  Description of Artificial Sequence: Synthetic oligonucleotide
  Target: ATXN1; (-) strand; PAM type: YTN; PAM sequence: CTG
agcagtctctctttatgaac

SEQ ID NO: 218122 - DNA, 20 bp, Artificial Sequence
  Description of Artificial Sequence: Synthetic oligonucleotide
  Target: ATXN1; (-) strand; PAM type: YTN; PAM sequence: CTG
cgcccggccctgagcagtct

SEQ ID NO: 218123 - DNA, 20 bp, Artificial Sequence
  Description of Artificial Sequence: Synthetic oligonucleotide
  Target: ATXN1; (-) strand; PAM type: YTN; PAM sequence: TTA
caggtgtaagccactgcgcc

SEQ ID NO: 218124 - DNA, 20 bp, Artificial Sequence
  Description of Artificial Sequence: Synthetic oligonucleotide
  Target: ATXN1; (-) strand; PAM type: YTN; PAM sequence: CTG
agattacaggtgtaagccac

SEQ ID NO: 218125 - DNA, 20 bp, Artificial Sequence
  Description of Artificial Sequence: Synthetic oligonucleotide
  Target: ATXN1; (-) strand; PAM type: YTN; PAM sequence: TTC
caaagtgctgagattacagg

SEQ ID NO: 218126 - DNA, 20 bp, Artificial Sequence
  Description of Artificial Sequence: Synthetic oligonucleotide
  Target: ATXN1; (-) strand; PAM type: YTN; PAM sequence: CTT
ccaaagtgctgagattacag

SEQ ID NO: 218127 - DNA, 20 bp, Artificial Sequence
  Description of Artificial Sequence: Synthetic oligonucleotide
  Target: ATXN1; (-) strand; PAM type: YTN; PAM sequence: TTG
gccttccaaagtgctgagat

SEQ ID NO: 218128 - DNA, 20 bp, Artificial Sequence
  Description of Artificial Sequence: Synthetic oligonucleotide
  Target: ATXN1; (-) strand; PAM type: YTN; PAM sequence: CTT
ggccttccaaagtgctgaga

SEQ ID NO: 218129 - DNA, 20 bp, Artificial Sequence
  Description of Artificial Sequence: Synthetic oligonucleotide
  Target: ATXN1; (-) strand; PAM type: YTN; PAM sequence: CTG
ccttggccttccaaagtgct

SEQ ID NO: 218130 - DNA, 20 bp, Artificial Sequence
  Description of Artificial Sequence: Synthetic oligonucleotide
  Target: ATXN1; (-) strand; PAM type: YTN; PAM sequence: CTC
atgatccatctgccttggcc

SEQ ID NO: 218131 - DNA, 20 bp, Artificial Sequence
  Description of Artificial Sequence: Synthetic oligonucleotide
  Target: ATXN1; (-) strand; PAM type: YTN; PAM sequence: TTG
atctcatgatccatctgcct

SEQ ID NO: 218132 - DNA, 20 bp, Artificial Sequence
  Description of Artificial Sequence: Synthetic oligonucleotide
  Target: ATXN1; (-) strand; PAM type: YTN; PAM sequence: CTT
gatctcatgatccatctgcc

SEQ ID NO: 218133 - DNA, 20 bp, Artificial Sequence
  Description of Artificial Sequence: Synthetic oligonucleotide
  Target: ATXN1; (-) strand; PAM type: YTN; PAM sequence: CTC
ttgatctcatgatccatctg

SEQ ID NO: 218134 - DNA, 20 bp, Artificial Sequence
  Description of Artificial Sequence: Synthetic oligonucleotide
  Target: ATXN1; (-) strand; PAM type: YTN; PAM sequence: TTG
atctcttgatctcatgatcc

SEQ ID NO: 218135 - DNA, 20 bp, Artificial Sequence
  Description of Artificial Sequence: Synthetic oligonucleotide
  Target: ATXN1; (-) strand; PAM type: YTN; PAM sequence: CTT
gatctcttgatctcatgatc

SEQ ID NO: 218136 - DNA, 20 bp, Artificial Sequence
  Description of Artificial Sequence: Synthetic oligonucleotide
  Target: ATXN1; (-) strand; PAM type: YTN; PAM sequence: TTG
gccaggatggtcttgatctc

SEQ ID NO: 218137 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggatggt

SEQ ID NO: 218138 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggatgg

SEQ ID NO: 218139 - DNA, 20 bp, Artificial Sequence
  Description of Artificial Sequence: Synthetic oligonucleotide
  Target: ATXN1; (-) strand; PAM type: YTN; PAM sequence: TTA
gtagaaatggggtttcacca

SEQ ID NO: 218140 - DNA, 20 bp, Artificial Sequence
  Description of Artificial Sequence: Synthetic oligonucleotide
  Target: ATXN1; (-) strand; PAM type: YTN; PAM sequence: TTT
agtagaaatggggtttcacc

SEQ ID NO: 218141 - DNA, 20 bp, Artificial Sequence
  Description of Artificial Sequence: Synthetic oligonucleotide
  Target: ATXN1; (-) strand; PAM type: YTN; PAM sequence: TTT
tagtagaaatggggtttcac

SEQ ID NO: 218142 - DNA, 20 bp, Artificial Sequence
  Description of Artificial Sequence: Synthetic oligonucleotide
  Target: ATXN1; (-) strand; PAM type: YTN; PAM sequence: TTT
ttagtagaaatggggtttca

SEQ ID NO: 218143 - DNA, 20 bp, Artificial Sequence
  Description of Artificial Sequence: Synthetic oligonucleotide
  Target: ATXN1; (-) strand; PAM type: YTN; PAM sequence: CTA
tttttagtagaaatggggtt

SEQ ID NO: 218144 - DNA, 20 bp, Artificial Sequence
  Description of Artificial Sequence: Synthetic oligonucleotide
  Target: ATXN1; (-) strand; PAM type: YTN; PAM sequence: TTC
tatttttagtagaaatgggg

SEQ ID NO: 218145 - DNA, 20 bp, Artificial Sequence
  Description of Artificial Sequence: Synthetic oligonucleotide
  Target: ATXN1; (-) strand; PAM type: YTN; PAM sequence: TTT
ctatttttagtagaaatggg

SEQ ID NO: 218146 - DNA, 20 bp, Artificial Sequence
  Description of Artificial Sequence: Synthetic oligonucleotide
  Target: ATXN1; (-) strand; PAM type: YTN; PAM sequence: TTT
tctatttttagtagaaatgg

SEQ ID NO: 218147 - DNA, 20 bp, Artificial Sequence
  Description of Artificial Sequence: Synthetic oligonucleotide
  Target: ATXN1; (-) strand; PAM type: YTN; PAM sequence: TTT
ttctatttttagtagaaatg

SEQ ID NO: 218148 - DNA, 20 bp, Artificial Sequence
  Description of Artificial Sequence: Synthetic oligonucleotide
  Target: ATXN1; (-) strand; PAM type: YTN; PAM sequence: CTA
atttttctatttttagtaga

SEQ ID NO: 218149 - DNA, 20 bp, Artificial Sequence
  Description of Artificial Sequence: Synthetic oligonucleotide
  Target: ATXN1; (-) strand; PAM type: YTN; PAM sequence: TTA
caggcatgcgccaccgtgcc

SEQ ID NO: 218150 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgcgccac

SEQ ID NO: 218151 - DNA, 20 bp, Artificial Sequence
  Description of Artificial Sequence: Synthetic oligonucleotide
  Target: ATXN1; (-) strand; PAM type: YTN; PAM sequence: CTG
agtagctgggattacaggca

SEQ ID NO: 218152 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggattacag

SEQ ID NO: 218153 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctggga

SEQ ID NO: 218154 - DNA, 20 bp, Artificial Sequence
  Description of Artificial Sequence: Synthetic oligonucleotide
  Target: ATXN1; (-) strand; PAM type: YTN; PAM sequence: TTG
cctcagcctcctgagtagct

SEQ ID NO: 218155 - DNA, 20 bp, Artificial Sequence
  Description of Artificial Sequence: Synthetic oligonucleotide
  Target: ATXN1; (-) strand; PAM type: YTN; PAM sequence: CTT
gcctcagcctcctgagtagc

SEQ ID NO: 218156 - DNA, 20 bp, Artificial Sequence
  Description of Artificial Sequence: Synthetic oligonucleotide
  Target: ATXN1; (-) strand; PAM type: YTN; PAM sequence: CTC
ttgcctcagcctcctgagta

SEQ ID NO: 218157 - DNA, 20 bp, Artificial Sequence
  Description of Artificial Sequence: Synthetic oligonucleotide
  Target: ATXN1; (-) strand; PAM type: YTN; PAM sequence: TTC
tcttgcctcagcctcctgag

SEQ ID NO: 218158 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcttgcctcag

SEQ ID NO: 218159 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcaattctct

SEQ ID NO: 218160 - DNA, 20 bp, Artificial Sequence
  Description of Artificial Sequence: Synthetic oligonucleotide
  Target: ATXN1; (-) strand; PAM type: YTN; PAM sequence: TTC
gcctcccaggttcaagcaat

SEQ ID NO: 218161 - DNA, 20 bp, Artificial Sequence
  Description of Artificial Sequence: Synthetic oligonucleotide
  Target: ATXN1; (-) strand; PAM type: YTN; PAM sequence: CTT
cgcctcccaggttcaagcaa

SEQ ID NO: 218162 - DNA, 20 bp, Artificial Sequence
  Description of Artificial Sequence: Synthetic oligonucleotide
  Target: ATXN1; (-) strand; PAM type: YTN; PAM sequence: CTG
caaccttcgcctcccaggtt

SEQ ID NO: 218163 - DNA, 20 bp, Artificial Sequence
  Description of Artificial Sequence: Synthetic oligonucleotide
  Target: ATXN1; (-) strand; PAM type: YTN; PAM sequence: CTC
actgcaaccttcgcctccca

SEQ ID NO: 218164 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaaccttcgcct

SEQ ID NO: 218165 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaaccttcgcc

SEQ ID NO: 218166 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcaatcttgg

SEQ ID NO: 218167 - DNA, 20 bp, Artificial Sequence
  Description of Artificial Sequence: Synthetic oligonucleotide
  Target: ATXN1; (-) strand; PAM type: YTN; PAM sequence: CTA
ggctggagtgcagtggcaat

SEQ ID NO: 218168 - DNA, 20 bp, Artificial Sequence
  Description of Artificial Sequence: Synthetic oligonucleotide
  Target: ATXN1; (-) strand; PAM type: YTN; PAM sequence: TTG
ctaggctggagtgcagtggc

SEQ ID NO: 218169 - DNA, 20 bp, Artificial Sequence
  Description of Artificial Sequence: Synthetic oligonucleotide
  Target: ATXN1; (-) strand; PAM type: YTN; PAM sequence: CTG
ttgctaggctggagtgcagt

SEQ ID NO: 218170 - DNA, 20 bp, Artificial Sequence
  Description of Artificial Sequence: Synthetic oligonucleotide
  Target: ATXN1; (-) strand; PAM type: YTN; PAM sequence: TTG
ggtctgttgctaggctggag

SEQ ID NO: 218171 - DNA, 20 bp, Artificial Sequence
  Description of Artificial Sequence: Synthetic oligonucleotide
  Target: ATXN1; (-) strand; PAM type: YTN; PAM sequence: CTT
gggtctgttgctaggctgga

SEQ ID NO: 218172 - DNA, 20 bp, Artificial Sequence
  Description of Artificial Sequence: Synthetic oligonucleotide
  Target: ATXN1; (-) strand; PAM type: YTN; PAM sequence: TTA
aggcagagtcttgggtctgt

SEQ ID NO: 218173 - DNA, 20 bp, Artificial Sequence
  Description of Artificial Sequence: Synthetic oligonucleotide
  Target: ATXN1; (-) strand; PAM type: YTN; PAM sequence: TTT
aaggcagagtcttgggtctg

SEQ ID NO: 218174 - DNA, 20 bp, Artificial Sequence
  Description of Artificial Sequence: Synthetic oligonucleotide
  Target: ATXN1; (-) strand; PAM type: YTN; PAM sequence: TTT
taaggcagagtcttgggtct

SEQ ID NO: 218175 - DNA, 20 bp, Artificial Sequence
  Description of Artificial Sequence: Synthetic oligonucleotide
  Target: ATXN1; (-) strand; PAM type: YTN; PAM sequence: TTT
ttaaggcagagtcttgggtc

SEQ ID NO: 218176 - DNA, 20 bp, Artificial Sequence
  Description of Artificial Sequence: Synthetic oligonucleotide
  Target: ATXN1; (-) strand; PAM type: YTN; PAM sequence: TTT
tttaaggcagagtcttgggt

SEQ ID NO: 218177 - DNA, 20 bp, Artificial Sequence
  Description of Artificial Sequence: Synthetic oligonucleotide
  Target: ATXN1; (-) strand; PAM type: YTN; PAM sequence: TTT
ttttaaggcagagtcttggg

SEQ ID NO: 218178 - DNA, 20 bp, Artificial Sequence
  Description of Artificial Sequence: Synthetic oligonucleotide
  Target: ATXN1; (-) strand; PAM type: YTN; PAM sequence: TTT
tttttaaggcagagtcttgg

SEQ ID NO: 218179 - DNA, 20 bp, Artificial Sequence
  Description of Artificial Sequence: Synthetic oligonucleotide
  Target: ATXN1; (-) strand; PAM type: YTN; PAM sequence: TTT
ttttttaaggcagagtcttg

SEQ ID NO: 218180 - DNA, 20 bp, Artificial Sequence
  Description of Artificial Sequence: Synthetic oligonucleotide
  Target: ATXN1; (-) strand; PAM type: YTN; PAM sequence: TTT
tttttttaaggcagagtctt

SEQ ID NO: 218181 - DNA, 20 bp, Artificial Sequence
  Description of Artificial Sequence: Synthetic oligonucleotide
  Target: ATXN1; (-) strand; PAM type: YTN; PAM sequence: TTT
ttttttttaaggcagagtct

SEQ ID NO: 218182 - DNA, 20 bp, Artificial Sequence
  Description of Artificial Sequence: Synthetic oligonucleotide
  Target: ATXN1; (-) strand; PAM type: YTN; PAM sequence: TTT
tttttttttaaggcagagtc

SEQ ID NO: 218183 - DNA, 20 bp, Artificial Sequence
  Description of Artificial Sequence: Synthetic oligonucleotide
  Target: ATXN1; (-) strand; PAM type: YTN; PAM sequence: TTT
ttttttttttaaggcagagt

SEQ ID NO: 218184 - DNA, 20 bp, Artificial Sequence
  Description of Artificial Sequence: Synthetic oligonucleotide
  Target: ATXN1; (-) strand; PAM type: YTN; PAM sequence: TTT
tttttttttttaaggcagag

SEQ ID NO: 218185 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttaaggcaga

SEQ ID NO: 218186 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttaaggcag

SEQ ID NO: 218187 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttaaggca

SEQ ID NO: 218188 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttaaggc

SEQ ID NO: 218189 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttaagg

SEQ ID NO: 218190 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttaag

SEQ ID NO: 218191 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttaa

SEQ ID NO: 218192 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttta

SEQ ID NO: 218193 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 218194 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 218195 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 218196 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttttttt

SEQ ID NO: 218197 - DNA, 20 bp, Artificial Sequence
  Description of Artificial Sequence: Synthetic oligonucleotide
  Target: ATXN1; (-) strand; PAM type: YTN; PAM sequence: CTC
tttttttttttttttttttt

SEQ ID NO: 218198 - DNA, 20 bp, Artificial Sequence
  Description of Artificial Sequence: Synthetic oligonucleotide
  Target: ATXN1; (-) strand; PAM type: YTN; PAM sequence: CTC
tctttttttttttttttttt

SEQ ID NO: 218199 - DNA, 20 bp, Artificial Sequence
  Description of Artificial Sequence: Synthetic oligonucleotide
  Target: ATXN1; (-) strand; PAM type: YTN; PAM sequence: CTC
tctctttttttttttttttt

SEQ ID NO: 218200 - DNA, 20 bp, Artificial Sequence
  Description of Artificial Sequence: Synthetic oligonucleotide
  Target: ATXN1; (-) strand; PAM type: YTN; PAM sequence: CTC
tctctctttttttttttttt

SEQ ID NO: 218201 - DNA, 20 bp, Artificial Sequence
  Description of Artificial Sequence: Synthetic oligonucleotide
  Target: ATXN1; (-) strand; PAM type: YTN; PAM sequence: CTC
tctctctctttttttttttt

SEQ ID NO: 218202 - DNA, 20 bp, Artificial Sequence
  Description of Artificial Sequence: Synthetic oligonucleotide
  Target: ATXN1; (-) strand; PAM type: YTN; PAM sequence: CTC
tctctctctctttttttttt

SEQ ID NO: 218203 - DNA, 20 bp, Artificial Sequence
  Description of Artificial Sequence: Synthetic oligonucleotide
  Target: ATXN1; (-) strand; PAM type: YTN; PAM sequence: CTC
tctctctctctctttttttt

SEQ ID NO: 218204 - DNA, 20 bp, Artificial Sequence
  Description of Artificial Sequence: Synthetic oligonucleotide
  Target: ATXN1; (-) strand; PAM type: YTN; PAM sequence: CTG
gtctctctctctctctcttt

SEQ ID NO: 218205 - DNA, 20 bp, Artificial Sequence
  Description of Artificial Sequence: Synthetic oligonucleotide
  Target: ATXN1; (-) strand; PAM type: YTN; PAM sequence: CTG
actggtctctctctctctct

SEQ ID NO: 218206 - DNA, 20 bp, Artificial Sequence
  Description of Artificial Sequence: Synthetic oligonucleotide
  Target: ATXN1; (-) strand; PAM type: YTN; PAM sequence: TTC
actgactggtctctctctct

SEQ ID NO: 218207 - DNA, 20 bp, Artificial Sequence
  Description of Artificial Sequence: Synthetic oligonucleotide
  Target: ATXN1; (-) strand; PAM type: YTN; PAM sequence: CTT
cactgactggtctctctctc

SEQ ID NO: 218208 - DNA, 20 bp, Artificial Sequence
  Description of Artificial Sequence: Synthetic oligonucleotide
  Target: ATXN1; (-) strand; PAM type: YTN; PAM sequence: CTC
aggacttcactgactggtct

SEQ ID NO: 218209 - DNA, 20 bp, Artificial Sequence
  Description of Artificial Sequence: Synthetic oligonucleotide
  Target: ATXN1; (-) strand; PAM type: YTN; PAM sequence: CTG
aatcctcaggacttcactga

SEQ ID NO: 218210 - DNA, 20 bp, Artificial Sequence
  Description of Artificial Sequence: Synthetic oligonucleotide
  Target: ATXN1; (-) strand; PAM type: YTN; PAM sequence: TTC
cctgaatcctcaggacttca

SEQ ID NO: 218211 - DNA, 20 bp, Artificial Sequence
  Description of Artificial Sequence: Synthetic oligonucleotide
  Target: ATXN1; (-) strand; PAM type: YTN; PAM sequence: CTT
ccctgaatcctcaggacttc

SEQ ID NO: 218212 - DNA, 20 bp, Artificial Sequence
  Description of Artificial Sequence: Synthetic oligonucleotide
  Target: ATXN1; (-) strand; PAM type: YTN; PAM sequence: TTA
caaagtcttccctgaatcct

SEQ ID NO: 218213 - DNA, 20 bp, Artificial Sequence
  Description of Artificial Sequence: Synthetic oligonucleotide
  Target: ATXN1; (-) strand; PAM type: YTN; PAM sequence: CTT
acaaagtcttccctgaatcc

SEQ ID NO: 218214 - DNA, 20 bp, Artificial Sequence
  Description of Artificial Sequence: Synthetic oligonucleotide
  Target: ATXN1; (-) strand; PAM type: YTN; PAM sequence: CTG
tcacttacaaagtcttccct

SEQ ID NO: 218215 - DNA, 20 bp, Artificial Sequence
  Description of Artificial Sequence: Synthetic oligonucleotide
  Target: ATXN1; (-) strand; PAM type: YTN; PAM sequence: CTG
gctgtcacttacaaagtctt

SEQ ID NO: 218216 - DNA, 20 bp, Artificial Sequence
  Description of Artificial Sequence: Synthetic oligonucleotide
  Target: ATXN1; (-) strand; PAM type: YTN; PAM sequence: CTC
accacaaatcctggctgtca

SEQ ID NO: 218217 - DNA, 20 bp, Artificial Sequence
  Description of Artificial Sequence: Synthetic oligonucleotide
  Target: ATXN1; (-) strand; PAM type: YTN; PAM sequence: CTG
cctcaccacaaatcctggct

SEQ ID NO: 218218 - DNA, 20 bp, Artificial Sequence
  Description of Artificial Sequence: Synthetic oligonucleotide
  Target: ATXN1; (-) strand; PAM type: YTN; PAM sequence: TTC
tgcctcaccacaaatcctgg

SEQ ID NO: 218219 - DNA, 20 bp, Artificial Sequence
  Description of Artificial Sequence: Synthetic oligonucleotide
  Target: ATXN1; (-) strand; PAM type: YTN; PAM sequence: CTA
tcaaagttctgcctcaccac

SEQ ID NO: 218220 - DNA, 20 bp, Artificial Sequence
  Description of Artificial Sequence: Synthetic oligonucleotide
  Target: ATXN1; (-) strand; PAM type: YTN; PAM sequence: CTC
tatcaaagttctgcctcacc

SEQ ID NO: 218221 - DNA, 20 bp, Artificial Sequence
  Description of Artificial Sequence: Synthetic oligonucleotide
  Target: ATXN1; (-) strand; PAM type: YTN; PAM sequence: CTA
tctctatcaaagttctgcct

SEQ ID NO: 218222 - DNA, 20 bp, Artificial Sequence
  Description of Artificial Sequence: Synthetic oligonucleotide
  Target: ATXN1; (-) strand; PAM type: YTN; PAM sequence: TTG
gggactatctctatcaaagt

SEQ ID NO: 218223 - DNA, 20 bp, Artificial Sequence
  Description of Artificial Sequence: Synthetic oligonucleotide
  Target: ATXN1; (-) strand; PAM type: YTN; PAM sequence: CTT
ggggactatctctatcaaag

SEQ ID NO: 218224 - DNA, 20 bp, Artificial Sequence
  Description of Artificial Sequence: Synthetic oligonucleotide
  Target: ATXN1; (-) strand; PAM type: YTN; PAM sequence: TTG
cttggggactatctctatca

SEQ ID NO: 218225 - DNA, 20 bp, Artificial Sequence
  Description of Artificial Sequence: Synthetic oligonucleotide
  Target: ATXN1; (-) strand; PAM type: YTN; PAM sequence: TTA
agacagttgcttggggacta

SEQ ID NO: 218226 - DNA, 20 bp, Artificial Sequence
  Description of Artificial Sequence: Synthetic oligonucleotide
  Target: ATXN1; (-) strand; PAM type: YTN; PAM sequence: TTG
attaagacagttgcttgggg

SEQ ID NO: 218227 - DNA, 20 bp, Artificial Sequence
  Description of Artificial Sequence: Synthetic oligonucleotide
  Target: ATXN1; (-) strand; PAM type: YTN; PAM sequence: TTT
gattaagacagttgcttggg

SEQ ID NO: 218228 - DNA, 20 bp, Artificial Sequence
  Description of Artificial Sequence: Synthetic oligonucleotide
  Target: ATXN1; (-) strand; PAM type: YTN; PAM sequence: CTG
aatcgggaggtttgattaag

SEQ ID NO: 218229 - DNA, 20 bp, Artificial Sequence
  Description of Artificial Sequence: Synthetic oligonucleotide
  Target: ATXN1; (-) strand; PAM type: YTN; PAM sequence: TTG
tcatgctgaatcgggaggtt

SEQ ID NO: 218230 - DNA, 20 bp, Artificial Sequence
  Description of Artificial Sequence: Synthetic oligonucleotide
  Target: ATXN1; (-) strand; PAM type: YTN; PAM sequence: TTT
gtcatgctgaatcgggaggt

SEQ ID NO: 218231 - DNA, 20 bp, Artificial Sequence
  Description of Artificial Sequence: Synthetic oligonucleotide
  Target: ATXN1; (-) strand; PAM type: YTN; PAM sequence: CTT
tgtcatgctgaatcgggagg

SEQ ID NO: 218232 - DNA, 20 bp, Artificial Sequence
  Description of Artificial Sequence: Synthetic oligonucleotide
  Target: ATXN1; (-) strand; PAM type: YTN; PAM sequence: CTG
tatgccatggccactttgtc

SEQ ID NO: 218233 - DNA, 20 bp, Artificial Sequence
  Description of Artificial Sequence: Synthetic oligonucleotide
  Target: ATXN1; (-) strand; PAM type: YTN; PAM sequence: TTA
tgctgtatgccatggccact

SEQ ID NO: 218234 - DNA, 20 bp, Artificial Sequence
  Description of Artificial Sequence: Synthetic oligonucleotide
  Target: ATXN1; (-) strand; PAM type: YTN; PAM sequence: TTT
atgctgtatgccatggccac

SEQ ID NO: 218235 - DNA, 20 bp, Artificial Sequence
  Description of Artificial Sequence: Synthetic oligonucleotide
  Target: ATXN1; (-) strand; PAM type: YTN; PAM sequence: CTC
catttatgctgtatgccatg

SEQ ID NO: 218236 - DNA, 20 bp, Artificial Sequence
  Description of Artificial Sequence: Synthetic oligonucleotide
  Target: ATXN1; (-) strand; PAM type: YTN; PAM sequence: CTC
tccatttatgctgtatgcca

SEQ ID NO: 218237 - DNA, 20 bp, Artificial Sequence
  Description of Artificial Sequence: Synthetic oligonucleotide
  Target: ATXN1; (-) strand; PAM type: YTN; PAM sequence: TTC
ctctccatttatgctgtatg

SEQ ID NO: 218238 - DNA, 20 bp, Artificial Sequence
  Description of Artificial Sequence: Synthetic oligonucleotide
  Target: ATXN1; (-) strand; PAM type: YTN; PAM sequence: CTT
cctctccatttatgctgtat

SEQ ID NO: 218239 - DNA, 20 bp, Artificial Sequence
  Description of Artificial Sequence: Synthetic oligonucleotide
  Target: ATXN1; (-) strand; PAM type: YTN; PAM sequence: CTG
tatcttcctctccatttatg

SEQ ID NO: 218240 - DNA, 20 bp, Artificial Sequence
  Description of Artificial Sequence: Synthetic oligonucleotide
  Target: ATXN1; (-) strand; PAM type: YTN; PAM sequence: CTA
tcctgtatcttcctctccat

SEQ ID NO: 218241 - DNA, 20 bp, Artificial Sequence
  Description of Artificial Sequence: Synthetic oligonucleotide
  Target: ATXN1; (-) strand; PAM type: YTN; PAM sequence: TTC
tatcctgtatcttcctctcc

SEQ ID NO: 218242 - DNA, 20 bp, Artificial Sequence
  Description of Artificial Sequence: Synthetic oligonucleotide
  Target: ATXN1; (-) strand; PAM type: YTN; PAM sequence: TTT
ctatcctgtatcttcctctc

SEQ ID NO: 218243 - DNA, 20 bp, Artificial Sequence
  Description of Artificial Sequence: Synthetic oligonucleotide
  Target: ATXN1; (-) strand; PAM type: YTN; PAM sequence: TTT
tctatcctgtatcttcctct

SEQ ID NO: 218244 - DNA, 20 bp, Artificial Sequence
  Description of Artificial Sequence: Synthetic oligonucleotide
  Target: ATXN1; (-) strand; PAM type: YTN; PAM sequence: CTG
gtggttttctatcctgtatc

SEQ ID NO: 218245 - DNA, 20 bp, Artificial Sequence
  Description of Artificial Sequence: Synthetic oligonucleotide
  Target: ATXN1; (-) strand; PAM type: YTN; PAM sequence: TTG
ctggtggttttctatcctgt

SEQ ID NO: 218246 - DNA, 20 bp, Artificial Sequence
  Description of Artificial Sequence: Synthetic oligonucleotide
  Target: ATXN1; (-) strand; PAM type: YTN; PAM sequence: TTT
gctggtggttttctatcctg

SEQ ID NO: 218247 - DNA, 20 bp, Artificial Sequence
  Description of Artificial Sequence: Synthetic oligonucleotide
  Target: ATXN1; (-) strand; PAM type: YTN; PAM sequence: CTG
tttgctggtggttttctatc

SEQ ID NO: 218248 - DNA, 20 bp, Artificial Sequence
  Description of Artificial Sequence: Synthetic oligonucleotide
  Target: ATXN1; (-) strand; PAM type: YTN; PAM sequence: TTA
cctgtttgctggtggttttc

SEQ ID NO: 218249 - DNA, 20 bp, Artificial Sequence
  Description of Artificial Sequence: Synthetic oligonucleotide
  Target: ATXN1; (-) strand; PAM type: YTN; PAM sequence: TTT
acctgtttgctggtggtttt

SEQ ID NO: 218250 - DNA, 20 bp, Artificial Sequence
  Description of Artificial Sequence: Synthetic oligonucleotide
  Target: ATXN1; (-) strand; PAM type: YTN; PAM sequence: CTT
tacctgtttgctggtggttt

SEQ ID NO: 218251 - DNA, 20 bp, Artificial Sequence
  Description of Artificial Sequence: Synthetic oligonucleotide
  Target: ATXN1; (-) strand; PAM type: YTN; PAM sequence: CTC
tttacctgtttgctggtggt

SEQ ID NO: 218252 - DNA, 20 bp, Artificial Sequence
  Description of Artificial Sequence: Synthetic oligonucleotide
  Target: ATXN1; (-) strand; PAM type: YTN; PAM sequence: CTG
taatcaacataggaaccctc

SEQ ID NO: 218253 - DNA, 20 bp, Artificial Sequence
  Description of Artificial Sequence: Synthetic oligonucleotide
  Target: ATXN1; (-) strand; PAM type: YTN; PAM sequence: TTC
ctgtaatcaacataggaacc

SEQ ID NO: 218254 - DNA, 20 bp, Artificial Sequence
  Description of Artificial Sequence: Synthetic oligonucleotide
  Target: ATXN1; (-) strand; PAM type: YTN; PAM sequence: CTT
cctgtaatcaacataggaac

SEQ ID NO: 218255 - DNA, 20 bp, Artificial Sequence
  Description of Artificial Sequence: Synthetic oligonucleotide
  Target: ATXN1; (-) strand; PAM type: YTN; PAM sequence: CTG
gtgacagtatccttcctgta

SEQ ID NO: 218256 - DNA, 20 bp, Artificial Sequence
  Description of Artificial Sequence: Synthetic oligonucleotide
  Target: ATXN1; (-) strand; PAM type: YTN; PAM sequence: CTC
ctggtgacagtatccttcct

SEQ ID NO: 218257 - DNA, 20 bp, Artificial Sequence
  Description of Artificial Sequence: Synthetic oligonucleotide
  Target: ATXN1; (-) strand; PAM type: YTN; PAM sequence: TTC
tcctggtgacagtatccttc

SEQ ID NO: 218258 - DNA, 20 bp, Artificial Sequence
  Description of Artificial Sequence: Synthetic oligonucleotide
  Target: ATXN1; (-) strand; PAM type: YTN; PAM sequence: TTG
tgattctcctggtgacagta

SEQ ID NO: 218259 - DNA, 20 bp, Artificial Sequence
  Description of Artificial Sequence: Synthetic oligonucleotide
  Target: ATXN1; (-) strand; PAM type: YTN; PAM sequence: TTT
gtgattctcctggtgacagt

SEQ ID NO: 218260 - DNA, 20 bp, Artificial Sequence
  Description of Artificial Sequence: Synthetic oligonucleotide
  Target: ATXN1; (-) strand; PAM type: YTN; PAM sequence: TTT
tgtgattctcctggtgacag

SEQ ID NO: 218261 - DNA, 20 bp, Artificial Sequence
  Description of Artificial Sequence: Synthetic oligonucleotide
  Target: ATXN1; (-) strand; PAM type: YTN; PAM sequence: CTA
gttttgtgattctcctggtg

SEQ ID NO: 218262 - DNA, 20 bp, Artificial Sequence
  Description of Artificial Sequence: Synthetic oligonucleotide
  Target: ATXN1; (-) strand; PAM type: YTN; PAM sequence: CTG
gaagtgctagttttgtgatt

SEQ ID NO: 218263 - DNA, 20 bp, Artificial Sequence
  Description of Artificial Sequence: Synthetic oligonucleotide
  Target: ATXN1; (-) strand; PAM type: YTN; PAM sequence: TTA
tctggaagtgctagttttgt

SEQ ID NO: 218264 - DNA, 20 bp, Artificial Sequence
  Description of Artificial Sequence: Synthetic oligonucleotide
  Target: ATXN1; (-) strand; PAM type: YTN; PAM sequence: TTA
tgaagtgcaggaaaccacat

SEQ ID NO: 218265 - DNA, 20 bp, Artificial Sequence
  Description of Artificial Sequence: Synthetic oligonucleotide
  Target: ATXN1; (-) strand; PAM type: YTN; PAM sequence: TTA
aattatgaagtgcaggaaac

SEQ ID NO: 218266 - DNA, 20 bp, Artificial Sequence
  Description of Artificial Sequence: Synthetic oligonucleotide
  Target: ATXN1; (-) strand; PAM type: YTN; PAM sequence: TTA
caaatattaaattatgaagt

SEQ ID NO: 218267 - DNA, 20 bp, Artificial Sequence
  Description of Artificial Sequence: Synthetic oligonucleotide
  Target: ATXN1; (-) strand; PAM type: YTN; PAM sequence: CTT
acaaatattaaattatgaag

SEQ ID NO: 218268 - DNA, 20 bp, Artificial Sequence
  Description of Artificial Sequence: Synthetic oligonucleotide
  Target: ATXN1; (-) strand; PAM type: YTN; PAM sequence: CTC
ttacaaatattaaattatga

SEQ ID NO: 218269 - DNA, 20 bp, Artificial Sequence
  Description of Artificial Sequence: Synthetic oligonucleotide
  Target: ATXN1; (-) strand; PAM type: YTN; PAM sequence: TTC
tcttacaaatattaaattat

SEQ ID NO: 218270 - DNA, 20 bp, Artificial Sequence
  Description of Artificial Sequence: Synthetic oligonucleotide
  Target: ATXN1; (-) strand; PAM type: YTN; PAM sequence: TTT
ctcttacaaatattaaatta

SEQ ID NO: 218271 - DNA, 20 bp, Artificial Sequence
  Description of Artificial Sequence: Synthetic oligonucleotide
  Target: ATXN1; (-) strand; PAM type: YTN; PAM sequence: TTT
tctcttacaaatattaaatt

SEQ ID NO: 218272 - DNA, 20 bp, Artificial Sequence
  Description of Artificial Sequence: Synthetic oligonucleotide
  Target: ATXN1; (-) strand; PAM type: YTN; PAM sequence: TTT
ttctcttacaaatattaaat

SEQ ID NO: 218273 - DNA, 20 bp, Artificial Sequence
  Description of Artificial Sequence: Synthetic oligonucleotide
  Target: ATXN1; (-) strand; PAM type: YTN; PAM sequence: TTT
tttctcttacaaatattaaa

SEQ ID NO: 218274 - DNA, 20 bp, Artificial Sequence
  Description of Artificial Sequence: Synthetic oligonucleotide
  Target: ATXN1; (-) strand; PAM type: YTN; PAM sequence: TTT
ttttctcttacaaatattaa

SEQ ID NO: 218275 - DNA, 20 bp, Artificial Sequence
  Description of Artificial Sequence: Synthetic oligonucleotide
  Target: ATXN1; (-) strand; PAM type: YTN; PAM sequence: TTT
tttttctcttacaaatatta

SEQ ID NO: 218276 - DNA, 20 bp, Artificial Sequence
  Description of Artificial Sequence: Synthetic oligonucleotide
  Target: ATXN1; (-) strand; PAM type: YTN; PAM sequence: TTT
ttttttctcttacaaatatt

SEQ ID NO: 218277 - DNA, 20 bp, Artificial Sequence
  Description of Artificial Sequence: Synthetic oligonucleotide
  Target: ATXN1; (-) strand; PAM type: YTN; PAM sequence: TTC
ataacagcatttttttttct

SEQ ID NO: 218278 - DNA, 20 bp, Artificial Sequence
  Description of Artificial Sequence: Synthetic oligonucleotide
  Target: ATXN1; (-) strand; PAM type: YTN; PAM sequence: TTT
cataacagcatttttttttc

SEQ ID NO: 218279 - DNA, 20 bp, Artificial Sequence
  Description of Artificial Sequence: Synthetic oligonucleotide
  Target: ATXN1; (-) strand; PAM type: YTN; PAM sequence: TTG
gggtttcataacagcatttt

SEQ ID NO: 218280 - DNA, 20 bp, Artificial Sequence
  Description of Artificial Sequence: Synthetic oligonucleotide
  Target: ATXN1; (-) strand; PAM type: YTN; PAM sequence: TTA
ttggggtttcataacagcat

SEQ ID NO: 218281 - DNA, 20 bp, Artificial Sequence
  Description of Artificial Sequence: Synthetic oligonucleotide
  Target: ATXN1; (-) strand; PAM type: YTN; PAM sequence: TTC
aagtgatgcattattggggt

SEQ ID NO: 218282 - DNA, 20 bp, Artificial Sequence
  Description of Artificial Sequence: Synthetic oligonucleotide
  Target: ATXN1; (-) strand; PAM type: YTN; PAM sequence: CTT
caagtgatgcattattgggg

SEQ ID NO: 218283 - DNA, 20 bp, Artificial Sequence
  Description of Artificial Sequence: Synthetic oligonucleotide
  Target: ATXN1; (-) strand; PAM type: YTN; PAM sequence: CTG
ccttcaagtgatgcattatt

SEQ ID NO: 218284 - DNA, 20 bp, Artificial Sequence
  Description of Artificial Sequence: Synthetic oligonucleotide
  Target: ATXN1; (-) strand; PAM type: YTN; PAM sequence: TTC
tgccttcaagtgatgcatta

SEQ ID NO: 218285 - DNA, 20 bp, Artificial Sequence
  Description of Artificial Sequence: Synthetic oligonucleotide
  Target: ATXN1; (-) strand; PAM type: YTN; PAM sequence: TTT
ctgccttcaagtgatgcatt

SEQ ID NO: 218286 - DNA, 20 bp, Artificial Sequence
  Description of Artificial Sequence: Synthetic oligonucleotide
  Target: ATXN1; (-) strand; PAM type: YTN; PAM sequence: CTT
tctgccttcaagtgatgcat

SEQ ID NO: 218287 - DNA, 20 bp, Artificial Sequence
  Description of Artificial Sequence: Synthetic oligonucleotide
  Target: ATXN1; (-) strand; PAM type: YTN; PAM sequence: CTG
gctttctgccttcaagtgat

SEQ ID NO: 218288 - DNA, 20 bp, Artificial Sequence
  Description of Artificial Sequence: Synthetic oligonucleotide
  Target: ATXN1; (-) strand; PAM type: YTN; PAM sequence: TTA
gcagctggctttctgccttc

SEQ ID NO: 218289 - DNA, 20 bp, Artificial Sequence
  Description of Artificial Sequence: Synthetic oligonucleotide
  Target: ATXN1; (-) strand; PAM type: YTN; PAM sequence: TTG
ttagcagctggctttctgcc

SEQ ID NO: 218290 - DNA, 20 bp, Artificial Sequence
  Description of Artificial Sequence: Synthetic oligonucleotide
  Target: ATXN1; (-) strand; PAM type: YTN; PAM sequence: CTT
gttagcagctggctttctgc

SEQ ID NO: 218291 - DNA, 20 bp, Artificial Sequence
  Description of Artificial Sequence: Synthetic oligonucleotide
  Target: ATXN1; (-) strand; PAM type: YTN; PAM sequence: CTC
ttgttagcagctggctttct

SEQ ID NO: 218292 - DNA, 20 bp, Artificial Sequence
  Description of Artificial Sequence: Synthetic oligonucleotide
  Target: ATXN1; (-) strand; PAM type: YTN; PAM sequence: CTC
agatgtcactcttgttagca

SEQ ID NO: 218293 - DNA, 20 bp, Artificial Sequence
  Description of Artificial Sequence: Synthetic oligonucleotide
  Target: ATXN1; (-) strand; PAM type: YTN; PAM sequence: TTC
agaaatgatgctcagatgtc

SEQ ID NO: 218294 - DNA, 20 bp, Artificial Sequence
  Description of Artificial Sequence: Synthetic oligonucleotide
  Target: ATXN1; (-) strand; PAM type: YTN; PAM sequence: CTT
cagaaatgatgctcagatgt

SEQ ID NO: 218295 - DNA, 20 bp, Artificial Sequence
  Description of Artificial Sequence: Synthetic oligonucleotide
  Target: ATXN1; (-) strand; PAM type: YTN; PAM sequence: CTG
aagcagagcttcagaaatga

SEQ ID NO: 218296 - DNA, 20 bp, Artificial Sequence
  Description of Artificial Sequence: Synthetic oligonucleotide
  Target: ATXN1; (-) strand; PAM type: YTN; PAM sequence: TTC
tgaagcagagcttcagaaat

SEQ ID NO: 218297 - DNA, 20 bp, Artificial Sequence
  Description of Artificial Sequence: Synthetic oligonucleotide
  Target: ATXN1; (-) strand; PAM type: YTN; PAM sequence: TTT
ctgaagcagagcttcagaaa

SEQ ID NO: 218298 - DNA, 20 bp, Artificial Sequence
  Description of Artificial Sequence: Synthetic oligonucleotide
  Target: ATXN1; (-) strand; PAM type: YTN; PAM sequence: CTT
tctgaagcagagcttcagaa

SEQ ID NO: 218299 - DNA, 20 bp, Artificial Sequence
  Description of Artificial Sequence: Synthetic oligonucleotide
  Target: ATXN1; (-) strand; PAM type: YTN; PAM sequence: CTA
aacatcccctttctgaagca

SEQ ID NO: 218300 - DNA, 20 bp, Artificial Sequence
  Description of Artificial Sequence: Synthetic oligonucleotide
  Target: ATXN1; (-) strand; PAM type: YTN; PAM sequence: TTA
ctaaacatcccctttctgaa

SEQ ID NO: 218301 - DNA, 20 bp, Artificial Sequence
  Description of Artificial Sequence: Synthetic oligonucleotide
  Target: ATXN1; (-) strand; PAM type: YTN; PAM sequence: CTT
actaaacatcccctttctga

SEQ ID NO: 218302 - DNA, 20 bp, Artificial Sequence
  Description of Artificial Sequence: Synthetic oligonucleotide
  Target: ATXN1; (-) strand; PAM type: YTN; PAM sequence: TTC
ttactaaacatcccctttct

SEQ ID NO: 218303 - DNA, 20 bp, Artificial Sequence
  Description of Artificial Sequence: Synthetic oligonucleotide
  Target: ATXN1; (-) strand; PAM type: YTN; PAM sequence: TTT
cttactaaacatcccctttc

SEQ ID NO: 218304 - DNA, 20 bp, Artificial Sequence
  Description of Artificial Sequence: Synthetic oligonucleotide
  Target: ATXN1; (-) strand; PAM type: YTN; PAM sequence: CTT
tcttactaaacatccccttt

SEQ ID NO: 218305 - DNA, 20 bp, Artificial Sequence
  Description of Artificial Sequence: Synthetic oligonucleotide
  Target: ATXN1; (-) strand; PAM type: YTN; PAM sequence: TTC
tttcttactaaacatcccct

SEQ ID NO: 218306 - DNA, 20 bp, Artificial Sequence
  Description of Artificial Sequence: Synthetic oligonucleotide
  Target: ATXN1; (-) strand; PAM type: YTN; PAM sequence: TTG
ttctttcttactaaacatcc

SEQ ID NO: 218307 - DNA, 20 bp, Artificial Sequence
  Description of Artificial Sequence: Synthetic oligonucleotide
  Target: ATXN1; (-) strand; PAM type: YTN; PAM sequence: TTA
ttgttctttcttactaaaca

SEQ ID NO: 218308 - DNA, 20 bp, Artificial Sequence
  Description of Artificial Sequence: Synthetic oligonucleotide
  Target: ATXN1; (-) strand; PAM type: YTN; PAM sequence: TTA
ttattgttctttcttactaa

SEQ ID NO: 218309 - DNA, 20 bp, Artificial Sequence
  Description of Artificial Sequence: Synthetic oligonucleotide
  Target: ATXN1; (-) strand; PAM type: YTN; PAM sequence: TTT
attattgttctttcttacta

SEQ ID NO: 218310 - DNA, 20 bp, Artificial Sequence
  Description of Artificial Sequence: Synthetic oligonucleotide
  Target: ATXN1; (-) strand; PAM type: YTN; PAM sequence: TTG
aatagcatttattattgttc

SEQ ID NO: 218311 - DNA, 20 bp, Artificial Sequence
  Description of Artificial Sequence: Synthetic oligonucleotide
  Target: ATXN1; (-) strand; PAM type: YTN; PAM sequence: TTA
cgttgaatagcatttattat

SEQ ID NO: 218312 - DNA, 20 bp, Artificial Sequence
  Description of Artificial Sequence: Synthetic oligonucleotide
  Target: ATXN1; (-) strand; PAM type: YTN; PAM sequence: TTT
acgttgaatagcatttatta

SEQ ID NO: 218313 - DNA, 20 bp, Artificial Sequence
  Description of Artificial Sequence: Synthetic oligonucleotide
  Target: ATXN1; (-) strand; PAM type: YTN; PAM sequence: TTT
tacgttgaatagcatttatt

SEQ ID NO: 218314 - DNA, 20 bp, Artificial Sequence
  Description of Artificial Sequence: Synthetic oligonucleotide
  Target: ATXN1; (-) strand; PAM type: YTN; PAM sequence: TTG
ttttacgttgaatagcattt

SEQ ID NO: 218315 - DNA, 20 bp, Artificial Sequence
  Description of Artificial Sequence: Synthetic oligonucleotide
  Target: ATXN1; (-) strand; PAM type: YTN; PAM sequence: TTT
gttttacgttgaatagcatt

SEQ ID NO: 218316 - DNA, 20 bp, Artificial Sequence
  Description of Artificial Sequence: Synthetic oligonucleotide
  Target: ATXN1; (-) strand; PAM type: YTN; PAM sequence: CTT
tgttttacgttgaatagcat

SEQ ID NO: 218317 - DNA, 20 bp, Artificial Sequence
  Description of Artificial Sequence: Synthetic oligonucleotide
  Target: ATXN1; (-) strand; PAM type: YTN; PAM sequence: CTG
tggatccccacactttgttt

SEQ ID NO: 218318 - DNA, 20 bp, Artificial Sequence
  Description of Artificial Sequence: Synthetic oligonucleotide
  Target: ATXN1; (-) strand; PAM type: YTN; PAM sequence: TTA
accctgtggatccccacact

SEQ ID NO: 218319 - DNA, 20 bp, Artificial Sequence
  Description of Artificial Sequence: Synthetic oligonucleotide
  Target: ATXN1; (-) strand; PAM type: YTN; PAM sequence: CTG
ttaaccctgtggatccccac

SEQ ID NO: 218320 - DNA, 20 bp, Artificial Sequence
  Description of Artificial Sequence: Synthetic oligonucleotide
  Target: ATXN1; (-) strand; PAM type: YTN; PAM sequence: TTA
ccggccagcctgttaaccct

SEQ ID NO: 218321 - DNA, 20 bp, Artificial Sequence
  Description of Artificial Sequence: Synthetic oligonucleotide
  Target: ATXN1; (-) strand; PAM type: YTN; PAM sequence: CTG
gttaccggccagcctgttaa

SEQ ID NO: 218322 - DNA, 20 bp, Artificial Sequence
  Description of Artificial Sequence: Synthetic oligonucleotide
  Target: ATXN1; (-) strand; PAM type: YTN; PAM sequence: TTA
ctggttaccggccagcctgt

SEQ ID NO: 218323 - DNA, 20 bp, Artificial Sequence
  Description of Artificial Sequence: Synthetic oligonucleotide
  Target: ATXN1; (-) strand; PAM type: YTN; PAM sequence: TTG
tgttactggttaccggccag

SEQ ID NO: 218324 - DNA, 20 bp, Artificial Sequence
  Description of Artificial Sequence: Synthetic oligonucleotide
  Target: ATXN1; (-) strand; PAM type: YTN; PAM sequence: TTG
ccgtcattgtgttactggtt

SEQ ID NO: 218325 - DNA, 20 bp, Artificial Sequence
  Description of Artificial Sequence: Synthetic oligonucleotide
  Target: ATXN1; (-) strand; PAM type: YTN; PAM sequence: CTT
gccgtcattgtgttactggt

SEQ ID NO: 218326 - DNA, 20 bp, Artificial Sequence
  Description of Artificial Sequence: Synthetic oligonucleotide
  Target: ATXN1; (-) strand; PAM type: YTN; PAM sequence: CTG
tgcttgccgtcattgtgtta

SEQ ID NO: 218327 - DNA, 20 bp, Artificial Sequence
  Description of Artificial Sequence: Synthetic oligonucleotide
  Target: ATXN1; (-) strand; PAM type: YTN; PAM sequence: CTC
tgtgcttgccgtcattgtgt

SEQ ID NO: 218328 - DNA, 20 bp, Artificial Sequence
  Description of Artificial Sequence: Synthetic oligonucleotide
  Target: ATXN1; (-) strand; PAM type: YTN; PAM sequence: TTC
tctgtgcttgccgtcattgt

SEQ ID NO: 218329 - DNA, 20 bp, Artificial Sequence
  Description of Artificial Sequence: Synthetic oligonucleotide
  Target: ATXN1; (-) strand; PAM type: YTN; PAM sequence: CTT
ctctgtgcttgccgtcattg

SEQ ID NO: 218330 - DNA, 20 bp, Artificial Sequence
  Description of Artificial Sequence: Synthetic oligonucleotide
  Target: ATXN1; (-) strand; PAM type: YTN; PAM sequence: TTC
cttctctgtgcttgccgtca

SEQ ID NO: 218331 - DNA, 20 bp, Artificial Sequence
  Description of Artificial Sequence: Synthetic oligonucleotide
  Target: ATXN1; (-) strand; PAM type: YTN; PAM sequence: TTT
ccttctctgtgcttgccgtc

SEQ ID NO: 218332 - DNA, 20 bp, Artificial Sequence
  Description of Artificial Sequence: Synthetic oligonucleotide
  Target: ATXN1; (-) strand; PAM type: YTN; PAM sequence: TTT
tccttctctgtgcttgccgt

SEQ ID NO: 218333 - DNA, 20 bp, Artificial Sequence
  Description of Artificial Sequence: Synthetic oligonucleotide
  Target: ATXN1; (-) strand; PAM type: YTN; PAM sequence: TTT
ttccttctctgtgcttgccg

SEQ ID NO: 218334 - DNA, 20 bp, Artificial Sequence
  Description of Artificial Sequence: Synthetic oligonucleotide
  Target: ATXN1; (-) strand; PAM type: YTN; PAM sequence: CTT
tttccttctctgtgcttgcc

SEQ ID NO: 218335 - DNA, 20 bp, Artificial Sequence
  Description of Artificial Sequence: Synthetic oligonucleotide
  Target: ATXN1; (-) strand; PAM type: YTN; PAM sequence: CTG
actttttccttctctgtgct

SEQ ID NO: 218336 - DNA, 20 bp, Artificial Sequence
  Description of Artificial Sequence: Synthetic oligonucleotide
  Target: ATXN1; (-) strand; PAM type: YTN; PAM sequence: TTA
ggggatctgactttttcctt

SEQ ID NO: 218337 - DNA, 20 bp, Artificial Sequence
  Description of Artificial Sequence: Synthetic oligonucleotide
  Target: ATXN1; (-) strand; PAM type: YTN; PAM sequence: TTT
aggggatctgactttttcct

SEQ ID NO: 218338 - DNA, 20 bp, Artificial Sequence
  Description of Artificial Sequence: Synthetic oligonucleotide
  Target: ATXN1; (-) strand; PAM type: YTN; PAM sequence: CTT
taggggatctgactttttcc

SEQ ID NO: 218339 - DNA, 20 bp, Artificial Sequence
  Description of Artificial Sequence: Synthetic oligonucleotide
  Target: ATXN1; (-) strand; PAM type: YTN; PAM sequence: TTC
tttaggggatctgacttttt

SEQ ID NO: 218340 - DNA, 20 bp, Artificial Sequence
  Description of Artificial Sequence: Synthetic oligonucleotide
  Target: ATXN1; (-) strand; PAM type: YTN; PAM sequence: TTT
ctttaggggatctgactttt

SEQ ID NO: 218341 - DNA, 20 bp, Artificial Sequence
  Description of Artificial Sequence: Synthetic oligonucleotide
  Target: ATXN1; (-) strand; PAM type: YTN; PAM sequence: TTT
tctttaggggatctgacttt

SEQ ID NO: 218342 - DNA, 20 bp, Artificial Sequence
  Description of Artificial Sequence: Synthetic oligonucleotide
  Target: ATXN1; (-) strand; PAM type: YTN; PAM sequence: TTT
ttctttaggggatctgactt

SEQ ID NO: 218343 - DNA, 20 bp, Artificial Sequence
  Description of Artificial Sequence: Synthetic oligonucleotide
  Target: ATXN1; (-) strand; PAM type: YTN; PAM sequence: TTG
tttttctttaggggatctga

SEQ ID NO: 218344 - DNA, 20 bp, Artificial Sequence
  Description of Artificial Sequence: Synthetic oligonucleotide
  Target: ATXN1; (-) strand; PAM type: YTN; PAM sequence: TTT
gtttttctttaggggatctg

SEQ ID NO: 218345 - DNA, 20 bp, Artificial Sequence
  Description of Artificial Sequence: Synthetic oligonucleotide
  Target: ATXN1; (-) strand; PAM type: YTN; PAM sequence: CTT
tgtttttctttaggggatct

SEQ ID NO: 218346 - DNA, 20 bp, Artificial Sequence
  Description of Artificial Sequence: Synthetic oligonucleotide
  Target: ATXN1; (-) strand; PAM type: YTN; PAM sequence: CTG
tcctttgtttttctttaggg

SEQ ID NO: 218347 - DNA, 20 bp, Artificial Sequence
  Description of Artificial Sequence: Synthetic oligonucleotide
  Target: ATXN1; (-) strand; PAM type: YTN; PAM sequence: TTG
aaatactgtcctttgttttt

SEQ ID NO: 218348 - DNA, 20 bp, Artificial Sequence
  Description of Artificial Sequence: Synthetic oligonucleotide
  Target: ATXN1; (-) strand; PAM type: YTN; PAM sequence: TTT
gaaatactgtcctttgtttt

SEQ ID NO: 218349 - DNA, 20 bp, Artificial Sequence
  Description of Artificial Sequence: Synthetic oligonucleotide
  Target: ATXN1; (-) strand; PAM type: YTN; PAM sequence: TTT
tgaaatactgtcctttgttt

SEQ ID NO: 218350 - DNA, 20 bp, Artificial Sequence
  Description of Artificial Sequence: Synthetic oligonucleotide
  Target: ATXN1; (-) strand; PAM type: YTN; PAM sequence: CTT
ttgaaatactgtcctttgtt

SEQ ID NO: 218351 - DNA, 20 bp, Artificial Sequence
  Description of Artificial Sequence: Synthetic oligonucleotide
  Target: ATXN1; (-) strand; PAM type: YTN; PAM sequence: TTC
ttttgaaatactgtcctttg

SEQ ID NO: 218352 - DNA, 20 bp, Artificial Sequence
  Description of Artificial Sequence: Synthetic oligonucleotide
  Target: ATXN1; (-) strand; PAM type: YTN; PAM sequence: CTT
cttttgaaatactgtccttt

SEQ ID NO: 218353 - DNA, 20 bp, Artificial Sequence
  Description of Artificial Sequence: Synthetic oligonucleotide
  Target: ATXN1; (-) strand; PAM type: YTN; PAM sequence: TTA
tatccaaataagtgagatag

SEQ ID NO: 218354 - DNA, 20 bp, Artificial Sequence
  Description of Artificial Sequence: Synthetic oligonucleotide
  Target: ATXN1; (-) strand; PAM type: YTN; PAM sequence: CTG
aatattatatccaaataagt

SEQ ID NO: 218355 - DNA, 20 bp, Artificial Sequence
  Description of Artificial Sequence: Synthetic oligonucleotide
  Target: ATXN1; (-) strand; PAM type: YTN; PAM sequence: CTG
gcctgaatattatatccaaa

SEQ ID NO: 218356 - DNA, 20 bp, Artificial Sequence
  Description of Artificial Sequence: Synthetic oligonucleotide
  Target: ATXN1; (-) strand; PAM type: YTN; PAM sequence: CTG
tgcctggcctgaatattata

SEQ ID NO: 218357 - DNA, 20 bp, Artificial Sequence
  Description of Artificial Sequence: Synthetic oligonucleotide
  Target: ATXN1; (-) strand; PAM type: YTN; PAM sequence: TTA
caggcatgcaccactgtgcc

SEQ ID NO: 218358 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgcaccac

SEQ ID NO: 218359 - DNA, 20 bp, Artificial Sequence
  Description of Artificial Sequence: Synthetic oligonucleotide
  Target: ATXN1; (-) strand; PAM type: YTN; PAM sequence: CTC
aaagtgctgggattacaggc

SEQ ID NO: 218360 - DNA, 20 bp, Artificial Sequence
  Description of Artificial Sequence: Synthetic oligonucleotide
  Target: ATXN1; (-) strand; PAM type: YTN; PAM sequence: CTC
tcaaagtgctgggattacag

SEQ ID NO: 218361 - DNA, 20 bp, Artificial Sequence
  Description of Artificial Sequence: Synthetic oligonucleotide
  Target: ATXN1; (-) strand; PAM type: YTN; PAM sequence: TTG
gcctctcaaagtgctgggat

SEQ ID NO: 218362 - DNA, 20 bp, Artificial Sequence
  Description of Artificial Sequence: Synthetic oligonucleotide
  Target: ATXN1; (-) strand; PAM type: YTN; PAM sequence: CTT
ggcctctcaaagtgctggga

SEQ ID NO: 218363 - DNA, 20 bp, Artificial Sequence
  Description of Artificial Sequence: Synthetic oligonucleotide
  Target: ATXN1; (-) strand; PAM type: YTN; PAM sequence: CTG
ccttggcctctcaaagtgct

SEQ ID NO: 218364 - DNA, 20 bp, Artificial Sequence
  Description of Artificial Sequence: Synthetic oligonucleotide
  Target: ATXN1; (-) strand; PAM type: YTN; PAM sequence: CTC
cagcaatcatcctgccttgg

SEQ ID NO: 218365 - DNA, 20 bp, Artificial Sequence
  Description of Artificial Sequence: Synthetic oligonucleotide
  Target: ATXN1; (-) strand; PAM type: YTN; PAM sequence: CTG
ggctccagcaatcatcctgc

SEQ ID NO: 218366 - DNA, 20 bp, Artificial Sequence
  Description of Artificial Sequence: Synthetic oligonucleotide
  Target: ATXN1; (-) strand; PAM type: YTN; PAM sequence: CTC
ctgggctccagcaatcatcc

SEQ ID NO: 218367 - DNA, 20 bp, Artificial Sequence
  Description of Artificial Sequence: Synthetic oligonucleotide
  Target: ATXN1; (-) strand; PAM type: YTN; PAM sequence: CTG
gaactcctgggctccagcaa

SEQ ID NO: 218368 - DNA, 20 bp, Artificial Sequence
  Description of Artificial Sequence: Synthetic oligonucleotide
  Target: ATXN1; (-) strand; PAM type: YTN; PAM sequence: CTG
gtctggaactcctgggctcc

SEQ ID NO: 218369 - DNA, 20 bp, Artificial Sequence
  Description of Artificial Sequence: Synthetic oligonucleotide
  Target: ATXN1; (-) strand; PAM type: YTN; PAM sequence: TTG
tccagactggtctggaactc

SEQ ID NO: 218370 - DNA, 20 bp, Artificial Sequence
  Description of Artificial Sequence: Synthetic oligonucleotide
  Target: ATXN1; (-) strand; PAM type: YTN; PAM sequence: CTA
tgttgtccagactggtctgg

SEQ ID NO: 218371 - DNA, 20 bp, Artificial Sequence
  Description of Artificial Sequence: Synthetic oligonucleotide
  Target: ATXN1; (-) strand; PAM type: YTN; PAM sequence: CTC
gctatgttgtccagactggt

SEQ ID NO: 218372 - DNA, 20 bp, Artificial Sequence
  Description of Artificial Sequence: Synthetic oligonucleotide
  Target: ATXN1; (-) strand; PAM type: YTN; PAM sequence: TTG
tagatacgaggtctcgctat

SEQ ID NO: 218373 - DNA, 20 bp, Artificial Sequence
  Description of Artificial Sequence: Synthetic oligonucleotide
  Target: ATXN1; (-) strand; PAM type: YTN; PAM sequence: TTT
gtagatacgaggtctcgcta

SEQ ID NO: 218374 - DNA, 20 bp, Artificial Sequence
  Description of Artificial Sequence: Synthetic oligonucleotide
  Target: ATXN1; (-) strand; PAM type: YTN; PAM sequence: TTT
tgtagatacgaggtctcgct

SEQ ID NO: 218375 - DNA, 20 bp, Artificial Sequence
  Description of Artificial Sequence: Synthetic oligonucleotide
  Target: ATXN1; (-) strand; PAM type: YTN; PAM sequence: TTT
ttgtagatacgaggtctcgc

SEQ ID NO: 218376 - DNA, 20 bp, Artificial Sequence
  Description of Artificial Sequence: Synthetic oligonucleotide
  Target: ATXN1; (-) strand; PAM type: YTN; PAM sequence: TTT
tttgtagatacgaggtctcg

SEQ ID NO: 218377 - DNA, 20 bp, Artificial Sequence
  Description of Artificial Sequence: Synthetic oligonucleotide
  Target: ATXN1; (-) strand; PAM type: YTN; PAM sequence: TTT
ttttgtagatacgaggtctc

SEQ ID NO: 218378 - DNA, 20 bp, Artificial Sequence
  Description of Artificial Sequence: Synthetic oligonucleotide
  Target: ATXN1; (-) strand; PAM type: YTN; PAM sequence: TTC
catttttttgtagatacgag

SEQ ID NO: 218379 - DNA, 20 bp, Artificial Sequence
  Description of Artificial Sequence: Synthetic oligonucleotide
  Target: ATXN1; (-) strand; PAM type: YTN; PAM sequence: TTT
ccatttttttgtagatacga

SEQ ID NO: 218380 - DNA, 20 bp, Artificial Sequence
  Description of Artificial Sequence: Synthetic oligonucleotide
  Target: ATXN1; (-) strand; PAM type: YTN; PAM sequence: TTT
tccatttttttgtagatacg

SEQ ID NO: 218381 - DNA, 20 bp, Artificial Sequence
  Description of Artificial Sequence: Synthetic oligonucleotide
  Target: ATXN1; (-) strand; PAM type: YTN; PAM sequence: TTT
ttccatttttttgtagatac

SEQ ID NO: 218382 - DNA, 20 bp, Artificial Sequence
  Description of Artificial Sequence: Synthetic oligonucleotide
  Target: ATXN1; (-) strand; PAM type: YTN; PAM sequence: CTA
atttttccatttttttgtag

SEQ ID NO: 218383 - DNA, 20 bp, Artificial Sequence
  Description of Artificial Sequence: Synthetic oligonucleotide
  Target: ATXN1; (-) strand; PAM type: YTN; PAM sequence: CTG
gctaatttttccattttttt

SEQ ID NO: 218384 - DNA, 20 bp, Artificial Sequence
  Description of Artificial Sequence: Synthetic oligonucleotide
  Target: ATXN1; (-) strand; PAM type: YTN; PAM sequence: CTA
caggcacgcgccaccatgcc

SEQ ID NO: 218385 - DNA, 20 bp, Artificial Sequence
  Description of Artificial Sequence: Synthetic oligonucleotide
  Target: ATXN1; (-) strand; PAM type: YTN; PAM sequence: TTC
agggcaggaatcatcatcac

SEQ ID NO: 218386 - DNA, 20 bp, Artificial Sequence
  Description of Artificial Sequence: Synthetic oligonucleotide
  Target: ATXN1; (-) strand; PAM type: YTN; PAM sequence: CTT
cagggcaggaatcatcatca

SEQ ID NO: 218387 - DNA, 20 bp, Artificial Sequence
  Description of Artificial Sequence: Synthetic oligonucleotide
  Target: ATXN1; (-) strand; PAM type: YTN; PAM sequence: TTG
tcatcacgccatcaggggta

SEQ ID NO: 218388 - DNA, 20 bp, Artificial Sequence
  Description of Artificial Sequence: Synthetic oligonucleotide
  Target: ATXN1; (-) strand; PAM type: YTN; PAM sequence: TTT
gtcatcacgccatcaggggt

SEQ ID NO: 218389 - DNA, 20 bp, Artificial Sequence
  Description of Artificial Sequence: Synthetic oligonucleotide
  Target: ATXN1; (-) strand; PAM type: YTN; PAM sequence: TTA
gtgtttgtcatcacgccatc

SEQ ID NO: 218390 - DNA, 20 bp, Artificial Sequence
  Description of Artificial Sequence: Synthetic oligonucleotide
  Target: ATXN1; (-) strand; PAM type: YTN; PAM sequence: CTG
ttagtgtttgtcatcacgcc

SEQ ID NO: 218391 - DNA, 20 bp, Artificial Sequence
  Description of Artificial Sequence: Synthetic oligonucleotide
  Target: ATXN1; (-) strand; PAM type: YTN; PAM sequence: TTC
tgttagtgtttgtcatcacg

SEQ ID NO: 218392 - DNA, 20 bp, Artificial Sequence
  Description of Artificial Sequence: Synthetic oligonucleotide
  Target: ATXN1; (-) strand; PAM type: YTN; PAM sequence: TTG
ttctgttagtgtttgtcatc

SEQ ID NO: 218393 - DNA, 20 bp, Artificial Sequence
  Description of Artificial Sequence: Synthetic oligonucleotide
  Target: ATXN1; (-) strand; PAM type: YTN; PAM sequence: CTA
tgtgttgttctgttagtgtt

SEQ ID NO: 218394 - DNA, 20 bp, Artificial Sequence
  Description of Artificial Sequence: Synthetic oligonucleotide
  Target: ATXN1; (-) strand; PAM type: YTN; PAM sequence: CTG
ctatgtgttgttctgttagt

SEQ ID NO: 218395 - DNA, 20 bp, Artificial Sequence
  Description of Artificial Sequence: Synthetic oligonucleotide
  Target: ATXN1; (-) strand; PAM type: YTN; PAM sequence: CTG
catcatataaaatgcactgc

SEQ ID NO: 218396 - DNA, 20 bp, Artificial Sequence
  Description of Artificial Sequence: Synthetic oligonucleotide
  Target: ATXN1; (-) strand; PAM type: YTN; PAM sequence: TTA
gggcctgcatcatataaaat

SEQ ID NO: 218397 - DNA, 20 bp, Artificial Sequence
  Description of Artificial Sequence: Synthetic oligonucleotide
  Target: ATXN1; (-) strand; PAM type: YTN; PAM sequence: TTT
agggcctgcatcatataaaa

SEQ ID NO: 218398 - DNA, 20 bp, Artificial Sequence
  Description of Artificial Sequence: Synthetic oligonucleotide
  Target: ATXN1; (-) strand; PAM type: YTN; PAM sequence: CTG
tcacatttagggcctgcatc

SEQ ID NO: 218399 - DNA, 20 bp, Artificial Sequence
  Description of Artificial Sequence: Synthetic oligonucleotide
  Target: ATXN1; (-) strand; PAM type: YTN; PAM sequence: TTC
tgtcacatttagggcctgca

SEQ ID NO: 218400 - DNA, 20 bp, Artificial Sequence
  Description of Artificial Sequence: Synthetic oligonucleotide
  Target: ATXN1; (-) strand; PAM type: YTN; PAM sequence: CTT
ctgtcacatttagggcctgc

SEQ ID NO: 218401 - DNA, 20 bp, Artificial Sequence
  Description of Artificial Sequence: Synthetic oligonucleotide
  Target: ATXN1; (-) strand; PAM type: YTN; PAM sequence: TTA
tgaacttctgtcacatttag

SEQ ID NO: 218402 - DNA, 20 bp, Artificial Sequence
  Description of Artificial Sequence: Synthetic oligonucleotide
  Target: ATXN1; (-) strand; PAM type: YTN; PAM sequence: TTT
atgaacttctgtcacattta

SEQ ID NO: 218403 - DNA, 20 bp, Artificial Sequence
  Description of Artificial Sequence: Synthetic oligonucleotide
  Target: ATXN1; (-) strand; PAM type: YTN; PAM sequence: CTT
tatgaacttctgtcacattt

SEQ ID NO: 218404 - DNA, 20 bp, Artificial Sequence
  Description of Artificial Sequence: Synthetic oligonucleotide
  Target: ATXN1; (-) strand; PAM type: YTN; PAM sequence: CTC
tttatgaacttctgtcacat

SEQ ID NO: 218405 - DNA, 20 bp, Artificial Sequence
  Description of Artificial Sequence: Synthetic oligonucleotide
  Target: ATXN1; (-) strand; PAM type: YTN; PAM sequence: CTC
tctttatgaacttctgtcac

SEQ ID NO: 218406 - DNA, 20 bp, Artificial Sequence
  Description of Artificial Sequence: Synthetic oligonucleotide
  Target: ATXN1; (-) strand; PAM type: YTN; PAM sequence: CTG
gtctctctttatgaacttct

SEQ ID NO: 218407 - DNA, 20 bp, Artificial Sequence
  Description of Artificial Sequence: Synthetic oligonucleotide
  Target: ATXN1; (-) strand; PAM type: YTN; PAM sequence: CTG
actggtctctctttatgaac

SEQ ID NO: 218408 - DNA, 20 bp, Artificial Sequence
  Description of Artificial Sequence: Synthetic oligonucleotide
  Target: ATXN1; (-) strand; PAM type: YTN; PAM sequence: TTC
gctgactggtctctctttat

SEQ ID NO: 218409 - DNA, 20 bp, Artificial Sequence
  Description of Artificial Sequence: Synthetic oligonucleotide
  Target: ATXN1; (-) strand; PAM type: YTN; PAM sequence: CTT
cgctgactggtctctcttta

SEQ ID NO: 218410 - DNA, 20 bp, Artificial Sequence
  Description of Artificial Sequence: Synthetic oligonucleotide
  Target: ATXN1; (-) strand; PAM type: YTN; PAM sequence: TTA
ggacttcgctgactggtctc

SEQ ID NO: 218411 - DNA, 20 bp, Artificial Sequence
  Description of Artificial Sequence: Synthetic oligonucleotide
  Target: ATXN1; (-) strand; PAM type: YTN; PAM sequence: TTT
aggacttcgctgactggtct

SEQ ID NO: 218412 - DNA, 20 bp, Artificial Sequence
  Description of Artificial Sequence: Synthetic oligonucleotide
  Target: ATXN1; (-) strand; PAM type: YTN; PAM sequence: TTT
taggacttcgctgactggtc

SEQ ID NO: 218413 - DNA, 20 bp, Artificial Sequence
  Description of Artificial Sequence: Synthetic oligonucleotide
  Target: ATXN1; (-) strand; PAM type: YTN; PAM sequence: TTT
ttaggacttcgctgactggt

SEQ ID NO: 218414 - DNA, 20 bp, Artificial Sequence
  Description of Artificial Sequence: Synthetic oligonucleotide
  Target: ATXN1; (-) strand; PAM type: YTN; PAM sequence: CTG
aatttttaggacttcgctga

SEQ ID NO: 218415 - DNA, 20 bp, Artificial Sequence
  Description of Artificial Sequence: Synthetic oligonucleotide
  Target: ATXN1; (-) strand; PAM type: YTN; PAM sequence: TTC
actgaatttttaggacttcg

SEQ ID NO: 218416 - DNA, 20 bp, Artificial Sequence
  Description of Artificial Sequence: Synthetic oligonucleotide
  Target: ATXN1; (-) strand; PAM type: YTN; PAM sequence: CTT
cactgaatttttaggacttc

SEQ ID NO: 218417 - DNA, 20 bp, Artificial Sequence
  Description of Artificial Sequence: Synthetic oligonucleotide
  Target: ATXN1; (-) strand; PAM type: YTN; PAM sequence: TTC
ataaagtcttcactgaattt

SEQ ID NO: 218418 - DNA, 20 bp, Artificial Sequence
  Description of Artificial Sequence: Synthetic oligonucleotide
  Target: ATXN1; (-) strand; PAM type: YTN; PAM sequence: CTG
tcattcataaagtcttcact

SEQ ID NO: 218419 - DNA, 20 bp, Artificial Sequence
  Description of Artificial Sequence: Synthetic oligonucleotide
  Target: ATXN1; (-) strand; PAM type: YTN; PAM sequence: CTG
gctgtcattcataaagtctt

SEQ ID NO: 218420 - DNA, 20 bp, Artificial Sequence
  Description of Artificial Sequence: Synthetic oligonucleotide
  Target: ATXN1; (-) strand; PAM type: YTN; PAM sequence: CTA
tcctggctgtcattcataaa

SEQ ID NO: 218421 - DNA, 20 bp, Artificial Sequence
  Description of Artificial Sequence: Synthetic oligonucleotide
  Target: ATXN1; (-) strand; PAM type: YTN; PAM sequence: CTG
ggactatcctggctgtcatt

SEQ ID NO: 218422 - DNA, 20 bp, Artificial Sequence
  Description of Artificial Sequence: Synthetic oligonucleotide
  Target: ATXN1; (-) strand; PAM type: YTN; PAM sequence: CTG
ggaccatatgagactgggac

SEQ ID NO: 218423 - DNA, 20 bp, Artificial Sequence
  Description of Artificial Sequence: Synthetic oligonucleotide
  Target: ATXN1; (-) strand; PAM type: YTN; PAM sequence: TTG
tgctgggaccatatgagact

SEQ ID NO: 218424 - DNA, 20 bp, Artificial Sequence
  Description of Artificial Sequence: Synthetic oligonucleotide
  Target: ATXN1; (-) strand; PAM type: YTN; PAM sequence: CTT
gtgctgggaccatatgagac

SEQ ID NO: 218425 - DNA, 20 bp, Artificial Sequence
  Description of Artificial Sequence: Synthetic oligonucleotide
  Target: ATXN1; (-) strand; PAM type: YTN; PAM sequence: CTG
cagtggtgcaatcgtagctt

SEQ ID NO: 218426 - DNA, 20 bp, Artificial Sequence
  Description of Artificial Sequence: Synthetic oligonucleotide
  Target: ATXN1; (-) strand; PAM type: YTN; PAM sequence: CTG
gactgcagtggtgcaatcgt

SEQ ID NO: 218427 - DNA, 20 bp, Artificial Sequence
  Description of Artificial Sequence: Synthetic oligonucleotide
  Target: ATXN1; (-) strand; PAM type: YTN; PAM sequence: TTG
cccaggctggactgcagtgg

SEQ ID NO: 218428 - DNA, 20 bp, Artificial Sequence
  Description of Artificial Sequence: Synthetic oligonucleotide
  Target: ATXN1; (-) strand; PAM type: YTN; PAM sequence: TTG
ttgcccaggctggactgcag

SEQ ID NO: 218429 - DNA, 20 bp, Artificial Sequence
  Description of Artificial Sequence: Synthetic oligonucleotide
  Target: ATXN1; (-) strand; PAM type: YTN; PAM sequence: TTT
gttgcccaggctggactgca

SEQ ID NO: 218430 - DNA, 20 bp, Artificial Sequence
  Description of Artificial Sequence: Synthetic oligonucleotide
  Target: ATXN1; (-) strand; PAM type: YTN; PAM sequence: CTT
tgttgcccaggctggactgc

SEQ ID NO: 218431 - DNA, 20 bp, Artificial Sequence
  Description of Artificial Sequence: Synthetic oligonucleotide
  Target: ATXN1; (-) strand; PAM type: YTN; PAM sequence: CTC
tttgttgcccaggctggact

SEQ ID NO: 218432 - DNA, 20 bp, Artificial Sequence
  Description of Artificial Sequence: Synthetic oligonucleotide
  Target: ATXN1; (-) strand; PAM type: YTN; PAM sequence: TTC
tctttgttgcccaggctgga

SEQ ID NO: 218433 - DNA, 20 bp, Artificial Sequence
  Description of Artificial Sequence: Synthetic oligonucleotide
  Target: ATXN1; (-) strand; PAM type: YTN; PAM sequence: TTT
ctctttgttgcccaggctgg

SEQ ID NO: 218434 - DNA, 20 bp, Artificial Sequence
  Description of Artificial Sequence: Synthetic oligonucleotide
  Target: ATXN1; (-) strand; PAM type: YTN; PAM sequence: CTT
tctctttgttgcccaggctg

SEQ ID NO: 218435 - DNA, 20 bp, Artificial Sequence
  Description of Artificial Sequence: Synthetic oligonucleotide
  Target: ATXN1; (-) strand; PAM type: YTN; PAM sequence: TTC
tttctctttgttgcccaggc

SEQ ID NO: 218436 - DNA, 20 bp, Artificial Sequence
  Description of Artificial Sequence: Synthetic oligonucleotide
  Target: ATXN1; (-) strand; PAM type: YTN; PAM sequence: TTT
ctttctctttgttgcccagg

SEQ ID NO: 218437 - DNA, 20 bp, Artificial Sequence
  Description of Artificial Sequence: Synthetic oligonucleotide
  Target: ATXN1; (-) strand; PAM type: YTN; PAM sequence: TTG
agacggggtttctttctctt

SEQ ID NO: 218438 - DNA, 20 bp, Artificial Sequence
  Description of Artificial Sequence: Synthetic oligonucleotide
  Target: ATXN1; (-) strand; PAM type: YTN; PAM sequence: TTT
gagacggggtttctttctct

SEQ ID NO: 218439 - DNA, 20 bp, Artificial Sequence
  Description of Artificial Sequence: Synthetic oligonucleotide
  Target: ATXN1; (-) strand; PAM type: YTN; PAM sequence: TTA
tttgagacggggtttctttc

SEQ ID NO: 218440 - DNA, 20 bp, Artificial Sequence
  Description of Artificial Sequence: Synthetic oligonucleotide
  Target: ATXN1; (-) strand; PAM type: YTN; PAM sequence: TTT
atttgagacggggtttcttt

SEQ ID NO: 218441 - DNA, 20 bp, Artificial Sequence
  Description of Artificial Sequence: Synthetic oligonucleotide
  Target: ATXN1; (-) strand; PAM type: YTN; PAM sequence: TTA
tttatttgagacggggtttc

SEQ ID NO: 218442 - DNA, 20 bp, Artificial Sequence
  Description of Artificial Sequence: Synthetic oligonucleotide
  Target: ATXN1; (-) strand; PAM type: YTN; PAM sequence: TTT
atttatttgagacggggttt

SEQ ID NO: 218443 - DNA, 20 bp, Artificial Sequence
  Description of Artificial Sequence: Synthetic oligonucleotide
  Target: ATXN1; (-) strand; PAM type: YTN; PAM sequence: TTA
tttatttatttgagacgggg

SEQ ID NO: 218444 - DNA, 20 bp, Artificial Sequence
  Description of Artificial Sequence: Synthetic oligonucleotide
  Target: ATXN1; (-) strand; PAM type: YTN; PAM sequence: TTT
atttatttatttgagacggg

SEQ ID NO: 218445 - DNA, 20 bp, Artificial Sequence
  Description of Artificial Sequence: Synthetic oligonucleotide
  Target: ATXN1; (-) strand; PAM type: YTN; PAM sequence: TTA
tttatttatttatttgagac

SEQ ID NO: 218446 - DNA, 20 bp, Artificial Sequence
  Description of Artificial Sequence: Synthetic oligonucleotide
  Target: ATXN1; (-) strand; PAM type: YTN; PAM sequence: TTT
atttatttatttatttgaga

SEQ ID NO: 218447 - DNA, 20 bp, Artificial Sequence
  Description of Artificial Sequence: Synthetic oligonucleotide
  Target: ATXN1; (-) strand; PAM type: YTN; PAM sequence: TTA
tttatttatttatttatttg

SEQ ID NO: 218448 - DNA, 20 bp, Artificial Sequence
  Description of Artificial Sequence: Synthetic oligonucleotide
  Target: ATXN1; (-) strand; PAM type: YTN; PAM sequence: TTT
atttatttatttatttattt

SEQ ID NO: 218449 - DNA, 20 bp, Artificial Sequence
  Description of Artificial Sequence: Synthetic oligonucleotide
  Target: ATXN1; (-) strand; PAM type: YTN; PAM sequence: TTA
atttatttatttatttattt

SEQ ID NO: 218450 - DNA, 20 bp, Artificial Sequence
  Description of Artificial Sequence: Synthetic oligonucleotide
  Target: ATXN1; (-) strand; PAM type: YTN; PAM sequence: TTT
aatttatttatttatttatt

SEQ ID NO: 218451 - DNA, 20 bp, Artificial Sequence
  Description of Artificial Sequence: Synthetic oligonucleotide
  Target: ATXN1; (-) strand; PAM type: YTN; PAM sequence: TTT
taatttatttatttatttat

SEQ ID NO: 218452 - DNA, 20 bp, Artificial Sequence
  Description of Artificial Sequence: Synthetic oligonucleotide
  Target: ATXN1; (-) strand; PAM type: YTN; PAM sequence: TTA
attttaatttatttatttat

SEQ ID NO: 218453 - DNA, 20 bp, Artificial Sequence
  Description of Artificial Sequence: Synthetic oligonucleotide
  Target: ATXN1; (-) strand; PAM type: YTN; PAM sequence: TTT
aattttaatttatttattta

SEQ ID NO: 218454 - DNA, 20 bp, Artificial Sequence
  Description of Artificial Sequence: Synthetic oligonucleotide
  Target: ATXN1; (-) strand; PAM type: YTN; PAM sequence: TTA
tgtatttaattttaatttat

SEQ ID NO: 218455 - DNA, 20 bp, Artificial Sequence
  Description of Artificial Sequence: Synthetic oligonucleotide
  Target: ATXN1; (-) strand; PAM type: YTN; PAM sequence: TTT
atgtatttaattttaattta

SEQ ID NO: 218456 - DNA, 20 bp, Artificial Sequence
  Description of Artificial Sequence: Synthetic oligonucleotide
  Target: ATXN1; (-) strand; PAM type: YTN; PAM sequence: TTT
tatgtatttaattttaattt

SEQ ID NO: 218457 - DNA, 20 bp, Artificial Sequence
  Description of Artificial Sequence: Synthetic oligonucleotide
  Target: ATXN1; (-) strand; PAM type: YTN; PAM sequence: TTT
ttatgtatttaattttaatt

SEQ ID NO: 218458 - DNA, 20 bp, Artificial Sequence
  Description of Artificial Sequence: Synthetic oligonucleotide
  Target: ATXN1; (-) strand; PAM type: YTN; PAM sequence: TTC
atttttatgtatttaatttt

SEQ ID NO: 218459 - DNA, 20 bp, Artificial Sequence
  Description of Artificial Sequence: Synthetic oligonucleotide
  Target: ATXN1; (-) strand; PAM type: YTN; PAM sequence: TTA
tattcatttttatgtattta

SEQ ID NO: 218460 - DNA, 20 bp, Artificial Sequence
  Description of Artificial Sequence: Synthetic oligonucleotide
  Target: ATXN1; (-) strand; PAM type: YTN; PAM sequence: TTA
tgaatattatattcattttt

SEQ ID NO: 218461 - DNA, 20 bp, Artificial Sequence
  Description of Artificial Sequence: Synthetic oligonucleotide
  Target: ATXN1; (-) strand; PAM type: YTN; PAM sequence: TTT
atgaatattatattcatttt

SEQ ID NO: 218462 - DNA, 20 bp, Artificial Sequence
  Description of Artificial Sequence: Synthetic oligonucleotide
  Target: ATXN1; (-) strand; PAM type: YTN; PAM sequence: CTT
tatgaatattatattcattt

SEQ ID NO: 218463 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaatgtggcacagtg

SEQ ID NO: 218464 - DNA, 20 bp, Artificial Sequence
  Description of Artificial Sequence: Synthetic oligonucleotide
  Target: ATXN1; (-) strand; PAM type: YTN; PAM sequence: TTG
caacattaaaaaaaaatgtg

SEQ ID NO: 218465 - DNA, 20 bp, Artificial Sequence
  Description of Artificial Sequence: Synthetic oligonucleotide
  Target: ATXN1; (-) strand; PAM type: YTN; PAM sequence: CTT
gcaacattaaaaaaaaatgt

SEQ ID NO: 218466 - DNA, 20 bp, Artificial Sequence
  Description of Artificial Sequence: Synthetic oligonucleotide
  Target: ATXN1; (-) strand; PAM type: YTN; PAM sequence: TTC
ccttgcaacattaaaaaaaa

SEQ ID NO: 218467 - DNA, 20 bp, Artificial Sequence
  Description of Artificial Sequence: Synthetic oligonucleotide
  Target: ATXN1; (-) strand; PAM type: YTN; PAM sequence: TTA
ttcccttgcaacattaaaaa

SEQ ID NO: 218468 - DNA, 20 bp, Artificial Sequence
  Description of Artificial Sequence: Synthetic oligonucleotide
  Target: ATXN1; (-) strand; PAM type: YTN; PAM sequence: TTT
attcccttgcaacattaaaa

SEQ ID NO: 218469 - DNA, 20 bp, Artificial Sequence
  Description of Artificial Sequence: Synthetic oligonucleotide
  Target: ATXN1; (-) strand; PAM type: YTN; PAM sequence: CTG
cacccggcccgcagtaaata

SEQ ID NO: 218470 - DNA, 20 bp, Artificial Sequence
  Description of Artificial Sequence: Synthetic oligonucleotide
  Target: ATXN1; (-) strand; PAM type: YTN; PAM sequence: TTA
cagatgtgaaccactgcacc

SEQ ID NO: 218471 - DNA, 20 bp, Artificial Sequence
  Description of Artificial Sequence: Synthetic oligonucleotide
  Target: ATXN1; (-) strand; PAM type: YTN; PAM sequence: CTG
ggattacagatgtgaaccac

SEQ ID NO: 218472 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 218473 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 218474 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaaagtgct

SEQ ID NO: 218475 - DNA, 20 bp, Artificial Sequence
  Description of Artificial Sequence: Synthetic oligonucleotide
  Target: ATXN1; (-) strand; PAM type: YTN; PAM sequence: CTC
aggtgatccgcctgcctcag

SEQ ID NO: 218476 - DNA, 20 bp, Artificial Sequence
  Description of Artificial Sequence: Synthetic oligonucleotide
  Target: ATXN1; (-) strand; PAM type: YTN; PAM sequence: CTC
acctcaggtgatccgcctgc

SEQ ID NO: 218477 - DNA, 20 bp, Artificial Sequence
  Description of Artificial Sequence: Synthetic oligonucleotide
  Target: ATXN1; (-) strand; PAM type: YTN; PAM sequence: CTC
ctcacctcaggtgatccgcc

SEQ ID NO: 218478 - DNA, 20 bp, Artificial Sequence
  Description of Artificial Sequence: Synthetic oligonucleotide
  Target: ATXN1; (-) strand; PAM type: YTN; PAM sequence: CTC
gatctcctcacctcaggtga

SEQ ID NO: 218479 - DNA, 20 bp, Artificial Sequence
  Description of Artificial Sequence: Synthetic oligonucleotide
  Target: ATXN1; (-) strand; PAM type: YTN; PAM sequence: TTA
gccaggatggtctcgatctc

SEQ ID NO: 218480 - DNA, 20 bp, Artificial Sequence
  Description of Artificial Sequence: Synthetic oligonucleotide
  Target: ATXN1; (-) strand; PAM type: YTN; PAM sequence: TTC
accatgttagccaggatggt

SEQ ID NO: 218481 - DNA, 20 bp, Artificial Sequence
  Description of Artificial Sequence: Synthetic oligonucleotide
  Target: ATXN1; (-) strand; PAM type: YTN; PAM sequence: TTT
caccatgttagccaggatgg

SEQ ID NO: 218482 - DNA, 20 bp, Artificial Sequence
  Description of Artificial Sequence: Synthetic oligonucleotide
  Target: ATXN1; (-) strand; PAM type: YTN; PAM sequence: CTG
gggtttcaccatgttagcca

SEQ ID NO: 218483 - DNA, 20 bp, Artificial Sequence
  Description of Artificial Sequence: Synthetic oligonucleotide
  Target: ATXN1; (-) strand; PAM type: YTN; PAM sequence: TTA
gtagagctggggtttcacca

SEQ ID NO: 218484 - DNA, 20 bp, Artificial Sequence
  Description of Artificial Sequence: Synthetic oligonucleotide
  Target: ATXN1; (-) strand; PAM type: YTN; PAM sequence: TTT
agtagagctggggtttcacc

SEQ ID NO: 218485 - DNA, 20 bp, Artificial Sequence
  Description of Artificial Sequence: Synthetic oligonucleotide
  Target: ATXN1; (-) strand; PAM type: YTN; PAM sequence: TTT
tagtagagctggggtttcac

SEQ ID NO: 218486 - DNA, 20 bp, Artificial Sequence
  Description of Artificial Sequence: Synthetic oligonucleotide
  Target: ATXN1; (-) strand; PAM type: YTN; PAM sequence: TTT
ttagtagagctggggtttca

SEQ ID NO: 218487 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagctgggg

SEQ ID NO: 218488 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagctggg

SEQ ID NO: 218489 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagctgg

SEQ ID NO: 218490 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagctg

SEQ ID NO: 218491 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 218492 - DNA, 20 bp, Artificial Sequence
  Description of Artificial Sequence: Synthetic oligonucleotide
  Target: ATXN1; (-) strand; PAM type: YTN; PAM sequence: CTA
cagatgcgtgccaccatgcc

SEQ ID NO: 218493 - DNA, 20 bp, Artificial Sequence
  Description of Artificial Sequence: Synthetic oligonucleotide
  Target: ATXN1; (-) strand; PAM type: YTN; PAM sequence: CTG
ggactacagatgcgtgccac

SEQ ID NO: 218494 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggactacag

SEQ ID NO: 218495 - DNA, 20 bp, Artificial Sequence
  Description of Artificial Sequence: Synthetic oligonucleotide
  Target: ATXN1; (-) strand; PAM type: YTN; PAM sequence: CTC
aacctcccgagtagctggga

SEQ ID NO: 218496 - DNA, 20 bp, Artificial Sequence
  Description of Artificial Sequence: Synthetic oligonucleotide
  Target: ATXN1; (-) strand; PAM type: YTN; PAM sequence: CTG
cctcaacctcccgagtagct

SEQ ID NO: 218497 - DNA, 20 bp, Artificial Sequence
  Description of Artificial Sequence: Synthetic oligonucleotide
  Target: ATXN1; (-) strand; PAM type: YTN; PAM sequence: CTC
ctgcctcaacctcccgagta

SEQ ID NO: 218498 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcaacctcccgag

SEQ ID NO: 218499 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgcctcaa

SEQ ID NO: 218500 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcgattctcc

SEQ ID NO: 218501 - DNA, 20 bp, Artificial Sequence
  Description of Artificial Sequence: Synthetic oligonucleotide
  Target: ATXN1; (-) strand; PAM type: YTN; PAM sequence: CTC
cacctcccaggttcaagcga

SEQ ID NO: 218502 - DNA, 20 bp, Artificial Sequence
  Description of Artificial Sequence: Synthetic oligonucleotide
  Target: ATXN1; (-) strand; PAM type: YTN; PAM sequence: CTG
caacctccacctcccaggtt

SEQ ID NO: 218503 - DNA, 20 bp, Artificial Sequence
  Description of Artificial Sequence: Synthetic oligonucleotide
  Target: ATXN1; (-) strand; PAM type: YTN; PAM sequence: TTC
actgcaacctccacctccca

SEQ ID NO: 218504 - DNA, 20 bp, Artificial Sequence
  Description of Artificial Sequence: Synthetic oligonucleotide
  Target: ATXN1; (-) strand; PAM type: YTN; PAM sequence: CTC
agttcactgcaacctccacc

SEQ ID NO: 218505 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcacagtctc

SEQ ID NO: 218506 - DNA, 20 bp, Artificial Sequence
  Description of Artificial Sequence: Synthetic oligonucleotide
  Target: ATXN1; (-) strand; PAM type: YTN; PAM sequence: CTG
tcaccaggctggagtgcagt

SEQ ID NO: 218507 - DNA, 20 bp, Artificial Sequence
  Description of Artificial Sequence: Synthetic oligonucleotide
  Target: ATXN1; (-) strand; PAM type: YTN; PAM sequence: CTC
tgtcaccaggctggagtgca

SEQ ID NO: 218508 - DNA, 20 bp, Artificial Sequence
  Description of Artificial Sequence: Synthetic oligonucleotide
  Target: ATXN1; (-) strand; PAM type: YTN; PAM sequence: TTG
ctctgtcaccaggctggagt

SEQ ID NO: 218509 - DNA, 20 bp, Artificial Sequence
  Description of Artificial Sequence: Synthetic oligonucleotide
  Target: ATXN1; (-) strand; PAM type: YTN; PAM sequence: CTT
gctctgtcaccaggctggag

SEQ ID NO: 218510 - DNA, 20 bp, Artificial Sequence
  Description of Artificial Sequence: Synthetic oligonucleotide
  Target: ATXN1; (-) strand; PAM type: YTN; PAM sequence: TTG
agatggagtcttgctctgtc

SEQ ID NO: 218511 - DNA, 20 bp, Artificial Sequence
  Description of Artificial Sequence: Synthetic oligonucleotide
  Target: ATXN1; (-) strand; PAM type: YTN; PAM sequence: TTT
gagatggagtcttgctctgt

SEQ ID NO: 218512 - DNA, 20 bp, Artificial Sequence
  Description of Artificial Sequence: Synthetic oligonucleotide
  Target: ATXN1; (-) strand; PAM type: YTN; PAM sequence: TTT
tgagatggagtcttgctctg

SEQ ID NO: 218513 - DNA, 20 bp, Artificial Sequence
  Description of Artificial Sequence: Synthetic oligonucleotide
  Target: ATXN1; (-) strand; PAM type: YTN; PAM sequence: TTT
ttgagatggagtcttgctct

SEQ ID NO: 218514 - DNA, 20 bp, Artificial Sequence
  Description of Artificial Sequence: Synthetic oligonucleotide
  Target: ATXN1; (-) strand; PAM type: YTN; PAM sequence: TTT
tttgagatggagtcttgctc

SEQ ID NO: 218515 - DNA, 20 bp, Artificial Sequence
  Description of Artificial Sequence: Synthetic oligonucleotide
  Target: ATXN1; (-) strand; PAM type: YTN; PAM sequence: TTT
ttttgagatggagtcttgct

SEQ ID NO: 218516 - DNA, 20 bp, Artificial Sequence
  Description of Artificial Sequence: Synthetic oligonucleotide
  Target: ATXN1; (-) strand; PAM type: YTN; PAM sequence: TTT
tttttgagatggagtcttgc

SEQ ID NO: 218517 - DNA, 20 bp, Artificial Sequence
  Description of Artificial Sequence: Synthetic oligonucleotide
  Target: ATXN1; (-) strand; PAM type: YTN; PAM sequence: TTT
ttttttgagatggagtcttg

SEQ ID NO: 218518 - DNA, 20 bp, Artificial Sequence
  Description of Artificial Sequence: Synthetic oligonucleotide
  Target: ATXN1; (-) strand; PAM type: YTN; PAM sequence: TTT
tttttttgagatggagtctt

SEQ ID NO: 218519 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagatggagtct

SEQ ID NO: 218520 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagatggagtc

SEQ ID NO: 218521 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagatggagt

SEQ ID NO: 218522 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagatggag

SEQ ID NO: 218523 - DNA, 20 bp, Artificial Sequence
  Description of Artificial Sequence: Synthetic oligonucleotide
  Target: ATXN1; (-) strand; PAM type: YTN; PAM sequence: TTG
ttttttttttttttgagatg

SEQ ID NO: 218524 - DNA, 20 bp, Artificial Sequence
  Description of Artificial Sequence: Synthetic oligonucleotide
  Target: ATXN1; (-) strand; PAM type: YTN; PAM sequence: TTT
gttttttttttttttgagat

SEQ ID NO: 218525 - DNA, 20 bp, Artificial Sequence
  Description of Artificial Sequence: Synthetic oligonucleotide
  Target: ATXN1; (-) strand; PAM type: YTN; PAM sequence: TTT
tgttttttttttttttgaga

SEQ ID NO: 218526 - DNA, 20 bp, Artificial Sequence
  Description of Artificial Sequence: Synthetic oligonucleotide
  Target: ATXN1; (-) strand; PAM type: YTN; PAM sequence: TTT
ttgttttttttttttttgag

SEQ ID NO: 218527 - DNA, 20 bp, Artificial Sequence
  Description of Artificial Sequence: Synthetic oligonucleotide
  Target: ATXN1; (-) strand; PAM type: YTN; PAM sequence: TTT
tttgttttttttttttttga

SEQ ID NO: 218528 - DNA, 20 bp, Artificial Sequence
  Description of Artificial Sequence: Synthetic oligonucleotide
  Target: ATXN1; (-) strand; PAM type: YTN; PAM sequence: TTT
ttttgttttttttttttttg

SEQ ID NO: 218529 - DNA, 20 bp, Artificial Sequence
  Description of Artificial Sequence: Synthetic oligonucleotide
  Target: ATXN1; (-) strand; PAM type: YTN; PAM sequence: CTG
cagtaaataatttttttgtt

SEQ ID NO: 218530 - DNA, 20 bp, Artificial Sequence
  Description of Artificial Sequence: Synthetic oligonucleotide
  Target: ATXN1; (-) strand; PAM type: YTN; PAM sequence: CTG
tcagcatctgcagtaaataa

SEQ ID NO: 218531 - DNA, 20 bp, Artificial Sequence
  Description of Artificial Sequence: Synthetic oligonucleotide
  Target: ATXN1; (-) strand; PAM type: YTN; PAM sequence: TTG
gtcaaacaggactgtcagca

SEQ ID NO: 218532 - DNA, 20 bp, Artificial Sequence
  Description of Artificial Sequence: Synthetic oligonucleotide
  Target: ATXN1; (-) strand; PAM type: YTN; PAM sequence: TTT
ggtcaaacaggactgtcagc

SEQ ID NO: 218533 - DNA, 20 bp, Artificial Sequence
  Description of Artificial Sequence: Synthetic oligonucleotide
  Target: ATXN1; (-) strand; PAM type: YTN; PAM sequence: CTT
tggtcaaacaggactgtcag

SEQ ID NO: 218534 - DNA, 20 bp, Artificial Sequence
  Description of Artificial Sequence: Synthetic oligonucleotide
  Target: ATXN1; (-) strand; PAM type: YTN; PAM sequence: TTG
acagccagccctttggtcaa

SEQ ID NO: 218535 - DNA, 20 bp, Artificial Sequence
  Description of Artificial Sequence: Synthetic oligonucleotide
  Target: ATXN1; (-) strand; PAM type: YTN; PAM sequence: TTT
gacagccagccctttggtca

SEQ ID NO: 218536 - DNA, 20 bp, Artificial Sequence
  Description of Artificial Sequence: Synthetic oligonucleotide
  Target: ATXN1; (-) strand; PAM type: YTN; PAM sequence: TTG
cccatttgacagccagccct

SEQ ID NO: 218537 - DNA, 20 bp, Artificial Sequence
  Description of Artificial Sequence: Synthetic oligonucleotide
  Target: ATXN1; (-) strand; PAM type: YTN; PAM sequence: TTT
gcccatttgacagccagccc

SEQ ID NO: 218538 - DNA, 20 bp, Artificial Sequence
  Description of Artificial Sequence: Synthetic oligonucleotide
  Target: ATXN1; (-) strand; PAM type: YTN; PAM sequence: CTG
gccccatttgcccatttgac

SEQ ID NO: 218539 - DNA, 20 bp, Artificial Sequence
  Description of Artificial Sequence: Synthetic oligonucleotide
  Target: ATXN1; (-) strand; PAM type: YTN; PAM sequence: CTC
ctggccccatttgcccattt

SEQ ID NO: 218540 - DNA, 20 bp, Artificial Sequence
  Description of Artificial Sequence: Synthetic oligonucleotide
  Target: ATXN1; (-) strand; PAM type: YTN; PAM sequence: CTC
ggggggtccctcctggcccc

SEQ ID NO: 218541 - DNA, 20 bp, Artificial Sequence
  Description of Artificial Sequence: Synthetic oligonucleotide
  Target: ATXN1; (-) strand; PAM type: YTN; PAM sequence: TTG
tatcaaccagtgtggaggaa

SEQ ID NO: 218542 - DNA, 20 bp, Artificial Sequence
  Description of Artificial Sequence: Synthetic oligonucleotide
  Target: ATXN1; (-) strand; PAM type: YTN; PAM sequence: CTC
attgtatcaaccagtgtgga

SEQ ID NO: 218543 - DNA, 20 bp, Artificial Sequence
  Description of Artificial Sequence: Synthetic oligonucleotide
  Target: ATXN1; (-) strand; PAM type: YTN; PAM sequence: TTG
cagaggggctcattgtatca

SEQ ID NO: 218544 - DNA, 20 bp, Artificial Sequence
  Description of Artificial Sequence: Synthetic oligonucleotide
  Target: ATXN1; (-) strand; PAM type: YTN; PAM sequence: TTT
gcagaggggctcattgtatc

SEQ ID NO: 218545 - DNA, 20 bp, Artificial Sequence
  Description of Artificial Sequence: Synthetic oligonucleotide
  Target: ATXN1; (-) strand; PAM type: YTN; PAM sequence: TTG
gtggtcatttgcagaggggc

SEQ ID NO: 218546 - DNA, 20 bp, Artificial Sequence
  Description of Artificial Sequence: Synthetic oligonucleotide
  Target: ATXN1; (-) strand; PAM type: YTN; PAM sequence: CTT
ggtggtcatttgcagagggg

SEQ ID NO: 218547 - DNA, 20 bp, Artificial Sequence
  Description of Artificial Sequence: Synthetic oligonucleotide
  Target: ATXN1; (-) strand; PAM type: YTN; PAM sequence: CTG
tgtaggcttggtggtcattt

SEQ ID NO: 218548 - DNA, 20 bp, Artificial Sequence
  Description of Artificial Sequence: Synthetic oligonucleotide
  Target: ATXN1; (-) strand; PAM type: YTN; PAM sequence: TTC
tgtgtaggcttggtggtcat

SEQ ID NO: 218549 - DNA, 20 bp, Artificial Sequence
  Description of Artificial Sequence: Synthetic oligonucleotide
  Target: ATXN1; (-) strand; PAM type: YTN; PAM sequence: TTT
ctgtgtaggcttggtggtca

SEQ ID NO: 218550 - DNA, 20 bp, Artificial Sequence
  Description of Artificial Sequence: Synthetic oligonucleotide
  Target: ATXN1; (-) strand; PAM type: YTN; PAM sequence: TTG
cccaacagaatttctgtgta

SEQ ID NO: 218551 - DNA, 20 bp, Artificial Sequence
  Description of Artificial Sequence: Synthetic oligonucleotide
  Target: ATXN1; (-) strand; PAM type: YTN; PAM sequence: CTT
gcccaacagaatttctgtgt

SEQ ID NO: 218552 - DNA, 20 bp, Artificial Sequence
  Description of Artificial Sequence: Synthetic oligonucleotide
  Target: ATXN1; (-) strand; PAM type: YTN; PAM sequence: TTC
ttgcccaacagaatttctgt

SEQ ID NO: 218553 - DNA, 20 bp, Artificial Sequence
  Description of Artificial Sequence: Synthetic oligonucleotide
  Target: ATXN1; (-) strand; PAM type: YTN; PAM sequence: TTC
agttcttgcccaacagaatt

SEQ ID NO: 218554 - DNA, 20 bp, Artificial Sequence
  Description of Artificial Sequence: Synthetic oligonucleotide
  Target: ATXN1; (-) strand; PAM type: YTN; PAM sequence: CTT
cagttcttgcccaacagaat

SEQ ID NO: 218555 - DNA, 20 bp, Artificial Sequence
  Description of Artificial Sequence: Synthetic oligonucleotide
  Target: ATXN1; (-) strand; PAM type: YTN; PAM sequence: TTA
tccacttcagttcttgccca

SEQ ID NO: 218556 - DNA, 20 bp, Artificial Sequence
  Description of Artificial Sequence: Synthetic oligonucleotide
  Target: ATXN1; (-) strand; PAM type: YTN; PAM sequence: TTA
aataattatccacttcagtt

SEQ ID NO: 218557 - DNA, 20 bp, Artificial Sequence
  Description of Artificial Sequence: Synthetic oligonucleotide
  Target: ATXN1; (-) strand; PAM type: YTN; PAM sequence: CTA
gtgcaatgaattaaataatt

SEQ ID NO: 218558 - DNA, 20 bp, Artificial Sequence
  Description of Artificial Sequence: Synthetic oligonucleotide
  Target: ATXN1; (-) strand; PAM type: YTN; PAM sequence: CTC
tagtgcaatgaattaaataa

SEQ ID NO: 218559 - DNA, 20 bp, Artificial Sequence
  Description of Artificial Sequence: Synthetic oligonucleotide
  Target: ATXN1; (-) strand; PAM type: YTN; PAM sequence: TTC
cctctagtgcaatgaattaa

SEQ ID NO: 218560 - DNA, 20 bp, Artificial Sequence
  Description of Artificial Sequence: Synthetic oligonucleotide
  Target: ATXN1; (-) strand; PAM type: YTN; PAM sequence: TTC
agttccctctagtgcaatga

SEQ ID NO: 218561 - DNA, 20 bp, Artificial Sequence
  Description of Artificial Sequence: Synthetic oligonucleotide
  Target: ATXN1; (-) strand; PAM type: YTN; PAM sequence: TTA
taattcagttccctctagtg

SEQ ID NO: 218562 - DNA, 20 bp, Artificial Sequence
  Description of Artificial Sequence: Synthetic oligonucleotide
  Target: ATXN1; (-) strand; PAM type: YTN; PAM sequence: TTT
ataattcagttccctctagt

SEQ ID NO: 218563 - DNA, 20 bp, Artificial Sequence
  Description of Artificial Sequence: Synthetic oligonucleotide
  Target: ATXN1; (-) strand; PAM type: YTN; PAM sequence: CTG
caaatttataattcagttcc

SEQ ID NO: 218564 - DNA, 20 bp, Artificial Sequence
  Description of Artificial Sequence: Synthetic oligonucleotide
  Target: ATXN1; (-) strand; PAM type: YTN; PAM sequence: CTC
ctgcaaatttataattcagt

SEQ ID NO: 218565 - DNA, 20 bp, Artificial Sequence
  Description of Artificial Sequence: Synthetic oligonucleotide
  Target: ATXN1; (-) strand; PAM type: YTN; PAM sequence: CTC
caaggtctcctgcaaattta

SEQ ID NO: 218566 - DNA, 20 bp, Artificial Sequence
  Description of Artificial Sequence: Synthetic oligonucleotide
  Target: ATXN1; (-) strand; PAM type: YTN; PAM sequence: CTG
atctccaaggtctcctgcaa

SEQ ID NO: 218567 - DNA, 20 bp, Artificial Sequence
  Description of Artificial Sequence: Synthetic oligonucleotide
  Target: ATXN1; (-) strand; PAM type: YTN; PAM sequence: CTA
actgatctccaaggtctcct

SEQ ID NO: 218568 - DNA, 20 bp, Artificial Sequence
  Description of Artificial Sequence: Synthetic oligonucleotide
  Target: ATXN1; (-) strand; PAM type: YTN; PAM sequence: TTA
aagatgtatgtgcctaactg

SEQ ID NO: 218569 - DNA, 20 bp, Artificial Sequence
  Description of Artificial Sequence: Synthetic oligonucleotide
  Target: ATXN1; (-) strand; PAM type: YTN; PAM sequence: TTT
aaagatgtatgtgcctaact

SEQ ID NO: 218570 - DNA, 20 bp, Artificial Sequence
  Description of Artificial Sequence: Synthetic oligonucleotide
  Target: ATXN1; (-) strand; PAM type: YTN; PAM sequence: CTT
taaagatgtatgtgcctaac

SEQ ID NO: 218571 - DNA, 20 bp, Artificial Sequence
  Description of Artificial Sequence: Synthetic oligonucleotide
  Target: ATXN1; (-) strand; PAM type: YTN; PAM sequence: TTG
cctttaaagatgtatgtgcc

SEQ ID NO: 218572 - DNA, 20 bp, Artificial Sequence
  Description of Artificial Sequence: Synthetic oligonucleotide
  Target: ATXN1; (-) strand; PAM type: YTN; PAM sequence: CTT
gcctttaaagatgtatgtgc

SEQ ID NO: 218573 - DNA, 20 bp, Artificial Sequence
  Description of Artificial Sequence: Synthetic oligonucleotide
  Target: ATXN1; (-) strand; PAM type: YTN; PAM sequence: TTG
gaacgacttgcctttaaaga

SEQ ID NO: 218574 - DNA, 20 bp, Artificial Sequence
  Description of Artificial Sequence: Synthetic oligonucleotide
  Target: ATXN1; (-) strand; PAM type: YTN; PAM sequence: CTT
ggaacgacttgcctttaaag

SEQ ID NO: 218575 - DNA, 20 bp, Artificial Sequence
  Description of Artificial Sequence: Synthetic oligonucleotide
  Target: ATXN1; (-) strand; PAM type: YTN; PAM sequence: CTC
atcatcttggaacgacttgc

SEQ ID NO: 218576 - DNA, 20 bp, Artificial Sequence
  Description of Artificial Sequence: Synthetic oligonucleotide
  Target: ATXN1; (-) strand; PAM type: YTN; PAM sequence: TTG
ctcatcatcttggaacgact

SEQ ID NO: 218577 - DNA, 20 bp, Artificial Sequence
  Description of Artificial Sequence: Synthetic oligonucleotide
  Target: ATXN1; (-) strand; PAM type: YTN; PAM sequence: CTT
gctcatcatcttggaacgac

SEQ ID NO: 218578 - DNA, 20 bp, Artificial Sequence
  Description of Artificial Sequence: Synthetic oligonucleotide
  Target: ATXN1; (-) strand; PAM type: YTN; PAM sequence: TTG
gagaacttgctcatcatctt

SEQ ID NO: 218579 - DNA, 20 bp, Artificial Sequence
  Description of Artificial Sequence: Synthetic oligonucleotide
  Target: ATXN1; (-) strand; PAM type: YTN; PAM sequence: CTT
ggagaacttgctcatcatct

SEQ ID NO: 218580 - DNA, 20 bp, Artificial Sequence
  Description of Artificial Sequence: Synthetic oligonucleotide
  Target: ATXN1; (-) strand; PAM type: YTN; PAM sequence: TTG
gtcaccttggagaacttgct

SEQ ID NO: 218581 - DNA, 20 bp, Artificial Sequence
  Description of Artificial Sequence: Synthetic oligonucleotide
  Target: ATXN1; (-) strand; PAM type: YTN; PAM sequence: CTT
ggtcaccttggagaacttgc

SEQ ID NO: 218582 - DNA, 20 bp, Artificial Sequence
  Description of Artificial Sequence: Synthetic oligonucleotide
  Target: ATXN1; (-) strand; PAM type: YTN; PAM sequence: CTA
tcttggtcaccttggagaac

SEQ ID NO: 218583 - DNA, 20 bp, Artificial Sequence
  Description of Artificial Sequence: Synthetic oligonucleotide
  Target: ATXN1; (-) strand; PAM type: YTN; PAM sequence: CTG
ccccacctatcttggtcacc

SEQ ID NO: 218584 - DNA, 20 bp, Artificial Sequence
  Description of Artificial Sequence: Synthetic oligonucleotide
  Target: ATXN1; (-) strand; PAM type: YTN; PAM sequence: CTA
ggtctgccccacctatcttg

SEQ ID NO: 218585 - DNA, 20 bp, Artificial Sequence
  Description of Artificial Sequence: Synthetic oligonucleotide
  Target: ATXN1; (-) strand; PAM type: YTN; PAM sequence: TTG
aagcctaggtctgccccacc

SEQ ID NO: 218586 - DNA, 20 bp, Artificial Sequence
  Description of Artificial Sequence: Synthetic oligonucleotide
  Target: ATXN1; (-) strand; PAM type: YTN; PAM sequence: CTC
aaattgaagcctaggtctgc

SEQ ID NO: 218587 - DNA, 20 bp, Artificial Sequence
  Description of Artificial Sequence: Synthetic oligonucleotide
  Target: ATXN1; (-) strand; PAM type: YTN; PAM sequence: CTG
gaagcagagtcctcaaattg

SEQ ID NO: 218588 - DNA, 20 bp, Artificial Sequence
  Description of Artificial Sequence: Synthetic oligonucleotide
  Target: ATXN1; (-) strand; PAM type: YTN; PAM sequence: TTA
cctggaagcagagtcctcaa

SEQ ID NO: 218589 - DNA, 20 bp, Artificial Sequence
  Description of Artificial Sequence: Synthetic oligonucleotide
  Target: ATXN1; (-) strand; PAM type: YTN; PAM sequence: TTC
atgatattacctggaagcag

SEQ ID NO: 218590 - DNA, 20 bp, Artificial Sequence
  Description of Artificial Sequence: Synthetic oligonucleotide
  Target: ATXN1; (-) strand; PAM type: YTN; PAM sequence: TTA
tcaaccccgttcatgatatt

SEQ ID NO: 218591 - DNA, 20 bp, Artificial Sequence
  Description of Artificial Sequence: Synthetic oligonucleotide
  Target: ATXN1; (-) strand; PAM type: YTN; PAM sequence: TTT
atcaaccccgttcatgatat

SEQ ID NO: 218592 - DNA, 20 bp, Artificial Sequence
  Description of Artificial Sequence: Synthetic oligonucleotide
  Target: ATXN1; (-) strand; PAM type: YTN; PAM sequence: TTT
tatcaaccccgttcatgata

SEQ ID NO: 218593 - DNA, 20 bp, Artificial Sequence
  Description of Artificial Sequence: Synthetic oligonucleotide
  Target: ATXN1; (-) strand; PAM type: YTN; PAM sequence: TTT
ttatcaaccccgttcatgat

SEQ ID NO: 218594 - DNA, 20 bp, Artificial Sequence
  Description of Artificial Sequence: Synthetic oligonucleotide
  Target: ATXN1; (-) strand; PAM type: YTN; PAM sequence: TTT
tttatcaaccccgttcatga

SEQ ID NO: 218595 - DNA, 20 bp, Artificial Sequence
  Description of Artificial Sequence: Synthetic oligonucleotide
  Target: ATXN1; (-) strand; PAM type: YTN; PAM sequence: TTT
ttttatcaaccccgttcatg

SEQ ID NO: 218596 - DNA, 20 bp, Artificial Sequence
  Description of Artificial Sequence: Synthetic oligonucleotide
  Target: ATXN1; (-) strand; PAM type: YTN; PAM sequence: TTT
tttttatcaaccccgttcat

SEQ ID NO: 218597 - DNA, 20 bp, Artificial Sequence
  Description of Artificial Sequence: Synthetic oligonucleotide
  Target: ATXN1; (-) strand; PAM type: YTN; PAM sequence: TTT
ttttttatcaaccccgttca

SEQ ID NO: 218598 - DNA, 20 bp, Artificial Sequence
  Description of Artificial Sequence: Synthetic oligonucleotide
  Target: ATXN1; (-) strand; PAM type: YTN; PAM sequence: TTT
tttttttatcaaccccgttc

SEQ ID NO: 218599 - DNA, 20 bp, Artificial Sequence
  Description of Artificial Sequence: Synthetic oligonucleotide
  Target: ATXN1; (-) strand; PAM type: YTN; PAM sequence: TTC
caggaattttttttttatca

SEQ ID NO: 218600 - DNA, 20 bp, Artificial Sequence
  Description of Artificial Sequence: Synthetic oligonucleotide
  Target: ATXN1; (-) strand; PAM type: YTN; PAM sequence: CTT
ccaggaattttttttttatc

SEQ ID NO: 218601 - DNA, 20 bp, Artificial Sequence
  Description of Artificial Sequence: Synthetic oligonucleotide
  Target: ATXN1; (-) strand; PAM type: YTN; PAM sequence: TTC
cagagcatacaccaacataa

SEQ ID NO: 218602 - DNA, 20 bp, Artificial Sequence
  Description of Artificial Sequence: Synthetic oligonucleotide
  Target: ATXN1; (-) strand; PAM type: YTN; PAM sequence: CTA
taaataaatgataaaaccat

SEQ ID NO: 218603 - DNA, 20 bp, Artificial Sequence
  Description of Artificial Sequence: Synthetic oligonucleotide
  Target: ATXN1; (-) strand; PAM type: YTN; PAM sequence: CTA
aactataaataaatgataaa

SEQ ID NO: 218604 - DNA, 20 bp, Artificial Sequence
  Description of Artificial Sequence: Synthetic oligonucleotide
  Target: ATXN1; (-) strand; PAM type: YTN; PAM sequence: CTC
taaactataaataaatgata

SEQ ID NO: 218605 - DNA, 20 bp, Artificial Sequence
  Description of Artificial Sequence: Synthetic oligonucleotide
  Target: ATXN1; (-) strand; PAM type: YTN; PAM sequence: TTC
aaacactctaaactataaat

SEQ ID NO: 218606 - DNA, 20 bp, Artificial Sequence
  Description of Artificial Sequence: Synthetic oligonucleotide
  Target: ATXN1; (-) strand; PAM type: YTN; PAM sequence: TTG
gaattcaaacactctaaact

SEQ ID NO: 218607 - DNA, 20 bp, Artificial Sequence
  Description of Artificial Sequence: Synthetic oligonucleotide
  Target: ATXN1; (-) strand; PAM type: YTN; PAM sequence: CTG
ggggttggaattcaaacact

SEQ ID NO: 218608 - DNA, 20 bp, Artificial Sequence
  Description of Artificial Sequence: Synthetic oligonucleotide
  Target: ATXN1; (-) strand; PAM type: YTN; PAM sequence: TTA
gtctgggggttggaattcaa

SEQ ID NO: 218609 - DNA, 20 bp, Artificial Sequence
  Description of Artificial Sequence: Synthetic oligonucleotide
  Target: ATXN1; (-) strand; PAM type: YTN; PAM sequence: CTT
agtctgggggttggaattca

SEQ ID NO: 218610 - DNA, 20 bp, Artificial Sequence
  Description of Artificial Sequence: Synthetic oligonucleotide
  Target: ATXN1; (-) strand; PAM type: YTN; PAM sequence: TTG
aatgacagtcttagtctggg

SEQ ID NO: 218611 - DNA, 20 bp, Artificial Sequence
  Description of Artificial Sequence: Synthetic oligonucleotide
  Target: ATXN1; (-) strand; PAM type: YTN; PAM sequence: CTT
gaatgacagtcttagtctgg

SEQ ID NO: 218612 - DNA, 20 bp, Artificial Sequence
  Description of Artificial Sequence: Synthetic oligonucleotide
  Target: ATXN1; (-) strand; PAM type: YTN; PAM sequence: TTA
agtatacatgggcccttgaa

SEQ ID NO: 218613 - DNA, 20 bp, Artificial Sequence
  Description of Artificial Sequence: Synthetic oligonucleotide
  Target: ATXN1; (-) strand; PAM type: YTN; PAM sequence: TTT
aagtatacatgggcccttga

SEQ ID NO: 218614 - DNA, 20 bp, Artificial Sequence
  Description of Artificial Sequence: Synthetic oligonucleotide
  Target: ATXN1; (-) strand; PAM type: YTN; PAM sequence: TTT
taagtatacatgggcccttg

SEQ ID NO: 218615 - DNA, 20 bp, Artificial Sequence
  Description of Artificial Sequence: Synthetic oligonucleotide
  Target: ATXN1; (-) strand; PAM type: YTN; PAM sequence: CTT
ttaagtatacatgggccctt

SEQ ID NO: 218616 - DNA, 20 bp, Artificial Sequence
  Description of Artificial Sequence: Synthetic oligonucleotide
  Target: ATXN1; (-) strand; PAM type: YTN; PAM sequence: CTG
agtaacttttaagtatacat

SEQ ID NO: 218617 - DNA, 20 bp, Artificial Sequence
  Description of Artificial Sequence: Synthetic oligonucleotide
  Target: ATXN1; (-) strand; PAM type: YTN; PAM sequence: TTA
ctgagtaacttttaagtata

SEQ ID NO: 218618 - DNA, 20 bp, Artificial Sequence
  Description of Artificial Sequence: Synthetic oligonucleotide
  Target: ATXN1; (-) strand; PAM type: YTN; PAM sequence: TTT
actgagtaacttttaagtat

SEQ ID NO: 218619 - DNA, 20 bp, Artificial Sequence
  Description of Artificial Sequence: Synthetic oligonucleotide
  Target: ATXN1; (-) strand; PAM type: YTN; PAM sequence: TTC
agcaaacatttactgagtaa

SEQ ID NO: 218620 - DNA, 20 bp, Artificial Sequence
  Description of Artificial Sequence: Synthetic oligonucleotide
  Target: ATXN1; (-) strand; PAM type: YTN; PAM sequence: CTG
ttcagcaaacatttactgag

SEQ ID NO: 218621 - DNA, 20 bp, Artificial Sequence
  Description of Artificial Sequence: Synthetic oligonucleotide
  Target: ATXN1; (-) strand; PAM type: YTN; PAM sequence: TTC
caagtcctgttcagcaaaca

SEQ ID NO: 218622 - DNA, 20 bp, Artificial Sequence
  Description of Artificial Sequence: Synthetic oligonucleotide
  Target: ATXN1; (-) strand; PAM type: YTN; PAM sequence: TTT
ccaagtcctgttcagcaaac

SEQ ID NO: 218623 - DNA, 20 bp, Artificial Sequence
  Description of Artificial Sequence: Synthetic oligonucleotide
  Target: ATXN1; (-) strand; PAM type: YTN; PAM sequence: TTG
tgatgggcaaggtgaaagat

SEQ ID NO: 218624 - DNA, 20 bp, Artificial Sequence
  Description of Artificial Sequence: Synthetic oligonucleotide
  Target: ATXN1; (-) strand; PAM type: YTN; PAM sequence: CTA
ttgtgatgggcaaggtgaaa

SEQ ID NO: 218625 - DNA, 20 bp, Artificial Sequence
  Description of Artificial Sequence: Synthetic oligonucleotide
  Target: ATXN1; (-) strand; PAM type: YTN; PAM sequence: TTA
aatgatgcatgactattgtg

SEQ ID NO: 218626 - DNA, 20 bp, Artificial Sequence
  Description of Artificial Sequence: Synthetic oligonucleotide
  Target: ATXN1; (-) strand; PAM type: YTN; PAM sequence: CTG
tcattaaatgatgcatgact

SEQ ID NO: 218627 - DNA, 20 bp, Artificial Sequence
  Description of Artificial Sequence: Synthetic oligonucleotide
  Target: ATXN1; (-) strand; PAM type: YTN; PAM sequence: CTC
agagcatatccctgtcatta

SEQ ID NO: 218628 - DNA, 20 bp, Artificial Sequence
  Description of Artificial Sequence: Synthetic oligonucleotide
  Target: ATXN1; (-) strand; PAM type: YTN; PAM sequence: TTC
tcagagcatatccctgtcat

SEQ ID NO: 218629 - DNA, 20 bp, Artificial Sequence
  Description of Artificial Sequence: Synthetic oligonucleotide
  Target: ATXN1; (-) strand; PAM type: YTN; PAM sequence: TTT
ctcagagcatatccctgtca

SEQ ID NO: 218630 - DNA, 20 bp, Artificial Sequence
  Description of Artificial Sequence: Synthetic oligonucleotide
  Target: ATXN1; (-) strand; PAM type: YTN; PAM sequence: CTA
acaatgcatttctcagagca

SEQ ID NO: 218631 - DNA, 20 bp, Artificial Sequence
  Description of Artificial Sequence: Synthetic oligonucleotide
  Target: ATXN1; (-) strand; PAM type: YTN; PAM sequence: TTG
cacagtgacaaagtcaccta

SEQ ID NO: 218632 - DNA, 20 bp, Artificial Sequence
  Description of Artificial Sequence: Synthetic oligonucleotide
  Target: ATXN1; (-) strand; PAM type: YTN; PAM sequence: CTG
tgatgttgcacagtgacaaa

SEQ ID NO: 218633 - DNA, 20 bp, Artificial Sequence
  Description of Artificial Sequence: Synthetic oligonucleotide
  Target: ATXN1; (-) strand; PAM type: YTN; PAM sequence: CTC
tgtgatgttgcacagtgaca

SEQ ID NO: 218634 - DNA, 20 bp, Artificial Sequence
  Description of Artificial Sequence: Synthetic oligonucleotide
  Target: ATXN1; (-) strand; PAM type: YTN; PAM sequence: CTG
tgaaagtactctgtgatgtt

SEQ ID NO: 218635 - DNA, 20 bp, Artificial Sequence
  Description of Artificial Sequence: Synthetic oligonucleotide
  Target: ATXN1; (-) strand; PAM type: YTN; PAM sequence: CTA
taccgtatagcgcaggcgtg

SEQ ID NO: 218636 - DNA, 20 bp, Artificial Sequence
  Description of Artificial Sequence: Synthetic oligonucleotide
  Target: ATXN1; (-) strand; PAM type: YTN; PAM sequence: CTA
ggagcaataagctataccgt

SEQ ID NO: 218637 - DNA, 20 bp, Artificial Sequence
  Description of Artificial Sequence: Synthetic oligonucleotide
  Target: ATXN1; (-) strand; PAM type: YTN; PAM sequence: TTG
tagcctaggagcaataagct

SEQ ID NO: 218638 - DNA, 20 bp, Artificial Sequence
  Description of Artificial Sequence: Synthetic oligonucleotide
  Target: ATXN1; (-) strand; PAM type: YTN; PAM sequence: TTT
gtagcctaggagcaataagc

SEQ ID NO: 218639 - DNA, 20 bp, Artificial Sequence
  Description of Artificial Sequence: Synthetic oligonucleotide
  Target: ATXN1; (-) strand; PAM type: YTN; PAM sequence: CTA
cagtagcatgccgtccaggt

SEQ ID NO: 218640 - DNA, 20 bp, Artificial Sequence
  Description of Artificial Sequence: Synthetic oligonucleotide
  Target: ATXN1; (-) strand; PAM type: YTN; PAM sequence: TTC
actacagtagcatgccgtcc

SEQ ID NO: 218641 - DNA, 20 bp, Artificial Sequence
  Description of Artificial Sequence: Synthetic oligonucleotide
  Target: ATXN1; (-) strand; PAM type: YTN; PAM sequence: CTA
cagtattcactacagtagca

SEQ ID NO: 218642 - DNA, 20 bp, Artificial Sequence
  Description of Artificial Sequence: Synthetic oligonucleotide
  Target: ATXN1; (-) strand; PAM type: YTN; PAM sequence: TTG
cctacagtattcactacagt

SEQ ID NO: 218643 - DNA, 20 bp, Artificial Sequence
  Description of Artificial Sequence: Synthetic oligonucleotide
  Target: ATXN1; (-) strand; PAM type: YTN; PAM sequence: TTA
cagttgcctacagtattcac

SEQ ID NO: 218644 - DNA, 20 bp, Artificial Sequence
  Description of Artificial Sequence: Synthetic oligonucleotide
  Target: ATXN1; (-) strand; PAM type: YTN; PAM sequence: TTG
tgttacagttgcctacagta

SEQ ID NO: 218645 - DNA, 20 bp, Artificial Sequence
  Description of Artificial Sequence: Synthetic oligonucleotide
  Target: ATXN1; (-) strand; PAM type: YTN; PAM sequence: CTA
ccattgtgttacagttgcct

SEQ ID NO: 218646 - DNA, 20 bp, Artificial Sequence
  Description of Artificial Sequence: Synthetic oligonucleotide
  Target: ATXN1; (-) strand; PAM type: YTN; PAM sequence: TTA
gaggcacaaatgcctaccat

SEQ ID NO: 218647 - DNA, 20 bp, Artificial Sequence
  Description of Artificial Sequence: Synthetic oligonucleotide
  Target: ATXN1; (-) strand; PAM type: YTN; PAM sequence: TTT
agaggcacaaatgcctacca

SEQ ID NO: 218648 - DNA, 20 bp, Artificial Sequence
  Description of Artificial Sequence: Synthetic oligonucleotide
  Target: ATXN1; (-) strand; PAM type: YTN; PAM sequence: TTA
gatgtgtttagaggcacaaa

SEQ ID NO: 218649 - DNA, 20 bp, Artificial Sequence
  Description of Artificial Sequence: Synthetic oligonucleotide
  Target: ATXN1; (-) strand; PAM type: YTN; PAM sequence: TTT
agatgtgtttagaggcacaa

SEQ ID NO: 218650 - DNA, 20 bp, Artificial Sequence
  Description of Artificial Sequence: Synthetic oligonucleotide
  Target: ATXN1; (-) strand; PAM type: YTN; PAM sequence: CTA
tgtttagatgtgtttagagg

SEQ ID NO: 218651 - DNA, 20 bp, Artificial Sequence
  Description of Artificial Sequence: Synthetic oligonucleotide
  Target: ATXN1; (-) strand; PAM type: YTN; PAM sequence: TTC
tatgtttagatgtgtttaga

SEQ ID NO: 218652 - DNA, 20 bp, Artificial Sequence
  Description of Artificial Sequence: Synthetic oligonucleotide
  Target: ATXN1; (-) strand; PAM type: YTN; PAM sequence: TTT
ctatgtttagatgtgtttag

SEQ ID NO: 218653 - DNA, 20 bp, Artificial Sequence
  Description of Artificial Sequence: Synthetic oligonucleotide
  Target: ATXN1; (-) strand; PAM type: YTN; PAM sequence: TTT
tctatgtttagatgtgttta

SEQ ID NO: 218654 - DNA, 20 bp, Artificial Sequence
  Description of Artificial Sequence: Synthetic oligonucleotide
  Target: ATXN1; (-) strand; PAM type: YTN; PAM sequence: CTT
ttctatgtttagatgtgttt

SEQ ID NO: 218655 - DNA, 20 bp, Artificial Sequence
  Description of Artificial Sequence: Synthetic oligonucleotide
  Target: ATXN1; (-) strand; PAM type: YTN; PAM sequence: TTG
taccttttctatgtttagat

SEQ ID NO: 218656 - DNA, 20 bp, Artificial Sequence
  Description of Artificial Sequence: Synthetic oligonucleotide
  Target: ATXN1; (-) strand; PAM type: YTN; PAM sequence: TTG
gttgtaccttttctatgttt

SEQ ID NO: 218657 - DNA, 20 bp, Artificial Sequence
  Description of Artificial Sequence: Synthetic oligonucleotide
  Target: ATXN1; (-) strand; PAM type: YTN; PAM sequence: TTT
ggttgtaccttttctatgtt

SEQ ID NO: 218658 - DNA, 20 bp, Artificial Sequence
  Description of Artificial Sequence: Synthetic oligonucleotide
  Target: ATXN1; (-) strand; PAM type: YTN; PAM sequence: TTT
tggttgtaccttttctatgt

SEQ ID NO: 218659 - DNA, 20 bp, Artificial Sequence
  Description of Artificial Sequence: Synthetic oligonucleotide
  Target: ATXN1; (-) strand; PAM type: YTN; PAM sequence: CTG
tattttggttgtaccttttc

SEQ ID NO: 218660 - DNA, 20 bp, Artificial Sequence
  Description of Artificial Sequence: Synthetic oligonucleotide
  Target: ATXN1; (-) strand; PAM type: YTN; PAM sequence: TTA
taatactgtattttggttgt

SEQ ID NO: 218661 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaaaaaa

SEQ ID NO: 218662 - DNA, 20 bp, Artificial Sequence
  Description of Artificial Sequence: Synthetic oligonucleotide
  Target: ATXN1; (-) strand; PAM type: YTN; PAM sequence: CTC
catctcaaaaaaaaaaaaaa

SEQ ID NO: 218663 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagcgagactcca

SEQ ID NO: 218664 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcgacagagcga

SEQ ID NO: 218665 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcgacag

SEQ ID NO: 218666 - DNA, 20 bp, Artificial Sequence
  Description of Artificial Sequence: Synthetic oligonucleotide
  Target: ATXN1; (-) strand; PAM type: YTN; PAM sequence: TTG
caccactgcactccagcctg

SEQ ID NO: 218667 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagattgcacc

SEQ ID NO: 218668 - DNA, 20 bp, Artificial Sequence
  Description of Artificial Sequence: Synthetic oligonucleotide
  Target: ATXN1; (-) strand; PAM type: YTN; PAM sequence: CTT
gcagtgagccgagattgcac

SEQ ID NO: 218669 - DNA, 20 bp, Artificial Sequence
  Description of Artificial Sequence: Synthetic oligonucleotide
  Target: ATXN1; (-) strand; PAM type: YTN; PAM sequence: CTG
ggaggcagagcttgcagtga

SEQ ID NO: 218670 - DNA, 20 bp, Artificial Sequence
  Description of Artificial Sequence: Synthetic oligonucleotide
  Target: ATXN1; (-) strand; PAM type: YTN; PAM sequence: CTG
aggcagcagaatggcgtgaa

SEQ ID NO: 218671 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcagcagaat

SEQ ID NO: 218672 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcagcagaa

SEQ ID NO: 218673 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcagca

SEQ ID NO: 218674 - DNA, 20 bp, Artificial Sequence
  Description of Artificial Sequence: Synthetic oligonucleotide
  Target: ATXN1; (-) strand; PAM type: YTN; PAM sequence: TTG
tagtcccagctacttgggag

SEQ ID NO: 218675 - DNA, 20 bp, Artificial Sequence
  Description of Artificial Sequence: Synthetic oligonucleotide
  Target: ATXN1; (-) strand; PAM type: YTN; PAM sequence: CTT
gtagtcccagctacttggga

SEQ ID NO: 218676 - DNA, 20 bp, Artificial Sequence
  Description of Artificial Sequence: Synthetic oligonucleotide
  Target: ATXN1; (-) strand; PAM type: YTN; PAM sequence: TTA
gccgggtgtagtggcgggcg

SEQ ID NO: 218677 - DNA, 20 bp, Artificial Sequence
  Description of Artificial Sequence: Synthetic oligonucleotide
  Target: ATXN1; (-) strand; PAM type: YTN; PAM sequence: CTA
agaatacaaaaaaaaaatta

SEQ ID NO: 218678 - DNA, 20 bp, Artificial Sequence
  Description of Artificial Sequence: Synthetic oligonucleotide
  Target: ATXN1; (-) strand; PAM type: YTN; PAM sequence: CTA
ctaagaatacaaaaaaaaaa

SEQ ID NO: 218679 - DNA, 20 bp, Artificial Sequence
  Description of Artificial Sequence: Synthetic oligonucleotide
  Target: ATXN1; (-) strand; PAM type: YTN; PAM sequence: CTC
tactaagaatacaaaaaaaa

SEQ ID NO: 218680 - DNA, 20 bp, Artificial Sequence
  Description of Artificial Sequence: Synthetic oligonucleotide
  Target: ATXN1; (-) strand; PAM type: YTN; PAM sequence: CTG
tctctactaagaatacaaaa

SEQ ID NO: 218681 - DNA, 20 bp, Artificial Sequence
  Description of Artificial Sequence: Synthetic oligonucleotide
  Target: ATXN1; (-) strand; PAM type: YTN; PAM sequence: CTA
acgcggtgaaaccctgtctc

SEQ ID NO: 218682 - DNA, 20 bp, Artificial Sequence
  Description of Artificial Sequence: Synthetic oligonucleotide
  Target: ATXN1; (-) strand; PAM type: YTN; PAM sequence: CTG
gctaacgcggtgaaaccctg

SEQ ID NO: 218683 - DNA, 20 bp, Artificial Sequence
  Description of Artificial Sequence: Synthetic oligonucleotide
  Target: ATXN1; (-) strand; PAM type: YTN; PAM sequence: TTG
agatcatcctggctaacgcg

SEQ ID NO: 218684 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggcgcgcggat

SEQ ID NO: 218685 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggcgcgcgga

SEQ ID NO: 218686 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggcgcgcgg

SEQ ID NO: 218687 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 218688 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcact

SEQ ID NO: 218689 - DNA, 20 bp, Artificial Sequence
  Description of Artificial Sequence: Synthetic oligonucleotide
  Target: ATXN1; (-) strand; PAM type: YTN; PAM sequence: CTG
ggtgtggtggctcacgcctg

SEQ ID NO: 218690 - DNA, 20 bp, Artificial Sequence
  Description of Artificial Sequence: Synthetic oligonucleotide
  Target: ATXN1; (-) strand; PAM type: YTN; PAM sequence: CTG
ggctgggtgtggtggctcac

SEQ ID NO: 218691 - DNA, 20 bp, Artificial Sequence
  Description of Artificial Sequence: Synthetic oligonucleotide
  Target: ATXN1; (-) strand; PAM type: YTN; PAM sequence: TTA
taatactgggctgggtgtgg

SEQ ID NO: 218692 - DNA, 20 bp, Artificial Sequence
  Description of Artificial Sequence: Synthetic oligonucleotide
  Target: ATXN1; (-) strand; PAM type: YTN; PAM sequence: TTA
cagtggtcccataagattat

SEQ ID NO: 218693 - DNA, 20 bp, Artificial Sequence
  Description of Artificial Sequence: Synthetic oligonucleotide
  Target: ATXN1; (-) strand; PAM type: YTN; PAM sequence: TTC
agtcaacgacagatcacacg

SEQ ID NO: 218694 - DNA, 20 bp, Artificial Sequence
  Description of Artificial Sequence: Synthetic oligonucleotide
  Target: ATXN1; (-) strand; PAM type: YTN; PAM sequence: TTT
cagtcaacgacagatcacac

SEQ ID NO: 218695 - DNA, 20 bp, Artificial Sequence
  Description of Artificial Sequence: Synthetic oligonucleotide
  Target: ATXN1; (-) strand; PAM type: YTN; PAM sequence: TTG
tgatcaaatacagtcatgtg

SEQ ID NO: 218696 - DNA, 20 bp, Artificial Sequence
  Description of Artificial Sequence: Synthetic oligonucleotide
  Target: ATXN1; (-) strand; PAM type: YTN; PAM sequence: CTT
gtgatcaaatacagtcatgt

SEQ ID NO: 218697 - DNA, 20 bp, Artificial Sequence
  Description of Artificial Sequence: Synthetic oligonucleotide
  Target: ATXN1; (-) strand; PAM type: YTN; PAM sequence: TTG
cgtcttgtgatcaaatacag

SEQ ID NO: 218698 - DNA, 20 bp, Artificial Sequence
  Description of Artificial Sequence: Synthetic oligonucleotide
  Target: ATXN1; (-) strand; PAM type: YTN; PAM sequence: TTT
gcgtcttgtgatcaaataca

SEQ ID NO: 218699 - DNA, 20 bp, Artificial Sequence
  Description of Artificial Sequence: Synthetic oligonucleotide
  Target: ATXN1; (-) strand; PAM type: YTN; PAM sequence: TTT
tgcgtcttgtgatcaaatac

SEQ ID NO: 218700 - DNA, 20 bp, Artificial Sequence
  Description of Artificial Sequence: Synthetic oligonucleotide
  Target: ATXN1; (-) strand; PAM type: YTN; PAM sequence: TTT
ttgcgtcttgtgatcaaata

SEQ ID NO: 218701 - DNA, 20 bp, Artificial Sequence
  Description of Artificial Sequence: Synthetic oligonucleotide
  Target: ATXN1; (-) strand; PAM type: YTN; PAM sequence: TTT
tttgcgtcttgtgatcaaat

SEQ ID NO: 218702 - DNA, 20 bp, Artificial Sequence
  Description of Artificial Sequence: Synthetic oligonucleotide
  Target: ATXN1; (-) strand; PAM type: YTN; PAM sequence: TTA
atggcaagttttttgcgtct

SEQ ID NO: 218703 - DNA, 20 bp, Artificial Sequence
  Description of Artificial Sequence: Synthetic oligonucleotide
  Target: ATXN1; (-) strand; PAM type: YTN; PAM sequence: TTT
aatggcaagttttttgcgtc

SEQ ID NO: 218704 - DNA, 20 bp, Artificial Sequence
  Description of Artificial Sequence: Synthetic oligonucleotide
  Target: ATXN1; (-) strand; PAM type: YTN; PAM sequence: TTC
aatttaatggcaagtttttt

SEQ ID NO: 218705 - DNA, 20 bp, Artificial Sequence
  Description of Artificial Sequence: Synthetic oligonucleotide
  Target: ATXN1; (-) strand; PAM type: YTN; PAM sequence: TTA
atcgcacgagaggaagtaga

SEQ ID NO: 218706 - DNA, 20 bp, Artificial Sequence
  Description of Artificial Sequence: Synthetic oligonucleotide
  Target: ATXN1; (-) strand; PAM type: YTN; PAM sequence: CTG
aaaacataagggattaatcg

SEQ ID NO: 218707 - DNA, 20 bp, Artificial Sequence
  Description of Artificial Sequence: Synthetic oligonucleotide
  Target: ATXN1; (-) strand; PAM type: YTN; PAM sequence: TTA
gctgaaaacataagggatta

SEQ ID NO: 218708 - DNA, 20 bp, Artificial Sequence
  Description of Artificial Sequence: Synthetic oligonucleotide
  Target: ATXN1; (-) strand; PAM type: YTN; PAM sequence: TTT
agctgaaaacataagggatt

SEQ ID NO: 218709 - DNA, 20 bp, Artificial Sequence
  Description of Artificial Sequence: Synthetic oligonucleotide
  Target: ATXN1; (-) strand; PAM type: YTN; PAM sequence: TTT
tagctgaaaacataagggat

SEQ ID NO: 218710 - DNA, 20 bp, Artificial Sequence
  Description of Artificial Sequence: Synthetic oligonucleotide
  Target: ATXN1; (-) strand; PAM type: YTN; PAM sequence: CTC
cattttagctgaaaacataa

SEQ ID NO: 218711 - DNA, 20 bp, Artificial Sequence
  Description of Artificial Sequence: Synthetic oligonucleotide
  Target: ATXN1; (-) strand; PAM type: YTN; PAM sequence: CTA
ccagatactccattttagct

SEQ ID NO: 218712 - DNA, 20 bp, Artificial Sequence
  Description of Artificial Sequence: Synthetic oligonucleotide
  Target: ATXN1; (-) strand; PAM type: YTN; PAM sequence: CTA
catctaccagatactccatt

SEQ ID NO: 218713 - DNA, 20 bp, Artificial Sequence
  Description of Artificial Sequence: Synthetic oligonucleotide
  Target: ATXN1; (-) strand; PAM type: YTN; PAM sequence: CTA
aacacacaaacagcaaataa

SEQ ID NO: 218714 - DNA, 20 bp, Artificial Sequence
  Description of Artificial Sequence: Synthetic oligonucleotide
  Target: ATXN1; (-) strand; PAM type: YTN; PAM sequence: TTA
gaaaaaagaacaaaagcaaa

SEQ ID NO: 218715 - DNA, 20 bp, Artificial Sequence
  Description of Artificial Sequence: Synthetic oligonucleotide
  Target: ATXN1; (-) strand; PAM type: YTN; PAM sequence: TTG
tggttagaaaaaagaacaaa

SEQ ID NO: 218716 - DNA, 20 bp, Artificial Sequence
  Description of Artificial Sequence: Synthetic oligonucleotide
  Target: ATXN1; (-) strand; PAM type: YTN; PAM sequence: TTT
gtggttagaaaaaagaacaa

SEQ ID NO: 218717 - DNA, 20 bp, Artificial Sequence
  Description of Artificial Sequence: Synthetic oligonucleotide
  Target: ATXN1; (-) strand; PAM type: YTN; PAM sequence: CTG
aatagaatgtatttgtggtt

SEQ ID NO: 218718 - DNA, 20 bp, Artificial Sequence
  Description of Artificial Sequence: Synthetic oligonucleotide
  Target: ATXN1; (-) strand; PAM type: YTN; PAM sequence: TTG
cagaatagtatgatctgaat

SEQ ID NO: 218719 - DNA, 20 bp, Artificial Sequence
  Description of Artificial Sequence: Synthetic oligonucleotide
  Target: ATXN1; (-) strand; PAM type: YTN; PAM sequence: CTT
gcagaatagtatgatctgaa

SEQ ID NO: 218720 - DNA, 20 bp, Artificial Sequence
  Description of Artificial Sequence: Synthetic oligonucleotide
  Target: ATXN1; (-) strand; PAM type: YTN; PAM sequence: CTG
aaacttgcagaatagtatga

SEQ ID NO: 218721 - DNA, 20 bp, Artificial Sequence
  Description of Artificial Sequence: Synthetic oligonucleotide
  Target: ATXN1; (-) strand; PAM type: YTN; PAM sequence: TTC
tgaaacttgcagaatagtat

SEQ ID NO: 218722 - DNA, 20 bp, Artificial Sequence
  Description of Artificial Sequence: Synthetic oligonucleotide
  Target: ATXN1; (-) strand; PAM type: YTN; PAM sequence: TTT
ctgaaacttgcagaatagta

SEQ ID NO: 218723 - DNA, 20 bp, Artificial Sequence
  Description of Artificial Sequence: Synthetic oligonucleotide
  Target: ATXN1; (-) strand; PAM type: YTN; PAM sequence: TTG
tttctgaaacttgcagaata

SEQ ID NO: 218724 - DNA, 20 bp, Artificial Sequence
  Description of Artificial Sequence: Synthetic oligonucleotide
  Target: ATXN1; (-) strand; PAM type: YTN; PAM sequence: TTT
gtttctgaaacttgcagaat

SEQ ID NO: 218725 - DNA, 20 bp, Artificial Sequence
  Description of Artificial Sequence: Synthetic oligonucleotide
  Target: ATXN1; (-) strand; PAM type: YTN; PAM sequence: TTA
tgtgtttgtttctgaaactt

SEQ ID NO: 218726 - DNA, 20 bp, Artificial Sequence
  Description of Artificial Sequence: Synthetic oligonucleotide
  Target: ATXN1; (-) strand; PAM type: YTN; PAM sequence: TTT
atgtgtttgtttctgaaact

SEQ ID NO: 218727 - DNA, 20 bp, Artificial Sequence
  Description of Artificial Sequence: Synthetic oligonucleotide
  Target: ATXN1; (-) strand; PAM type: YTN; PAM sequence: CTT
tatgtgtttgtttctgaaac

SEQ ID NO: 218728 - DNA, 20 bp, Artificial Sequence
  Description of Artificial Sequence: Synthetic oligonucleotide
  Target: ATXN1; (-) strand; PAM type: YTN; PAM sequence: TTA
ctttatgtgtttgtttctga

SEQ ID NO: 218729 - DNA, 20 bp, Artificial Sequence
  Description of Artificial Sequence: Synthetic oligonucleotide
  Target: ATXN1; (-) strand; PAM type: YTN; PAM sequence: TTT
actttatgtgtttgtttctg

SEQ ID NO: 218730 - DNA, 20 bp, Artificial Sequence
  Description of Artificial Sequence: Synthetic oligonucleotide
  Target: ATXN1; (-) strand; PAM type: YTN; PAM sequence: CTG
agagagcaaccgcatttact

SEQ ID NO: 218731 - DNA, 20 bp, Artificial Sequence
  Description of Artificial Sequence: Synthetic oligonucleotide
  Target: ATXN1; (-) strand; PAM type: YTN; PAM sequence: CTA
gtgacagagcactgagagag

SEQ ID NO: 218732 - DNA, 20 bp, Artificial Sequence
  Description of Artificial Sequence: Synthetic oligonucleotide
  Target: ATXN1; (-) strand; PAM type: YTN; PAM sequence: TTG
tcctagtgacagagcactga

SEQ ID NO: 218733 - DNA, 20 bp, Artificial Sequence
  Description of Artificial Sequence: Synthetic oligonucleotide
  Target: ATXN1; (-) strand; PAM type: YTN; PAM sequence: TTG
aaaaaatgttgtcctagtga

SEQ ID NO: 218734 - DNA, 20 bp, Artificial Sequence
  Description of Artificial Sequence: Synthetic oligonucleotide
  Target: ATXN1; (-) strand; PAM type: YTN; PAM sequence: TTT
gaaaaaatgttgtcctagtg

SEQ ID NO: 218735 - DNA, 20 bp, Artificial Sequence
  Description of Artificial Sequence: Synthetic oligonucleotide
  Target: ATXN1; (-) strand; PAM type: YTN; PAM sequence: CTA
aataacaggacatttgaaaa

SEQ ID NO: 218736 - DNA, 20 bp, Artificial Sequence
  Description of Artificial Sequence: Synthetic oligonucleotide
  Target: ATXN1; (-) strand; PAM type: YTN; PAM sequence: CTA
catcctaaataacaggacat

SEQ ID NO: 218737 - DNA, 20 bp, Artificial Sequence
  Description of Artificial Sequence: Synthetic oligonucleotide
  Target: ATXN1; (-) strand; PAM type: YTN; PAM sequence: CTC
tacatcctaaataacaggac

SEQ ID NO: 218738 - DNA, 20 bp, Artificial Sequence
  Description of Artificial Sequence: Synthetic oligonucleotide
  Target: ATXN1; (-) strand; PAM type: YTN; PAM sequence: TTC
tctacatcctaaataacagg

SEQ ID NO: 218739 - DNA, 20 bp, Artificial Sequence
  Description of Artificial Sequence: Synthetic oligonucleotide
  Target: ATXN1; (-) strand; PAM type: YTN; PAM sequence: TTT
ctctacatcctaaataacag

SEQ ID NO: 218740 - DNA, 20 bp, Artificial Sequence
  Description of Artificial Sequence: Synthetic oligonucleotide
  Target: ATXN1; (-) strand; PAM type: YTN; PAM sequence: CTA
tttctctacatcctaaataa

SEQ ID NO: 218741 - DNA, 20 bp, Artificial Sequence
  Description of Artificial Sequence: Synthetic oligonucleotide
  Target: ATXN1; (-) strand; PAM type: YTN; PAM sequence: TTG
ctatttctctacatcctaaa

SEQ ID NO: 218742 - DNA, 20 bp, Artificial Sequence
  Description of Artificial Sequence: Synthetic oligonucleotide
  Target: ATXN1; (-) strand; PAM type: YTN; PAM sequence: TTC
aagcgtattgctatttctct

SEQ ID NO: 218743 - DNA, 20 bp, Artificial Sequence
  Description of Artificial Sequence: Synthetic oligonucleotide
  Target: ATXN1; (-) strand; PAM type: YTN; PAM sequence: CTT
caagcgtattgctatttctc

SEQ ID NO: 218744 - DNA, 20 bp, Artificial Sequence
  Description of Artificial Sequence: Synthetic oligonucleotide
  Target: ATXN1; (-) strand; PAM type: YTN; PAM sequence: TTC
ttcaagcgtattgctatttc

SEQ ID NO: 218745 - DNA, 20 bp, Artificial Sequence
  Description of Artificial Sequence: Synthetic oligonucleotide
  Target: ATXN1; (-) strand; PAM type: YTN; PAM sequence: CTT
cttcaagcgtattgctattt

SEQ ID NO: 218746 - DNA, 20 bp, Artificial Sequence
  Description of Artificial Sequence: Synthetic oligonucleotide
  Target: ATXN1; (-) strand; PAM type: YTN; PAM sequence: TTC
ttcttcaagcgtattgctat

SEQ ID NO: 218747 - DNA, 20 bp, Artificial Sequence
  Description of Artificial Sequence: Synthetic oligonucleotide
  Target: ATXN1; (-) strand; PAM type: YTN; PAM sequence: CTT
cttcttcaagcgtattgcta

SEQ ID NO: 218748 - DNA, 20 bp, Artificial Sequence
  Description of Artificial Sequence: Synthetic oligonucleotide
  Target: ATXN1; (-) strand; PAM type: YTN; PAM sequence: CTG
gtgtaccagaacttcttctt

SEQ ID NO: 218749 - DNA, 20 bp, Artificial Sequence
  Description of Artificial Sequence: Synthetic oligonucleotide
  Target: ATXN1; (-) strand; PAM type: YTN; PAM sequence: TTC
actggtgtaccagaacttct

SEQ ID NO: 218750 - DNA, 20 bp, Artificial Sequence
  Description of Artificial Sequence: Synthetic oligonucleotide
  Target: ATXN1; (-) strand; PAM type: YTN; PAM sequence: CTT
cactggtgtaccagaacttc

SEQ ID NO: 218751 - DNA, 20 bp, Artificial Sequence
  Description of Artificial Sequence: Synthetic oligonucleotide
  Target: ATXN1; (-) strand; PAM type: YTN; PAM sequence: TTA
aatgtcatcgggcatcactt

SEQ ID NO: 218752 - DNA, 20 bp, Artificial Sequence
  Description of Artificial Sequence: Synthetic oligonucleotide
  Target: ATXN1; (-) strand; PAM type: YTN; PAM sequence: TTT
aaatgtcatcgggcatcact

SEQ ID NO: 218753 - DNA, 20 bp, Artificial Sequence
  Description of Artificial Sequence: Synthetic oligonucleotide
  Target: ATXN1; (-) strand; PAM type: YTN; PAM sequence: CTT
taaatgtcatcgggcatcac

SEQ ID NO: 218754 - DNA, 20 bp, Artificial Sequence
  Description of Artificial Sequence: Synthetic oligonucleotide
  Target: ATXN1; (-) strand; PAM type: YTN; PAM sequence: TTA
gctttaaatgtcatcgggca

SEQ ID NO: 218755 - DNA, 20 bp, Artificial Sequence
  Description of Artificial Sequence: Synthetic oligonucleotide
  Target: ATXN1; (-) strand; PAM type: YTN; PAM sequence: TTT
agctttaaatgtcatcgggc

SEQ ID NO: 218756 - DNA, 20 bp, Artificial Sequence
  Description of Artificial Sequence: Synthetic oligonucleotide
  Target: ATXN1; (-) strand; PAM type: YTN; PAM sequence: TTT
tagctttaaatgtcatcggg

SEQ ID NO: 218757 - DNA, 20 bp, Artificial Sequence
  Description of Artificial Sequence: Synthetic oligonucleotide
  Target: ATXN1; (-) strand; PAM type: YTN; PAM sequence: CTT
ttagctttaaatgtcatcgg

SEQ ID NO: 218758 - DNA, 20 bp, Artificial Sequence
  Description of Artificial Sequence: Synthetic oligonucleotide
  Target: ATXN1; (-) strand; PAM type: YTN; PAM sequence: TTG
acatcttttagctttaaatg

SEQ ID NO: 218759 - DNA, 20 bp, Artificial Sequence
  Description of Artificial Sequence: Synthetic oligonucleotide
  Target: ATXN1; (-) strand; PAM type: YTN; PAM sequence: CTT
gacatcttttagctttaaat

SEQ ID NO: 218760 - DNA, 20 bp, Artificial Sequence
  Description of Artificial Sequence: Synthetic oligonucleotide
  Target: ATXN1; (-) strand; PAM type: YTN; PAM sequence: TTG
gtaagtcatccaaaagactt

SEQ ID NO: 218761 - DNA, 20 bp, Artificial Sequence
  Description of Artificial Sequence: Synthetic oligonucleotide
  Target: ATXN1; (-) strand; PAM type: YTN; PAM sequence: TTT
ggtaagtcatccaaaagact

SEQ ID NO: 218762 - DNA, 20 bp, Artificial Sequence
  Description of Artificial Sequence: Synthetic oligonucleotide
  Target: ATXN1; (-) strand; PAM type: YTN; PAM sequence: TTT
tggtaagtcatccaaaagac

SEQ ID NO: 218763 - DNA, 20 bp, Artificial Sequence
  Description of Artificial Sequence: Synthetic oligonucleotide
  Target: ATXN1; (-) strand; PAM type: YTN; PAM sequence: TTT
ttggtaagtcatccaaaaga

SEQ ID NO: 218764 - DNA, 20 bp, Artificial Sequence
  Description of Artificial Sequence: Synthetic oligonucleotide
  Target: ATXN1; (-) strand; PAM type: YTN; PAM sequence: TTG
aaacacaaatggtttttggt

SEQ ID NO: 218765 - DNA, 20 bp, Artificial Sequence
  Description of Artificial Sequence: Synthetic oligonucleotide
  Target: ATXN1; (-) strand; PAM type: YTN; PAM sequence: CTT
gaaacacaaatggtttttgg

SEQ ID NO: 218766 - DNA, 20 bp, Artificial Sequence
  Description of Artificial Sequence: Synthetic oligonucleotide
  Target: ATXN1; (-) strand; PAM type: YTN; PAM sequence: CTG
cacggatggtcttgaaacac

SEQ ID NO: 218767 - DNA, 20 bp, Artificial Sequence
  Description of Artificial Sequence: Synthetic oligonucleotide
  Target: ATXN1; (-) strand; PAM type: YTN; PAM sequence: TTC
agcctgcacggatggtcttg

SEQ ID NO: 218768 - DNA, 20 bp, Artificial Sequence
  Description of Artificial Sequence: Synthetic oligonucleotide
  Target: ATXN1; (-) strand; PAM type: YTN; PAM sequence: TTT
cagcctgcacggatggtctt

SEQ ID NO: 218769 - DNA, 20 bp, Artificial Sequence
  Description of Artificial Sequence: Synthetic oligonucleotide
  Target: ATXN1; (-) strand; PAM type: YTN; PAM sequence: CTG
cagaccaggaacaagagaga

SEQ ID NO: 218770 - DNA, 20 bp, Artificial Sequence
  Description of Artificial Sequence: Synthetic oligonucleotide
  Target: ATXN1; (-) strand; PAM type: YTN; PAM sequence: CTG
ctgcagaccaggaacaagag

SEQ ID NO: 218771 - DNA, 20 bp, Artificial Sequence
  Description of Artificial Sequence: Synthetic oligonucleotide
  Target: ATXN1; (-) strand; PAM type: YTN; PAM sequence: TTA
gtgctgctgcagaccaggaa

SEQ ID NO: 218772 - DNA, 20 bp, Artificial Sequence
  Description of Artificial Sequence: Synthetic oligonucleotide
  Target: ATXN1; (-) strand; PAM type: YTN; PAM sequence: CTT
agtgctgctgcagaccagga

SEQ ID NO: 218773 - DNA, 20 bp, Artificial Sequence
  Description of Artificial Sequence: Synthetic oligonucleotide
  Target: ATXN1; (-) strand; PAM type: YTN; PAM sequence: TTC
aaacttagtgctgctgcaga

SEQ ID NO: 218774 - DNA, 20 bp, Artificial Sequence
  Description of Artificial Sequence: Synthetic oligonucleotide
  Target: ATXN1; (-) strand; PAM type: YTN; PAM sequence: CTT
caaacttagtgctgctgcag

SEQ ID NO: 218775 - DNA, 20 bp, Artificial Sequence
  Description of Artificial Sequence: Synthetic oligonucleotide
  Target: ATXN1; (-) strand; PAM type: YTN; PAM sequence: TTG
aagcttcaaacttagtgctg

SEQ ID NO: 218776 - DNA, 20 bp, Artificial Sequence
  Description of Artificial Sequence: Synthetic oligonucleotide
  Target: ATXN1; (-) strand; PAM type: YTN; PAM sequence: TTT
gaagcttcaaacttagtgct

SEQ ID NO: 218777 - DNA, 20 bp, Artificial Sequence
  Description of Artificial Sequence: Synthetic oligonucleotide
  Target: ATXN1; (-) strand; PAM type: YTN; PAM sequence: TTT
tgaagcttcaaacttagtgc

SEQ ID NO: 218778 - DNA, 20 bp, Artificial Sequence
  Description of Artificial Sequence: Synthetic oligonucleotide
  Target: ATXN1; (-) strand; PAM type: YTN; PAM sequence: CTA
ttttgaagcttcaaacttag

SEQ ID NO: 218779 - DNA, 20 bp, Artificial Sequence
  Description of Artificial Sequence: Synthetic oligonucleotide
  Target: ATXN1; (-) strand; PAM type: YTN; PAM sequence: CTG
gagcatagtgaaagagtcta

SEQ ID NO: 218780 - DNA, 20 bp, Artificial Sequence
  Description of Artificial Sequence: Synthetic oligonucleotide
  Target: ATXN1; (-) strand; PAM type: YTN; PAM sequence: CTG
cagcatactggagcatagtg

SEQ ID NO: 218781 - DNA, 20 bp, Artificial Sequence
  Description of Artificial Sequence: Synthetic oligonucleotide
  Target: ATXN1; (-) strand; PAM type: YTN; PAM sequence: TTG
actgcagcatactggagcat

SEQ ID NO: 218782 - DNA, 20 bp, Artificial Sequence
  Description of Artificial Sequence: Synthetic oligonucleotide
  Target: ATXN1; (-) strand; PAM type: YTN; PAM sequence: TTT
gactgcagcatactggagca

SEQ ID NO: 218783 - DNA, 20 bp, Artificial Sequence
  Description of Artificial Sequence: Synthetic oligonucleotide
  Target: ATXN1; (-) strand; PAM type: YTN; PAM sequence: TTG
tttgactgcagcatactgga

SEQ ID NO: 218784 - DNA, 20 bp, Artificial Sequence
  Description of Artificial Sequence: Synthetic oligonucleotide
  Target: ATXN1; (-) strand; PAM type: YTN; PAM sequence: TTT
gtttgactgcagcatactgg

SEQ ID NO: 218785 - DNA, 20 bp, Artificial Sequence
  Description of Artificial Sequence: Synthetic oligonucleotide
  Target: ATXN1; (-) strand; PAM type: YTN; PAM sequence: TTT
tgtttgactgcagcatactg

SEQ ID NO: 218786 - DNA, 20 bp, Artificial Sequence
  Description of Artificial Sequence: Synthetic oligonucleotide
  Target: ATXN1; (-) strand; PAM type: YTN; PAM sequence: TTG
ttttgtttgactgcagcata

SEQ ID NO: 218787 - DNA, 20 bp, Artificial Sequence
  Description of Artificial Sequence: Synthetic oligonucleotide
  Target: ATXN1; (-) strand; PAM type: YTN; PAM sequence: TTT
gttttgtttgactgcagcat

SEQ ID NO: 218788 - DNA, 20 bp, Artificial Sequence
  Description of Artificial Sequence: Synthetic oligonucleotide
  Target: ATXN1; (-) strand; PAM type: YTN; PAM sequence: TTT
tgttttgtttgactgcagca

SEQ ID NO: 218789 - DNA, 20 bp, Artificial Sequence
  Description of Artificial Sequence: Synthetic oligonucleotide
  Target: ATXN1; (-) strand; PAM type: YTN; PAM sequence: TTG
gtattttgttttgtttgact

SEQ ID NO: 218790 - DNA, 20 bp, Artificial Sequence
  Description of Artificial Sequence: Synthetic oligonucleotide
  Target: ATXN1; (-) strand; PAM type: YTN; PAM sequence: CTT
ggtattttgttttgtttgac

SEQ ID NO: 218791 - DNA, 20 bp, Artificial Sequence
  Description of Artificial Sequence: Synthetic oligonucleotide
  Target: ATXN1; (-) strand; PAM type: YTN; PAM sequence: CTG
acttggtattttgttttgtt

SEQ ID NO: 218792 - DNA, 20 bp, Artificial Sequence
  Description of Artificial Sequence: Synthetic oligonucleotide
  Target: ATXN1; (-) strand; PAM type: YTN; PAM sequence: TTC
tgacttggtattttgttttg

SEQ ID NO: 218793 - DNA, 20 bp, Artificial Sequence
  Description of Artificial Sequence: Synthetic oligonucleotide
  Target: ATXN1; (-) strand; PAM type: YTN; PAM sequence: TTC
attctgacttggtattttgt

SEQ ID NO: 218794 - DNA, 20 bp, Artificial Sequence
  Description of Artificial Sequence: Synthetic oligonucleotide
  Target: ATXN1; (-) strand; PAM type: YTN; PAM sequence: TTT
cattctgacttggtattttg

SEQ ID NO: 218795 - DNA, 20 bp, Artificial Sequence
  Description of Artificial Sequence: Synthetic oligonucleotide
  Target: ATXN1; (-) strand; PAM type: YTN; PAM sequence: TTT
tcattctgacttggtatttt

SEQ ID NO: 218796 - DNA, 20 bp, Artificial Sequence
  Description of Artificial Sequence: Synthetic oligonucleotide
  Target: ATXN1; (-) strand; PAM type: YTN; PAM sequence: TTG
aagtggcattttcattctga

SEQ ID NO: 218797 - DNA, 20 bp, Artificial Sequence
  Description of Artificial Sequence: Synthetic oligonucleotide
  Target: ATXN1; (-) strand; PAM type: YTN; PAM sequence: CTT
gaagtggcattttcattctg

SEQ ID NO: 218798 - DNA, 20 bp, Artificial Sequence
  Description of Artificial Sequence: Synthetic oligonucleotide
  Target: ATXN1; (-) strand; PAM type: YTN; PAM sequence: CTG
cttgaagtggcattttcatt

SEQ ID NO: 218799 - DNA, 20 bp, Artificial Sequence
  Description of Artificial Sequence: Synthetic oligonucleotide
  Target: ATXN1; (-) strand; PAM type: YTN; PAM sequence: CTA
actgcttgaagtggcatttt

SEQ ID NO: 218800 - DNA, 20 bp, Artificial Sequence
  Description of Artificial Sequence: Synthetic oligonucleotide
  Target: ATXN1; (-) strand; PAM type: YTN; PAM sequence: CTG
aatatccactaactgcttga

SEQ ID NO: 218801 - DNA, 20 bp, Artificial Sequence
  Description of Artificial Sequence: Synthetic oligonucleotide
  Target: ATXN1; (-) strand; PAM type: YTN; PAM sequence: TTC
cccctgaatatccactaact

SEQ ID NO: 218802 - DNA, 20 bp, Artificial Sequence
  Description of Artificial Sequence: Synthetic oligonucleotide
  Target: ATXN1; (-) strand; PAM type: YTN; PAM sequence: TTT
ccccctgaatatccactaac

SEQ ID NO: 218803 - DNA, 20 bp, Artificial Sequence
  Description of Artificial Sequence: Synthetic oligonucleotide
  Target: ATXN1; (-) strand; PAM type: YTN; PAM sequence: TTG
agaaaggccagggatttccc

SEQ ID NO: 218804 - DNA, 20 bp, Artificial Sequence
  Description of Artificial Sequence: Synthetic oligonucleotide
  Target: ATXN1; (-) strand; PAM type: YTN; PAM sequence: TTT
gagaaaggccagggatttcc

SEQ ID NO: 218805 - DNA, 20 bp, Artificial Sequence
  Description of Artificial Sequence: Synthetic oligonucleotide
  Target: ATXN1; (-) strand; PAM type: YTN; PAM sequence: TTA
tgaaatatacatttgagaaa

SEQ ID NO: 218806 - DNA, 20 bp, Artificial Sequence
  Description of Artificial Sequence: Synthetic oligonucleotide
  Target: ATXN1; (-) strand; PAM type: YTN; PAM sequence: TTG
aggttatgaaatatacattt

SEQ ID NO: 218807 - DNA, 20 bp, Artificial Sequence
  Description of Artificial Sequence: Synthetic oligonucleotide
  Target: ATXN1; (-) strand; PAM type: YTN; PAM sequence: TTT
gaggttatgaaatatacatt

SEQ ID NO: 218808 - DNA, 20 bp, Artificial Sequence
  Description of Artificial Sequence: Synthetic oligonucleotide
  Target: ATXN1; (-) strand; PAM type: YTN; PAM sequence: TTG
tttgaggttatgaaatatac

SEQ ID NO: 218809 - DNA, 20 bp, Artificial Sequence
  Description of Artificial Sequence: Synthetic oligonucleotide
  Target: ATXN1; (-) strand; PAM type: YTN; PAM sequence: CTT
gtttgaggttatgaaatata

SEQ ID NO: 218810 - DNA, 20 bp, Artificial Sequence
  Description of Artificial Sequence: Synthetic oligonucleotide
  Target: ATXN1; (-) strand; PAM type: YTN; PAM sequence: TTA
acatgcttgtttgaggttat

SEQ ID NO: 218811 - DNA, 20 bp, Artificial Sequence
  Description of Artificial Sequence: Synthetic oligonucleotide
  Target: ATXN1; (-) strand; PAM type: YTN; PAM sequence: CTG
ataattaacatgcttgtttg

SEQ ID NO: 218812 - DNA, 20 bp, Artificial Sequence
  Description of Artificial Sequence: Synthetic oligonucleotide
  Target: ATXN1; (-) strand; PAM type: YTN; PAM sequence: TTC
atcctgataattaacatgct

SEQ ID NO: 218813 - DNA, 20 bp, Artificial Sequence
  Description of Artificial Sequence: Synthetic oligonucleotide
  Target: ATXN1; (-) strand; PAM type: YTN; PAM sequence: CTT
catcctgataattaacatgc

SEQ ID NO: 218814 - DNA, 20 bp, Artificial Sequence
  Description of Artificial Sequence: Synthetic oligonucleotide
  Target: ATXN1; (-) strand; PAM type: YTN; PAM sequence: TTA
tgtagataagcagtgagatg

SEQ ID NO: 218815 - DNA, 20 bp, Artificial Sequence
  Description of Artificial Sequence: Synthetic oligonucleotide
  Target: ATXN1; (-) strand; PAM type: YTN; PAM sequence: CTT
atgtagataagcagtgagat

SEQ ID NO: 218816 - DNA, 20 bp, Artificial Sequence
  Description of Artificial Sequence: Synthetic oligonucleotide
  Target: ATXN1; (-) strand; PAM type: YTN; PAM sequence: TTA
gggcaccttatgtagataag

SEQ ID NO: 218817 - DNA, 20 bp, Artificial Sequence
  Description of Artificial Sequence: Synthetic oligonucleotide
  Target: ATXN1; (-) strand; PAM type: YTN; PAM sequence: TTT
agggcaccttatgtagataa

SEQ ID NO: 218818 - DNA, 20 bp, Artificial Sequence
  Description of Artificial Sequence: Synthetic oligonucleotide
  Target: ATXN1; (-) strand; PAM type: YTN; PAM sequence: TTT
tagggcaccttatgtagata

SEQ ID NO: 218819 - DNA, 20 bp, Artificial Sequence
  Description of Artificial Sequence: Synthetic oligonucleotide
  Target: ATXN1; (-) strand; PAM type: YTN; PAM sequence: CTC
cagtattttagggcacctta

SEQ ID NO: 218820 - DNA, 20 bp, Artificial Sequence
  Description of Artificial Sequence: Synthetic oligonucleotide
  Target: ATXN1; (-) strand; PAM type: YTN; PAM sequence: TTC
ccacaccccacctccagtat

SEQ ID NO: 218821 - DNA, 20 bp, Artificial Sequence
  Description of Artificial Sequence: Synthetic oligonucleotide
  Target: ATXN1; (-) strand; PAM type: YTN; PAM sequence: CTT
cccacaccccacctccagta

SEQ ID NO: 218822 - DNA, 20 bp, Artificial Sequence
  Description of Artificial Sequence: Synthetic oligonucleotide
  Target: ATXN1; (-) strand; PAM type: YTN; PAM sequence: TTC
cttcccacaccccacctcca

SEQ ID NO: 218823 - DNA, 20 bp, Artificial Sequence
  Description of Artificial Sequence: Synthetic oligonucleotide
  Target: ATXN1; (-) strand; PAM type: YTN; PAM sequence: CTT
ccttcccacaccccacctcc

SEQ ID NO: 218824 - DNA, 20 bp, Artificial Sequence
  Description of Artificial Sequence: Synthetic oligonucleotide
  Target: ATXN1; (-) strand; PAM type: YTN; PAM sequence: TTC
ttccttcccacaccccacct

SEQ ID NO: 218825 - DNA, 20 bp, Artificial Sequence
  Description of Artificial Sequence: Synthetic oligonucleotide
  Target: ATXN1; (-) strand; PAM type: YTN; PAM sequence: TTT
cttccttcccacaccccacc

SEQ ID NO: 218826 - DNA, 20 bp, Artificial Sequence
  Description of Artificial Sequence: Synthetic oligonucleotide
  Target: ATXN1; (-) strand; PAM type: YTN; PAM sequence: CTT
tcttccttcccacaccccac

SEQ ID NO: 218827 - DNA, 20 bp, Artificial Sequence
  Description of Artificial Sequence: Synthetic oligonucleotide
  Target: ATXN1; (-) strand; PAM type: YTN; PAM sequence: TTC
tttcttccttcccacacccc

SEQ ID NO: 218828 - DNA, 20 bp, Artificial Sequence
  Description of Artificial Sequence: Synthetic oligonucleotide
  Target: ATXN1; (-) strand; PAM type: YTN; PAM sequence: TTT
ctttcttccttcccacaccc

SEQ ID NO: 218829 - DNA, 20 bp, Artificial Sequence
  Description of Artificial Sequence: Synthetic oligonucleotide
  Target: ATXN1; (-) strand; PAM type: YTN; PAM sequence: CTT
tctttcttccttcccacacc

SEQ ID NO: 218830 - DNA, 20 bp, Artificial Sequence
  Description of Artificial Sequence: Synthetic oligonucleotide
  Target: ATXN1; (-) strand; PAM type: YTN; PAM sequence: TTC
tttctttcttccttcccaca

SEQ ID NO: 218831 - DNA, 20 bp, Artificial Sequence
  Description of Artificial Sequence: Synthetic oligonucleotide
  Target: ATXN1; (-) strand; PAM type: YTN; PAM sequence: TTT
ctttctttcttccttcccac

SEQ ID NO: 218832 - DNA, 20 bp, Artificial Sequence
  Description of Artificial Sequence: Synthetic oligonucleotide
  Target: ATXN1; (-) strand; PAM type: YTN; PAM sequence: TTT
tctttctttcttccttccca

SEQ ID NO: 218833 - DNA, 20 bp, Artificial Sequence
  Description of Artificial Sequence: Synthetic oligonucleotide
  Target: ATXN1; (-) strand; PAM type: YTN; PAM sequence: TTT
ttctttctttcttccttccc

SEQ ID NO: 218834 - DNA, 20 bp, Artificial Sequence
  Description of Artificial Sequence: Synthetic oligonucleotide
  Target: ATXN1; (-) strand; PAM type: YTN; PAM sequence: TTT
tttctttctttcttccttcc

SEQ ID NO: 218835 - DNA, 20 bp, Artificial Sequence
  Description of Artificial Sequence: Synthetic oligonucleotide
  Target: ATXN1; (-) strand; PAM type: YTN; PAM sequence: TTT
ttttctttctttcttccttc

SEQ ID NO: 218836 - DNA, 20 bp, Artificial Sequence
  Description of Artificial Sequence: Synthetic oligonucleotide
  Target: ATXN1; (-) strand; PAM type: YTN; PAM sequence: TTT
tttttctttctttcttcctt

SEQ ID NO: 218837 - DNA, 20 bp, Artificial Sequence
  Description of Artificial Sequence: Synthetic oligonucleotide
  Target: ATXN1; (-) strand; PAM type: YTN; PAM sequence: TTT
ttttttctttctttcttcct

SEQ ID NO: 218838 - DNA, 20 bp, Artificial Sequence
  Description of Artificial Sequence: Synthetic oligonucleotide
  Target: ATXN1; (-) strand; PAM type: YTN; PAM sequence: TTT
tttttttctttctttcttcc

SEQ ID NO: 218839 - DNA, 20 bp, Artificial Sequence
  Description of Artificial Sequence: Synthetic oligonucleotide
  Target: ATXN1; (-) strand; PAM type: YTN; PAM sequence: TTG
ttttttttttctttctttct

SEQ ID NO: 218840 - DNA, 20 bp, Artificial Sequence
  Description of Artificial Sequence: Synthetic oligonucleotide
  Target: ATXN1; (-) strand; PAM type: YTN; PAM sequence: CTT
gttttttttttctttctttc

SEQ ID NO: 218841 - DNA, 20 bp, Artificial Sequence
  Description of Artificial Sequence: Synthetic oligonucleotide
  Target: ATXN1; (-) strand; PAM type: YTN; PAM sequence: CTC
ccccagtgtcatgcttgttt

SEQ ID NO: 218842 - DNA, 20 bp, Artificial Sequence
  Description of Artificial Sequence: Synthetic oligonucleotide
  Target: ATXN1; (-) strand; PAM type: YTN; PAM sequence: CTA
cctcccccagtgtcatgctt

SEQ ID NO: 218843 - DNA, 20 bp, Artificial Sequence
  Description of Artificial Sequence: Synthetic oligonucleotide
  Target: ATXN1; (-) strand; PAM type: YTN; PAM sequence: CTG
ctacctcccccagtgtcatg

SEQ ID NO: 218844 - DNA, 20 bp, Artificial Sequence
  Description of Artificial Sequence: Synthetic oligonucleotide
  Target: ATXN1; (-) strand; PAM type: YTN; PAM sequence: TTC
aagacctgctacctccccca

SEQ ID NO: 218845 - DNA, 20 bp, Artificial Sequence
  Description of Artificial Sequence: Synthetic oligonucleotide
  Target: ATXN1; (-) strand; PAM type: YTN; PAM sequence: TTT
caagacctgctacctccccc

SEQ ID NO: 218846 - DNA, 20 bp, Artificial Sequence
  Description of Artificial Sequence: Synthetic oligonucleotide
  Target: ATXN1; (-) strand; PAM type: YTN; PAM sequence: TTT
tcaagacctgctacctcccc

SEQ ID NO: 218847 - DNA, 20 bp, Artificial Sequence
  Description of Artificial Sequence: Synthetic oligonucleotide
  Target: ATXN1; (-) strand; PAM type: YTN; PAM sequence: CTG
attttcaagacctgctacct

SEQ ID NO: 218848 - DNA, 20 bp, Artificial Sequence
  Description of Artificial Sequence: Synthetic oligonucleotide
  Target: ATXN1; (-) strand; PAM type: YTN; PAM sequence: TTC
tgattttcaagacctgctac

SEQ ID NO: 218849 - DNA, 20 bp, Artificial Sequence
  Description of Artificial Sequence: Synthetic oligonucleotide
  Target: ATXN1; (-) strand; PAM type: YTN; PAM sequence: CTG
gtgtacattctgattttcaa

SEQ ID NO: 218850 - DNA, 20 bp, Artificial Sequence
  Description of Artificial Sequence: Synthetic oligonucleotide
  Target: ATXN1; (-) strand; PAM type: YTN; PAM sequence: TTC
ccactggtgtacattctgat

SEQ ID NO: 218851 - DNA, 20 bp, Artificial Sequence
  Description of Artificial Sequence: Synthetic oligonucleotide
  Target: ATXN1; (-) strand; PAM type: YTN; PAM sequence: TTG
caagtgcattcccactggtg

SEQ ID NO: 218852 - DNA, 20 bp, Artificial Sequence
  Description of Artificial Sequence: Synthetic oligonucleotide
  Target: ATXN1; (-) strand; PAM type: YTN; PAM sequence: TTT
gcaagtgcattcccactggt

SEQ ID NO: 218853 - DNA, 20 bp, Artificial Sequence
  Description of Artificial Sequence: Synthetic oligonucleotide
  Target: ATXN1; (-) strand; PAM type: YTN; PAM sequence: TTT
tgcaagtgcattcccactgg

SEQ ID NO: 218854 - DNA, 20 bp, Artificial Sequence
  Description of Artificial Sequence: Synthetic oligonucleotide
  Target: ATXN1; (-) strand; PAM type: YTN; PAM sequence: TTG
aaattttgcaagtgcattcc

SEQ ID NO: 218855 - DNA, 20 bp, Artificial Sequence
  Description of Artificial Sequence: Synthetic oligonucleotide
  Target: ATXN1; (-) strand; PAM type: YTN; PAM sequence: CTT
gaaattttgcaagtgcattc

SEQ ID NO: 218856 - DNA, 20 bp, Artificial Sequence
  Description of Artificial Sequence: Synthetic oligonucleotide
  Target: ATXN1; (-) strand; PAM type: YTN; PAM sequence: TTC
aatcggtaaacttgaaattt

SEQ ID NO: 218857 - DNA, 20 bp, Artificial Sequence
  Description of Artificial Sequence: Synthetic oligonucleotide
  Target: ATXN1; (-) strand; PAM type: YTN; PAM sequence: TTT
caatcggtaaacttgaaatt

SEQ ID NO: 218858 - DNA, 20 bp, Artificial Sequence
  Description of Artificial Sequence: Synthetic oligonucleotide
  Target: ATXN1; (-) strand; PAM type: YTN; PAM sequence: CTT
tcaatcggtaaacttgaaat

SEQ ID NO: 218859 - DNA, 20 bp, Artificial Sequence
  Description of Artificial Sequence: Synthetic oligonucleotide
  Target: ATXN1; (-) strand; PAM type: YTN; PAM sequence: TTC
acatctttcaatcggtaaac

SEQ ID NO: 218860 - DNA, 20 bp, Artificial Sequence
  Description of Artificial Sequence: Synthetic oligonucleotide
  Target: ATXN1; (-) strand; PAM type: YTN; PAM sequence: TTA
ttcacatctttcaatcggta

SEQ ID NO: 218861 - DNA, 20 bp, Artificial Sequence
  Description of Artificial Sequence: Synthetic oligonucleotide
  Target: ATXN1; (-) strand; PAM type: YTN; PAM sequence: TTT
attcacatctttcaatcggt

SEQ ID NO: 218862 - DNA, 20 bp, Artificial Sequence
  Description of Artificial Sequence: Synthetic oligonucleotide
  Target: ATXN1; (-) strand; PAM type: YTN; PAM sequence: CTT
tattcacatctttcaatcgg

SEQ ID NO: 218863 - DNA, 20 bp, Artificial Sequence
  Description of Artificial Sequence: Synthetic oligonucleotide
  Target: ATXN1; (-) strand; PAM type: YTN; PAM sequence: TTC
tttattcacatctttcaatc

SEQ ID NO: 218864 - DNA, 20 bp, Artificial Sequence
  Description of Artificial Sequence: Synthetic oligonucleotide
  Target: ATXN1; (-) strand; PAM type: YTN; PAM sequence: TTT
ctttattcacatctttcaat

SEQ ID NO: 218865 - DNA, 20 bp, Artificial Sequence
  Description of Artificial Sequence: Synthetic oligonucleotide
  Target: ATXN1; (-) strand; PAM type: YTN; PAM sequence: TTT
tctttattcacatctttcaa

SEQ ID NO: 218866 - DNA, 20 bp, Artificial Sequence
  Description of Artificial Sequence: Synthetic oligonucleotide
  Target: ATXN1; (-) strand; PAM type: YTN; PAM sequence: TTT
ttctttattcacatctttca

SEQ ID NO: 218867 - DNA, 20 bp, Artificial Sequence
  Description of Artificial Sequence: Synthetic oligonucleotide
  Target: ATXN1; (-) strand; PAM type: YTN; PAM sequence: CTG
aatttttctttattcacatc

SEQ ID NO: 218868 - DNA, 20 bp, Artificial Sequence
  Description of Artificial Sequence: Synthetic oligonucleotide
  Target: ATXN1; (-) strand; PAM type: YTN; PAM sequence: TTA
gacgtactgaatttttcttt

SEQ ID NO: 218869 - DNA, 20 bp, Artificial Sequence
  Description of Artificial Sequence: Synthetic oligonucleotide
  Target: ATXN1; (-) strand; PAM type: YTN; PAM sequence: CTT
agacgtactgaatttttctt

SEQ ID NO: 218870 - DNA, 20 bp, Artificial Sequence
  Description of Artificial Sequence: Synthetic oligonucleotide
  Target: ATXN1; (-) strand; PAM type: YTN; PAM sequence: TTA
atcacttagacgtactgaat

SEQ ID NO: 218871 - DNA, 20 bp, Artificial Sequence
  Description of Artificial Sequence: Synthetic oligonucleotide
  Target: ATXN1; (-) strand; PAM type: YTN; PAM sequence: TTT
aatcacttagacgtactgaa

SEQ ID NO: 218872 - DNA, 20 bp, Artificial Sequence
  Description of Artificial Sequence: Synthetic oligonucleotide
  Target: ATXN1; (-) strand; PAM type: YTN; PAM sequence: CTT
taatcacttagacgtactga

SEQ ID NO: 218873 - DNA, 20 bp, Artificial Sequence
  Description of Artificial Sequence: Synthetic oligonucleotide
  Target: ATXN1; (-) strand; PAM type: YTN; PAM sequence: CTG
cacatcagtctttaatcact

SEQ ID NO: 218874 - DNA, 20 bp, Artificial Sequence
  Description of Artificial Sequence: Synthetic oligonucleotide
  Target: ATXN1; (-) strand; PAM type: YTN; PAM sequence: TTG
atactgcacatcagtcttta

SEQ ID NO: 218875 - DNA, 20 bp, Artificial Sequence
  Description of Artificial Sequence: Synthetic oligonucleotide
  Target: ATXN1; (-) strand; PAM type: YTN; PAM sequence: CTT
gatactgcacatcagtcttt

SEQ ID NO: 218876 - DNA, 20 bp, Artificial Sequence
  Description of Artificial Sequence: Synthetic oligonucleotide
  Target: ATXN1; (-) strand; PAM type: YTN; PAM sequence: CTG
cccttgatactgcacatcag

SEQ ID NO: 218877 - DNA, 20 bp, Artificial Sequence
  Description of Artificial Sequence: Synthetic oligonucleotide
  Target: ATXN1; (-) strand; PAM type: YTN; PAM sequence: TTC
tgcccttgatactgcacatc

SEQ ID NO: 218878 - DNA, 20 bp, Artificial Sequence
  Description of Artificial Sequence: Synthetic oligonucleotide
  Target: ATXN1; (-) strand; PAM type: YTN; PAM sequence: TTT
ctgcccttgatactgcacat

SEQ ID NO: 218879 - DNA, 20 bp, Artificial Sequence
  Description of Artificial Sequence: Synthetic oligonucleotide
  Target: ATXN1; (-) strand; PAM type: YTN; PAM sequence: CTT
tctgcccttgatactgcaca

SEQ ID NO: 218880 - DNA, 20 bp, Artificial Sequence
  Description of Artificial Sequence: Synthetic oligonucleotide
  Target: ATXN1; (-) strand; PAM type: YTN; PAM sequence: TTC
actttctgcccttgatactg

SEQ ID NO: 218881 - DNA, 20 bp, Artificial Sequence
  Description of Artificial Sequence: Synthetic oligonucleotide
  Target: ATXN1; (-) strand; PAM type: YTN; PAM sequence: CTT
cactttctgcccttgatact

SEQ ID NO: 218882 - DNA, 20 bp, Artificial Sequence
  Description of Artificial Sequence: Synthetic oligonucleotide
  Target: ATXN1; (-) strand; PAM type: YTN; PAM sequence: TTC
ttcactttctgcccttgata

SEQ ID NO: 218883 - DNA, 20 bp, Artificial Sequence
  Description of Artificial Sequence: Synthetic oligonucleotide
  Target: ATXN1; (-) strand; PAM type: YTN; PAM sequence: TTT
cttcactttctgcccttgat

SEQ ID NO: 218884 - DNA, 20 bp, Artificial Sequence
  Description of Artificial Sequence: Synthetic oligonucleotide
  Target: ATXN1; (-) strand; PAM type: YTN; PAM sequence: CTT
tcttcactttctgcccttga

SEQ ID NO: 218885 - DNA, 20 bp, Artificial Sequence
  Description of Artificial Sequence: Synthetic oligonucleotide
  Target: ATXN1; (-) strand; PAM type: YTN; PAM sequence: TTG
aagcaaactttcttcacttt

SEQ ID NO: 218886 - DNA, 20 bp, Artificial Sequence
  Description of Artificial Sequence: Synthetic oligonucleotide
  Target: ATXN1; (-) strand; PAM type: YTN; PAM sequence: TTT
gaagcaaactttcttcactt

SEQ ID NO: 218887 - DNA, 20 bp, Artificial Sequence
  Description of Artificial Sequence: Synthetic oligonucleotide
  Target: ATXN1; (-) strand; PAM type: YTN; PAM sequence: TTC
atttgaagcaaactttcttc

SEQ ID NO: 218888 - DNA, 20 bp, Artificial Sequence
  Description of Artificial Sequence: Synthetic oligonucleotide
  Target: ATXN1; (-) strand; PAM type: YTN; PAM sequence: TTT
catttgaagcaaactttctt

SEQ ID NO: 218889 - DNA, 20 bp, Artificial Sequence
  Description of Artificial Sequence: Synthetic oligonucleotide
  Target: ATXN1; (-) strand; PAM type: YTN; PAM sequence: CTT
tcatttgaagcaaactttct

SEQ ID NO: 218890 - DNA, 20 bp, Artificial Sequence
  Description of Artificial Sequence: Synthetic oligonucleotide
  Target: ATXN1; (-) strand; PAM type: YTN; PAM sequence: CTG
agtctttcatttgaagcaaa

SEQ ID NO: 218891 - DNA, 20 bp, Artificial Sequence
  Description of Artificial Sequence: Synthetic oligonucleotide
  Target: ATXN1; (-) strand; PAM type: YTN; PAM sequence: TTA
gtctgagtctttcatttgaa

SEQ ID NO: 218892 - DNA, 20 bp, Artificial Sequence
  Description of Artificial Sequence: Synthetic oligonucleotide
  Target: ATXN1; (-) strand; PAM type: YTN; PAM sequence: TTG
attagtctgagtctttcatt

SEQ ID NO: 218893 - DNA, 20 bp, Artificial Sequence
  Description of Artificial Sequence: Synthetic oligonucleotide
  Target: ATXN1; (-) strand; PAM type: YTN; PAM sequence: TTC
acatcagttgattagtctga

SEQ ID NO: 218894 - DNA, 20 bp, Artificial Sequence
  Description of Artificial Sequence: Synthetic oligonucleotide
  Target: ATXN1; (-) strand; PAM type: YTN; PAM sequence: TTA
aaaagtattcacatcagttg

SEQ ID NO: 218895 - DNA, 20 bp, Artificial Sequence
  Description of Artificial Sequence: Synthetic oligonucleotide
  Target: ATXN1; (-) strand; PAM type: YTN; PAM sequence: TTT
aaaaagtattcacatcagtt

SEQ ID NO: 218896 - DNA, 20 bp, Artificial Sequence
  Description of Artificial Sequence: Synthetic oligonucleotide
  Target: ATXN1; (-) strand; PAM type: YTN; PAM sequence: TTA
tttaaaaagtattcacatca

SEQ ID NO: 218897 - DNA, 20 bp, Artificial Sequence
  Description of Artificial Sequence: Synthetic oligonucleotide
  Target: ATXN1; (-) strand; PAM type: YTN; PAM sequence: TTT
atttaaaaagtattcacatc

SEQ ID NO: 218898 - DNA, 20 bp, Artificial Sequence
  Description of Artificial Sequence: Synthetic oligonucleotide
  Target: ATXN1; (-) strand; PAM type: YTN; PAM sequence: CTT
tatttaaaaagtattcacat

SEQ ID NO: 218899 - DNA, 20 bp, Artificial Sequence
  Description of Artificial Sequence: Synthetic oligonucleotide
  Target: ATXN1; (-) strand; PAM type: YTN; PAM sequence: CTC
tttatttaaaaagtattcac

SEQ ID NO: 218900 - DNA, 20 bp, Artificial Sequence
  Description of Artificial Sequence: Synthetic oligonucleotide
  Target: ATXN1; (-) strand; PAM type: YTN; PAM sequence: TTA
atagctctttatttaaaaag

SEQ ID NO: 218901 - DNA, 20 bp, Artificial Sequence
  Description of Artificial Sequence: Synthetic oligonucleotide
  Target: ATXN1; (-) strand; PAM type: YTN; PAM sequence: CTT
aatagctctttatttaaaaa

SEQ ID NO: 218902 - DNA, 20 bp, Artificial Sequence
  Description of Artificial Sequence: Synthetic oligonucleotide
  Target: ATXN1; (-) strand; PAM type: YTN; PAM sequence: TTC
catcttaatagctctttatt

SEQ ID NO: 218903 - DNA, 20 bp, Artificial Sequence
  Description of Artificial Sequence: Synthetic oligonucleotide
  Target: ATXN1; (-) strand; PAM type: YTN; PAM sequence: TTG
ttccatcttaatagctcttt

SEQ ID NO: 218904 - DNA, 20 bp, Artificial Sequence
  Description of Artificial Sequence: Synthetic oligonucleotide
  Target: ATXN1; (-) strand; PAM type: YTN; PAM sequence: TTT
gttccatcttaatagctctt

SEQ ID NO: 218905 - DNA, 20 bp, Artificial Sequence
  Description of Artificial Sequence: Synthetic oligonucleotide
  Target: ATXN1; (-) strand; PAM type: YTN; PAM sequence: TTT
tgttccatcttaatagctct

SEQ ID NO: 218906 - DNA, 20 bp, Artificial Sequence
  Description of Artificial Sequence: Synthetic oligonucleotide
  Target: ATXN1; (-) strand; PAM type: YTN; PAM sequence: TTT
ttgttccatcttaatagctc

SEQ ID NO: 218907 - DNA, 20 bp, Artificial Sequence
  Description of Artificial Sequence: Synthetic oligonucleotide
  Target: ATXN1; (-) strand; PAM type: YTN; PAM sequence: TTT
tttgttccatcttaatagct

SEQ ID NO: 218908 - DNA, 20 bp, Artificial Sequence
  Description of Artificial Sequence: Synthetic oligonucleotide
  Target: ATXN1; (-) strand; PAM type: YTN; PAM sequence: CTT
ttttgttccatcttaatagc

SEQ ID NO: 218909 - DNA, 20 bp, Artificial Sequence
  Description of Artificial Sequence: Synthetic oligonucleotide
  Target: ATXN1; (-) strand; PAM type: YTN; PAM sequence: TTA
tcttttttgttccatcttaa

SEQ ID NO: 218910 - DNA, 20 bp, Artificial Sequence
  Description of Artificial Sequence: Synthetic oligonucleotide
  Target: ATXN1; (-) strand; PAM type: YTN; PAM sequence: TTT
atcttttttgttccatctta

SEQ ID NO: 218911 - DNA, 20 bp, Artificial Sequence
  Description of Artificial Sequence: Synthetic oligonucleotide
  Target: ATXN1; (-) strand; PAM type: YTN; PAM sequence: CTT
tatcttttttgttccatctt

SEQ ID NO: 218912 - DNA, 20 bp, Artificial Sequence
  Description of Artificial Sequence: Synthetic oligonucleotide
  Target: ATXN1; (-) strand; PAM type: YTN; PAM sequence: TTA
tgctttatcttttttgttcc

SEQ ID NO: 218913 - DNA, 20 bp, Artificial Sequence
  Description of Artificial Sequence: Synthetic oligonucleotide
  Target: ATXN1; (-) strand; PAM type: YTN; PAM sequence: CTT
atgctttatcttttttgttc

SEQ ID NO: 218914 - DNA, 20 bp, Artificial Sequence
  Description of Artificial Sequence: Synthetic oligonucleotide
  Target: ATXN1; (-) strand; PAM type: YTN; PAM sequence: CTC
ttatgctttatcttttttgt

SEQ ID NO: 218915 - DNA, 20 bp, Artificial Sequence
  Description of Artificial Sequence: Synthetic oligonucleotide
  Target: ATXN1; (-) strand; PAM type: YTN; PAM sequence: CTC
tcttatgctttatctttttt

SEQ ID NO: 218916 - DNA, 20 bp, Artificial Sequence
  Description of Artificial Sequence: Synthetic oligonucleotide
  Target: ATXN1; (-) strand; PAM type: YTN; PAM sequence: CTC
tctcttatgctttatctttt

SEQ ID NO: 218917 - DNA, 20 bp, Artificial Sequence
  Description of Artificial Sequence: Synthetic oligonucleotide
  Target: ATXN1; (-) strand; PAM type: YTN; PAM sequence: TTC
tctctcttatgctttatctt

SEQ ID NO: 218918 - DNA, 20 bp, Artificial Sequence
  Description of Artificial Sequence: Synthetic oligonucleotide
  Target: ATXN1; (-) strand; PAM type: YTN; PAM sequence: TTA
tagggcaaaatggaaaatgt

SEQ ID NO: 218919 - DNA, 20 bp, Artificial Sequence
  Description of Artificial Sequence: Synthetic oligonucleotide
  Target: ATXN1; (-) strand; PAM type: YTN; PAM sequence: CTT
atagggcaaaatggaaaatg

SEQ ID NO: 218920 - DNA, 20 bp, Artificial Sequence
  Description of Artificial Sequence: Synthetic oligonucleotide
  Target: ATXN1; (-) strand; PAM type: YTN; PAM sequence: CTA
cttatagggcaaaatggaaa

SEQ ID NO: 218921 - DNA, 20 bp, Artificial Sequence
  Description of Artificial Sequence: Synthetic oligonucleotide
  Target: ATXN1; (-) strand; PAM type: YTN; PAM sequence: TTA
cctacttatagggcaaaatg

SEQ ID NO: 218922 - DNA, 20 bp, Artificial Sequence
  Description of Artificial Sequence: Synthetic oligonucleotide
  Target: ATXN1; (-) strand; PAM type: YTN; PAM sequence: TTA
tcaagaatcacacaagggaa

SEQ ID NO: 218923 - DNA, 20 bp, Artificial Sequence
  Description of Artificial Sequence: Synthetic oligonucleotide
  Target: ATXN1; (-) strand; PAM type: YTN; PAM sequence: TTT
atcaagaatcacacaaggga

SEQ ID NO: 218924 - DNA, 20 bp, Artificial Sequence
  Description of Artificial Sequence: Synthetic oligonucleotide
  Target: ATXN1; (-) strand; PAM type: YTN; PAM sequence: TTG
ggtggagaaagtatttatca

SEQ ID NO: 218925 - DNA, 20 bp, Artificial Sequence
  Description of Artificial Sequence: Synthetic oligonucleotide
  Target: ATXN1; (-) strand; PAM type: YTN; PAM sequence: CTT
gggtggagaaagtatttatc

SEQ ID NO: 218926 - DNA, 20 bp, Artificial Sequence
  Description of Artificial Sequence: Synthetic oligonucleotide
  Target: ATXN1; (-) strand; PAM type: YTN; PAM sequence: TTC
agcttgggtggagaaagtat

SEQ ID NO: 218927 - DNA, 20 bp, Artificial Sequence
  Description of Artificial Sequence: Synthetic oligonucleotide
  Target: ATXN1; (-) strand; PAM type: YTN; PAM sequence: TTT
cagcttgggtggagaaagta

SEQ ID NO: 218928 - DNA, 20 bp, Artificial Sequence
  Description of Artificial Sequence: Synthetic oligonucleotide
  Target: ATXN1; (-) strand; PAM type: YTN; PAM sequence: TTT
tcagcttgggtggagaaagt

SEQ ID NO: 218929 - DNA, 20 bp, Artificial Sequence
  Description of Artificial Sequence: Synthetic oligonucleotide
  Target: ATXN1; (-) strand; PAM type: YTN; PAM sequence: CTT
ttcagcttgggtggagaaag

SEQ ID NO: 218930 - DNA, 20 bp, Artificial Sequence
  Description of Artificial Sequence: Synthetic oligonucleotide
  Target: ATXN1; (-) strand; PAM type: YTN; PAM sequence: CTG
cttttcagcttgggtggaga

SEQ ID NO: 218931 - DNA, 20 bp, Artificial Sequence
  Description of Artificial Sequence: Synthetic oligonucleotide
  Target: ATXN1; (-) strand; PAM type: YTN; PAM sequence: CTA
ctgcttttcagcttgggtgg

SEQ ID NO: 218932 - DNA, 20 bp, Artificial Sequence
  Description of Artificial Sequence: Synthetic oligonucleotide
  Target: ATXN1; (-) strand; PAM type: YTN; PAM sequence: TTC
agtgtgtaaagtaactactg

SEQ ID NO: 218933 - DNA, 20 bp, Artificial Sequence
  Description of Artificial Sequence: Synthetic oligonucleotide
  Target: ATXN1; (-) strand; PAM type: YTN; PAM sequence: TTC
atattcagtgtgtaaagtaa

SEQ ID NO: 218934 - DNA, 20 bp, Artificial Sequence
  Description of Artificial Sequence: Synthetic oligonucleotide
  Target: ATXN1; (-) strand; PAM type: YTN; PAM sequence: TTT
catattcagtgtgtaaagta

SEQ ID NO: 218935 - DNA, 20 bp, Artificial Sequence
  Description of Artificial Sequence: Synthetic oligonucleotide
  Target: ATXN1; (-) strand; PAM type: YTN; PAM sequence: TTC
atttcatattcagtgtgtaa

SEQ ID NO: 218936 - DNA, 20 bp, Artificial Sequence
  Description of Artificial Sequence: Synthetic oligonucleotide
  Target: ATXN1; (-) strand; PAM type: YTN; PAM sequence: TTA
aacattcatttcatattcag

SEQ ID NO: 218937 - DNA, 20 bp, Artificial Sequence
  Description of Artificial Sequence: Synthetic oligonucleotide
  Target: ATXN1; (-) strand; PAM type: YTN; PAM sequence: TTT
aaacattcatttcatattca

SEQ ID NO: 218938 - DNA, 20 bp, Artificial Sequence
  Description of Artificial Sequence: Synthetic oligonucleotide
  Target: ATXN1; (-) strand; PAM type: YTN; PAM sequence: TTT
taaacattcatttcatattc

SEQ ID NO: 218939 - DNA, 20 bp, Artificial Sequence
  Description of Artificial Sequence: Synthetic oligonucleotide
  Target: ATXN1; (-) strand; PAM type: YTN; PAM sequence: CTG
agtgggggtaaagaggcatg

SEQ ID NO: 218940 - DNA, 20 bp, Artificial Sequence
  Description of Artificial Sequence: Synthetic oligonucleotide
  Target: ATXN1; (-) strand; PAM type: YTN; PAM sequence: CTC
tgagtgggggtaaagaggca

SEQ ID NO: 218941 - DNA, 20 bp, Artificial Sequence
  Description of Artificial Sequence: Synthetic oligonucleotide
  Target: ATXN1; (-) strand; PAM type: YTN; PAM sequence: CTG
ctctgagtgggggtaaagag

SEQ ID NO: 218942 - DNA, 20 bp, Artificial Sequence
  Description of Artificial Sequence: Synthetic oligonucleotide
  Target: ATXN1; (-) strand; PAM type: YTN; PAM sequence: TTA
tcagctgctctgagtggggg

SEQ ID NO: 218943 - DNA, 20 bp, Artificial Sequence
  Description of Artificial Sequence: Synthetic oligonucleotide
  Target: ATXN1; (-) strand; PAM type: YTN; PAM sequence: TTT
atcagctgctctgagtgggg

SEQ ID NO: 218944 - DNA, 20 bp, Artificial Sequence
  Description of Artificial Sequence: Synthetic oligonucleotide
  Target: ATXN1; (-) strand; PAM type: YTN; PAM sequence: CTT
tatcagctgctctgagtggg

SEQ ID NO: 218945 - DNA, 20 bp, Artificial Sequence
  Description of Artificial Sequence: Synthetic oligonucleotide
  Target: ATXN1; (-) strand; PAM type: YTN; PAM sequence: CTA
atgtgtaggctttatcagct

SEQ ID NO: 218946 - DNA, 20 bp, Artificial Sequence
  Description of Artificial Sequence: Synthetic oligonucleotide
  Target: ATXN1; (-) strand; PAM type: YTN; PAM sequence: TTC
taatgtgtaggctttatcag

SEQ ID NO: 218947 - DNA, 20 bp, Artificial Sequence
  Description of Artificial Sequence: Synthetic oligonucleotide
  Target: ATXN1; (-) strand; PAM type: YTN; PAM sequence: TTG
tcagacgaggttctaatgtg

SEQ ID NO: 218948 - DNA, 20 bp, Artificial Sequence
  Description of Artificial Sequence: Synthetic oligonucleotide
  Target: ATXN1; (-) strand; PAM type: YTN; PAM sequence: CTT
gtcagacgaggttctaatgt

SEQ ID NO: 218949 - DNA, 20 bp, Artificial Sequence
  Description of Artificial Sequence: Synthetic oligonucleotide
  Target: ATXN1; (-) strand; PAM type: YTN; PAM sequence: TTC
agagtgaccttgtcagacga

SEQ ID NO: 218950 - DNA, 20 bp, Artificial Sequence
  Description of Artificial Sequence: Synthetic oligonucleotide
  Target: ATXN1; (-) strand; PAM type: YTN; PAM sequence: TTT
cagagtgaccttgtcagacg

SEQ ID NO: 218951 - DNA, 20 bp, Artificial Sequence
  Description of Artificial Sequence: Synthetic oligonucleotide
  Target: ATXN1; (-) strand; PAM type: YTN; PAM sequence: TTT
tcagagtgaccttgtcagac

SEQ ID NO: 218952 - DNA, 20 bp, Artificial Sequence
  Description of Artificial Sequence: Synthetic oligonucleotide
  Target: ATXN1; (-) strand; PAM type: YTN; PAM sequence: CTT
ttcagagtgaccttgtcaga

SEQ ID NO: 218953 - DNA, 20 bp, Artificial Sequence
  Description of Artificial Sequence: Synthetic oligonucleotide
  Target: ATXN1; (-) strand; PAM type: YTN; PAM sequence: CTC
acaaggcagaaaggaacttt

SEQ ID NO: 218954 - DNA, 20 bp, Artificial Sequence
  Description of Artificial Sequence: Synthetic oligonucleotide
  Target: ATXN1; (-) strand; PAM type: YTN; PAM sequence: TTA
aaagctcacaaggcagaaag

SEQ ID NO: 218955 - DNA, 20 bp, Artificial Sequence
  Description of Artificial Sequence: Synthetic oligonucleotide
  Target: ATXN1; (-) strand; PAM type: YTN; PAM sequence: CTG
tgacaagtgagcgttaaaag

SEQ ID NO: 218956 - DNA, 20 bp, Artificial Sequence
  Description of Artificial Sequence: Synthetic oligonucleotide
  Target: ATXN1; (-) strand; PAM type: YTN; PAM sequence: TTA
acaacagcctgtgacaagtg

SEQ ID NO: 218957 - DNA, 20 bp, Artificial Sequence
  Description of Artificial Sequence: Synthetic oligonucleotide
  Target: ATXN1; (-) strand; PAM type: YTN; PAM sequence: TTT
aacaacagcctgtgacaagt

SEQ ID NO: 218958 - DNA, 20 bp, Artificial Sequence
  Description of Artificial Sequence: Synthetic oligonucleotide
  Target: ATXN1; (-) strand; PAM type: YTN; PAM sequence: CTT
taacaacagcctgtgacaag

SEQ ID NO: 218959 - DNA, 20 bp, Artificial Sequence
  Description of Artificial Sequence: Synthetic oligonucleotide
  Target: ATXN1; (-) strand; PAM type: YTN; PAM sequence: CTA
agcatcagaagatgctttaa

SEQ ID NO: 218960 - DNA, 20 bp, Artificial Sequence
  Description of Artificial Sequence: Synthetic oligonucleotide
  Target: ATXN1; (-) strand; PAM type: YTN; PAM sequence: TTG
actaagcatcagaagatgct

SEQ ID NO: 218961 - DNA, 20 bp, Artificial Sequence
  Description of Artificial Sequence: Synthetic oligonucleotide
  Target: ATXN1; (-) strand; PAM type: YTN; PAM sequence: TTT
gactaagcatcagaagatgc

SEQ ID NO: 218962 - DNA, 20 bp, Artificial Sequence
  Description of Artificial Sequence: Synthetic oligonucleotide
  Target: ATXN1; (-) strand; PAM type: YTN; PAM sequence: TTG
tcaaaaaacaaacagtgggg

SEQ ID NO: 218963 - DNA, 20 bp, Artificial Sequence
  Description of Artificial Sequence: Synthetic oligonucleotide
  Target: ATXN1; (-) strand; PAM type: YTN; PAM sequence: CTC
aaatggccattgtcaaaaaa

SEQ ID NO: 218964 - DNA, 20 bp, Artificial Sequence
  Description of Artificial Sequence: Synthetic oligonucleotide
  Target: ATXN1; (-) strand; PAM type: YTN; PAM sequence: CTC
tcaaatggccattgtcaaaa

SEQ ID NO: 218965 - DNA, 20 bp, Artificial Sequence
  Description of Artificial Sequence: Synthetic oligonucleotide
  Target: ATXN1; (-) strand; PAM type: YTN; PAM sequence: CTA
ggctctcaaatggccattgt

SEQ ID NO: 218966 - DNA, 20 bp, Artificial Sequence
  Description of Artificial Sequence: Synthetic oligonucleotide
  Target: ATXN1; (-) strand; PAM type: YTN; PAM sequence: TTC
taggctctcaaatggccatt

SEQ ID NO: 218967 - DNA, 20 bp, Artificial Sequence
  Description of Artificial Sequence: Synthetic oligonucleotide
  Target: ATXN1; (-) strand; PAM type: YTN; PAM sequence: TTT
ctaggctctcaaatggccat

SEQ ID NO: 218968 - DNA, 20 bp, Artificial Sequence
  Description of Artificial Sequence: Synthetic oligonucleotide
  Target: ATXN1; (-) strand; PAM type: YTN; PAM sequence: CTG
tttctaggctctcaaatggc

SEQ ID NO: 218969 - DNA, 20 bp, Artificial Sequence
  Description of Artificial Sequence: Synthetic oligonucleotide
  Target: ATXN1; (-) strand; PAM type: YTN; PAM sequence: TTG
gaagactgtttctaggctct

SEQ ID NO: 218970 - DNA, 20 bp, Artificial Sequence
  Description of Artificial Sequence: Synthetic oligonucleotide
  Target: ATXN1; (-) strand; PAM type: YTN; PAM sequence: TTT
ggaagactgtttctaggctc

SEQ ID NO: 218971 - DNA, 20 bp, Artificial Sequence
  Description of Artificial Sequence: Synthetic oligonucleotide
  Target: ATXN1; (-) strand; PAM type: YTN; PAM sequence: CTT
tggaagactgtttctaggct

SEQ ID NO: 218972 - DNA, 20 bp, Artificial Sequence
  Description of Artificial Sequence: Synthetic oligonucleotide
  Target: ATXN1; (-) strand; PAM type: YTN; PAM sequence: CTA
aaaaaggaggcagacacctt

SEQ ID NO: 218973 - DNA, 20 bp, Artificial Sequence
  Description of Artificial Sequence: Synthetic oligonucleotide
  Target: ATXN1; (-) strand; PAM type: YTN; PAM sequence: CTC
ataaaaggctaaaaaaggag

SEQ ID NO: 218974 - DNA, 20 bp, Artificial Sequence
  Description of Artificial Sequence: Synthetic oligonucleotide
  Target: ATXN1; (-) strand; PAM type: YTN; PAM sequence: TTC
aacatagatgaggatgagct

SEQ ID NO: 218975 - DNA, 20 bp, Artificial Sequence
  Description of Artificial Sequence: Synthetic oligonucleotide
  Target: ATXN1; (-) strand; PAM type: YTN; PAM sequence: TTT
caacatagatgaggatgagc

SEQ ID NO: 218976 - DNA, 20 bp, Artificial Sequence
  Description of Artificial Sequence: Synthetic oligonucleotide
  Target: ATXN1; (-) strand; PAM type: YTN; PAM sequence: TTT
tcaacatagatgaggatgag

SEQ ID NO: 218977 - DNA, 20 bp, Artificial Sequence
  Description of Artificial Sequence: Synthetic oligonucleotide
  Target: ATXN1; (-) strand; PAM type: YTN; PAM sequence: CTG
gatgacagtcagccgatggg

SEQ ID NO: 218978 - DNA, 20 bp, Artificial Sequence
  Description of Artificial Sequence: Synthetic oligonucleotide
  Target: ATXN1; (-) strand; PAM type: YTN; PAM sequence: CTC
agggaactggatgacagtca

SEQ ID NO: 218979 - DNA, 20 bp, Artificial Sequence
  Description of Artificial Sequence: Synthetic oligonucleotide
  Target: ATXN1; (-) strand; PAM type: YTN; PAM sequence: TTA
caagtatgatgtggccacca

SEQ ID NO: 218980 - DNA, 20 bp, Artificial Sequence
  Description of Artificial Sequence: Synthetic oligonucleotide
  Target: ATXN1; (-) strand; PAM type: YTN; PAM sequence: TTA
gggttacaagtatgatgtgg

SEQ ID NO: 218981 - DNA, 20 bp, Artificial Sequence
  Description of Artificial Sequence: Synthetic oligonucleotide
  Target: ATXN1; (-) strand; PAM type: YTN; PAM sequence: TTT
agggttacaagtatgatgtg

SEQ ID NO: 218982 - DNA, 20 bp, Artificial Sequence
  Description of Artificial Sequence: Synthetic oligonucleotide
  Target: ATXN1; (-) strand; PAM type: YTN; PAM sequence: TTA
tggagtttagggttacaagt

SEQ ID NO: 218983 - DNA, 20 bp, Artificial Sequence
  Description of Artificial Sequence: Synthetic oligonucleotide
  Target: ATXN1; (-) strand; PAM type: YTN; PAM sequence: TTT
atggagtttagggttacaag

SEQ ID NO: 218984 - DNA, 20 bp, Artificial Sequence
  Description of Artificial Sequence: Synthetic oligonucleotide
  Target: ATXN1; (-) strand; PAM type: YTN; PAM sequence: TTG
gagatttatggagtttaggg

SEQ ID NO: 218985 - DNA, 20 bp, Artificial Sequence
  Description of Artificial Sequence: Synthetic oligonucleotide
  Target: ATXN1; (-) strand; PAM type: YTN; PAM sequence: TTT
ggagatttatggagtttagg

SEQ ID NO: 218986 - DNA, 20 bp, Artificial Sequence
  Description of Artificial Sequence: Synthetic oligonucleotide
  Target: ATXN1; (-) strand; PAM type: YTN; PAM sequence: CTT
tggagatttatggagtttag

SEQ ID NO: 218987 - DNA, 20 bp, Artificial Sequence
  Description of Artificial Sequence: Synthetic oligonucleotide
  Target: ATXN1; (-) strand; PAM type: YTN; PAM sequence: TTG
atgatcaccgtgggaccttt

SEQ ID NO: 218988 - DNA, 20 bp, Artificial Sequence
  Description of Artificial Sequence: Synthetic oligonucleotide
  Target: ATXN1; (-) strand; PAM type: YTN; PAM sequence: TTT
gatgatcaccgtgggacctt

SEQ ID NO: 218989 - DNA, 20 bp, Artificial Sequence
  Description of Artificial Sequence: Synthetic oligonucleotide
  Target: ATXN1; (-) strand; PAM type: YTN; PAM sequence: CTT
tgatgatcaccgtgggacct

SEQ ID NO: 218990 - DNA, 20 bp, Artificial Sequence
  Description of Artificial Sequence: Synthetic oligonucleotide
  Target: ATXN1; (-) strand; PAM type: YTN; PAM sequence: TTG
atccaatctttgatgatcac

SEQ ID NO: 218991 - DNA, 20 bp, Artificial Sequence
  Description of Artificial Sequence: Synthetic oligonucleotide
  Target: ATXN1; (-) strand; PAM type: YTN; PAM sequence: CTT
gatccaatctttgatgatca

SEQ ID NO: 218992 - DNA, 20 bp, Artificial Sequence
  Description of Artificial Sequence: Synthetic oligonucleotide
  Target: ATXN1; (-) strand; PAM type: YTN; PAM sequence: TTG
gtcacttgatccaatctttg

SEQ ID NO: 218993 - DNA, 20 bp, Artificial Sequence
  Description of Artificial Sequence: Synthetic oligonucleotide
  Target: ATXN1; (-) strand; PAM type: YTN; PAM sequence: CTT
ggtcacttgatccaatcttt

SEQ ID NO: 218994 - DNA, 20 bp, Artificial Sequence
  Description of Artificial Sequence: Synthetic oligonucleotide
  Target: ATXN1; (-) strand; PAM type: YTN; PAM sequence: TTA
caacttggtcacttgatcca

SEQ ID NO: 218995 - DNA, 20 bp, Artificial Sequence
  Description of Artificial Sequence: Synthetic oligonucleotide
  Target: ATXN1; (-) strand; PAM type: YTN; PAM sequence: CTT
acaacttggtcacttgatcc

SEQ ID NO: 218996 - DNA, 20 bp, Artificial Sequence
  Description of Artificial Sequence: Synthetic oligonucleotide
  Target: ATXN1; (-) strand; PAM type: YTN; PAM sequence: TTC
ttacaacttggtcacttgat

SEQ ID NO: 218997 - DNA, 20 bp, Artificial Sequence
  Description of Artificial Sequence: Synthetic oligonucleotide
  Target: ATXN1; (-) strand; PAM type: YTN; PAM sequence: TTT
cttacaacttggtcacttga

SEQ ID NO: 218998 - DNA, 20 bp, Artificial Sequence
  Description of Artificial Sequence: Synthetic oligonucleotide
  Target: ATXN1; (-) strand; PAM type: YTN; PAM sequence: CTT
tcttacaacttggtcacttg

SEQ ID NO: 218999 - DNA, 20 bp, Artificial Sequence
  Description of Artificial Sequence: Synthetic oligonucleotide
  Target: ATXN1; (-) strand; PAM type: YTN; PAM sequence: CTC
tttcttacaacttggtcact

SEQ ID NO: 219000 - DNA, 20 bp, Artificial Sequence
  Description of Artificial Sequence: Synthetic oligonucleotide
  Target: ATXN1; (-) strand; PAM type: YTN; PAM sequence: CTG
aggcatacgagcatatcctc

SEQ ID NO: 219001 - DNA, 20 bp, Artificial Sequence
  Description of Artificial Sequence: Synthetic oligonucleotide
  Target: ATXN1; (-) strand; PAM type: YTN; PAM sequence: TTC
tgaggcatacgagcatatcc

SEQ ID NO: 219002 - DNA, 20 bp, Artificial Sequence
  Description of Artificial Sequence: Synthetic oligonucleotide
  Target: ATXN1; (-) strand; PAM type: YTN; PAM sequence: CTT
ctgaggcatacgagcatatc

SEQ ID NO: 219003 - DNA, 20 bp, Artificial Sequence
  Description of Artificial Sequence: Synthetic oligonucleotide
  Target: ATXN1; (-) strand; PAM type: YTN; PAM sequence: TTC
acacagtaagcttctgaggc

SEQ ID NO: 219004 - DNA, 20 bp, Artificial Sequence
  Description of Artificial Sequence: Synthetic oligonucleotide
  Target: ATXN1; (-) strand; PAM type: YTN; PAM sequence: TTA
ttcacacagtaagcttctga

SEQ ID NO: 219005 - DNA, 20 bp, Artificial Sequence
  Description of Artificial Sequence: Synthetic oligonucleotide
  Target: ATXN1; (-) strand; PAM type: YTN; PAM sequence: TTA
gttattcacacagtaagctt

SEQ ID NO: 219006 - DNA, 20 bp, Artificial Sequence
  Description of Artificial Sequence: Synthetic oligonucleotide
  Target: ATXN1; (-) strand; PAM type: YTN; PAM sequence: TTC
aaggaattagttattcacac

SEQ ID NO: 219007 - DNA, 20 bp, Artificial Sequence
  Description of Artificial Sequence: Synthetic oligonucleotide
  Target: ATXN1; (-) strand; PAM type: YTN; PAM sequence: TTT
caaggaattagttattcaca

SEQ ID NO: 219008 - DNA, 20 bp, Artificial Sequence
  Description of Artificial Sequence: Synthetic oligonucleotide
  Target: ATXN1; (-) strand; PAM type: YTN; PAM sequence: CTT
tcaaggaattagttattcac

SEQ ID NO: 219009 - DNA, 20 bp, Artificial Sequence
  Description of Artificial Sequence: Synthetic oligonucleotide
  Target: ATXN1; (-) strand; PAM type: YTN; PAM sequence: TTA
cagaaggctttcaaggaatt

SEQ ID NO: 219010 - DNA, 20 bp, Artificial Sequence
  Description of Artificial Sequence: Synthetic oligonucleotide
  Target: ATXN1; (-) strand; PAM type: YTN; PAM sequence: TTC
cataaagtaatagttacaga

SEQ ID NO: 219011 - DNA, 20 bp, Artificial Sequence
  Description of Artificial Sequence: Synthetic oligonucleotide
  Target: ATXN1; (-) strand; PAM type: YTN; PAM sequence: CTA
ttccataaagtaatagttac

SEQ ID NO: 219012 - DNA, 20 bp, Artificial Sequence
  Description of Artificial Sequence: Synthetic oligonucleotide
  Target: ATXN1; (-) strand; PAM type: YTN; PAM sequence: TTG
actattccataaagtaatag

SEQ ID NO: 219013 - DNA, 20 bp, Artificial Sequence
  Description of Artificial Sequence: Synthetic oligonucleotide
  Target: ATXN1; (-) strand; PAM type: YTN; PAM sequence: CTC
aaacgtcccgaaaaaaaggt

SEQ ID NO: 219014 - DNA, 20 bp, Artificial Sequence
  Description of Artificial Sequence: Synthetic oligonucleotide
  Target: ATXN1; (-) strand; PAM type: YTN; PAM sequence: CTC
ctcaaacgtcccgaaaaaaa

SEQ ID NO: 219015 - DNA, 20 bp, Artificial Sequence
  Description of Artificial Sequence: Synthetic oligonucleotide
  Target: ATXN1; (-) strand; PAM type: YTN; PAM sequence: TTA
accacagatagacacaactc

SEQ ID NO: 219016 - DNA, 20 bp, Artificial Sequence
  Description of Artificial Sequence: Synthetic oligonucleotide
  Target: ATXN1; (-) strand; PAM type: YTN; PAM sequence: TTT
aaccacagatagacacaact

SEQ ID NO: 219017 - DNA, 20 bp, Artificial Sequence
  Description of Artificial Sequence: Synthetic oligonucleotide
  Target: ATXN1; (-) strand; PAM type: YTN; PAM sequence: TTC
ccaggaatttaaccacagat

SEQ ID NO: 219018 - DNA, 20 bp, Artificial Sequence
  Description of Artificial Sequence: Synthetic oligonucleotide
  Target: ATXN1; (-) strand; PAM type: YTN; PAM sequence: TTA
gtgttcccaggaatttaacc

SEQ ID NO: 219019 - DNA, 20 bp, Artificial Sequence
  Description of Artificial Sequence: Synthetic oligonucleotide
  Target: ATXN1; (-) strand; PAM type: YTN; PAM sequence: TTT
agtgttcccaggaatttaac

SEQ ID NO: 219020 - DNA, 20 bp, Artificial Sequence
  Description of Artificial Sequence: Synthetic oligonucleotide
  Target: ATXN1; (-) strand; PAM type: YTN; PAM sequence: TTT
tagtgttcccaggaatttaa

SEQ ID NO: 219021 - DNA, 20 bp, Artificial Sequence
  Description of Artificial Sequence: Synthetic oligonucleotide
  Target: ATXN1; (-) strand; PAM type: YTN; PAM sequence: TTT
ttagtgttcccaggaattta

SEQ ID NO: 219022 - DNA, 20 bp, Artificial Sequence
  Description of Artificial Sequence: Synthetic oligonucleotide
  Target: ATXN1; (-) strand; PAM type: YTN; PAM sequence: CTC
aaaagtttttagtgttccca

SEQ ID NO: 219023 - DNA, 20 bp, Artificial Sequence
  Description of Artificial Sequence: Synthetic oligonucleotide
  Target: ATXN1; (-) strand; PAM type: YTN; PAM sequence: CTC
ctcaaaagtttttagtgttc

SEQ ID NO: 219024 - DNA, 20 bp, Artificial Sequence
  Description of Artificial Sequence: Synthetic oligonucleotide
  Target: ATXN1; (-) strand; PAM type: YTN; PAM sequence: CTC
ctcctcaaaagtttttagtg

SEQ ID NO: 219025 - DNA, 20 bp, Artificial Sequence
  Description of Artificial Sequence: Synthetic oligonucleotide
  Target: ATXN1; (-) strand; PAM type: YTN; PAM sequence: TTC
tcctcctcaaaagtttttag

SEQ ID NO: 219026 - DNA, 20 bp, Artificial Sequence
  Description of Artificial Sequence: Synthetic oligonucleotide
  Target: ATXN1; (-) strand; PAM type: YTN; PAM sequence: TTT
ctcctcctcaaaagttttta

SEQ ID NO: 219027 - DNA, 20 bp, Artificial Sequence
  Description of Artificial Sequence: Synthetic oligonucleotide
  Target: ATXN1; (-) strand; PAM type: YTN; PAM sequence: CTT
tctcctcctcaaaagttttt

SEQ ID NO: 219028 - DNA, 20 bp, Artificial Sequence
  Description of Artificial Sequence: Synthetic oligonucleotide
  Target: ATXN1; (-) strand; PAM type: YTN; PAM sequence: TTA
acggagagacactttctcct

SEQ ID NO: 219029 - DNA, 20 bp, Artificial Sequence
  Description of Artificial Sequence: Synthetic oligonucleotide
  Target: ATXN1; (-) strand; PAM type: YTN; PAM sequence: TTA
aacattaacggagagacact

SEQ ID NO: 219030 - DNA, 20 bp, Artificial Sequence
  Description of Artificial Sequence: Synthetic oligonucleotide
  Target: ATXN1; (-) strand; PAM type: YTN; PAM sequence: TTT
aaacattaacggagagacac

SEQ ID NO: 219031 - DNA, 20 bp, Artificial Sequence
  Description of Artificial Sequence: Synthetic oligonucleotide
  Target: ATXN1; (-) strand; PAM type: YTN; PAM sequence: CTC
acatgtttaaacattaacgg

SEQ ID NO: 219032 - DNA, 20 bp, Artificial Sequence
  Description of Artificial Sequence: Synthetic oligonucleotide
  Target: ATXN1; (-) strand; PAM type: YTN; PAM sequence: CTC
aactcacatgtttaaacatt

SEQ ID NO: 219033 - DNA, 20 bp, Artificial Sequence
  Description of Artificial Sequence: Synthetic oligonucleotide
  Target: ATXN1; (-) strand; PAM type: YTN; PAM sequence: TTA
tctcaactcacatgtttaaa

SEQ ID NO: 219034 - DNA, 20 bp, Artificial Sequence
  Description of Artificial Sequence: Synthetic oligonucleotide
  Target: ATXN1; (-) strand; PAM type: YTN; PAM sequence: TTG
aatggcattatctcaactca

SEQ ID NO: 219035 - DNA, 20 bp, Artificial Sequence
  Description of Artificial Sequence: Synthetic oligonucleotide
  Target: ATXN1; (-) strand; PAM type: YTN; PAM sequence: CTA
gatggaaaattgaatggcat

SEQ ID NO: 219036 - DNA, 20 bp, Artificial Sequence
  Description of Artificial Sequence: Synthetic oligonucleotide
  Target: ATXN1; (-) strand; PAM type: YTN; PAM sequence: CTC
cggctagatggaaaattgaa

SEQ ID NO: 219037 - DNA, 20 bp, Artificial Sequence
  Description of Artificial Sequence: Synthetic oligonucleotide
  Target: ATXN1; (-) strand; PAM type: YTN; PAM sequence: TTC
ctccggctagatggaaaatt

SEQ ID NO: 219038 - DNA, 20 bp, Artificial Sequence
  Description of Artificial Sequence: Synthetic oligonucleotide
  Target: ATXN1; (-) strand; PAM type: YTN; PAM sequence: TTG
ttcctccggctagatggaaa

SEQ ID NO: 219039 - DNA, 20 bp, Artificial Sequence
  Description of Artificial Sequence: Synthetic oligonucleotide
  Target: ATXN1; (-) strand; PAM type: YTN; PAM sequence: TTC
aggcagttgttcctccggct

SEQ ID NO: 219040 - DNA, 20 bp, Artificial Sequence
  Description of Artificial Sequence: Synthetic oligonucleotide
  Target: ATXN1; (-) strand; PAM type: YTN; PAM sequence: TTT
caggcagttgttcctccggc

SEQ ID NO: 219041 - DNA, 20 bp, Artificial Sequence
  Description of Artificial Sequence: Synthetic oligonucleotide
  Target: ATXN1; (-) strand; PAM type: YTN; PAM sequence: TTT
tcaggcagttgttcctccgg

SEQ ID NO: 219042 - DNA, 20 bp, Artificial Sequence
  Description of Artificial Sequence: Synthetic oligonucleotide
  Target: ATXN1; (-) strand; PAM type: YTN; PAM sequence: TTG
ccattttcaggcagttgttc

SEQ ID NO: 219043 - DNA, 20 bp, Artificial Sequence
  Description of Artificial Sequence: Synthetic oligonucleotide
  Target: ATXN1; (-) strand; PAM type: YTN; PAM sequence: TTT
gccattttcaggcagttgtt

SEQ ID NO: 219044 - DNA, 20 bp, Artificial Sequence
  Description of Artificial Sequence: Synthetic oligonucleotide
  Target: ATXN1; (-) strand; PAM type: YTN; PAM sequence: TTT
tgccattttcaggcagttgt

SEQ ID NO: 219045 - DNA, 20 bp, Artificial Sequence
  Description of Artificial Sequence: Synthetic oligonucleotide
  Target: ATXN1; (-) strand; PAM type: YTN; PAM sequence: CTT
ttgccattttcaggcagttg

SEQ ID NO: 219046 - DNA, 20 bp, Artificial Sequence
  Description of Artificial Sequence: Synthetic oligonucleotide
  Target: ATXN1; (-) strand; PAM type: YTN; PAM sequence: CTG
atagcatccaaaaaataaaa

SEQ ID NO: 219047 - DNA, 20 bp, Artificial Sequence
  Description of Artificial Sequence: Synthetic oligonucleotide
  Target: ATXN1; (-) strand; PAM type: YTN; PAM sequence: CTG
tgggtactgatagcatccaa

SEQ ID NO: 219048 - DNA, 20 bp, Artificial Sequence
  Description of Artificial Sequence: Synthetic oligonucleotide
  Target: ATXN1; (-) strand; PAM type: YTN; PAM sequence: TTC
tgtgggtactgatagcatcc

SEQ ID NO: 219049 - DNA, 20 bp, Artificial Sequence
  Description of Artificial Sequence: Synthetic oligonucleotide
  Target: ATXN1; (-) strand; PAM type: YTN; PAM sequence: TTT
ctgtgggtactgatagcatc

SEQ ID NO: 219050 - DNA, 20 bp, Artificial Sequence
  Description of Artificial Sequence: Synthetic oligonucleotide
  Target: ATXN1; (-) strand; PAM type: YTN; PAM sequence: TTT
tctgtgggtactgatagcat

SEQ ID NO: 219051 - DNA, 20 bp, Artificial Sequence
  Description of Artificial Sequence: Synthetic oligonucleotide
  Target: ATXN1; (-) strand; PAM type: YTN; PAM sequence: TTA
caaccccattttctgtgggt

SEQ ID NO: 219052 - DNA, 20 bp, Artificial Sequence
  Description of Artificial Sequence: Synthetic oligonucleotide
  Target: ATXN1; (-) strand; PAM type: YTN; PAM sequence: CTT
acaaccccattttctgtggg

SEQ ID NO: 219053 - DNA, 20 bp, Artificial Sequence
  Description of Artificial Sequence: Synthetic oligonucleotide
  Target: ATXN1; (-) strand; PAM type: YTN; PAM sequence: CTA
ataaaatccttacaacccca

SEQ ID NO: 219054 - DNA, 20 bp, Artificial Sequence
  Description of Artificial Sequence: Synthetic oligonucleotide
  Target: ATXN1; (-) strand; PAM type: YTN; PAM sequence: TTA
cataaaactaataaaatcct

SEQ ID NO: 219055 - DNA, 20 bp, Artificial Sequence
  Description of Artificial Sequence: Synthetic oligonucleotide
  Target: ATXN1; (-) strand; PAM type: YTN; PAM sequence: CTG
agttacataaaactaataaa

SEQ ID NO: 219056 - DNA, 20 bp, Artificial Sequence
  Description of Artificial Sequence: Synthetic oligonucleotide
  Target: ATXN1; (-) strand; PAM type: YTN; PAM sequence: TTG
agtgggagctgagttacata

SEQ ID NO: 219057 - DNA, 20 bp, Artificial Sequence
  Description of Artificial Sequence: Synthetic oligonucleotide
  Target: ATXN1; (-) strand; PAM type: YTN; PAM sequence: TTT
gagtgggagctgagttacat

SEQ ID NO: 219058 - DNA, 20 bp, Artificial Sequence
  Description of Artificial Sequence: Synthetic oligonucleotide
  Target: ATXN1; (-) strand; PAM type: YTN; PAM sequence: TTA
cacatttgagtgggagctga

SEQ ID NO: 219059 - DNA, 20 bp, Artificial Sequence
  Description of Artificial Sequence: Synthetic oligonucleotide
  Target: ATXN1; (-) strand; PAM type: YTN; PAM sequence: CTT
acacatttgagtgggagctg

SEQ ID NO: 219060 - DNA, 20 bp, Artificial Sequence
  Description of Artificial Sequence: Synthetic oligonucleotide
  Target: ATXN1; (-) strand; PAM type: YTN; PAM sequence: TTG
ccttacacatttgagtggga

SEQ ID NO: 219061 - DNA, 20 bp, Artificial Sequence
  Description of Artificial Sequence: Synthetic oligonucleotide
  Target: ATXN1; (-) strand; PAM type: YTN; PAM sequence: CTA
tcagtatgttgccttacaca

SEQ ID NO: 219062 - DNA, 20 bp, Artificial Sequence
  Description of Artificial Sequence: Synthetic oligonucleotide
  Target: ATXN1; (-) strand; PAM type: YTN; PAM sequence: TTC
tatcagtatgttgccttaca

SEQ ID NO: 219063 - DNA, 20 bp, Artificial Sequence
  Description of Artificial Sequence: Synthetic oligonucleotide
  Target: ATXN1; (-) strand; PAM type: YTN; PAM sequence: TTT
ctatcagtatgttgccttac

SEQ ID NO: 219064 - DNA, 20 bp, Artificial Sequence
  Description of Artificial Sequence: Synthetic oligonucleotide
  Target: ATXN1; (-) strand; PAM type: YTN; PAM sequence: TTG
atttctatcagtatgttgcc

SEQ ID NO: 219065 - DNA, 20 bp, Artificial Sequence
  Description of Artificial Sequence: Synthetic oligonucleotide
  Target: ATXN1; (-) strand; PAM type: YTN; PAM sequence: TTA
tgttgatttctatcagtatg

SEQ ID NO: 219066 - DNA, 20 bp, Artificial Sequence
  Description of Artificial Sequence: Synthetic oligonucleotide
  Target: ATXN1; (-) strand; PAM type: YTN; PAM sequence: CTT
atgttgatttctatcagtat

SEQ ID NO: 219067 - DNA, 20 bp, Artificial Sequence
  Description of Artificial Sequence: Synthetic oligonucleotide
  Target: ATXN1; (-) strand; PAM type: YTN; PAM sequence: CTG
gcttatgttgatttctatca

SEQ ID NO: 219068 - DNA, 20 bp, Artificial Sequence
  Description of Artificial Sequence: Synthetic oligonucleotide
  Target: ATXN1; (-) strand; PAM type: YTN; PAM sequence: TTC
ctggcttatgttgatttcta

SEQ ID NO: 219069 - DNA, 20 bp, Artificial Sequence
  Description of Artificial Sequence: Synthetic oligonucleotide
  Target: ATXN1; (-) strand; PAM type: YTN; PAM sequence: CTT
cctggcttatgttgatttct

SEQ ID NO: 219070 - DNA, 20 bp, Artificial Sequence
  Description of Artificial Sequence: Synthetic oligonucleotide
  Target: ATXN1; (-) strand; PAM type: YTN; PAM sequence: TTG
aacttcctggcttatgttga

SEQ ID NO: 219071 - DNA, 20 bp, Artificial Sequence
  Description of Artificial Sequence: Synthetic oligonucleotide
  Target: ATXN1; (-) strand; PAM type: YTN; PAM sequence: TTT
gaacttcctggcttatgttg

SEQ ID NO: 219072 - DNA, 20 bp, Artificial Sequence
  Description of Artificial Sequence: Synthetic oligonucleotide
  Target: ATXN1; (-) strand; PAM type: YTN; PAM sequence: CTT
tgaacttcctggcttatgtt

SEQ ID NO: 219073 - DNA, 20 bp, Artificial Sequence
  Description of Artificial Sequence: Synthetic oligonucleotide
  Target: ATXN1; (-) strand; PAM type: YTN; PAM sequence: TTG
tcatgctttgaacttcctgg

SEQ ID NO: 219074 - DNA, 20 bp, Artificial Sequence
  Description of Artificial Sequence: Synthetic oligonucleotide
  Target: ATXN1; (-) strand; PAM type: YTN; PAM sequence: TTT
gtcatgctttgaacttcctg

SEQ ID NO: 219075 - DNA, 20 bp, Artificial Sequence
  Description of Artificial Sequence: Synthetic oligonucleotide
  Target: ATXN1; (-) strand; PAM type: YTN; PAM sequence: TTA
ccaagccggtaaagtaaaga

SEQ ID NO: 219076 - DNA, 20 bp, Artificial Sequence
  Description of Artificial Sequence: Synthetic oligonucleotide
  Target: ATXN1; (-) strand; PAM type: YTN; PAM sequence: TTT
accaagccggtaaagtaaag

SEQ ID NO: 219077 - DNA, 20 bp, Artificial Sequence
  Description of Artificial Sequence: Synthetic oligonucleotide
  Target: ATXN1; (-) strand; PAM type: YTN; PAM sequence: TTT
taccaagccggtaaagtaaa

SEQ ID NO: 219078 - DNA, 20 bp, Artificial Sequence
  Description of Artificial Sequence: Synthetic oligonucleotide
  Target: ATXN1; (-) strand; PAM type: YTN; PAM sequence: TTT
ttaccaagccggtaaagtaa

SEQ ID NO: 219079 - DNA, 20 bp, Artificial Sequence
  Description of Artificial Sequence: Synthetic oligonucleotide
  Target: ATXN1; (-) strand; PAM type: YTN; PAM sequence: CTG
tttttaccaagccggtaaag

SEQ ID NO: 219080 - DNA, 20 bp, Artificial Sequence
  Description of Artificial Sequence: Synthetic oligonucleotide
  Target: ATXN1; (-) strand; PAM type: YTN; PAM sequence: TTC
tgtttttaccaagccggtaa

SEQ ID NO: 219081 - DNA, 20 bp, Artificial Sequence
  Description of Artificial Sequence: Synthetic oligonucleotide
  Target: ATXN1; (-) strand; PAM type: YTN; PAM sequence: CTC
caaattctgtttttaccaag

SEQ ID NO: 219082 - DNA, 20 bp, Artificial Sequence
  Description of Artificial Sequence: Synthetic oligonucleotide
  Target: ATXN1; (-) strand; PAM type: YTN; PAM sequence: CTC
tccaaattctgtttttacca

SEQ ID NO: 219083 - DNA, 20 bp, Artificial Sequence
  Description of Artificial Sequence: Synthetic oligonucleotide
  Target: ATXN1; (-) strand; PAM type: YTN; PAM sequence: CTC
tctccaaattctgtttttac

SEQ ID NO: 219084 - DNA, 20 bp, Artificial Sequence
  Description of Artificial Sequence: Synthetic oligonucleotide
  Target: ATXN1; (-) strand; PAM type: YTN; PAM sequence: CTC
ctctctccaaattctgtttt

SEQ ID NO: 219085 - DNA, 20 bp, Artificial Sequence
  Description of Artificial Sequence: Synthetic oligonucleotide
  Target: ATXN1; (-) strand; PAM type: YTN; PAM sequence: CTC
ctcctctctccaaattctgt

SEQ ID NO: 219086 - DNA, 20 bp, Artificial Sequence
  Description of Artificial Sequence: Synthetic oligonucleotide
  Target: ATXN1; (-) strand; PAM type: YTN; PAM sequence: TTA
aatcctcctcctctctccaa

SEQ ID NO: 219087 - DNA, 20 bp, Artificial Sequence
  Description of Artificial Sequence: Synthetic oligonucleotide
  Target: ATXN1; (-) strand; PAM type: YTN; PAM sequence: TTT
aaatcctcctcctctctcca

SEQ ID NO: 219088 - DNA, 20 bp, Artificial Sequence
  Description of Artificial Sequence: Synthetic oligonucleotide
  Target: ATXN1; (-) strand; PAM type: YTN; PAM sequence: TTG
tttaaatcctcctcctctct

SEQ ID NO: 219089 - DNA, 20 bp, Artificial Sequence
  Description of Artificial Sequence: Synthetic oligonucleotide
  Target: ATXN1; (-) strand; PAM type: YTN; PAM sequence: CTT
gtttaaatcctcctcctctc

SEQ ID NO: 219090 - DNA, 20 bp, Artificial Sequence
  Description of Artificial Sequence: Synthetic oligonucleotide
  Target: ATXN1; (-) strand; PAM type: YTN; PAM sequence: TTG
cagtgaacttgtttaaatcc

SEQ ID NO: 219091 - DNA, 20 bp, Artificial Sequence
  Description of Artificial Sequence: Synthetic oligonucleotide
  Target: ATXN1; (-) strand; PAM type: YTN; PAM sequence: CTT
gcagtgaacttgtttaaatc

SEQ ID NO: 219092 - DNA, 20 bp, Artificial Sequence
  Description of Artificial Sequence: Synthetic oligonucleotide
  Target: ATXN1; (-) strand; PAM type: YTN; PAM sequence: TTG
atacaagccagtaacttgca

SEQ ID NO: 219093 - DNA, 20 bp, Artificial Sequence
  Description of Artificial Sequence: Synthetic oligonucleotide
  Target: ATXN1; (-) strand; PAM type: YTN; PAM sequence: TTA
aaaaagaaaagattgataca

SEQ ID NO: 219094 - DNA, 20 bp, Artificial Sequence
  Description of Artificial Sequence: Synthetic oligonucleotide
  Target: ATXN1; (-) strand; PAM type: YTN; PAM sequence: TTA
gttaaaaaagaaaagattga

SEQ ID NO: 219095 - DNA, 20 bp, Artificial Sequence
  Description of Artificial Sequence: Synthetic oligonucleotide
  Target: ATXN1; (-) strand; PAM type: YTN; PAM sequence: TTT
agttaaaaaagaaaagattg

SEQ ID NO: 219096 - DNA, 20 bp, Artificial Sequence
  Description of Artificial Sequence: Synthetic oligonucleotide
  Target: ATXN1; (-) strand; PAM type: YTN; PAM sequence: TTT
tagttaaaaaagaaaagatt

SEQ ID NO: 219097 - DNA, 20 bp, Artificial Sequence
  Description of Artificial Sequence: Synthetic oligonucleotide
  Target: ATXN1; (-) strand; PAM type: YTN; PAM sequence: TTT
ttagttaaaaaagaaaagat

SEQ ID NO: 219098 - DNA, 20 bp, Artificial Sequence
  Description of Artificial Sequence: Synthetic oligonucleotide
  Target: ATXN1; (-) strand; PAM type: YTN; PAM sequence: TTG
gtaacaaataagagaaatgc

SEQ ID NO: 219099 - DNA, 20 bp, Artificial Sequence
  Description of Artificial Sequence: Synthetic oligonucleotide
  Target: ATXN1; (-) strand; PAM type: YTN; PAM sequence: CTC
gagatatgaagttggtaaca

SEQ ID NO: 219100 - DNA, 20 bp, Artificial Sequence
  Description of Artificial Sequence: Synthetic oligonucleotide
  Target: ATXN1; (-) strand; PAM type: YTN; PAM sequence: TTA
tagaatacctcgagatatga

SEQ ID NO: 219101 - DNA, 20 bp, Artificial Sequence
  Description of Artificial Sequence: Synthetic oligonucleotide
  Target: ATXN1; (-) strand; PAM type: YTN; PAM sequence: TTC
caattatagaatacctcgag

SEQ ID NO: 219102 - DNA, 20 bp, Artificial Sequence
  Description of Artificial Sequence: Synthetic oligonucleotide
  Target: ATXN1; (-) strand; PAM type: YTN; PAM sequence: CTT
ccaattatagaatacctcga

SEQ ID NO: 219103 - DNA, 20 bp, Artificial Sequence
  Description of Artificial Sequence: Synthetic oligonucleotide
  Target: ATXN1; (-) strand; PAM type: YTN; PAM sequence: CTC
ttccaattatagaatacctc

SEQ ID NO: 219104 - DNA, 20 bp, Artificial Sequence
  Description of Artificial Sequence: Synthetic oligonucleotide
  Target: ATXN1; (-) strand; PAM type: YTN; PAM sequence: TTG
gaatgaaacgtcaaggacct

SEQ ID NO: 219105 - DNA, 20 bp, Artificial Sequence
  Description of Artificial Sequence: Synthetic oligonucleotide
  Target: ATXN1; (-) strand; PAM type: YTN; PAM sequence: TTG
cagaagacattggaatgaaa

SEQ ID NO: 219106 - DNA, 20 bp, Artificial Sequence
  Description of Artificial Sequence: Synthetic oligonucleotide
  Target: ATXN1; (-) strand; PAM type: YTN; PAM sequence: TTT
gcagaagacattggaatgaa

SEQ ID NO: 219107 - DNA, 20 bp, Artificial Sequence
  Description of Artificial Sequence: Synthetic oligonucleotide
  Target: ATXN1; (-) strand; PAM type: YTN; PAM sequence: CTT
tgcagaagacattggaatga

SEQ ID NO: 219108 - DNA, 20 bp, Artificial Sequence
  Description of Artificial Sequence: Synthetic oligonucleotide
  Target: ATXN1; (-) strand; PAM type: YTN; PAM sequence: TTC
ctttgcagaagacattggaa

SEQ ID NO: 219109 - DNA, 20 bp, Artificial Sequence
  Description of Artificial Sequence: Synthetic oligonucleotide
  Target: ATXN1; (-) strand; PAM type: YTN; PAM sequence: CTG
ggtcagcaggttcctttgca

SEQ ID NO: 219110 - DNA, 20 bp, Artificial Sequence
  Description of Artificial Sequence: Synthetic oligonucleotide
  Target: ATXN1; (-) strand; PAM type: YTN; PAM sequence: CTC
cctgggtcagcaggttcctt

SEQ ID NO: 219111 - DNA, 20 bp, Artificial Sequence
  Description of Artificial Sequence: Synthetic oligonucleotide
  Target: ATXN1; (-) strand; PAM type: YTN; PAM sequence: TTA
aaaagaggtatgtcaacctc

SEQ ID NO: 219112 - DNA, 20 bp, Artificial Sequence
  Description of Artificial Sequence: Synthetic oligonucleotide
  Target: ATXN1; (-) strand; PAM type: YTN; PAM sequence: TTT
aaaaagaggtatgtcaacct

SEQ ID NO: 219113 - DNA, 20 bp, Artificial Sequence
  Description of Artificial Sequence: Synthetic oligonucleotide
  Target: ATXN1; (-) strand; PAM type: YTN; PAM sequence: CTT
taaaaagaggtatgtcaacc

SEQ ID NO: 219114 - DNA, 20 bp, Artificial Sequence
  Description of Artificial Sequence: Synthetic oligonucleotide
  Target: ATXN1; (-) strand; PAM type: YTN; PAM sequence: CTG
tatgactttaaaaagaggta

SEQ ID NO: 219115 - DNA, 20 bp, Artificial Sequence
  Description of Artificial Sequence: Synthetic oligonucleotide
  Target: ATXN1; (-) strand; PAM type: YTN; PAM sequence: TTC
tgtatgactttaaaaagagg

SEQ ID NO: 219116 - DNA, 20 bp, Artificial Sequence
  Description of Artificial Sequence: Synthetic oligonucleotide
  Target: ATXN1; (-) strand; PAM type: YTN; PAM sequence: TTT
ctgtatgactttaaaaagag

SEQ ID NO: 219117 - DNA, 20 bp, Artificial Sequence
  Description of Artificial Sequence: Synthetic oligonucleotide
  Target: ATXN1; (-) strand; PAM type: YTN; PAM sequence: CTT
tctgtatgactttaaaaaga

SEQ ID NO: 219118 - DNA, 20 bp, Artificial Sequence
  Description of Artificial Sequence: Synthetic oligonucleotide
  Target: ATXN1; (-) strand; PAM type: YTN; PAM sequence: TTA
actttctgtatgactttaaa

SEQ ID NO: 219119 - DNA, 20 bp, Artificial Sequence
  Description of Artificial Sequence: Synthetic oligonucleotide
  Target: ATXN1; (-) strand; PAM type: YTN; PAM sequence: TTG
aacccagaatccagtcaaag

SEQ ID NO: 219120 - DNA, 20 bp, Artificial Sequence
  Description of Artificial Sequence: Synthetic oligonucleotide
  Target: ATXN1; (-) strand; PAM type: YTN; PAM sequence: TTA
agcgtcaatgagcatgagtg

SEQ ID NO: 219121 - DNA, 20 bp, Artificial Sequence
  Description of Artificial Sequence: Synthetic oligonucleotide
  Target: ATXN1; (-) strand; PAM type: YTN; PAM sequence: TTA
tgtccattaagcgtcaatga

SEQ ID NO: 219122 - DNA, 20 bp, Artificial Sequence
  Description of Artificial Sequence: Synthetic oligonucleotide
  Target: ATXN1; (-) strand; PAM type: YTN; PAM sequence: TTT
atgtccattaagcgtcaatg

SEQ ID NO: 219123 - DNA, 20 bp, Artificial Sequence
  Description of Artificial Sequence: Synthetic oligonucleotide
  Target: ATXN1; (-) strand; PAM type: YTN; PAM sequence: TTA
aatgagtttatgtccattaa

SEQ ID NO: 219124 - DNA, 20 bp, Artificial Sequence
  Description of Artificial Sequence: Synthetic oligonucleotide
  Target: ATXN1; (-) strand; PAM type: YTN; PAM sequence: TTC
attaaatgagtttatgtcca

SEQ ID NO: 219125 - DNA, 20 bp, Artificial Sequence
  Description of Artificial Sequence: Synthetic oligonucleotide
  Target: ATXN1; (-) strand; PAM type: YTN; PAM sequence: TTT
cattaaatgagtttatgtcc

SEQ ID NO: 219126 - DNA, 20 bp, Artificial Sequence
  Description of Artificial Sequence: Synthetic oligonucleotide
  Target: ATXN1; (-) strand; PAM type: YTN; PAM sequence: TTA
catttcattaaatgagttta

SEQ ID NO: 219127 - DNA, 20 bp, Artificial Sequence
  Description of Artificial Sequence: Synthetic oligonucleotide
  Target: ATXN1; (-) strand; PAM type: YTN; PAM sequence: CTA
aaaccgcattacatttcatt

SEQ ID NO: 219128 - DNA, 20 bp, Artificial Sequence
  Description of Artificial Sequence: Synthetic oligonucleotide
  Target: ATXN1; (-) strand; PAM type: YTN; PAM sequence: TTC
aaactaaaaccgcattacat

SEQ ID NO: 219129 - DNA, 20 bp, Artificial Sequence
  Description of Artificial Sequence: Synthetic oligonucleotide
  Target: ATXN1; (-) strand; PAM type: YTN; PAM sequence: TTT
caaactaaaaccgcattaca

SEQ ID NO: 219130 - DNA, 20 bp, Artificial Sequence
  Description of Artificial Sequence: Synthetic oligonucleotide
  Target: ATXN1; (-) strand; PAM type: YTN; PAM sequence: TTT
tcaaactaaaaccgcattac

SEQ ID NO: 219131 - DNA, 20 bp, Artificial Sequence
  Description of Artificial Sequence: Synthetic oligonucleotide
  Target: ATXN1; (-) strand; PAM type: YTN; PAM sequence: TTT
ttcaaactaaaaccgcatta

SEQ ID NO: 219132 - DNA, 20 bp, Artificial Sequence
  Description of Artificial Sequence: Synthetic oligonucleotide
  Target: ATXN1; (-) strand; PAM type: YTN; PAM sequence: CTG
gtaaatttttcaaactaaaa

SEQ ID NO: 219133 - DNA, 20 bp, Artificial Sequence
  Description of Artificial Sequence: Synthetic oligonucleotide
  Target: ATXN1; (-) strand; PAM type: YTN; PAM sequence: CTA
ctggtaaatttttcaaacta

SEQ ID NO: 219134 - DNA, 20 bp, Artificial Sequence
  Description of Artificial Sequence: Synthetic oligonucleotide
  Target: ATXN1; (-) strand; PAM type: YTN; PAM sequence: CTA
tgaggaagtatcatgctact

SEQ ID NO: 219135 - DNA, 20 bp, Artificial Sequence
  Description of Artificial Sequence: Synthetic oligonucleotide
  Target: ATXN1; (-) strand; PAM type: YTN; PAM sequence: TTA
tggcaaaaacaaaacagaaa

SEQ ID NO: 219136 - DNA, 20 bp, Artificial Sequence
  Description of Artificial Sequence: Synthetic oligonucleotide
  Target: ATXN1; (-) strand; PAM type: YTN; PAM sequence: CTT
atggcaaaaacaaaacagaa

SEQ ID NO: 219137 - DNA, 20 bp, Artificial Sequence
  Description of Artificial Sequence: Synthetic oligonucleotide
  Target: ATXN1; (-) strand; PAM type: YTN; PAM sequence: TTC
ttatggcaaaaacaaaacag

SEQ ID NO: 219138 - DNA, 20 bp, Artificial Sequence
  Description of Artificial Sequence: Synthetic oligonucleotide
  Target: ATXN1; (-) strand; PAM type: YTN; PAM sequence: TTT
cttatggcaaaaacaaaaca

SEQ ID NO: 219139 - DNA, 20 bp, Artificial Sequence
  Description of Artificial Sequence: Synthetic oligonucleotide
  Target: ATXN1; (-) strand; PAM type: YTN; PAM sequence: TTT
tcttatggcaaaaacaaaac

SEQ ID NO: 219140 - DNA, 20 bp, Artificial Sequence
  Description of Artificial Sequence: Synthetic oligonucleotide
  Target: ATXN1; (-) strand; PAM type: YTN; PAM sequence: TTA
ttttcttatggcaaaaacaa

SEQ ID NO: 219141 - DNA, 20 bp, Artificial Sequence
  Description of Artificial Sequence: Synthetic oligonucleotide
  Target: ATXN1; (-) strand; PAM type: YTN; PAM sequence: TTT
attttcttatggcaaaaaca

SEQ ID NO: 219142 - DNA, 20 bp, Artificial Sequence
  Description of Artificial Sequence: Synthetic oligonucleotide
  Target: ATXN1; (-) strand; PAM type: YTN; PAM sequence: TTG
aaaataatataatccagaaa

SEQ ID NO: 219143 - DNA, 20 bp, Artificial Sequence
  Description of Artificial Sequence: Synthetic oligonucleotide
  Target: ATXN1; (-) strand; PAM type: YTN; PAM sequence: CTG
caagatagttgaaaataata

SEQ ID NO: 219144 - DNA, 20 bp, Artificial Sequence
  Description of Artificial Sequence: Synthetic oligonucleotide
  Target: ATXN1; (-) strand; PAM type: YTN; PAM sequence: TTG
ctgcaagatagttgaaaata

SEQ ID NO: 219145 - DNA, 20 bp, Artificial Sequence
  Description of Artificial Sequence: Synthetic oligonucleotide
  Target: ATXN1; (-) strand; PAM type: YTN; PAM sequence: TTT
gctgcaagatagttgaaaat

SEQ ID NO: 219146 - DNA, 20 bp, Artificial Sequence
  Description of Artificial Sequence: Synthetic oligonucleotide
  Target: ATXN1; (-) strand; PAM type: YTN; PAM sequence: TTT
tgctgcaagatagttgaaaa

SEQ ID NO: 219147 - DNA, 20 bp, Artificial Sequence
  Description of Artificial Sequence: Synthetic oligonucleotide
  Target: ATXN1; (-) strand; PAM type: YTN; PAM sequence: CTC
ccagatcgattttgctgcaa

SEQ ID NO: 219148 - DNA, 20 bp, Artificial Sequence
  Description of Artificial Sequence: Synthetic oligonucleotide
  Target: ATXN1; (-) strand; PAM type: YTN; PAM sequence: CTC
tcccagatcgattttgctgc

SEQ ID NO: 219149 - DNA, 20 bp, Artificial Sequence
  Description of Artificial Sequence: Synthetic oligonucleotide
  Target: ATXN1; (-) strand; PAM type: YTN; PAM sequence: CTG
cctctcccagatcgattttg

SEQ ID NO: 219150 - DNA, 20 bp, Artificial Sequence
  Description of Artificial Sequence: Synthetic oligonucleotide
  Target: ATXN1; (-) strand; PAM type: YTN; PAM sequence: TTC
tgcctctcccagatcgattt

SEQ ID NO: 219151 - DNA, 20 bp, Artificial Sequence
  Description of Artificial Sequence: Synthetic oligonucleotide
  Target: ATXN1; (-) strand; PAM type: YTN; PAM sequence: TTA
aagtaacaaatgggaccatt

SEQ ID NO: 219152 - DNA, 20 bp, Artificial Sequence
  Description of Artificial Sequence: Synthetic oligonucleotide
  Target: ATXN1; (-) strand; PAM type: YTN; PAM sequence: TTG
ttaaagtaacaaatgggacc

SEQ ID NO: 219153 - DNA, 20 bp, Artificial Sequence
  Description of Artificial Sequence: Synthetic oligonucleotide
  Target: ATXN1; (-) strand; PAM type: YTN; PAM sequence: CTG
gtgaaggttgttaaagtaac

SEQ ID NO: 219154 - DNA, 20 bp, Artificial Sequence
  Description of Artificial Sequence: Synthetic oligonucleotide
  Target: ATXN1; (-) strand; PAM type: YTN; PAM sequence: TTG
gcagctggtgaaggttgtta

SEQ ID NO: 219155 - DNA, 20 bp, Artificial Sequence
  Description of Artificial Sequence: Synthetic oligonucleotide
  Target: ATXN1; (-) strand; PAM type: YTN; PAM sequence: TTT
ggcagctggtgaaggttgtt

SEQ ID NO: 219156 - DNA, 20 bp, Artificial Sequence
  Description of Artificial Sequence: Synthetic oligonucleotide
  Target: ATXN1; (-) strand; PAM type: YTN; PAM sequence: CTT
tggcagctggtgaaggttgt

SEQ ID NO: 219157 - DNA, 20 bp, Artificial Sequence
  Description of Artificial Sequence: Synthetic oligonucleotide
  Target: ATXN1; (-) strand; PAM type: YTN; PAM sequence: CTA
gctttggcagctggtgaagg

SEQ ID NO: 219158 - DNA, 20 bp, Artificial Sequence
  Description of Artificial Sequence: Synthetic oligonucleotide
  Target: ATXN1; (-) strand; PAM type: YTN; PAM sequence: CTG
gacacctagctttggcagct

SEQ ID NO: 219159 - DNA, 20 bp, Artificial Sequence
  Description of Artificial Sequence: Synthetic oligonucleotide
  Target: ATXN1; (-) strand; PAM type: YTN; PAM sequence: TTC
tggacacctagctttggcag

SEQ ID NO: 219160 - DNA, 20 bp, Artificial Sequence
  Description of Artificial Sequence: Synthetic oligonucleotide
  Target: ATXN1; (-) strand; PAM type: YTN; PAM sequence: TTT
ctggacacctagctttggca

SEQ ID NO: 219161 - DNA, 20 bp, Artificial Sequence
  Description of Artificial Sequence: Synthetic oligonucleotide
  Target: ATXN1; (-) strand; PAM type: YTN; PAM sequence: TTT
tctggacacctagctttggc

SEQ ID NO: 219162 - DNA, 20 bp, Artificial Sequence
  Description of Artificial Sequence: Synthetic oligonucleotide
  Target: ATXN1; (-) strand; PAM type: YTN; PAM sequence: CTT
ttctggacacctagctttgg

SEQ ID NO: 219163 - DNA, 20 bp, Artificial Sequence
  Description of Artificial Sequence: Synthetic oligonucleotide
  Target: ATXN1; (-) strand; PAM type: YTN; PAM sequence: TTA
cttttctggacacctagctt

SEQ ID NO: 219164 - DNA, 20 bp, Artificial Sequence
  Description of Artificial Sequence: Synthetic oligonucleotide
  Target: ATXN1; (-) strand; PAM type: YTN; PAM sequence: CTT
acttttctggacacctagct

SEQ ID NO: 219165 - DNA, 20 bp, Artificial Sequence
  Description of Artificial Sequence: Synthetic oligonucleotide
  Target: ATXN1; (-) strand; PAM type: YTN; PAM sequence: CTG
tatgaatagtataaacctta

SEQ ID NO: 219166 - DNA, 20 bp, Artificial Sequence
  Description of Artificial Sequence: Synthetic oligonucleotide
  Target: ATXN1; (-) strand; PAM type: YTN; PAM sequence: TTC
tgtatgaatagtataaacct

SEQ ID NO: 219167 - DNA, 20 bp, Artificial Sequence
  Description of Artificial Sequence: Synthetic oligonucleotide
  Target: ATXN1; (-) strand; PAM type: YTN; PAM sequence: TTT
ctgtatgaatagtataaacc

SEQ ID NO: 219168 - DNA, 20 bp, Artificial Sequence
  Description of Artificial Sequence: Synthetic oligonucleotide
  Target: ATXN1; (-) strand; PAM type: YTN; PAM sequence: TTT
tctgtatgaatagtataaac

SEQ ID NO: 219169 - DNA, 20 bp, Artificial Sequence
  Description of Artificial Sequence: Synthetic oligonucleotide
  Target: ATXN1; (-) strand; PAM type: YTN; PAM sequence: TTT
ttctgtatgaatagtataaa

SEQ ID NO: 219170 - DNA, 20 bp, Artificial Sequence
  Description of Artificial Sequence: Synthetic oligonucleotide
  Target: ATXN1; (-) strand; PAM type: YTN; PAM sequence: TTT
tttctgtatgaatagtataa

SEQ ID NO: 219171 - DNA, 20 bp, Artificial Sequence
  Description of Artificial Sequence: Synthetic oligonucleotide
  Target: ATXN1; (-) strand; PAM type: YTN; PAM sequence: TTT
ttttctgtatgaatagtata

SEQ ID NO: 219172 - DNA, 20 bp, Artificial Sequence
  Description of Artificial Sequence: Synthetic oligonucleotide
  Target: ATXN1; (-) strand; PAM type: YTN; PAM sequence: TTT
tttttctgtatgaatagtat

SEQ ID NO: 219173 - DNA, 20 bp, Artificial Sequence
  Description of Artificial Sequence: Synthetic oligonucleotide
  Target: ATXN1; (-) strand; PAM type: YTN; PAM sequence: TTT
ttttttctgtatgaatagta

SEQ ID NO: 219174 - DNA, 20 bp, Artificial Sequence
  Description of Artificial Sequence: Synthetic oligonucleotide
  Target: ATXN1; (-) strand; PAM type: YTN; PAM sequence: TTT
tttttttctgtatgaatagt

SEQ ID NO: 219175 - DNA, 20 bp, Artificial Sequence
  Description of Artificial Sequence: Synthetic oligonucleotide
  Target: ATXN1; (-) strand; PAM type: YTN; PAM sequence: TTA
ttttttttttctgtatgaat

SEQ ID NO: 219176 - DNA, 20 bp, Artificial Sequence
  Description of Artificial Sequence: Synthetic oligonucleotide
  Target: ATXN1; (-) strand; PAM type: YTN; PAM sequence: CTT
attttttttttctgtatgaa

SEQ ID NO: 219177 - DNA, 20 bp, Artificial Sequence
  Description of Artificial Sequence: Synthetic oligonucleotide
  Target: ATXN1; (-) strand; PAM type: YTN; PAM sequence: TTA
gatgagtccttatttttttt

SEQ ID NO: 219178 - DNA, 20 bp, Artificial Sequence
  Description of Artificial Sequence: Synthetic oligonucleotide
  Target: ATXN1; (-) strand; PAM type: YTN; PAM sequence: CTT
agatgagtccttattttttt

SEQ ID NO: 219179 - DNA, 20 bp, Artificial Sequence
  Description of Artificial Sequence: Synthetic oligonucleotide
  Target: ATXN1; (-) strand; PAM type: YTN; PAM sequence: TTG
tcacttagatgagtccttat

SEQ ID NO: 219180 - DNA, 20 bp, Artificial Sequence
  Description of Artificial Sequence: Synthetic oligonucleotide
  Target: ATXN1; (-) strand; PAM type: YTN; PAM sequence: CTA
cagatataagtaagaatgga

SEQ ID NO: 219181 - DNA, 20 bp, Artificial Sequence
  Description of Artificial Sequence: Synthetic oligonucleotide
  Target: ATXN1; (-) strand; PAM type: YTN; PAM sequence: TTC
acatctacagatataagtaa

SEQ ID NO: 219182 - DNA, 20 bp, Artificial Sequence
  Description of Artificial Sequence: Synthetic oligonucleotide
  Target: ATXN1; (-) strand; PAM type: YTN; PAM sequence: CTT
cacatctacagatataagta

SEQ ID NO: 219183 - DNA, 20 bp, Artificial Sequence
  Description of Artificial Sequence: Synthetic oligonucleotide
  Target: ATXN1; (-) strand; PAM type: YTN; PAM sequence: CTC
cttcacatctacagatataa

SEQ ID NO: 219184 - DNA, 20 bp, Artificial Sequence
  Description of Artificial Sequence: Synthetic oligonucleotide
  Target: ATXN1; (-) strand; PAM type: YTN; PAM sequence: TTC
caactccttcacatctacag

SEQ ID NO: 219185 - DNA, 20 bp, Artificial Sequence
  Description of Artificial Sequence: Synthetic oligonucleotide
  Target: ATXN1; (-) strand; PAM type: YTN; PAM sequence: CTT
ccaactccttcacatctaca

SEQ ID NO: 219186 - DNA, 20 bp, Artificial Sequence
  Description of Artificial Sequence: Synthetic oligonucleotide
  Target: ATXN1; (-) strand; PAM type: YTN; PAM sequence: TTG
tagtatgtgcaaatgaaggt

SEQ ID NO: 219187 - DNA, 20 bp, Artificial Sequence
  Description of Artificial Sequence: Synthetic oligonucleotide
  Target: ATXN1; (-) strand; PAM type: YTN; PAM sequence: CTG
ttgtagtatgtgcaaatgaa

SEQ ID NO: 219188 - DNA, 20 bp, Artificial Sequence
  Description of Artificial Sequence: Synthetic oligonucleotide
  Target: ATXN1; (-) strand; PAM type: YTN; PAM sequence: CTC
atagctgttgtagtatgtgc

SEQ ID NO: 219189 - DNA, 20 bp, Artificial Sequence
  Description of Artificial Sequence: Synthetic oligonucleotide
  Target: ATXN1; (-) strand; PAM type: YTN; PAM sequence: TTG
cctcatagctgttgtagtat

SEQ ID NO: 219190 - DNA, 20 bp, Artificial Sequence
  Description of Artificial Sequence: Synthetic oligonucleotide
  Target: ATXN1; (-) strand; PAM type: YTN; PAM sequence: TTG
ataagagttgcctcatagct

SEQ ID NO: 219191 - DNA, 20 bp, Artificial Sequence
  Description of Artificial Sequence: Synthetic oligonucleotide
  Target: ATXN1; (-) strand; PAM type: YTN; PAM sequence: TTT
gataagagttgcctcatagc

SEQ ID NO: 219192 - DNA, 20 bp, Artificial Sequence
  Description of Artificial Sequence: Synthetic oligonucleotide
  Target: ATXN1; (-) strand; PAM type: YTN; PAM sequence: TTT
tgataagagttgcctcatag

SEQ ID NO: 219193 - DNA, 20 bp, Artificial Sequence
  Description of Artificial Sequence: Synthetic oligonucleotide
  Target: ATXN1; (-) strand; PAM type: YTN; PAM sequence: CTT
ttgataagagttgcctcata

SEQ ID NO: 219194 - DNA, 20 bp, Artificial Sequence
  Description of Artificial Sequence: Synthetic oligonucleotide
  Target: ATXN1; (-) strand; PAM type: YTN; PAM sequence: TTC
ttttgataagagttgcctca

SEQ ID NO: 219195 - DNA, 20 bp, Artificial Sequence
  Description of Artificial Sequence: Synthetic oligonucleotide
  Target: ATXN1; (-) strand; PAM type: YTN; PAM sequence: TTT
cttttgataagagttgcctc

SEQ ID NO: 219196 - DNA, 20 bp, Artificial Sequence
  Description of Artificial Sequence: Synthetic oligonucleotide
  Target: ATXN1; (-) strand; PAM type: YTN; PAM sequence: TTT
tcttttgataagagttgcct

SEQ ID NO: 219197 - DNA, 20 bp, Artificial Sequence
  Description of Artificial Sequence: Synthetic oligonucleotide
  Target: ATXN1; (-) strand; PAM type: YTN; PAM sequence: TTG
ttttcttttgataagagttg

SEQ ID NO: 219198 - DNA, 20 bp, Artificial Sequence
  Description of Artificial Sequence: Synthetic oligonucleotide
  Target: ATXN1; (-) strand; PAM type: YTN; PAM sequence: TTC
agttgttttcttttgataag

SEQ ID NO: 219199 - DNA, 20 bp, Artificial Sequence
  Description of Artificial Sequence: Synthetic oligonucleotide
  Target: ATXN1; (-) strand; PAM type: YTN; PAM sequence: TTT
cagttgttttcttttgataa

SEQ ID NO: 219200 - DNA, 20 bp, Artificial Sequence
  Description of Artificial Sequence: Synthetic oligonucleotide
  Target: ATXN1; (-) strand; PAM type: YTN; PAM sequence: TTT
tcagttgttttcttttgata

SEQ ID NO: 219201 - DNA, 20 bp, Artificial Sequence
  Description of Artificial Sequence: Synthetic oligonucleotide
  Target: ATXN1; (-) strand; PAM type: YTN; PAM sequence: TTA
aaaagaagtgtgtagaattt

SEQ ID NO: 219202 - DNA, 20 bp, Artificial Sequence
  Description of Artificial Sequence: Synthetic oligonucleotide
  Target: ATXN1; (-) strand; PAM type: YTN; PAM sequence: CTT
aaaaagaagtgtgtagaatt

SEQ ID NO: 219203 - DNA, 20 bp, Artificial Sequence
  Description of Artificial Sequence: Synthetic oligonucleotide
  Target: ATXN1; (-) strand; PAM type: YTN; PAM sequence: TTG
cttaaaaagaagtgtgtaga

SEQ ID NO: 219204 - DNA, 20 bp, Artificial Sequence
  Description of Artificial Sequence: Synthetic oligonucleotide
  Target: ATXN1; (-) strand; PAM type: YTN; PAM sequence: TTA
ttgcttaaaaagaagtgtgt

SEQ ID NO: 219205 - DNA, 20 bp, Artificial Sequence
  Description of Artificial Sequence: Synthetic oligonucleotide
  Target: ATXN1; (-) strand; PAM type: YTN; PAM sequence: TTG
aaattattgcttaaaaagaa

SEQ ID NO: 219206 - DNA, 20 bp, Artificial Sequence
  Description of Artificial Sequence: Synthetic oligonucleotide
  Target: ATXN1; (-) strand; PAM type: YTN; PAM sequence: CTG
aaagagggaagcatattgaa

SEQ ID NO: 219207 - DNA, 20 bp, Artificial Sequence
  Description of Artificial Sequence: Synthetic oligonucleotide
  Target: ATXN1; (-) strand; PAM type: YTN; PAM sequence: TTG
ctgaaagagggaagcatatt

SEQ ID NO: 219208 - DNA, 20 bp, Artificial Sequence
  Description of Artificial Sequence: Synthetic oligonucleotide
  Target: ATXN1; (-) strand; PAM type: YTN; PAM sequence: TTT
gctgaaagagggaagcatat

SEQ ID NO: 219209 - DNA, 20 bp, Artificial Sequence
  Description of Artificial Sequence: Synthetic oligonucleotide
  Target: ATXN1; (-) strand; PAM type: YTN; PAM sequence: TTG
ataaagagtttgctgaaaga

SEQ ID NO: 219210 - DNA, 20 bp, Artificial Sequence
  Description of Artificial Sequence: Synthetic oligonucleotide
  Target: ATXN1; (-) strand; PAM type: YTN; PAM sequence: TTA
acggtattgataaagagttt

SEQ ID NO: 219211 - DNA, 20 bp, Artificial Sequence
  Description of Artificial Sequence: Synthetic oligonucleotide
  Target: ATXN1; (-) strand; PAM type: YTN; PAM sequence: TTA
ttaacggtattgataaagag

SEQ ID NO: 219212 - DNA, 20 bp, Artificial Sequence
  Description of Artificial Sequence: Synthetic oligonucleotide
  Target: ATXN1; (-) strand; PAM type: YTN; PAM sequence: TTA
ttattaacggtattgataaa

SEQ ID NO: 219213 - DNA, 20 bp, Artificial Sequence
  Description of Artificial Sequence: Synthetic oligonucleotide
  Target: ATXN1; (-) strand; PAM type: YTN; PAM sequence: TTG
attattattaacggtattga

SEQ ID NO: 219214 - DNA, 20 bp, Artificial Sequence
  Description of Artificial Sequence: Synthetic oligonucleotide
  Target: ATXN1; (-) strand; PAM type: YTN; PAM sequence: TTG
ttgattattattaacggtat

SEQ ID NO: 219215 - DNA, 20 bp, Artificial Sequence
  Description of Artificial Sequence: Synthetic oligonucleotide
  Target: ATXN1; (-) strand; PAM type: YTN; PAM sequence: TTT
gttgattattattaacggta

SEQ ID NO: 219216 - DNA, 20 bp, Artificial Sequence
  Description of Artificial Sequence: Synthetic oligonucleotide
  Target: ATXN1; (-) strand; PAM type: YTN; PAM sequence: TTT
tgttgattattattaacggt

SEQ ID NO: 219217 - DNA, 20 bp, Artificial Sequence
  Description of Artificial Sequence: Synthetic oligonucleotide
  Target: ATXN1; (-) strand; PAM type: YTN; PAM sequence: TTG
ttttgttgattattattaac

SEQ ID NO: 219218 - DNA, 20 bp, Artificial Sequence
  Description of Artificial Sequence: Synthetic oligonucleotide
  Target: ATXN1; (-) strand; PAM type: YTN; PAM sequence: TTT
gttttgttgattattattaa

SEQ ID NO: 219219 - DNA, 20 bp, Artificial Sequence
  Description of Artificial Sequence: Synthetic oligonucleotide
  Target: ATXN1; (-) strand; PAM type: YTN; PAM sequence: TTA
aacccaagccagtttgtttt

SEQ ID NO: 219220 - DNA, 20 bp, Artificial Sequence
  Description of Artificial Sequence: Synthetic oligonucleotide
  Target: ATXN1; (-) strand; PAM type: YTN; PAM sequence: TTC
aaatggtaaacaagaaggga

SEQ ID NO: 219221 - DNA, 20 bp, Artificial Sequence
  Description of Artificial Sequence: Synthetic oligonucleotide
  Target: ATXN1; (-) strand; PAM type: YTN; PAM sequence: CTT
caaatggtaaacaagaaggg

SEQ ID NO: 219222 - DNA, 20 bp, Artificial Sequence
  Description of Artificial Sequence: Synthetic oligonucleotide
  Target: ATXN1; (-) strand; PAM type: YTN; PAM sequence: TTA
tgataacttcaaatggtaaa

SEQ ID NO: 219223 - DNA, 20 bp, Artificial Sequence
  Description of Artificial Sequence: Synthetic oligonucleotide
  Target: ATXN1; (-) strand; PAM type: YTN; PAM sequence: CTT
atgataacttcaaatggtaa

SEQ ID NO: 219224 - DNA, 20 bp, Artificial Sequence
  Description of Artificial Sequence: Synthetic oligonucleotide
  Target: ATXN1; (-) strand; PAM type: YTN; PAM sequence: TTG
cttatgataacttcaaatgg

SEQ ID NO: 219225 - DNA, 20 bp, Artificial Sequence
  Description of Artificial Sequence: Synthetic oligonucleotide
  Target: ATXN1; (-) strand; PAM type: YTN; PAM sequence: TTT
gcttatgataacttcaaatg

SEQ ID NO: 219226 - DNA, 20 bp, Artificial Sequence
  Description of Artificial Sequence: Synthetic oligonucleotide
  Target: ATXN1; (-) strand; PAM type: YTN; PAM sequence: CTT
tgcttatgataacttcaaat

SEQ ID NO: 219227 - DNA, 20 bp, Artificial Sequence
  Description of Artificial Sequence: Synthetic oligonucleotide
  Target: ATXN1; (-) strand; PAM type: YTN; PAM sequence: TTA
tctttgcttatgataacttc

SEQ ID NO: 219228 - DNA, 20 bp, Artificial Sequence
  Description of Artificial Sequence: Synthetic oligonucleotide
  Target: ATXN1; (-) strand; PAM type: YTN; PAM sequence: CTT
atctttgcttatgataactt

SEQ ID NO: 219229 - DNA, 20 bp, Artificial Sequence
  Description of Artificial Sequence: Synthetic oligonucleotide
  Target: ATXN1; (-) strand; PAM type: YTN; PAM sequence: TTG
gccttatctttgcttatgat

SEQ ID NO: 219230 - DNA, 20 bp, Artificial Sequence
  Description of Artificial Sequence: Synthetic oligonucleotide
  Target: ATXN1; (-) strand; PAM type: YTN; PAM sequence: TTT
ggccttatctttgcttatga

SEQ ID NO: 219231 - DNA, 20 bp, Artificial Sequence
  Description of Artificial Sequence: Synthetic oligonucleotide
  Target: ATXN1; (-) strand; PAM type: YTN; PAM sequence: TTT
tggccttatctttgcttatg

SEQ ID NO: 219232 - DNA, 20 bp, Artificial Sequence
  Description of Artificial Sequence: Synthetic oligonucleotide
  Target: ATXN1; (-) strand; PAM type: YTN; PAM sequence: CTT
ttggccttatctttgcttat

SEQ ID NO: 219233 - DNA, 20 bp, Artificial Sequence
  Description of Artificial Sequence: Synthetic oligonucleotide
  Target: ATXN1; (-) strand; PAM type: YTN; PAM sequence: TTG
ggcttttggccttatctttg

SEQ ID NO: 219234 - DNA, 20 bp, Artificial Sequence
  Description of Artificial Sequence: Synthetic oligonucleotide
  Target: ATXN1; (-) strand; PAM type: YTN; PAM sequence: TTT
gggcttttggccttatcttt

SEQ ID NO: 219235 - DNA, 20 bp, Artificial Sequence
  Description of Artificial Sequence: Synthetic oligonucleotide
  Target: ATXN1; (-) strand; PAM type: YTN; PAM sequence: TTT
tgggcttttggccttatctt

SEQ ID NO: 219236 - DNA, 20 bp, Artificial Sequence
  Description of Artificial Sequence: Synthetic oligonucleotide
  Target: ATXN1; (-) strand; PAM type: YTN; PAM sequence: TTT
ttgggcttttggccttatct

SEQ ID NO: 219237 - DNA, 20 bp, Artificial Sequence
  Description of Artificial Sequence: Synthetic oligonucleotide
  Target: ATXN1; (-) strand; PAM type: YTN; PAM sequence: CTT
tttgggcttttggccttatc

SEQ ID NO: 219238 - DNA, 20 bp, Artificial Sequence
  Description of Artificial Sequence: Synthetic oligonucleotide
  Target: ATXN1; (-) strand; PAM type: YTN; PAM sequence: CTG
ctttttgggcttttggcctt

SEQ ID NO: 219239 - DNA, 20 bp, Artificial Sequence
  Description of Artificial Sequence: Synthetic oligonucleotide
  Target: ATXN1; (-) strand; PAM type: YTN; PAM sequence: TTC
tgctttttgggcttttggcc

SEQ ID NO: 219240 - DNA, 20 bp, Artificial Sequence
  Description of Artificial Sequence: Synthetic oligonucleotide
  Target: ATXN1; (-) strand; PAM type: YTN; PAM sequence: CTT
ctgctttttgggcttttggc

SEQ ID NO: 219241 - DNA, 20 bp, Artificial Sequence
  Description of Artificial Sequence: Synthetic oligonucleotide
  Target: ATXN1; (-) strand; PAM type: YTN; PAM sequence: CTC
ttctgctttttgggcttttg

SEQ ID NO: 219242 - DNA, 20 bp, Artificial Sequence
  Description of Artificial Sequence: Synthetic oligonucleotide
  Target: ATXN1; (-) strand; PAM type: YTN; PAM sequence: TTC
tcttctgctttttgggcttt

SEQ ID NO: 219243 - DNA, 20 bp, Artificial Sequence
  Description of Artificial Sequence: Synthetic oligonucleotide
  Target: ATXN1; (-) strand; PAM type: YTN; PAM sequence: TTT
ctcttctgctttttgggctt

SEQ ID NO: 219244 - DNA, 20 bp, Artificial Sequence
  Description of Artificial Sequence: Synthetic oligonucleotide
  Target: ATXN1; (-) strand; PAM type: YTN; PAM sequence: CTT
tctcttctgctttttgggct

SEQ ID NO: 219245 - DNA, 20 bp, Artificial Sequence
  Description of Artificial Sequence: Synthetic oligonucleotide
  Target: ATXN1; (-) strand; PAM type: YTN; PAM sequence: CTG
tgctttctcttctgcttttt

SEQ ID NO: 219246 - DNA, 20 bp, Artificial Sequence
  Description of Artificial Sequence: Synthetic oligonucleotide
  Target: ATXN1; (-) strand; PAM type: YTN; PAM sequence: CTA
ggcccctgtgctttctcttc

SEQ ID NO: 219247 - DNA, 20 bp, Artificial Sequence
  Description of Artificial Sequence: Synthetic oligonucleotide
  Target: ATXN1; (-) strand; PAM type: YTN; PAM sequence: CTG
tgaatgccctaggcccctgt

SEQ ID NO: 219248 - DNA, 20 bp, Artificial Sequence
  Description of Artificial Sequence: Synthetic oligonucleotide
  Target: ATXN1; (-) strand; PAM type: YTN; PAM sequence: TTC
acatatgcaggcatatctgt

SEQ ID NO: 219249 - DNA, 20 bp, Artificial Sequence
  Description of Artificial Sequence: Synthetic oligonucleotide
  Target: ATXN1; (-) strand; PAM type: YTN; PAM sequence: TTT
cacatatgcaggcatatctg

SEQ ID NO: 219250 - DNA, 20 bp, Artificial Sequence
  Description of Artificial Sequence: Synthetic oligonucleotide
  Target: ATXN1; (-) strand; PAM type: YTN; PAM sequence: CTT
tcacatatgcaggcatatct

SEQ ID NO: 219251 - DNA, 20 bp, Artificial Sequence
  Description of Artificial Sequence: Synthetic oligonucleotide
  Target: ATXN1; (-) strand; PAM type: YTN; PAM sequence: TTA
aaatatagccaactttcaca

SEQ ID NO: 219252 - DNA, 20 bp, Artificial Sequence
  Description of Artificial Sequence: Synthetic oligonucleotide
  Target: ATXN1; (-) strand; PAM type: YTN; PAM sequence: TTT
aaaatatagccaactttcac

SEQ ID NO: 219253 - DNA, 20 bp, Artificial Sequence
  Description of Artificial Sequence: Synthetic oligonucleotide
  Target: ATXN1; (-) strand; PAM type: YTN; PAM sequence: TTT
taaaatatagccaactttca

SEQ ID NO: 219254 - DNA, 20 bp, Artificial Sequence
  Description of Artificial Sequence: Synthetic oligonucleotide
  Target: ATXN1; (-) strand; PAM type: YTN; PAM sequence: TTT
ttaaaatatagccaactttc

SEQ ID NO: 219255 - DNA, 20 bp, Artificial Sequence
  Description of Artificial Sequence: Synthetic oligonucleotide
  Target: ATXN1; (-) strand; PAM type: YTN; PAM sequence: CTT
tttaaaatatagccaacttt

SEQ ID NO: 219256 - DNA, 20 bp, Artificial Sequence
  Description of Artificial Sequence: Synthetic oligonucleotide
  Target: ATXN1; (-) strand; PAM type: YTN; PAM sequence: CTG
gagtgagatcctttttaaaa

SEQ ID NO: 219257 - DNA, 20 bp, Artificial Sequence
  Description of Artificial Sequence: Synthetic oligonucleotide
  Target: ATXN1; (-) strand; PAM type: YTN; PAM sequence: CTC
tggagtgagatcctttttaa

SEQ ID NO: 219258 - DNA, 20 bp, Artificial Sequence
  Description of Artificial Sequence: Synthetic oligonucleotide
  Target: ATXN1; (-) strand; PAM type: YTN; PAM sequence: TTG
gaaaaccctctggagtgaga

SEQ ID NO: 219259 - DNA, 20 bp, Artificial Sequence
  Description of Artificial Sequence: Synthetic oligonucleotide
  Target: ATXN1; (-) strand; PAM type: YTN; PAM sequence: CTA
tcaaattggaaaaccctctg

SEQ ID NO: 219260 - DNA, 20 bp, Artificial Sequence
  Description of Artificial Sequence: Synthetic oligonucleotide
  Target: ATXN1; (-) strand; PAM type: YTN; PAM sequence: TTC
accaaaatgtctatcaaatt

SEQ ID NO: 219261 - DNA, 20 bp, Artificial Sequence
  Description of Artificial Sequence: Synthetic oligonucleotide
  Target: ATXN1; (-) strand; PAM type: YTN; PAM sequence: TTT
caccaaaatgtctatcaaat

SEQ ID NO: 219262 - DNA, 20 bp, Artificial Sequence
  Description of Artificial Sequence: Synthetic oligonucleotide
  Target: ATXN1; (-) strand; PAM type: YTN; PAM sequence: TTT
tcaccaaaatgtctatcaaa

SEQ ID NO: 219263 - DNA, 20 bp, Artificial Sequence
  Description of Artificial Sequence: Synthetic oligonucleotide
  Target: ATXN1; (-) strand; PAM type: YTN; PAM sequence: TTC
agaaaattttcaccaaaatg

SEQ ID NO: 219264 - DNA, 20 bp, Artificial Sequence
  Description of Artificial Sequence: Synthetic oligonucleotide
  Target: ATXN1; (-) strand; PAM type: YTN; PAM sequence: CTG
ttcagaaaattttcaccaaa

SEQ ID NO: 219265 - DNA, 20 bp, Artificial Sequence
  Description of Artificial Sequence: Synthetic oligonucleotide
  Target: ATXN1; (-) strand; PAM type: YTN; PAM sequence: TTA
taactgttcagaaaattttc

SEQ ID NO: 219266 - DNA, 20 bp, Artificial Sequence
  Description of Artificial Sequence: Synthetic oligonucleotide
  Target: ATXN1; (-) strand; PAM type: YTN; PAM sequence: CTT
ataactgttcagaaaatttt

SEQ ID NO: 219267 - DNA, 20 bp, Artificial Sequence
  Description of Artificial Sequence: Synthetic oligonucleotide
  Target: ATXN1; (-) strand; PAM type: YTN; PAM sequence: TTG
cttataactgttcagaaaat

SEQ ID NO: 219268 - DNA, 20 bp, Artificial Sequence
  Description of Artificial Sequence: Synthetic oligonucleotide
  Target: ATXN1; (-) strand; PAM type: YTN; PAM sequence: CTG
ttgcttataactgttcagaa

SEQ ID NO: 219269 - DNA, 20 bp, Artificial Sequence
  Description of Artificial Sequence: Synthetic oligonucleotide
  Target: ATXN1; (-) strand; PAM type: YTN; PAM sequence: CTG
ctgttgcttataactgttca

SEQ ID NO: 219270 - DNA, 20 bp, Artificial Sequence
  Description of Artificial Sequence: Synthetic oligonucleotide
  Target: ATXN1; (-) strand; PAM type: YTN; PAM sequence: CTG
ctgctgttgcttataactgt

SEQ ID NO: 219271 - DNA, 20 bp, Artificial Sequence
  Description of Artificial Sequence: Synthetic oligonucleotide
  Target: ATXN1; (-) strand; PAM type: YTN; PAM sequence: CTG
ctgctgctgttgcttataac

SEQ ID NO: 219272 - DNA, 20 bp, Artificial Sequence
  Description of Artificial Sequence: Synthetic oligonucleotide
  Target: ATXN1; (-) strand; PAM type: YTN; PAM sequence: TTG
ctgctgctgctgttgcttat

SEQ ID NO: 219273 - DNA, 20 bp, Artificial Sequence
  Description of Artificial Sequence: Synthetic oligonucleotide
  Target: ATXN1; (-) strand; PAM type: YTN; PAM sequence: TTT
gctgctgctgctgttgctta

SEQ ID NO: 219274 - DNA, 20 bp, Artificial Sequence
  Description of Artificial Sequence: Synthetic oligonucleotide
  Target: ATXN1; (-) strand; PAM type: YTN; PAM sequence: CTT
tgctgctgctgctgttgctt

SEQ ID NO: 219275 - DNA, 20 bp, Artificial Sequence
  Description of Artificial Sequence: Synthetic oligonucleotide
  Target: ATXN1; (-) strand; PAM type: YTN; PAM sequence: TTG
atatcccatactttgctgct

SEQ ID NO: 219276 - DNA, 20 bp, Artificial Sequence
  Description of Artificial Sequence: Synthetic oligonucleotide
  Target: ATXN1; (-) strand; PAM type: YTN; PAM sequence: TTG
ttgatatcccatactttgct

SEQ ID NO: 219277 - DNA, 20 bp, Artificial Sequence
  Description of Artificial Sequence: Synthetic oligonucleotide
  Target: ATXN1; (-) strand; PAM type: YTN; PAM sequence: TTA
taggttgttgatatcccata

SEQ ID NO: 219278 - DNA, 20 bp, Artificial Sequence
  Description of Artificial Sequence: Synthetic oligonucleotide
  Target: ATXN1; (-) strand; PAM type: YTN; PAM sequence: TTT
ataggttgttgatatcccat

SEQ ID NO: 219279 - DNA, 20 bp, Artificial Sequence
  Description of Artificial Sequence: Synthetic oligonucleotide
  Target: ATXN1; (-) strand; PAM type: YTN; PAM sequence: CTG
tttataggttgttgatatcc

SEQ ID NO: 219280 - DNA, 20 bp, Artificial Sequence
  Description of Artificial Sequence: Synthetic oligonucleotide
  Target: ATXN1; (-) strand; PAM type: YTN; PAM sequence: CTC
ccaggtcactgtttataggt

SEQ ID NO: 219281 - DNA, 20 bp, Artificial Sequence
  Description of Artificial Sequence: Synthetic oligonucleotide
  Target: ATXN1; (-) strand; PAM type: YTN; PAM sequence: TTC
atgactcccaggtcactgtt

SEQ ID NO: 219282 - DNA, 20 bp, Artificial Sequence
  Description of Artificial Sequence: Synthetic oligonucleotide
  Target: ATXN1; (-) strand; PAM type: YTN; PAM sequence: TTT
catgactcccaggtcactgt

SEQ ID NO: 219283 - DNA, 20 bp, Artificial Sequence
  Description of Artificial Sequence: Synthetic oligonucleotide
  Target: ATXN1; (-) strand; PAM type: YTN; PAM sequence: CTA
aaaagtatatttcatgactc

SEQ ID NO: 219284 - DNA, 20 bp, Artificial Sequence
  Description of Artificial Sequence: Synthetic oligonucleotide
  Target: ATXN1; (-) strand; PAM type: YTN; PAM sequence: TTA
agactaaaaagtatatttca

SEQ ID NO: 219285 - DNA, 20 bp, Artificial Sequence
  Description of Artificial Sequence: Synthetic oligonucleotide
  Target: ATXN1; (-) strand; PAM type: YTN; PAM sequence: CTA
caacattaagactaaaaagt

SEQ ID NO: 219286 - DNA, 20 bp, Artificial Sequence
  Description of Artificial Sequence: Synthetic oligonucleotide
  Target: ATXN1; (-) strand; PAM type: YTN; PAM sequence: TTA
gctacaacattaagactaaa

SEQ ID NO: 219287 - DNA, 20 bp, Artificial Sequence
  Description of Artificial Sequence: Synthetic oligonucleotide
  Target: ATXN1; (-) strand; PAM type: YTN; PAM sequence: TTA
aaagtccaattagctacaac

SEQ ID NO: 219288 - DNA, 20 bp, Artificial Sequence
  Description of Artificial Sequence: Synthetic oligonucleotide
  Target: ATXN1; (-) strand; PAM type: YTN; PAM sequence: TTT
aaaagtccaattagctacaa

SEQ ID NO: 219289 - DNA, 20 bp, Artificial Sequence
  Description of Artificial Sequence: Synthetic oligonucleotide
  Target: ATXN1; (-) strand; PAM type: YTN; PAM sequence: TTA
catttaaaagtccaattagc

SEQ ID NO: 219290 - DNA, 20 bp, Artificial Sequence
  Description of Artificial Sequence: Synthetic oligonucleotide
  Target: ATXN1; (-) strand; PAM type: YTN; PAM sequence: CTT
acatttaaaagtccaattag

SEQ ID NO: 219291 - DNA, 20 bp, Artificial Sequence
  Description of Artificial Sequence: Synthetic oligonucleotide
  Target: ATXN1; (-) strand; PAM type: YTN; PAM sequence: TTA
aaaggccgtgacttacattt

SEQ ID NO: 219292 - DNA, 20 bp, Artificial Sequence
  Description of Artificial Sequence: Synthetic oligonucleotide
  Target: ATXN1; (-) strand; PAM type: YTN; PAM sequence: TTT
aaaaggccgtgacttacatt

SEQ ID NO: 219293 - DNA, 20 bp, Artificial Sequence
  Description of Artificial Sequence: Synthetic oligonucleotide
  Target: ATXN1; (-) strand; PAM type: YTN; PAM sequence: TTA
tttaaaaggccgtgacttac

SEQ ID NO: 219294 - DNA, 20 bp, Artificial Sequence
  Description of Artificial Sequence: Synthetic oligonucleotide
  Target: ATXN1; (-) strand; PAM type: YTN; PAM sequence: TTT
atttaaaaggccgtgactta

SEQ ID NO: 219295 - DNA, 20 bp, Artificial Sequence
  Description of Artificial Sequence: Synthetic oligonucleotide
  Target: ATXN1; (-) strand; PAM type: YTN; PAM sequence: TTT
tatttaaaaggccgtgactt

SEQ ID NO: 219296 - DNA, 20 bp, Artificial Sequence
  Description of Artificial Sequence: Synthetic oligonucleotide
  Target: ATXN1; (-) strand; PAM type: YTN; PAM sequence: CTA
attttatttaaaaggccgtg

SEQ ID NO: 219297 - DNA, 20 bp, Artificial Sequence
  Description of Artificial Sequence: Synthetic oligonucleotide
  Target: ATXN1; (-) strand; PAM type: YTN; PAM sequence: TTA
ggaactaattttatttaaaa

SEQ ID NO: 219298 - DNA, 20 bp, Artificial Sequence
  Description of Artificial Sequence: Synthetic oligonucleotide
  Target: ATXN1; (-) strand; PAM type: YTN; PAM sequence: TTG
atagattaggaactaatttt

SEQ ID NO: 219299 - DNA, 20 bp, Artificial Sequence
  Description of Artificial Sequence: Synthetic oligonucleotide
  Target: ATXN1; (-) strand; PAM type: YTN; PAM sequence: TTT
gatagattaggaactaattt

SEQ ID NO: 219300 - DNA, 20 bp, Artificial Sequence
  Description of Artificial Sequence: Synthetic oligonucleotide
  Target: ATXN1; (-) strand; PAM type: YTN; PAM sequence: TTA
tttgatagattaggaactaa

SEQ ID NO: 219301 - DNA, 20 bp, Artificial Sequence
  Description of Artificial Sequence: Synthetic oligonucleotide
  Target: ATXN1; (-) strand; PAM type: YTN; PAM sequence: TTT
atttgatagattaggaacta

SEQ ID NO: 219302 - DNA, 20 bp, Artificial Sequence
  Description of Artificial Sequence: Synthetic oligonucleotide
  Target: ATXN1; (-) strand; PAM type: YTN; PAM sequence: CTT
tatttgatagattaggaact

SEQ ID NO: 219303 - DNA, 20 bp, Artificial Sequence
  Description of Artificial Sequence: Synthetic oligonucleotide
  Target: ATXN1; (-) strand; PAM type: YTN; PAM sequence: TTC
ctttatttgatagattagga

SEQ ID NO: 219304 - DNA, 20 bp, Artificial Sequence
  Description of Artificial Sequence: Synthetic oligonucleotide
  Target: ATXN1; (-) strand; PAM type: YTN; PAM sequence: TTA
ataagttcctttatttgata

SEQ ID NO: 219305 - DNA, 20 bp, Artificial Sequence
  Description of Artificial Sequence: Synthetic oligonucleotide
  Target: ATXN1; (-) strand; PAM type: YTN; PAM sequence: TTT
aataagttcctttatttgat

SEQ ID NO: 219306 - DNA, 20 bp, Artificial Sequence
  Description of Artificial Sequence: Synthetic oligonucleotide
  Target: ATXN1; (-) strand; PAM type: YTN; PAM sequence: TTA
tggcaaacatttaataagtt

SEQ ID NO: 219307 - DNA, 20 bp, Artificial Sequence
  Description of Artificial Sequence: Synthetic oligonucleotide
  Target: ATXN1; (-) strand; PAM type: YTN; PAM sequence: TTA
attatggcaaacatttaata

SEQ ID NO: 219308 - DNA, 20 bp, Artificial Sequence
  Description of Artificial Sequence: Synthetic oligonucleotide
  Target: ATXN1; (-) strand; PAM type: YTN; PAM sequence: TTG
agaattaattatggcaaaca

SEQ ID NO: 219309 - DNA, 20 bp, Artificial Sequence
  Description of Artificial Sequence: Synthetic oligonucleotide
  Target: ATXN1; (-) strand; PAM type: YTN; PAM sequence: TTA
taattgagaattaattatgg

SEQ ID NO: 219310 - DNA, 20 bp, Artificial Sequence
  Description of Artificial Sequence: Synthetic oligonucleotide
  Target: ATXN1; (-) strand; PAM type: YTN; PAM sequence: TTC
aaatacatgtaaaaacaaat

SEQ ID NO: 219311 - DNA, 20 bp, Artificial Sequence
  Description of Artificial Sequence: Synthetic oligonucleotide
  Target: ATXN1; (-) strand; PAM type: YTN; PAM sequence: TTG
aaacattcaaatacatgtaa

SEQ ID NO: 219312 - DNA, 20 bp, Artificial Sequence
  Description of Artificial Sequence: Synthetic oligonucleotide
  Target: ATXN1; (-) strand; PAM type: YTN; PAM sequence: TTT
gaaacattcaaatacatgta

SEQ ID NO: 219313 - DNA, 20 bp, Artificial Sequence
  Description of Artificial Sequence: Synthetic oligonucleotide
  Target: ATXN1; (-) strand; PAM type: YTN; PAM sequence: TTG
atttgaaacattcaaataca

SEQ ID NO: 219314 - DNA, 20 bp, Artificial Sequence
  Description of Artificial Sequence: Synthetic oligonucleotide
  Target: ATXN1; (-) strand; PAM type: YTN; PAM sequence: TTT
gatttgaaacattcaaatac

SEQ ID NO: 219315 - DNA, 20 bp, Artificial Sequence
  Description of Artificial Sequence: Synthetic oligonucleotide
  Target: ATXN1; (-) strand; PAM type: YTN; PAM sequence: TTA
tttgatttgaaacattcaaa

SEQ ID NO: 219316 - DNA, 20 bp, Artificial Sequence
  Description of Artificial Sequence: Synthetic oligonucleotide
  Target: ATXN1; (-) strand; PAM type: YTN; PAM sequence: TTT
atttgatttgaaacattcaa

SEQ ID NO: 219317 - DNA, 20 bp, Artificial Sequence
  Description of Artificial Sequence: Synthetic oligonucleotide
  Target: ATXN1; (-) strand; PAM type: YTN; PAM sequence: TTT
tatttgatttgaaacattca

SEQ ID NO: 219318 - DNA, 20 bp, Artificial Sequence
  Description of Artificial Sequence: Synthetic oligonucleotide
  Target: ATXN1; (-) strand; PAM type: YTN; PAM sequence: TTA
tgattttatttgatttgaaa

SEQ ID NO: 219319 - DNA, 20 bp, Artificial Sequence
  Description of Artificial Sequence: Synthetic oligonucleotide
  Target: ATXN1; (-) strand; PAM type: YTN; PAM sequence: TTG
ttatgattttatttgatttg

SEQ ID NO: 219320 - DNA, 20 bp, Artificial Sequence
  Description of Artificial Sequence: Synthetic oligonucleotide
  Target: ATXN1; (-) strand; PAM type: YTN; PAM sequence: TTT
gttatgattttatttgattt

SEQ ID NO: 219321 - DNA, 20 bp, Artificial Sequence
  Description of Artificial Sequence: Synthetic oligonucleotide
  Target: ATXN1; (-) strand; PAM type: YTN; PAM sequence: TTG
tgtttgttatgattttattt

SEQ ID NO: 219322 - DNA, 20 bp, Artificial Sequence
  Description of Artificial Sequence: Synthetic oligonucleotide
  Target: ATXN1; (-) strand; PAM type: YTN; PAM sequence: CTA
gtaaatcatataagatagtt

SEQ ID NO: 219323 - DNA, 20 bp, Artificial Sequence
  Description of Artificial Sequence: Synthetic oligonucleotide
  Target: ATXN1; (-) strand; PAM type: YTN; PAM sequence: TTA
gtgggtctagtaaatcatat

SEQ ID NO: 219324 - DNA, 20 bp, Artificial Sequence
  Description of Artificial Sequence: Synthetic oligonucleotide
  Target: ATXN1; (-) strand; PAM type: YTN; PAM sequence: CTT
agtgggtctagtaaatcata

SEQ ID NO: 219325 - DNA, 20 bp, Artificial Sequence
  Description of Artificial Sequence: Synthetic oligonucleotide
  Target: ATXN1; (-) strand; PAM type: YTN; PAM sequence: TTG
aataaagatatacttagtgg

SEQ ID NO: 219326 - DNA, 20 bp, Artificial Sequence
  Description of Artificial Sequence: Synthetic oligonucleotide
  Target: ATXN1; (-) strand; PAM type: YTN; PAM sequence: TTT
gaataaagatatacttagtg

SEQ ID NO: 219327 - DNA, 20 bp, Artificial Sequence
  Description of Artificial Sequence: Synthetic oligonucleotide
  Target: ATXN1; (-) strand; PAM type: YTN; PAM sequence: TTT
tgaataaagatatacttagt

SEQ ID NO: 219328 - DNA, 20 bp, Artificial Sequence
  Description of Artificial Sequence: Synthetic oligonucleotide
  Target: ATXN1; (-) strand; PAM type: YTN; PAM sequence: TTT
ttgaataaagatatacttag

SEQ ID NO: 219329 - DNA, 20 bp, Artificial Sequence
  Description of Artificial Sequence: Synthetic oligonucleotide
  Target: ATXN1; (-) strand; PAM type: YTN; PAM sequence: TTG
catttttgaataaagatata

SEQ ID NO: 219330 - DNA, 20 bp, Artificial Sequence
  Description of Artificial Sequence: Synthetic oligonucleotide
  Target: ATXN1; (-) strand; PAM type: YTN; PAM sequence: TTG
ttgcatttttgaataaagat

SEQ ID NO: 219331 - DNA, 20 bp, Artificial Sequence
  Description of Artificial Sequence: Synthetic oligonucleotide
  Target: ATXN1; (-) strand; PAM type: YTN; PAM sequence: CTA
attgttgcatttttgaataa

SEQ ID NO: 219332 - DNA, 20 bp, Artificial Sequence
  Description of Artificial Sequence: Synthetic oligonucleotide
  Target: ATXN1; (-) strand; PAM type: YTN; PAM sequence: CTG
tgtctaattgttgcattttt

SEQ ID NO: 219333 - DNA, 20 bp, Artificial Sequence
  Description of Artificial Sequence: Synthetic oligonucleotide
  Target: ATXN1; (-) strand; PAM type: YTN; PAM sequence: TTA
tgcaatctgtgtctaattgt

SEQ ID NO: 219334 - DNA, 20 bp, Artificial Sequence
  Description of Artificial Sequence: Synthetic oligonucleotide
  Target: ATXN1; (-) strand; PAM type: YTN; PAM sequence: TTA
ttatgcaatctgtgtctaat

SEQ ID NO: 219335 - DNA, 20 bp, Artificial Sequence
  Description of Artificial Sequence: Synthetic oligonucleotide
  Target: ATXN1; (-) strand; PAM type: YTN; PAM sequence: CTT
attatgcaatctgtgtctaa

SEQ ID NO: 219336 - DNA, 20 bp, Artificial Sequence
  Description of Artificial Sequence: Synthetic oligonucleotide
  Target: ATXN1; (-) strand; PAM type: YTN; PAM sequence: CTC
ttattatgcaatctgtgtct

SEQ ID NO: 219337 - DNA, 20 bp, Artificial Sequence
  Description of Artificial Sequence: Synthetic oligonucleotide
  Target: ATXN1; (-) strand; PAM type: YTN; PAM sequence: TTG
tctcttattatgcaatctgt

SEQ ID NO: 219338 - DNA, 20 bp, Artificial Sequence
  Description of Artificial Sequence: Synthetic oligonucleotide
  Target: ATXN1; (-) strand; PAM type: YTN; PAM sequence: TTT
gtctcttattatgcaatctg

SEQ ID NO: 219339 - DNA, 20 bp, Artificial Sequence
  Description of Artificial Sequence: Synthetic oligonucleotide
  Target: ATXN1; (-) strand; PAM type: YTN; PAM sequence: CTG
tttgtctcttattatgcaat

SEQ ID NO: 219340 - DNA, 20 bp, Artificial Sequence
  Description of Artificial Sequence: Synthetic oligonucleotide
  Target: ATXN1; (-) strand; PAM type: YTN; PAM sequence: CTG
agaacctgtttgtctcttat

SEQ ID NO: 219341 - DNA, 20 bp, Artificial Sequence
  Description of Artificial Sequence: Synthetic oligonucleotide
  Target: ATXN1; (-) strand; PAM type: YTN; PAM sequence: CTA
ctgagaacctgtttgtctct

SEQ ID NO: 219342 - DNA, 20 bp, Artificial Sequence
  Description of Artificial Sequence: Synthetic oligonucleotide
  Target: ATXN1; (-) strand; PAM type: YTN; PAM sequence: TTC
tactgagaacctgtttgtct

SEQ ID NO: 219343 - DNA, 20 bp, Artificial Sequence
  Description of Artificial Sequence: Synthetic oligonucleotide
  Target: ATXN1; (-) strand; PAM type: YTN; PAM sequence: TTG
atattctactgagaacctgt

SEQ ID NO: 219344 - DNA, 20 bp, Artificial Sequence
  Description of Artificial Sequence: Synthetic oligonucleotide
  Target: ATXN1; (-) strand; PAM type: YTN; PAM sequence: CTG
agttgatattctactgagaa

SEQ ID NO: 219345 - DNA, 20 bp, Artificial Sequence
  Description of Artificial Sequence: Synthetic oligonucleotide
  Target: ATXN1; (-) strand; PAM type: YTN; PAM sequence: TTC
cctgagttgatattctactg

SEQ ID NO: 219346 - DNA, 20 bp, Artificial Sequence
  Description of Artificial Sequence: Synthetic oligonucleotide
  Target: ATXN1; (-) strand; PAM type: YTN; PAM sequence: TTT
ccctgagttgatattctact

SEQ ID NO: 219347 - DNA, 20 bp, Artificial Sequence
  Description of Artificial Sequence: Synthetic oligonucleotide
  Target: ATXN1; (-) strand; PAM type: YTN; PAM sequence: TTT
tccctgagttgatattctac

SEQ ID NO: 219348 - DNA, 20 bp, Artificial Sequence
  Description of Artificial Sequence: Synthetic oligonucleotide
  Target: ATXN1; (-) strand; PAM type: YTN; PAM sequence: TTT
ttccctgagttgatattcta

SEQ ID NO: 219349 - DNA, 20 bp, Artificial Sequence
  Description of Artificial Sequence: Synthetic oligonucleotide
  Target: ATXN1; (-) strand; PAM type: YTN; PAM sequence: TTT
tttccctgagttgatattct

SEQ ID NO: 219350 - DNA, 20 bp, Artificial Sequence
  Description of Artificial Sequence: Synthetic oligonucleotide
  Target: ATXN1; (-) strand; PAM type: YTN; PAM sequence: CTT
ttttccctgagttgatattc

SEQ ID NO: 219351 - DNA, 20 bp, Artificial Sequence
  Description of Artificial Sequence: Synthetic oligonucleotide
  Target: ATXN1; (-) strand; PAM type: YTN; PAM sequence: CTC
ttttttccctgagttgatat

SEQ ID NO: 219352 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaaaaaa

SEQ ID NO: 219353 - DNA, 20 bp, Artificial Sequence
  Description of Artificial Sequence: Synthetic oligonucleotide
  Target: ATXN1; (-) strand; PAM type: YTN; PAM sequence: CTG
tctcaaaaaaaaaaaaaaaa

SEQ ID NO: 219354 - DNA, 20 bp, Artificial Sequence
  Description of Artificial Sequence: Synthetic oligonucleotide
  Target: ATXN1; (-) strand; PAM type: YTN; PAM sequence: CTC
tgtctcaaaaaaaaaaaaaa

SEQ ID NO: 219355 - DNA, 20 bp, Artificial Sequence
  Description of Artificial Sequence: Synthetic oligonucleotide
  Target: ATXN1; (-) strand; PAM type: YTN; PAM sequence: CTG
ggtgaaagagcaaaactctg

SEQ ID NO: 219356 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgaaagagcaa

SEQ ID NO: 219357 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggtgaaag

SEQ ID NO: 219358 - DNA, 20 bp, Artificial Sequence
  Description of Artificial Sequence: Synthetic oligonucleotide
  Target: ATXN1; (-) strand; PAM type: YTN; PAM sequence: CTC
cactgcactccagcctgggt

SEQ ID NO: 219359 - DNA, 20 bp, Artificial Sequence
  Description of Artificial Sequence: Synthetic oligonucleotide
  Target: ATXN1; (-) strand; PAM type: YTN; PAM sequence: CTG
agatcactccactgcactcc

SEQ ID NO: 219360 - DNA, 20 bp, Artificial Sequence
  Description of Artificial Sequence: Synthetic oligonucleotide
  Target: ATXN1; (-) strand; PAM type: YTN; PAM sequence: TTG
cagtgagctgagatcactcc

SEQ ID NO: 219361 - DNA, 20 bp, Artificial Sequence
  Description of Artificial Sequence: Synthetic oligonucleotide
  Target: ATXN1; (-) strand; PAM type: YTN; PAM sequence: TTG
aaaccagaaggcagaggttg

SEQ ID NO: 219362 - DNA, 20 bp, Artificial Sequence
  Description of Artificial Sequence: Synthetic oligonucleotide
  Target: ATXN1; (-) strand; PAM type: YTN; PAM sequence: CTT
gaaaccagaaggcagaggtt

SEQ ID NO: 219363 - DNA, 20 bp, Artificial Sequence
  Description of Artificial Sequence: Synthetic oligonucleotide
  Target: ATXN1; (-) strand; PAM type: YTN; PAM sequence: TTG
cttgaaaccagaaggcagag

SEQ ID NO: 219364 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaattgcttgaa

SEQ ID NO: 219365 - DNA, 20 bp, Artificial Sequence
  Description of Artificial Sequence: Synthetic oligonucleotide
  Target: ATXN1; (-) strand; PAM type: YTN; PAM sequence: TTG
ggagcctgaggcaggagaat

SEQ ID NO: 219366 - DNA, 20 bp, Artificial Sequence
  Description of Artificial Sequence: Synthetic oligonucleotide
  Target: ATXN1; (-) strand; PAM type: YTN; PAM sequence: CTT
gggagcctgaggcaggagaa

SEQ ID NO: 219367 - DNA, 20 bp, Artificial Sequence
  Description of Artificial Sequence: Synthetic oligonucleotide
  Target: ATXN1; (-) strand; PAM type: YTN; PAM sequence: CTA
cttgggagcctgaggcagga

SEQ ID NO: 219368 - DNA, 20 bp, Artificial Sequence
  Description of Artificial Sequence: Synthetic oligonucleotide
  Target: ATXN1; (-) strand; PAM type: YTN; PAM sequence: CTA
gctacttgggagcctgaggc

SEQ ID NO: 219369 - DNA, 20 bp, Artificial Sequence
  Description of Artificial Sequence: Synthetic oligonucleotide
  Target: ATXN1; (-) strand; PAM type: YTN; PAM sequence: CTA
tgatcctagctacttgggag

SEQ ID NO: 219370 - DNA, 20 bp, Artificial Sequence
  Description of Artificial Sequence: Synthetic oligonucleotide
  Target: ATXN1; (-) strand; PAM type: YTN; PAM sequence: CTG
ggtgtggtggtgggcaccta

SEQ ID NO: 219371 - DNA, 20 bp, Artificial Sequence
  Description of Artificial Sequence: Synthetic oligonucleotide
  Target: ATXN1; (-) strand; PAM type: YTN; PAM sequence: TTA
gctgggtgtggtggtgggca

SEQ ID NO: 219372 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagctgg

SEQ ID NO: 219373 - DNA, 20 bp, Artificial Sequence
  Description of Artificial Sequence: Synthetic oligonucleotide
  Target: ATXN1; (-) strand; PAM type: YTN; PAM sequence: CTC
cactaaaaatacaaaaatta

SEQ ID NO: 219374 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaatcccg

SEQ ID NO: 219375 - DNA, 20 bp, Artificial Sequence
  Description of Artificial Sequence: Synthetic oligonucleotide
  Target: ATXN1; (-) strand; PAM type: YTN; PAM sequence: TTC
aagaccagcctggccaacat

SEQ ID NO: 219376 - DNA, 20 bp, Artificial Sequence
  Description of Artificial Sequence: Synthetic oligonucleotide
  Target: ATXN1; (-) strand; PAM type: YTN; PAM sequence: TTG
ggaggtcaaagcgggtgaat

SEQ ID NO: 219377 - DNA, 20 bp, Artificial Sequence
  Description of Artificial Sequence: Synthetic oligonucleotide
  Target: ATXN1; (-) strand; PAM type: YTN; PAM sequence: TTT
gggaggtcaaagcgggtgaa

SEQ ID NO: 219378 - DNA, 20 bp, Artificial Sequence
  Description of Artificial Sequence: Synthetic oligonucleotide
  Target: ATXN1; (-) strand; PAM type: YTN; PAM sequence: CTT
tgggaggtcaaagcgggtga

SEQ ID NO: 219379 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 219380 - DNA, 20 bp, Artificial Sequence
  Description of Artificial Sequence: Synthetic oligonucleotide
  Target: ATXN1; (-) strand; PAM type: YTN; PAM sequence: CTC
acatctgtaatcccagcact

SEQ ID NO: 219381 - DNA, 20 bp, Artificial Sequence
  Description of Artificial Sequence: Synthetic oligonucleotide
  Target: ATXN1; (-) strand; PAM type: YTN; PAM sequence: CTG
ggccaggtgcggtggctcac

SEQ ID NO: 219382 - DNA, 20 bp, Artificial Sequence
  Description of Artificial Sequence: Synthetic oligonucleotide
  Target: ATXN1; (-) strand; PAM type: YTN; PAM sequence: TTC
ctgggccaggtgcggtggct

SEQ ID NO: 219383 - DNA, 20 bp, Artificial Sequence
  Description of Artificial Sequence: Synthetic oligonucleotide
  Target: ATXN1; (-) strand; PAM type: YTN; PAM sequence: TTT
cctgggccaggtgcggtggc

SEQ ID NO: 219384 - DNA, 20 bp, Artificial Sequence
  Description of Artificial Sequence: Synthetic oligonucleotide
  Target: ATXN1; (-) strand; PAM type: YTN; PAM sequence: TTT
tcctgggccaggtgcggtgg

SEQ ID NO: 219385 - DNA, 20 bp, Artificial Sequence
  Description of Artificial Sequence: Synthetic oligonucleotide
  Target: ATXN1; (-) strand; PAM type: YTN; PAM sequence: CTT
ttcctgggccaggtgcggtg

SEQ ID NO: 219386 - DNA, 20 bp, Artificial Sequence
  Description of Artificial Sequence: Synthetic oligonucleotide
  Target: ATXN1; (-) strand; PAM type: YTN; PAM sequence: TTA
caatacccttttcctgggcc

SEQ ID NO: 219387 - DNA, 20 bp, Artificial Sequence
  Description of Artificial Sequence: Synthetic oligonucleotide
  Target: ATXN1; (-) strand; PAM type: YTN; PAM sequence: TTG
attacaatacccttttcctg

SEQ ID NO: 219388 - DNA, 20 bp, Artificial Sequence
  Description of Artificial Sequence: Synthetic oligonucleotide
  Target: ATXN1; (-) strand; PAM type: YTN; PAM sequence: TTA
ttgattacaatacccttttc

SEQ ID NO: 219389 - DNA, 20 bp, Artificial Sequence
  Description of Artificial Sequence: Synthetic oligonucleotide
  Target: ATXN1; (-) strand; PAM type: YTN; PAM sequence: TTT
attgattacaataccctttt

SEQ ID NO: 219390 - DNA, 20 bp, Artificial Sequence
  Description of Artificial Sequence: Synthetic oligonucleotide
  Target: ATXN1; (-) strand; PAM type: YTN; PAM sequence: CTA
tttattgattacaataccct

SEQ ID NO: 219391 - DNA, 20 bp, Artificial Sequence
  Description of Artificial Sequence: Synthetic oligonucleotide
  Target: ATXN1; (-) strand; PAM type: YTN; PAM sequence: TTC
ccagcactatttattgatta

SEQ ID NO: 219392 - DNA, 20 bp, Artificial Sequence
  Description of Artificial Sequence: Synthetic oligonucleotide
  Target: ATXN1; (-) strand; PAM type: YTN; PAM sequence: TTT
cccagcactatttattgatt

SEQ ID NO: 219393 - DNA, 20 bp, Artificial Sequence
  Description of Artificial Sequence: Synthetic oligonucleotide
  Target: ATXN1; (-) strand; PAM type: YTN; PAM sequence: TTC
gaaacgaagagccaggtttc

SEQ ID NO: 219394 - DNA, 20 bp, Artificial Sequence
  Description of Artificial Sequence: Synthetic oligonucleotide
  Target: ATXN1; (-) strand; PAM type: YTN; PAM sequence: TTT
cgaaacgaagagccaggttt

SEQ ID NO: 219395 - DNA, 20 bp, Artificial Sequence
  Description of Artificial Sequence: Synthetic oligonucleotide
  Target: ATXN1; (-) strand; PAM type: YTN; PAM sequence: CTT
tcgaaacgaagagccaggtt

SEQ ID NO: 219396 - DNA, 20 bp, Artificial Sequence
  Description of Artificial Sequence: Synthetic oligonucleotide
  Target: ATXN1; (-) strand; PAM type: YTN; PAM sequence: CTC
tttcgaaacgaagagccagg

SEQ ID NO: 219397 - DNA, 20 bp, Artificial Sequence
  Description of Artificial Sequence: Synthetic oligonucleotide
  Target: ATXN1; (-) strand; PAM type: YTN; PAM sequence: TTC
catatggtgtaagatagcaa

SEQ ID NO: 219398 - DNA, 20 bp, Artificial Sequence
  Description of Artificial Sequence: Synthetic oligonucleotide
  Target: ATXN1; (-) strand; PAM type: YTN; PAM sequence: TTT
ccatatggtgtaagatagca

SEQ ID NO: 219399 - DNA, 20 bp, Artificial Sequence
  Description of Artificial Sequence: Synthetic oligonucleotide
  Target: ATXN1; (-) strand; PAM type: YTN; PAM sequence: TTT
tccatatggtgtaagatagc

SEQ ID NO: 219400 - DNA, 20 bp, Artificial Sequence
  Description of Artificial Sequence: Synthetic oligonucleotide
  Target: ATXN1; (-) strand; PAM type: YTN; PAM sequence: TTA
ttttccatatggtgtaagat

SEQ ID NO: 219401 - DNA, 20 bp, Artificial Sequence
  Description of Artificial Sequence: Synthetic oligonucleotide
  Target: ATXN1; (-) strand; PAM type: YTN; PAM sequence: TTT
attttccatatggtgtaaga

SEQ ID NO: 219402 - DNA, 20 bp, Artificial Sequence
  Description of Artificial Sequence: Synthetic oligonucleotide
  Target: ATXN1; (-) strand; PAM type: YTN; PAM sequence: CTA
gaatttattttccatatggt

SEQ ID NO: 219403 - DNA, 20 bp, Artificial Sequence
  Description of Artificial Sequence: Synthetic oligonucleotide
  Target: ATXN1; (-) strand; PAM type: YTN; PAM sequence: TTA
tatatctagaatttattttc

SEQ ID NO: 219404 - DNA, 20 bp, Artificial Sequence
  Description of Artificial Sequence: Synthetic oligonucleotide
  Target: ATXN1; (-) strand; PAM type: YTN; PAM sequence: TTA
gttatatatctagaatttat

SEQ ID NO: 219405 - DNA, 20 bp, Artificial Sequence
  Description of Artificial Sequence: Synthetic oligonucleotide
  Target: ATXN1; (-) strand; PAM type: YTN; PAM sequence: TTT
agttatatatctagaattta

SEQ ID NO: 219406 - DNA, 20 bp, Artificial Sequence
  Description of Artificial Sequence: Synthetic oligonucleotide
  Target: ATXN1; (-) strand; PAM type: YTN; PAM sequence: TTA
tatgtttagttatatatcta

SEQ ID NO: 219407 - DNA, 20 bp, Artificial Sequence
  Description of Artificial Sequence: Synthetic oligonucleotide
  Target: ATXN1; (-) strand; PAM type: YTN; PAM sequence: TTT
atatgtttagttatatatct

SEQ ID NO: 219408 - DNA, 20 bp, Artificial Sequence
  Description of Artificial Sequence: Synthetic oligonucleotide
  Target: ATXN1; (-) strand; PAM type: YTN; PAM sequence: TTG
tataaacacatgtttatatg

SEQ ID NO: 219409 - DNA, 20 bp, Artificial Sequence
  Description of Artificial Sequence: Synthetic oligonucleotide
  Target: ATXN1; (-) strand; PAM type: YTN; PAM sequence: TTT
gtataaacacatgtttatat

SEQ ID NO: 219410 - DNA, 20 bp, Artificial Sequence
  Description of Artificial Sequence: Synthetic oligonucleotide
  Target: ATXN1; (-) strand; PAM type: YTN; PAM sequence: CTA
tatatgtatatttgtataaa

SEQ ID NO: 219411 - DNA, 20 bp, Artificial Sequence
  Description of Artificial Sequence: Synthetic oligonucleotide
  Target: ATXN1; (-) strand; PAM type: YTN; PAM sequence: TTG
taaaataatatatatgtata

SEQ ID NO: 219412 - DNA, 20 bp, Artificial Sequence
  Description of Artificial Sequence: Synthetic oligonucleotide
  Target: ATXN1; (-) strand; PAM type: YTN; PAM sequence: TTT
gtaaaataatatatatgtat

SEQ ID NO: 219413 - DNA, 20 bp, Artificial Sequence
  Description of Artificial Sequence: Synthetic oligonucleotide
  Target: ATXN1; (-) strand; PAM type: YTN; PAM sequence: TTT
tgtaaaataatatatatgta

SEQ ID NO: 219414 - DNA, 20 bp, Artificial Sequence
  Description of Artificial Sequence: Synthetic oligonucleotide
  Target: ATXN1; (-) strand; PAM type: YTN; PAM sequence: CTA
tattttgtaaaataatatat

SEQ ID NO: 219415 - DNA, 20 bp, Artificial Sequence
  Description of Artificial Sequence: Synthetic oligonucleotide
  Target: ATXN1; (-) strand; PAM type: YTN; PAM sequence: TTC
tatattttgtaaaataatat

SEQ ID NO: 219416 - DNA, 20 bp, Artificial Sequence
  Description of Artificial Sequence: Synthetic oligonucleotide
  Target: ATXN1; (-) strand; PAM type: YTN; PAM sequence: TTT
ctatattttgtaaaataata

SEQ ID NO: 219417 - DNA, 20 bp, Artificial Sequence
  Description of Artificial Sequence: Synthetic oligonucleotide
  Target: ATXN1; (-) strand; PAM type: YTN; PAM sequence: TTT
tctatattttgtaaaataat

SEQ ID NO: 219418 - DNA, 20 bp, Artificial Sequence
  Description of Artificial Sequence: Synthetic oligonucleotide
  Target: ATXN1; (-) strand; PAM type: YTN; PAM sequence: TTT
ttctatattttgtaaaataa

SEQ ID NO: 219419 - DNA, 20 bp, Artificial Sequence
  Description of Artificial Sequence: Synthetic oligonucleotide
  Target: ATXN1; (-) strand; PAM type: YTN; PAM sequence: TTA
tttttctatattttgtaaaa

SEQ ID NO: 219420 - DNA, 20 bp, Artificial Sequence
  Description of Artificial Sequence: Synthetic oligonucleotide
  Target: ATXN1; (-) strand; PAM type: YTN; PAM sequence: TTA
taaaattatttttctatatt

SEQ ID NO: 219421 - DNA, 20 bp, Artificial Sequence
  Description of Artificial Sequence: Synthetic oligonucleotide
  Target: ATXN1; (-) strand; PAM type: YTN; PAM sequence: CTT
ataaaattatttttctatat

SEQ ID NO: 219422 - DNA, 20 bp, Artificial Sequence
  Description of Artificial Sequence: Synthetic oligonucleotide
  Target: ATXN1; (-) strand; PAM type: YTN; PAM sequence: TTC
atgcttataaaattattttt

SEQ ID NO: 219423 - DNA, 20 bp, Artificial Sequence
  Description of Artificial Sequence: Synthetic oligonucleotide
  Target: ATXN1; (-) strand; PAM type: YTN; PAM sequence: TTT
catgcttataaaattatttt

SEQ ID NO: 219424 - DNA, 20 bp, Artificial Sequence
  Description of Artificial Sequence: Synthetic oligonucleotide
  Target: ATXN1; (-) strand; PAM type: YTN; PAM sequence: CTT
tcatgcttataaaattattt

SEQ ID NO: 219425 - DNA, 20 bp, Artificial Sequence
  Description of Artificial Sequence: Synthetic oligonucleotide
  Target: ATXN1; (-) strand; PAM type: YTN; PAM sequence: CTA
caaggcctttcatgcttata

SEQ ID NO: 219426 - DNA, 20 bp, Artificial Sequence
  Description of Artificial Sequence: Synthetic oligonucleotide
  Target: ATXN1; (-) strand; PAM type: YTN; PAM sequence: TTA
caatggcctacaaggccttt

SEQ ID NO: 219427 - DNA, 20 bp, Artificial Sequence
  Description of Artificial Sequence: Synthetic oligonucleotide
  Target: ATXN1; (-) strand; PAM type: YTN; PAM sequence: TTT
acaatggcctacaaggcctt

SEQ ID NO: 219428 - DNA, 20 bp, Artificial Sequence
  Description of Artificial Sequence: Synthetic oligonucleotide
  Target: ATXN1; (-) strand; PAM type: YTN; PAM sequence: CTT
tacaatggcctacaaggcct

SEQ ID NO: 219429 - DNA, 20 bp, Artificial Sequence
  Description of Artificial Sequence: Synthetic oligonucleotide
  Target: ATXN1; (-) strand; PAM type: YTN; PAM sequence: TTA
aaagtcggtatctttacaat

SEQ ID NO: 219430 - DNA, 20 bp, Artificial Sequence
  Description of Artificial Sequence: Synthetic oligonucleotide
  Target: ATXN1; (-) strand; PAM type: YTN; PAM sequence: CTT
aaaagtcggtatctttacaa

SEQ ID NO: 219431 - DNA, 20 bp, Artificial Sequence
  Description of Artificial Sequence: Synthetic oligonucleotide
  Target: ATXN1; (-) strand; PAM type: YTN; PAM sequence: TTA
cttaaaagtcggtatcttta

SEQ ID NO: 219432 - DNA, 20 bp, Artificial Sequence
  Description of Artificial Sequence: Synthetic oligonucleotide
  Target: ATXN1; (-) strand; PAM type: YTN; PAM sequence: TTT
acttaaaagtcggtatcttt

SEQ ID NO: 219433 - DNA, 20 bp, Artificial Sequence
  Description of Artificial Sequence: Synthetic oligonucleotide
  Target: ATXN1; (-) strand; PAM type: YTN; PAM sequence: TTT
tacttaaaagtcggtatctt

SEQ ID NO: 219434 - DNA, 20 bp, Artificial Sequence
  Description of Artificial Sequence: Synthetic oligonucleotide
  Target: ATXN1; (-) strand; PAM type: YTN; PAM sequence: TTC
ccattttacttaaaagtcgg

SEQ ID NO: 219435 - DNA, 20 bp, Artificial Sequence
  Description of Artificial Sequence: Synthetic oligonucleotide
  Target: ATXN1; (-) strand; PAM type: YTN; PAM sequence: CTT
cccattttacttaaaagtcg

SEQ ID NO: 219436 - DNA, 20 bp, Artificial Sequence
  Description of Artificial Sequence: Synthetic oligonucleotide
  Target: ATXN1; (-) strand; PAM type: YTN; PAM sequence: CTG
gtcttcccattttacttaaa

SEQ ID NO: 219437 - DNA, 20 bp, Artificial Sequence
  Description of Artificial Sequence: Synthetic oligonucleotide
  Target: ATXN1; (-) strand; PAM type: YTN; PAM sequence: CTC
tggtcttcccattttactta

SEQ ID NO: 219438 - DNA, 20 bp, Artificial Sequence
  Description of Artificial Sequence: Synthetic oligonucleotide
  Target: ATXN1; (-) strand; PAM type: YTN; PAM sequence: TTA
tctctggtcttcccatttta

SEQ ID NO: 219439 - DNA, 20 bp, Artificial Sequence
  Description of Artificial Sequence: Synthetic oligonucleotide
  Target: ATXN1; (-) strand; PAM type: YTN; PAM sequence: TTA
aaaattatctctggtcttcc

SEQ ID NO: 219440 - DNA, 20 bp, Artificial Sequence
  Description of Artificial Sequence: Synthetic oligonucleotide
  Target: ATXN1; (-) strand; PAM type: YTN; PAM sequence: CTG
cattaaaaattatctctggt

SEQ ID NO: 219441 - DNA, 20 bp, Artificial Sequence
  Description of Artificial Sequence: Synthetic oligonucleotide
  Target: ATXN1; (-) strand; PAM type: YTN; PAM sequence: CTA
ctgcattaaaaattatctct

SEQ ID NO: 219442 - DNA, 20 bp, Artificial Sequence
  Description of Artificial Sequence: Synthetic oligonucleotide
  Target: ATXN1; (-) strand; PAM type: YTN; PAM sequence: TTA
aaatgtaaggcagatcatga

SEQ ID NO: 219443 - DNA, 20 bp, Artificial Sequence
  Description of Artificial Sequence: Synthetic oligonucleotide
  Target: ATXN1; (-) strand; PAM type: YTN; PAM sequence: CTT
aaaatgtaaggcagatcatg

SEQ ID NO: 219444 - DNA, 20 bp, Artificial Sequence
  Description of Artificial Sequence: Synthetic oligonucleotide
  Target: ATXN1; (-) strand; PAM type: YTN; PAM sequence: CTG
acaatcagaccaaatgagcc

SEQ ID NO: 219445 - DNA, 20 bp, Artificial Sequence
  Description of Artificial Sequence: Synthetic oligonucleotide
  Target: ATXN1; (-) strand; PAM type: YTN; PAM sequence: TTC
ctgacaatcagaccaaatga

SEQ ID NO: 219446 - DNA, 20 bp, Artificial Sequence
  Description of Artificial Sequence: Synthetic oligonucleotide
  Target: ATXN1; (-) strand; PAM type: YTN; PAM sequence: CTA
ttcctgacaatcagaccaaa

SEQ ID NO: 219447 - DNA, 20 bp, Artificial Sequence
  Description of Artificial Sequence: Synthetic oligonucleotide
  Target: ATXN1; (-) strand; PAM type: YTN; PAM sequence: TTA
tggtctattcctgacaatca

SEQ ID NO: 219448 - DNA, 20 bp, Artificial Sequence
  Description of Artificial Sequence: Synthetic oligonucleotide
  Target: ATXN1; (-) strand; PAM type: YTN; PAM sequence: CTT
atggtctattcctgacaatc

SEQ ID NO: 219449 - DNA, 20 bp, Artificial Sequence
  Description of Artificial Sequence: Synthetic oligonucleotide
  Target: ATXN1; (-) strand; PAM type: YTN; PAM sequence: TTA
tatccccttatggtctattc

SEQ ID NO: 219450 - DNA, 20 bp, Artificial Sequence
  Description of Artificial Sequence: Synthetic oligonucleotide
  Target: ATXN1; (-) strand; PAM type: YTN; PAM sequence: TTT
atatccccttatggtctatt

SEQ ID NO: 219451 - DNA, 20 bp, Artificial Sequence
  Description of Artificial Sequence: Synthetic oligonucleotide
  Target: ATXN1; (-) strand; PAM type: YTN; PAM sequence: TTA
atttatatccccttatggtc

SEQ ID NO: 219452 - DNA, 20 bp, Artificial Sequence
  Description of Artificial Sequence: Synthetic oligonucleotide
  Target: ATXN1; (-) strand; PAM type: YTN; PAM sequence: TTT
aatttatatccccttatggt

SEQ ID NO: 219453 - DNA, 20 bp, Artificial Sequence
  Description of Artificial Sequence: Synthetic oligonucleotide
  Target: ATXN1; (-) strand; PAM type: YTN; PAM sequence: CTT
taatttatatccccttatgg

SEQ ID NO: 219454 - DNA, 20 bp, Artificial Sequence
  Description of Artificial Sequence: Synthetic oligonucleotide
  Target: ATXN1; (-) strand; PAM type: YTN; PAM sequence: TTG
tgctttaatttatatcccct

SEQ ID NO: 219455 - DNA, 20 bp, Artificial Sequence
  Description of Artificial Sequence: Synthetic oligonucleotide
  Target: ATXN1; (-) strand; PAM type: YTN; PAM sequence: CTT
gtgctttaatttatatcccc

SEQ ID NO: 219456 - DNA, 20 bp, Artificial Sequence
  Description of Artificial Sequence: Synthetic oligonucleotide
  Target: ATXN1; (-) strand; PAM type: YTN; PAM sequence: TTA
taacagtaacttgtgcttta

SEQ ID NO: 219457 - DNA, 20 bp, Artificial Sequence
  Description of Artificial Sequence: Synthetic oligonucleotide
  Target: ATXN1; (-) strand; PAM type: YTN; PAM sequence: CTT
ataacagtaacttgtgcttt

SEQ ID NO: 219458 - DNA, 20 bp, Artificial Sequence
  Description of Artificial Sequence: Synthetic oligonucleotide
  Target: ATXN1; (-) strand; PAM type: YTN; PAM sequence: CTG
cttataacagtaacttgtgc

SEQ ID NO: 219459 - DNA, 20 bp, Artificial Sequence
  Description of Artificial Sequence: Synthetic oligonucleotide
  Target: ATXN1; (-) strand; PAM type: YTN; PAM sequence: CTG
caggctgcttataacagtaa

SEQ ID NO: 219460 - DNA, 20 bp, Artificial Sequence
  Description of Artificial Sequence: Synthetic oligonucleotide
  Target: ATXN1; (-) strand; PAM type: YTN; PAM sequence: CTG
gaagccatcctgcaggctgc

SEQ ID NO: 219461 - DNA, 20 bp, Artificial Sequence
  Description of Artificial Sequence: Synthetic oligonucleotide
  Target: ATXN1; (-) strand; PAM type: YTN; PAM sequence: TTC
caagaggtgggatcactgga

SEQ ID NO: 219462 - DNA, 20 bp, Artificial Sequence
  Description of Artificial Sequence: Synthetic oligonucleotide
  Target: ATXN1; (-) strand; PAM type: YTN; PAM sequence: TTA
caagggcatgaattccaaga

SEQ ID NO: 219463 - DNA, 20 bp, Artificial Sequence
  Description of Artificial Sequence: Synthetic oligonucleotide
  Target: ATXN1; (-) strand; PAM type: YTN; PAM sequence: TTT
acaagggcatgaattccaag

SEQ ID NO: 219464 - DNA, 20 bp, Artificial Sequence
  Description of Artificial Sequence: Synthetic oligonucleotide
  Target: ATXN1; (-) strand; PAM type: YTN; PAM sequence: CTT
tacaagggcatgaattccaa

SEQ ID NO: 219465 - DNA, 20 bp, Artificial Sequence
  Description of Artificial Sequence: Synthetic oligonucleotide
  Target: ATXN1; (-) strand; PAM type: YTN; PAM sequence: CTC
aagaaggctttacaagggca

SEQ ID NO: 219466 - DNA, 20 bp, Artificial Sequence
  Description of Artificial Sequence: Synthetic oligonucleotide
  Target: ATXN1; (-) strand; PAM type: YTN; PAM sequence: CTA
aatccagtccacactcaaga

SEQ ID NO: 219467 - DNA, 20 bp, Artificial Sequence
  Description of Artificial Sequence: Synthetic oligonucleotide
  Target: ATXN1; (-) strand; PAM type: YTN; PAM sequence: TTG
agtcactaaatccagtccac

SEQ ID NO: 219468 - DNA, 20 bp, Artificial Sequence
  Description of Artificial Sequence: Synthetic oligonucleotide
  Target: ATXN1; (-) strand; PAM type: YTN; PAM sequence: CTA
gaattgagtcactaaatcca

SEQ ID NO: 219469 - DNA, 20 bp, Artificial Sequence
  Description of Artificial Sequence: Synthetic oligonucleotide
  Target: ATXN1; (-) strand; PAM type: YTN; PAM sequence: TTG
ctagaattgagtcactaaat

SEQ ID NO: 219470 - DNA, 20 bp, Artificial Sequence
  Description of Artificial Sequence: Synthetic oligonucleotide
  Target: ATXN1; (-) strand; PAM type: YTN; PAM sequence: TTT
gctagaattgagtcactaaa

SEQ ID NO: 219471 - DNA, 20 bp, Artificial Sequence
  Description of Artificial Sequence: Synthetic oligonucleotide
  Target: ATXN1; (-) strand; PAM type: YTN; PAM sequence: CTG
tttgctagaattgagtcact

SEQ ID NO: 219472 - DNA, 20 bp, Artificial Sequence
  Description of Artificial Sequence: Synthetic oligonucleotide
  Target: ATXN1; (-) strand; PAM type: YTN; PAM sequence: TTG
ccacagtctgtttgctagaa

SEQ ID NO: 219473 - DNA, 20 bp, Artificial Sequence
  Description of Artificial Sequence: Synthetic oligonucleotide
  Target: ATXN1; (-) strand; PAM type: YTN; PAM sequence: TTT
gccacagtctgtttgctaga

SEQ ID NO: 219474 - DNA, 20 bp, Artificial Sequence
  Description of Artificial Sequence: Synthetic oligonucleotide
  Target: ATXN1; (-) strand; PAM type: YTN; PAM sequence: CTT
tgccacagtctgtttgctag

SEQ ID NO: 219475 - DNA, 20 bp, Artificial Sequence
  Description of Artificial Sequence: Synthetic oligonucleotide
  Target: ATXN1; (-) strand; PAM type: YTN; PAM sequence: TTA
cctttgccacagtctgtttg

SEQ ID NO: 219476 - DNA, 20 bp, Artificial Sequence
  Description of Artificial Sequence: Synthetic oligonucleotide
  Target: ATXN1; (-) strand; PAM type: YTN; PAM sequence: CTC
ccattacctttgccacagtc

SEQ ID NO: 219477 - DNA, 20 bp, Artificial Sequence
  Description of Artificial Sequence: Synthetic oligonucleotide
  Target: ATXN1; (-) strand; PAM type: YTN; PAM sequence: TTG
gaaatgatctcccattacct

SEQ ID NO: 219478 - DNA, 20 bp, Artificial Sequence
  Description of Artificial Sequence: Synthetic oligonucleotide
  Target: ATXN1; (-) strand; PAM type: YTN; PAM sequence: CTT
ggaaatgatctcccattacc

SEQ ID NO: 219479 - DNA, 20 bp, Artificial Sequence
  Description of Artificial Sequence: Synthetic oligonucleotide
  Target: ATXN1; (-) strand; PAM type: YTN; PAM sequence: TTC
atgtaacccagtcttggaaa

SEQ ID NO: 219480 - DNA, 20 bp, Artificial Sequence
  Description of Artificial Sequence: Synthetic oligonucleotide
  Target: ATXN1; (-) strand; PAM type: YTN; PAM sequence: CTT
catgtaacccagtcttggaa

SEQ ID NO: 219481 - DNA, 20 bp, Artificial Sequence
  Description of Artificial Sequence: Synthetic oligonucleotide
  Target: ATXN1; (-) strand; PAM type: YTN; PAM sequence: CTC
ccccaggtgagtaacccaga

SEQ ID NO: 219482 - DNA, 20 bp, Artificial Sequence
  Description of Artificial Sequence: Synthetic oligonucleotide
  Target: ATXN1; (-) strand; PAM type: YTN; PAM sequence: CTG
gcagtcagcctcccccaggt

SEQ ID NO: 219483 - DNA, 20 bp, Artificial Sequence
  Description of Artificial Sequence: Synthetic oligonucleotide
  Target: ATXN1; (-) strand; PAM type: YTN; PAM sequence: CTG
catcacagcctggcagtcag

SEQ ID NO: 219484 - DNA, 20 bp, Artificial Sequence
  Description of Artificial Sequence: Synthetic oligonucleotide
  Target: ATXN1; (-) strand; PAM type: YTN; PAM sequence: TTC
cacaggactgcatcacagcc

SEQ ID NO: 219485 - DNA, 20 bp, Artificial Sequence
  Description of Artificial Sequence: Synthetic oligonucleotide
  Target: ATXN1; (-) strand; PAM type: YTN; PAM sequence: CTT
ccacaggactgcatcacagc

SEQ ID NO: 219486 - DNA, 20 bp, Artificial Sequence
  Description of Artificial Sequence: Synthetic oligonucleotide
  Target: ATXN1; (-) strand; PAM type: YTN; PAM sequence: CTC
agtgatatgccatgtgggcc

SEQ ID NO: 219487 - DNA, 20 bp, Artificial Sequence
  Description of Artificial Sequence: Synthetic oligonucleotide
  Target: ATXN1; (-) strand; PAM type: YTN; PAM sequence: CTA
gcaggcctcagtgatatgcc

SEQ ID NO: 219488 - DNA, 20 bp, Artificial Sequence
  Description of Artificial Sequence: Synthetic oligonucleotide
  Target: ATXN1; (-) strand; PAM type: YTN; PAM sequence: CTC
acatagatgctagcaggcct

SEQ ID NO: 219489 - DNA, 20 bp, Artificial Sequence
  Description of Artificial Sequence: Synthetic oligonucleotide
  Target: ATXN1; (-) strand; PAM type: YTN; PAM sequence: TTC
caaatccactcacatagatg

SEQ ID NO: 219490 - DNA, 20 bp, Artificial Sequence
  Description of Artificial Sequence: Synthetic oligonucleotide
  Target: ATXN1; (-) strand; PAM type: YTN; PAM sequence: CTT
ccaaatccactcacatagat

SEQ ID NO: 219491 - DNA, 20 bp, Artificial Sequence
  Description of Artificial Sequence: Synthetic oligonucleotide
  Target: ATXN1; (-) strand; PAM type: YTN; PAM sequence: CTG
cttccaaatccactcacata

SEQ ID NO: 219492 - DNA, 20 bp, Artificial Sequence
  Description of Artificial Sequence: Synthetic oligonucleotide
  Target: ATXN1; (-) strand; PAM type: YTN; PAM sequence: CTG
aaggatagggtgggggcggt

SEQ ID NO: 219493 - DNA, 20 bp, Artificial Sequence
  Description of Artificial Sequence: Synthetic oligonucleotide
  Target: ATXN1; (-) strand; PAM type: YTN; PAM sequence: TTC
atctgaaggatagggtgggg

SEQ ID NO: 219494 - DNA, 20 bp, Artificial Sequence
  Description of Artificial Sequence: Synthetic oligonucleotide
  Target: ATXN1; (-) strand; PAM type: YTN; PAM sequence: TTT
catctgaaggatagggtggg

SEQ ID NO: 219495 - DNA, 20 bp, Artificial Sequence
  Description of Artificial Sequence: Synthetic oligonucleotide
  Target: ATXN1; (-) strand; PAM type: YTN; PAM sequence: CTG
acgtttcatctgaaggatag

SEQ ID NO: 219496 - DNA, 20 bp, Artificial Sequence
  Description of Artificial Sequence: Synthetic oligonucleotide
  Target: ATXN1; (-) strand; PAM type: YTN; PAM sequence: CTG
ggctgacgtttcatctgaag

SEQ ID NO: 219497 - DNA, 20 bp, Artificial Sequence
  Description of Artificial Sequence: Synthetic oligonucleotide
  Target: ATXN1; (-) strand; PAM type: YTN; PAM sequence: TTA
acctgggctgacgtttcatc

SEQ ID NO: 219498 - DNA, 20 bp, Artificial Sequence
  Description of Artificial Sequence: Synthetic oligonucleotide
  Target: ATXN1; (-) strand; PAM type: YTN; PAM sequence: TTG
ttaacctgggctgacgtttc

SEQ ID NO: 219499 - DNA, 20 bp, Artificial Sequence
  Description of Artificial Sequence: Synthetic oligonucleotide
  Target: ATXN1; (-) strand; PAM type: YTN; PAM sequence: TTG
tagtcaagttgttaacctgg

SEQ ID NO: 219500 - DNA, 20 bp, Artificial Sequence
  Description of Artificial Sequence: Synthetic oligonucleotide
  Target: ATXN1; (-) strand; PAM type: YTN; PAM sequence: TTC
atgaggttgtagtcaagttg

SEQ ID NO: 219501 - DNA, 20 bp, Artificial Sequence
  Description of Artificial Sequence: Synthetic oligonucleotide
  Target: ATXN1; (-) strand; PAM type: YTN; PAM sequence: TTT
catgaggttgtagtcaagtt

SEQ ID NO: 219502 - DNA, 20 bp, Artificial Sequence
  Description of Artificial Sequence: Synthetic oligonucleotide
  Target: ATXN1; (-) strand; PAM type: YTN; PAM sequence: CTT
tcatgaggttgtagtcaagt

SEQ ID NO: 219503 - DNA, 20 bp, Artificial Sequence
  Description of Artificial Sequence: Synthetic oligonucleotide
  Target: ATXN1; (-) strand; PAM type: YTN; PAM sequence: CTC
caagtctttcatgaggttgt

SEQ ID NO: 219504 - DNA, 20 bp, Artificial Sequence
  Description of Artificial Sequence: Synthetic oligonucleotide
  Target: ATXN1; (-) strand; PAM type: YTN; PAM sequence: CTA
gctccaagtctttcatgagg

SEQ ID NO: 219505 - DNA, 20 bp, Artificial Sequence
  Description of Artificial Sequence: Synthetic oligonucleotide
  Target: ATXN1; (-) strand; PAM type: YTN; PAM sequence: CTC
tagctccaagtctttcatga

SEQ ID NO: 219506 - DNA, 20 bp, Artificial Sequence
  Description of Artificial Sequence: Synthetic oligonucleotide
  Target: ATXN1; (-) strand; PAM type: YTN; PAM sequence: CTG
ggtgtctctagctccaagtc

SEQ ID NO: 219507 - DNA, 20 bp, Artificial Sequence
  Description of Artificial Sequence: Synthetic oligonucleotide
  Target: ATXN1; (-) strand; PAM type: YTN; PAM sequence: CTG
catatcatagctgggtgtct

SEQ ID NO: 219508 - DNA, 20 bp, Artificial Sequence
  Description of Artificial Sequence: Synthetic oligonucleotide
  Target: ATXN1; (-) strand; PAM type: YTN; PAM sequence: CTA
agtgtgaatcactgcatatc

SEQ ID NO: 219509 - DNA, 20 bp, Artificial Sequence
  Description of Artificial Sequence: Synthetic oligonucleotide
  Target: ATXN1; (-) strand; PAM type: YTN; PAM sequence: TTC
taagtgtgaatcactgcata

SEQ ID NO: 219510 - DNA, 20 bp, Artificial Sequence
  Description of Artificial Sequence: Synthetic oligonucleotide
  Target: ATXN1; (-) strand; PAM type: YTN; PAM sequence: TTT
ctaagtgtgaatcactgcat

SEQ ID NO: 219511 - DNA, 20 bp, Artificial Sequence
  Description of Artificial Sequence: Synthetic oligonucleotide
  Target: ATXN1; (-) strand; PAM type: YTN; PAM sequence: TTT
tctaagtgtgaatcactgca

SEQ ID NO: 219512 - DNA, 20 bp, Artificial Sequence
  Description of Artificial Sequence: Synthetic oligonucleotide
  Target: ATXN1; (-) strand; PAM type: YTN; PAM sequence: TTT
ttctaagtgtgaatcactgc

SEQ ID NO: 219513 - DNA, 20 bp, Artificial Sequence
  Description of Artificial Sequence: Synthetic oligonucleotide
  Target: ATXN1; (-) strand; PAM type: YTN; PAM sequence: CTC
agtttttctaagtgtgaatc

SEQ ID NO: 219514 - DNA, 20 bp, Artificial Sequence
  Description of Artificial Sequence: Synthetic oligonucleotide
  Target: ATXN1; (-) strand; PAM type: YTN; PAM sequence: CTC
tcagtttttctaagtgtgaa

SEQ ID NO: 219515 - DNA, 20 bp, Artificial Sequence
  Description of Artificial Sequence: Synthetic oligonucleotide
  Target: ATXN1; (-) strand; PAM type: YTN; PAM sequence: TTA
tctctcagtttttctaagtg

SEQ ID NO: 219516 - DNA, 20 bp, Artificial Sequence
  Description of Artificial Sequence: Synthetic oligonucleotide
  Target: ATXN1; (-) strand; PAM type: YTN; PAM sequence: TTA
ttatctctcagtttttctaa

SEQ ID NO: 219517 - DNA, 20 bp, Artificial Sequence
  Description of Artificial Sequence: Synthetic oligonucleotide
  Target: ATXN1; (-) strand; PAM type: YTN; PAM sequence: TTT
attatctctcagtttttcta

SEQ ID NO: 219518 - DNA, 20 bp, Artificial Sequence
  Description of Artificial Sequence: Synthetic oligonucleotide
  Target: ATXN1; (-) strand; PAM type: YTN; PAM sequence: TTA
aaacaacaagtgtttattat

SEQ ID NO: 219519 - DNA, 20 bp, Artificial Sequence
  Description of Artificial Sequence: Synthetic oligonucleotide
  Target: ATXN1; (-) strand; PAM type: YTN; PAM sequence: CTT
aaaacaacaagtgtttatta

SEQ ID NO: 219520 - DNA, 20 bp, Artificial Sequence
  Description of Artificial Sequence: Synthetic oligonucleotide
  Target: ATXN1; (-) strand; PAM type: YTN; PAM sequence: TTA
gtggcttaaaacaacaagtg

SEQ ID NO: 219521 - DNA, 20 bp, Artificial Sequence
  Description of Artificial Sequence: Synthetic oligonucleotide
  Target: ATXN1; (-) strand; PAM type: YTN; PAM sequence: CTT
agtggcttaaaacaacaagt

SEQ ID NO: 219522 - DNA, 20 bp, Artificial Sequence
  Description of Artificial Sequence: Synthetic oligonucleotide
  Target: ATXN1; (-) strand; PAM type: YTN; PAM sequence: CTC
caaatcttagtggcttaaaa

SEQ ID NO: 219523 - DNA, 20 bp, Artificial Sequence
  Description of Artificial Sequence: Synthetic oligonucleotide
  Target: ATXN1; (-) strand; PAM type: YTN; PAM sequence: TTA
ctccaaatcttagtggctta

SEQ ID NO: 219524 - DNA, 20 bp, Artificial Sequence
  Description of Artificial Sequence: Synthetic oligonucleotide
  Target: ATXN1; (-) strand; PAM type: YTN; PAM sequence: CTG
tgtaagtaattactccaaat

SEQ ID NO: 219525 - DNA, 20 bp, Artificial Sequence
  Description of Artificial Sequence: Synthetic oligonucleotide
  Target: ATXN1; (-) strand; PAM type: YTN; PAM sequence: CTG
ctgtgtaagtaattactcca

SEQ ID NO: 219526 - DNA, 20 bp, Artificial Sequence
  Description of Artificial Sequence: Synthetic oligonucleotide
  Target: ATXN1; (-) strand; PAM type: YTN; PAM sequence: CTA
ctgctgtgtaagtaattact

SEQ ID NO: 219527 - DNA, 20 bp, Artificial Sequence
  Description of Artificial Sequence: Synthetic oligonucleotide
  Target: ATXN1; (-) strand; PAM type: YTN; PAM sequence: TTA
tctactgctgtgtaagtaat

SEQ ID NO: 219528 - DNA, 20 bp, Artificial Sequence
  Description of Artificial Sequence: Synthetic oligonucleotide
  Target: ATXN1; (-) strand; PAM type: YTN; PAM sequence: CTG
tagtagttatctactgctgt

SEQ ID NO: 219529 - DNA, 20 bp, Artificial Sequence
  Description of Artificial Sequence: Synthetic oligonucleotide
  Target: ATXN1; (-) strand; PAM type: YTN; PAM sequence: TTG
taactgtagtagttatctac

SEQ ID NO: 219530 - DNA, 20 bp, Artificial Sequence
  Description of Artificial Sequence: Synthetic oligonucleotide
  Target: ATXN1; (-) strand; PAM type: YTN; PAM sequence: TTC
atacattgtaactgtagtag

SEQ ID NO: 219531 - DNA, 20 bp, Artificial Sequence
  Description of Artificial Sequence: Synthetic oligonucleotide
  Target: ATXN1; (-) strand; PAM type: YTN; PAM sequence: TTT
catacattgtaactgtagta

SEQ ID NO: 219532 - DNA, 20 bp, Artificial Sequence
  Description of Artificial Sequence: Synthetic oligonucleotide
  Target: ATXN1; (-) strand; PAM type: YTN; PAM sequence: TTC
ccagaagagtgtttcataca

SEQ ID NO: 219533 - DNA, 20 bp, Artificial Sequence
  Description of Artificial Sequence: Synthetic oligonucleotide
  Target: ATXN1; (-) strand; PAM type: YTN; PAM sequence: CTG
taaaaagtcatgtaaagttc

SEQ ID NO: 219534 - DNA, 20 bp, Artificial Sequence
  Description of Artificial Sequence: Synthetic oligonucleotide
  Target: ATXN1; (-) strand; PAM type: YTN; PAM sequence: CTC
ccactgtaaaaagtcatgta

SEQ ID NO: 219535 - DNA, 20 bp, Artificial Sequence
  Description of Artificial Sequence: Synthetic oligonucleotide
  Target: ATXN1; (-) strand; PAM type: YTN; PAM sequence: TTC
tcccactgtaaaaagtcatg

SEQ ID NO: 219536 - DNA, 20 bp, Artificial Sequence
  Description of Artificial Sequence: Synthetic oligonucleotide
  Target: ATXN1; (-) strand; PAM type: YTN; PAM sequence: TTT
ctcccactgtaaaaagtcat

SEQ ID NO: 219537 - DNA, 20 bp, Artificial Sequence
  Description of Artificial Sequence: Synthetic oligonucleotide
  Target: ATXN1; (-) strand; PAM type: YTN; PAM sequence: CTC
agtttctcccactgtaaaaa

SEQ ID NO: 219538 - DNA, 20 bp, Artificial Sequence
  Description of Artificial Sequence: Synthetic oligonucleotide
  Target: ATXN1; (-) strand; PAM type: YTN; PAM sequence: TTG
gggctcagtttctcccactg

SEQ ID NO: 219539 - DNA, 20 bp, Artificial Sequence
  Description of Artificial Sequence: Synthetic oligonucleotide
  Target: ATXN1; (-) strand; PAM type: YTN; PAM sequence: TTT
ggggctcagtttctcccact

SEQ ID NO: 219540 - DNA, 20 bp, Artificial Sequence
  Description of Artificial Sequence: Synthetic oligonucleotide
  Target: ATXN1; (-) strand; PAM type: YTN; PAM sequence: CTT
tggggctcagtttctcccac

SEQ ID NO: 219541 - DNA, 20 bp, Artificial Sequence
  Description of Artificial Sequence: Synthetic oligonucleotide
  Target: ATXN1; (-) strand; PAM type: YTN; PAM sequence: TTC
tttggggctcagtttctccc

SEQ ID NO: 219542 - DNA, 20 bp, Artificial Sequence
  Description of Artificial Sequence: Synthetic oligonucleotide
  Target: ATXN1; (-) strand; PAM type: YTN; PAM sequence: CTT
ctttggggctcagtttctcc

SEQ ID NO: 219543 - DNA, 20 bp, Artificial Sequence
  Description of Artificial Sequence: Synthetic oligonucleotide
  Target: ATXN1; (-) strand; PAM type: YTN; PAM sequence: TTA
acttctttggggctcagttt

SEQ ID NO: 219544 - DNA, 20 bp, Artificial Sequence
  Description of Artificial Sequence: Synthetic oligonucleotide
  Target: ATXN1; (-) strand; PAM type: YTN; PAM sequence: TTT
aacttctttggggctcagtt

SEQ ID NO: 219545 - DNA, 20 bp, Artificial Sequence
  Description of Artificial Sequence: Synthetic oligonucleotide
  Target: ATXN1; (-) strand; PAM type: YTN; PAM sequence: TTG
aacaggtgatttaacttctt

SEQ ID NO: 219546 - DNA, 20 bp, Artificial Sequence
  Description of Artificial Sequence: Synthetic oligonucleotide
  Target: ATXN1; (-) strand; PAM type: YTN; PAM sequence: CTG
ttgaacaggtgatttaactt

SEQ ID NO: 219547 - DNA, 20 bp, Artificial Sequence
  Description of Artificial Sequence: Synthetic oligonucleotide
  Target: ATXN1; (-) strand; PAM type: YTN; PAM sequence: CTA
ccatgtatgtgtgctgttga

SEQ ID NO: 219548 - DNA, 20 bp, Artificial Sequence
  Description of Artificial Sequence: Synthetic oligonucleotide
  Target: ATXN1; (-) strand; PAM type: YTN; PAM sequence: CTC
taccatgtatgtgtgctgtt

SEQ ID NO: 219549 - DNA, 20 bp, Artificial Sequence
  Description of Artificial Sequence: Synthetic oligonucleotide
  Target: ATXN1; (-) strand; PAM type: YTN; PAM sequence: TTG
agtcccacctctaccatgta

SEQ ID NO: 219550 - DNA, 20 bp, Artificial Sequence
  Description of Artificial Sequence: Synthetic oligonucleotide
  Target: ATXN1; (-) strand; PAM type: YTN; PAM sequence: TTT
gagtcccacctctaccatgt

SEQ ID NO: 219551 - DNA, 20 bp, Artificial Sequence
  Description of Artificial Sequence: Synthetic oligonucleotide
  Target: ATXN1; (-) strand; PAM type: YTN; PAM sequence: CTG
agtttgagtcccacctctac

SEQ ID NO: 219552 - DNA, 20 bp, Artificial Sequence
  Description of Artificial Sequence: Synthetic oligonucleotide
  Target: ATXN1; (-) strand; PAM type: YTN; PAM sequence: CTG
gagtcagatggcctgagttt

SEQ ID NO: 219553 - DNA, 20 bp, Artificial Sequence
  Description of Artificial Sequence: Synthetic oligonucleotide
  Target: ATXN1; (-) strand; PAM type: YTN; PAM sequence: TTC
tggagtcagatggcctgagt

SEQ ID NO: 219554 - DNA, 20 bp, Artificial Sequence
  Description of Artificial Sequence: Synthetic oligonucleotide
  Target: ATXN1; (-) strand; PAM type: YTN; PAM sequence: TTT
ctggagtcagatggcctgag

SEQ ID NO: 219555 - DNA, 20 bp, Artificial Sequence
  Description of Artificial Sequence: Synthetic oligonucleotide
  Target: ATXN1; (-) strand; PAM type: YTN; PAM sequence: CTG
gtttctggagtcagatggcc

SEQ ID NO: 219556 - DNA, 20 bp, Artificial Sequence
  Description of Artificial Sequence: Synthetic oligonucleotide
  Target: ATXN1; (-) strand; PAM type: YTN; PAM sequence: TTA
agaacctggtttctggagtc

SEQ ID NO: 219557 - DNA, 20 bp, Artificial Sequence
  Description of Artificial Sequence: Synthetic oligonucleotide
  Target: ATXN1; (-) strand; PAM type: YTN; PAM sequence: TTA
aaggggtagtgtgatgcagg

SEQ ID NO: 219558 - DNA, 20 bp, Artificial Sequence
  Description of Artificial Sequence: Synthetic oligonucleotide
  Target: ATXN1; (-) strand; PAM type: YTN; PAM sequence: CTT
aaaggggtagtgtgatgcag

SEQ ID NO: 219559 - DNA, 20 bp, Artificial Sequence
  Description of Artificial Sequence: Synthetic oligonucleotide
  Target: ATXN1; (-) strand; PAM type: YTN; PAM sequence: TTC
ttaaaggggtagtgtgatgc

SEQ ID NO: 219560 - DNA, 20 bp, Artificial Sequence
  Description of Artificial Sequence: Synthetic oligonucleotide
  Target: ATXN1; (-) strand; PAM type: YTN; PAM sequence: CTA
aagtaggaaaaatggttctt

SEQ ID NO: 219561 - DNA, 20 bp, Artificial Sequence
  Description of Artificial Sequence: Synthetic oligonucleotide
  Target: ATXN1; (-) strand; PAM type: YTN; PAM sequence: TTC
aggcatgcacacctaaagta

SEQ ID NO: 219562 - DNA, 20 bp, Artificial Sequence
  Description of Artificial Sequence: Synthetic oligonucleotide
  Target: ATXN1; (-) strand; PAM type: YTN; PAM sequence: TTT
caggcatgcacacctaaagt

SEQ ID NO: 219563 - DNA, 20 bp, Artificial Sequence
  Description of Artificial Sequence: Synthetic oligonucleotide
  Target: ATXN1; (-) strand; PAM type: YTN; PAM sequence: CTA
cagtggaaagtcaaatttca

SEQ ID NO: 219564 - DNA, 20 bp, Artificial Sequence
  Description of Artificial Sequence: Synthetic oligonucleotide
  Target: ATXN1; (-) strand; PAM type: YTN; PAM sequence: TTC
tacagtggaaagtcaaattt

SEQ ID NO: 219565 - DNA, 20 bp, Artificial Sequence
  Description of Artificial Sequence: Synthetic oligonucleotide
  Target: ATXN1; (-) strand; PAM type: YTN; PAM sequence: TTA
gcatattctacagtggaaag

SEQ ID NO: 219566 - DNA, 20 bp, Artificial Sequence
  Description of Artificial Sequence: Synthetic oligonucleotide
  Target: ATXN1; (-) strand; PAM type: YTN; PAM sequence: TTT
agcatattctacagtggaaa

SEQ ID NO: 219567 - DNA, 20 bp, Artificial Sequence
  Description of Artificial Sequence: Synthetic oligonucleotide
  Target: ATXN1; (-) strand; PAM type: YTN; PAM sequence: TTT
tagcatattctacagtggaa

SEQ ID NO: 219568 - DNA, 20 bp, Artificial Sequence
  Description of Artificial Sequence: Synthetic oligonucleotide
  Target: ATXN1; (-) strand; PAM type: YTN; PAM sequence: TTG
tgtgattttagcatattcta

SEQ ID NO: 219569 - DNA, 20 bp, Artificial Sequence
  Description of Artificial Sequence: Synthetic oligonucleotide
  Target: ATXN1; (-) strand; PAM type: YTN; PAM sequence: TTG
tgcaaattgtgtgattttag

SEQ ID NO: 219570 - DNA, 20 bp, Artificial Sequence
  Description of Artificial Sequence: Synthetic oligonucleotide
  Target: ATXN1; (-) strand; PAM type: YTN; PAM sequence: CTT
gtgcaaattgtgtgatttta

SEQ ID NO: 219571 - DNA, 20 bp, Artificial Sequence
  Description of Artificial Sequence: Synthetic oligonucleotide
  Target: ATXN1; (-) strand; PAM type: YTN; PAM sequence: TTG
cttgtgcaaattgtgtgatt

SEQ ID NO: 219572 - DNA, 20 bp, Artificial Sequence
  Description of Artificial Sequence: Synthetic oligonucleotide
  Target: ATXN1; (-) strand; PAM type: YTN; PAM sequence: TTC
attgcttgtgcaaattgtgt

SEQ ID NO: 219573 - DNA, 20 bp, Artificial Sequence
  Description of Artificial Sequence: Synthetic oligonucleotide
  Target: ATXN1; (-) strand; PAM type: YTN; PAM sequence: CTT
cattgcttgtgcaaattgtg

SEQ ID NO: 219574 - DNA, 20 bp, Artificial Sequence
  Description of Artificial Sequence: Synthetic oligonucleotide
  Target: ATXN1; (-) strand; PAM type: YTN; PAM sequence: TTG
atgaagatgcagatgcttca

SEQ ID NO: 219575 - DNA, 20 bp, Artificial Sequence
  Description of Artificial Sequence: Synthetic oligonucleotide
  Target: ATXN1; (-) strand; PAM type: YTN; PAM sequence: TTT
gatgaagatgcagatgcttc

SEQ ID NO: 219576 - DNA, 20 bp, Artificial Sequence
  Description of Artificial Sequence: Synthetic oligonucleotide
  Target: ATXN1; (-) strand; PAM type: YTN; PAM sequence: TTC
aaaaaaaaaaaaaagaagtt

SEQ ID NO: 219577 - DNA, 20 bp, Artificial Sequence
  Description of Artificial Sequence: Synthetic oligonucleotide
  Target: ATXN1; (-) strand; PAM type: YTN; PAM sequence: TTT
caaaaaaaaaaaaaagaagt

SEQ ID NO: 219578 - DNA, 20 bp, Artificial Sequence
  Description of Artificial Sequence: Synthetic oligonucleotide
  Target: ATXN1; (-) strand; PAM type: YTN; PAM sequence: CTA
tttcaaaaaaaaaaaaaaga

SEQ ID NO: 219579 - DNA, 20 bp, Artificial Sequence
  Description of Artificial Sequence: Synthetic oligonucleotide
  Target: ATXN1; (-) strand; PAM type: YTN; PAM sequence: CTC
tatttcaaaaaaaaaaaaaa

SEQ ID NO: 219580 - DNA, 20 bp, Artificial Sequence
  Description of Artificial Sequence: Synthetic oligonucleotide
  Target: ATXN1; (-) strand; PAM type: YTN; PAM sequence: CTG
ggcaacaagagcaaaactct

SEQ ID NO: 219581 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcaacaagagca

SEQ ID NO: 219582 - DNA, 20 bp, Artificial Sequence
  Description of Artificial Sequence: Synthetic oligonucleotide
  Target: ATXN1; (-) strand; PAM type: YTN; PAM sequence: TTG
tactccagcctgggcaacaa

SEQ ID NO: 219583 - DNA, 20 bp, Artificial Sequence
  Description of Artificial Sequence: Synthetic oligonucleotide
  Target: ATXN1; (-) strand; PAM type: YTN; PAM sequence: CTG
agaccacaccattgtactcc

SEQ ID NO: 219584 - DNA, 20 bp, Artificial Sequence
  Description of Artificial Sequence: Synthetic oligonucleotide
  Target: ATXN1; (-) strand; PAM type: YTN; PAM sequence: TTG
cagtgagctgagaccacacc

SEQ ID NO: 219585 - DNA, 20 bp, Artificial Sequence
  Description of Artificial Sequence: Synthetic oligonucleotide
  Target: ATXN1; (-) strand; PAM type: YTN; PAM sequence: CTG
agaggcagaggttgcagtga

SEQ ID NO: 219586 - DNA, 20 bp, Artificial Sequence
  Description of Artificial Sequence: Synthetic oligonucleotide
  Target: ATXN1; (-) strand; PAM type: YTN; PAM sequence: TTG
aacctgagaggcagaggttg

SEQ ID NO: 219587 - DNA, 20 bp, Artificial Sequence
  Description of Artificial Sequence: Synthetic oligonucleotide
  Target: ATXN1; (-) strand; PAM type: YTN; PAM sequence: CTT
gaacctgagaggcagaggtt

SEQ ID NO: 219588 - DNA, 20 bp, Artificial Sequence
  Description of Artificial Sequence: Synthetic oligonucleotide
  Target: ATXN1; (-) strand; PAM type: YTN; PAM sequence: TTG
cttgaacctgagaggcagag

SEQ ID NO: 219589 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaattgcttgaa

SEQ ID NO: 219590 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagaat

SEQ ID NO: 219591 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagaa

SEQ ID NO: 219592 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcagga

SEQ ID NO: 219593 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacttgggag

SEQ ID NO: 219594 - DNA, 20 bp, Artificial Sequence
  Description of Artificial Sequence: Synthetic oligonucleotide
  Target: ATXN1; (-) strand; PAM type: YTN; PAM sequence: CTG
ggcgtggtggcgtgtgcctg

SEQ ID NO: 219595 - DNA, 20 bp, Artificial Sequence
  Description of Artificial Sequence: Synthetic oligonucleotide
  Target: ATXN1; (-) strand; PAM type: YTN; PAM sequence: TTA
gctgggcgtggtggcgtgtg

SEQ ID NO: 219596 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaattagctg

SEQ ID NO: 219597 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaattag

SEQ ID NO: 219598 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaaatt

SEQ ID NO: 219599 - DNA, 20 bp, Artificial Sequence
  Description of Artificial Sequence: Synthetic oligonucleotide
  Target: ATXN1; (-) strand; PAM type: YTN; PAM sequence: CTG
tctctactaaaaatacaaaa

SEQ ID NO: 219600 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaatcctg

SEQ ID NO: 219601 - DNA, 20 bp, Artificial Sequence
  Description of Artificial Sequence: Synthetic oligonucleotide
  Target: ATXN1; (-) strand; PAM type: YTN; PAM sequence: TTC
aagaccagcctggccaacat

SEQ ID NO: 219602 - DNA, 20 bp, Artificial Sequence
  Description of Artificial Sequence: Synthetic oligonucleotide
  Target: ATXN1; (-) strand; PAM type: YTN; PAM sequence: CTG
aggtcaagagttcaagacca

SEQ ID NO: 219603 - DNA, 20 bp, Artificial Sequence
  Description of Artificial Sequence: Synthetic oligonucleotide
  Target: ATXN1; (-) strand; PAM type: YTN; PAM sequence: TTG
ggaggccgagaccagcagat

SEQ ID NO: 219604 - DNA, 20 bp, Artificial Sequence
  Description of Artificial Sequence: Synthetic oligonucleotide
  Target: ATXN1; (-) strand; PAM type: YTN; PAM sequence: TTT
gggaggccgagaccagcaga

SEQ ID NO: 219605 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgagaccagcag

SEQ ID NO: 219606 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 219607 - DNA, 20 bp, Artificial Sequence
  Description of Artificial Sequence: Synthetic oligonucleotide
  Target: ATXN1; (-) strand; PAM type: YTN; PAM sequence: CTG
atgaatggccgggtgcagtg

SEQ ID NO: 219608 - DNA, 20 bp, Artificial Sequence
  Description of Artificial Sequence: Synthetic oligonucleotide
  Target: ATXN1; (-) strand; PAM type: YTN; PAM sequence: TTA
agaagcctgatgaatggccg

SEQ ID NO: 219609 - DNA, 20 bp, Artificial Sequence
  Description of Artificial Sequence: Synthetic oligonucleotide
  Target: ATXN1; (-) strand; PAM type: YTN; PAM sequence: CTA
tgtggcaggttaagaagcct

SEQ ID NO: 219610 - DNA, 20 bp, Artificial Sequence
  Description of Artificial Sequence: Synthetic oligonucleotide
  Target: ATXN1; (-) strand; PAM type: YTN; PAM sequence: TTG
tagagctatgtggcaggtta

SEQ ID NO: 219611 - DNA, 20 bp, Artificial Sequence
  Description of Artificial Sequence: Synthetic oligonucleotide
  Target: ATXN1; (-) strand; PAM type: YTN; PAM sequence: TTA
aggtatcaaagatgcaagaa

SEQ ID NO: 219612 - DNA, 20 bp, Artificial Sequence
  Description of Artificial Sequence: Synthetic oligonucleotide
  Target: ATXN1; (-) strand; PAM type: YTN; PAM sequence: TTA
tgatatagttaaggtatcaa

SEQ ID NO: 219613 - DNA, 20 bp, Artificial Sequence
  Description of Artificial Sequence: Synthetic oligonucleotide
  Target: ATXN1; (-) strand; PAM type: YTN; PAM sequence: CTT
atgatatagttaaggtatca

SEQ ID NO: 219614 - DNA, 20 bp, Artificial Sequence
  Description of Artificial Sequence: Synthetic oligonucleotide
  Target: ATXN1; (-) strand; PAM type: YTN; PAM sequence: CTG
aatatagcttatgatatagt

SEQ ID NO: 219615 - DNA, 20 bp, Artificial Sequence
  Description of Artificial Sequence: Synthetic oligonucleotide
  Target: ATXN1; (-) strand; PAM type: YTN; PAM sequence: TTG
acaactgaatatagcttatg

SEQ ID NO: 219616 - DNA, 20 bp, Artificial Sequence
  Description of Artificial Sequence: Synthetic oligonucleotide
  Target: ATXN1; (-) strand; PAM type: YTN; PAM sequence: TTT
gacaactgaatatagcttat

SEQ ID NO: 219617 - DNA, 20 bp, Artificial Sequence
  Description of Artificial Sequence: Synthetic oligonucleotide
  Target: ATXN1; (-) strand; PAM type: YTN; PAM sequence: CTT
tgacaactgaatatagctta

SEQ ID NO: 219618 - DNA, 20 bp, Artificial Sequence
  Description of Artificial Sequence: Synthetic oligonucleotide
  Target: ATXN1; (-) strand; PAM type: YTN; PAM sequence: TTC
tttgacaactgaatatagct

SEQ ID NO: 219619 - DNA, 20 bp, Artificial Sequence
  Description of Artificial Sequence: Synthetic oligonucleotide
  Target: ATXN1; (-) strand; PAM type: YTN; PAM sequence: TTT
ctttgacaactgaatatagc

SEQ ID NO: 219620 - DNA, 20 bp, Artificial Sequence
  Description of Artificial Sequence: Synthetic oligonucleotide
  Target: ATXN1; (-) strand; PAM type: YTN; PAM sequence: TTT
tctttgacaactgaatatag

SEQ ID NO: 219621 - DNA, 20 bp, Artificial Sequence
  Description of Artificial Sequence: Synthetic oligonucleotide
  Target: ATXN1; (-) strand; PAM type: YTN; PAM sequence: CTG
ttttctttgacaactgaata

SEQ ID NO: 219622 - DNA, 20 bp, Artificial Sequence
  Description of Artificial Sequence: Synthetic oligonucleotide
  Target: ATXN1; (-) strand; PAM type: YTN; PAM sequence: TTC
tgttttctttgacaactgaa

SEQ ID NO: 219623 - DNA, 20 bp, Artificial Sequence
  Description of Artificial Sequence: Synthetic oligonucleotide
  Target: ATXN1; (-) strand; PAM type: YTN; PAM sequence: TTT
ctgttttctttgacaactga

SEQ ID NO: 219624 - DNA, 20 bp, Artificial Sequence
  Description of Artificial Sequence: Synthetic oligonucleotide
  Target: ATXN1; (-) strand; PAM type: YTN; PAM sequence: CTT
tctgttttctttgacaactg

SEQ ID NO: 219625 - DNA, 20 bp, Artificial Sequence
  Description of Artificial Sequence: Synthetic oligonucleotide
  Target: ATXN1; (-) strand; PAM type: YTN; PAM sequence: CTA
cctttctgttttctttgaca

SEQ ID NO: 219626 - DNA, 20 bp, Artificial Sequence
  Description of Artificial Sequence: Synthetic oligonucleotide
  Target: ATXN1; (-) strand; PAM type: YTN; PAM sequence: TTC
aaacagcaagaggctacctt

SEQ ID NO: 219627 - DNA, 20 bp, Artificial Sequence
  Description of Artificial Sequence: Synthetic oligonucleotide
  Target: ATXN1; (-) strand; PAM type: YTN; PAM sequence: CTT
caaacagcaagaggctacct

SEQ ID NO: 219628 - DNA, 20 bp, Artificial Sequence
  Description of Artificial Sequence: Synthetic oligonucleotide
  Target: ATXN1; (-) strand; PAM type: YTN; PAM sequence: CTC
ttcaaacagcaagaggctac

SEQ ID NO: 219629 - DNA, 20 bp, Artificial Sequence
  Description of Artificial Sequence: Synthetic oligonucleotide
  Target: ATXN1; (-) strand; PAM type: YTN; PAM sequence: TTG
ctcttcaaacagcaagaggc

SEQ ID NO: 219630 - DNA, 20 bp, Artificial Sequence
  Description of Artificial Sequence: Synthetic oligonucleotide
  Target: ATXN1; (-) strand; PAM type: YTN; PAM sequence: CTG
aggttgctcttcaaacagca

SEQ ID NO: 219631 - DNA, 20 bp, Artificial Sequence
  Description of Artificial Sequence: Synthetic oligonucleotide
  Target: ATXN1; (-) strand; PAM type: YTN; PAM sequence: CTG
aaatggaagaaccatactga

SEQ ID NO: 219632 - DNA, 20 bp, Artificial Sequence
  Description of Artificial Sequence: Synthetic oligonucleotide
  Target: ATXN1; (-) strand; PAM type: YTN; PAM sequence: TTA
accagactgaaatggaagaa

SEQ ID NO: 219633 - DNA, 20 bp, Artificial Sequence
  Description of Artificial Sequence: Synthetic oligonucleotide
  Target: ATXN1; (-) strand; PAM type: YTN; PAM sequence: TTA
aatgacgcaaattaaccaga

SEQ ID NO: 219634 - DNA, 20 bp, Artificial Sequence
  Description of Artificial Sequence: Synthetic oligonucleotide
  Target: ATXN1; (-) strand; PAM type: YTN; PAM sequence: CTA
atagttaaatgacgcaaatt

SEQ ID NO: 219635 - DNA, 20 bp, Artificial Sequence
  Description of Artificial Sequence: Synthetic oligonucleotide
  Target: ATXN1; (-) strand; PAM type: YTN; PAM sequence: CTC
taatagttaaatgacgcaaa

SEQ ID NO: 219636 - DNA, 20 bp, Artificial Sequence
  Description of Artificial Sequence: Synthetic oligonucleotide
  Target: ATXN1; (-) strand; PAM type: YTN; PAM sequence: TTC
tctaatagttaaatgacgca

SEQ ID NO: 219637 - DNA, 20 bp, Artificial Sequence
  Description of Artificial Sequence: Synthetic oligonucleotide
  Target: ATXN1; (-) strand; PAM type: YTN; PAM sequence: CTG
gaaattctctaatagttaaa

SEQ ID NO: 219638 - DNA, 20 bp, Artificial Sequence
  Description of Artificial Sequence: Synthetic oligonucleotide
  Target: ATXN1; (-) strand; PAM type: YTN; PAM sequence: TTG
gcaaatggtgctggaaattc

SEQ ID NO: 219639 - DNA, 20 bp, Artificial Sequence
  Description of Artificial Sequence: Synthetic oligonucleotide
  Target: ATXN1; (-) strand; PAM type: YTN; PAM sequence: TTA
cagcgttggcaaatggtgct

SEQ ID NO: 219640 - DNA, 20 bp, Artificial Sequence
  Description of Artificial Sequence: Synthetic oligonucleotide
  Target: ATXN1; (-) strand; PAM type: YTN; PAM sequence: TTA
ttacagcgttggcaaatggt

SEQ ID NO: 219641 - DNA, 20 bp, Artificial Sequence
  Description of Artificial Sequence: Synthetic oligonucleotide
  Target: ATXN1; (-) strand; PAM type: YTN; PAM sequence: TTT
attacagcgttggcaaatgg

SEQ ID NO: 219642 - DNA, 20 bp, Artificial Sequence
  Description of Artificial Sequence: Synthetic oligonucleotide
  Target: ATXN1; (-) strand; PAM type: YTN; PAM sequence: CTA
tttattacagcgttggcaaa

SEQ ID NO: 219643 - DNA, 20 bp, Artificial Sequence
  Description of Artificial Sequence: Synthetic oligonucleotide
  Target: ATXN1; (-) strand; PAM type: YTN; PAM sequence: TTA
taggactatttattacagcg

SEQ ID NO: 219644 - DNA, 20 bp, Artificial Sequence
  Description of Artificial Sequence: Synthetic oligonucleotide
  Target: ATXN1; (-) strand; PAM type: YTN; PAM sequence: TTT
ataggactatttattacagc

SEQ ID NO: 219645 - DNA, 20 bp, Artificial Sequence
  Description of Artificial Sequence: Synthetic oligonucleotide
  Target: ATXN1; (-) strand; PAM type: YTN; PAM sequence: TTC
agtttataggactatttatt

SEQ ID NO: 219646 - DNA, 20 bp, Artificial Sequence
  Description of Artificial Sequence: Synthetic oligonucleotide
  Target: ATXN1; (-) strand; PAM type: YTN; PAM sequence: TTG
caaaaagacattcagtttat

SEQ ID NO: 219647 - DNA, 20 bp, Artificial Sequence
  Description of Artificial Sequence: Synthetic oligonucleotide
  Target: ATXN1; (-) strand; PAM type: YTN; PAM sequence: TTA
caattgcaaaaagacattca

SEQ ID NO: 219648 - DNA, 20 bp, Artificial Sequence
  Description of Artificial Sequence: Synthetic oligonucleotide
  Target: ATXN1; (-) strand; PAM type: YTN; PAM sequence: TTT
acaattgcaaaaagacattc

SEQ ID NO: 219649 - DNA, 20 bp, Artificial Sequence
  Description of Artificial Sequence: Synthetic oligonucleotide
  Target: ATXN1; (-) strand; PAM type: YTN; PAM sequence: CTT
tacaattgcaaaaagacatt

SEQ ID NO: 219650 - DNA, 20 bp, Artificial Sequence
  Description of Artificial Sequence: Synthetic oligonucleotide
  Target: ATXN1; (-) strand; PAM type: YTN; PAM sequence: TTC
agggaaaaccctttacaatt

SEQ ID NO: 219651 - DNA, 20 bp, Artificial Sequence
  Description of Artificial Sequence: Synthetic oligonucleotide
  Target: ATXN1; (-) strand; PAM type: YTN; PAM sequence: TTT
cagggaaaaccctttacaat

SEQ ID NO: 219652 - DNA, 20 bp, Artificial Sequence
  Description of Artificial Sequence: Synthetic oligonucleotide
  Target: ATXN1; (-) strand; PAM type: YTN; PAM sequence: CTG
agtagtttcagggaaaaccc

SEQ ID NO: 219653 - DNA, 20 bp, Artificial Sequence
  Description of Artificial Sequence: Synthetic oligonucleotide
  Target: ATXN1; (-) strand; PAM type: YTN; PAM sequence: TTA
ccactgagtagtttcaggga

SEQ ID NO: 219654 - DNA, 20 bp, Artificial Sequence
  Description of Artificial Sequence: Synthetic oligonucleotide
  Target: ATXN1; (-) strand; PAM type: YTN; PAM sequence: CTT
accactgagtagtttcaggg

SEQ ID NO: 219655 - DNA, 20 bp, Artificial Sequence
  Description of Artificial Sequence: Synthetic oligonucleotide
  Target: ATXN1; (-) strand; PAM type: YTN; PAM sequence: TTC
cttaccactgagtagtttca

SEQ ID NO: 219656 - DNA, 20 bp, Artificial Sequence
  Description of Artificial Sequence: Synthetic oligonucleotide
  Target: ATXN1; (-) strand; PAM type: YTN; PAM sequence: TTT
ccttaccactgagtagtttc

SEQ ID NO: 219657 - DNA, 20 bp, Artificial Sequence
  Description of Artificial Sequence: Synthetic oligonucleotide
  Target: ATXN1; (-) strand; PAM type: YTN; PAM sequence: TTT
tccttaccactgagtagttt

SEQ ID NO: 219658 - DNA, 20 bp, Artificial Sequence
  Description of Artificial Sequence: Synthetic oligonucleotide
  Target: ATXN1; (-) strand; PAM type: YTN; PAM sequence: CTT
ttccttaccactgagtagtt

SEQ ID NO: 219659 - DNA, 20 bp, Artificial Sequence
  Description of Artificial Sequence: Synthetic oligonucleotide
  Target: ATXN1; (-) strand; PAM type: YTN; PAM sequence: TTC
ttttccttaccactgagtag

SEQ ID NO: 219660 - DNA, 20 bp, Artificial Sequence
  Description of Artificial Sequence: Synthetic oligonucleotide
  Target: ATXN1; (-) strand; PAM type: YTN; PAM sequence: TTG
ttcttttccttaccactgag

SEQ ID NO: 219661 - DNA, 20 bp, Artificial Sequence
  Description of Artificial Sequence: Synthetic oligonucleotide
  Target: ATXN1; (-) strand; PAM type: YTN; PAM sequence: CTT
gttcttttccttaccactga

SEQ ID NO: 219662 - DNA, 20 bp, Artificial Sequence
  Description of Artificial Sequence: Synthetic oligonucleotide
  Target: ATXN1; (-) strand; PAM type: YTN; PAM sequence: TTC
agtatcttgttcttttcctt

SEQ ID NO: 219663 - DNA, 20 bp, Artificial Sequence
  Description of Artificial Sequence: Synthetic oligonucleotide
  Target: ATXN1; (-) strand; PAM type: YTN; PAM sequence: TTA
ttcagtatcttgttcttttc

SEQ ID NO: 219664 - DNA, 20 bp, Artificial Sequence
  Description of Artificial Sequence: Synthetic oligonucleotide
  Target: ATXN1; (-) strand; PAM type: YTN; PAM sequence: CTT
attcagtatcttgttctttt

SEQ ID NO: 219665 - DNA, 20 bp, Artificial Sequence
  Description of Artificial Sequence: Synthetic oligonucleotide
  Target: ATXN1; (-) strand; PAM type: YTN; PAM sequence: CTA
tcttattcagtatcttgttc

SEQ ID NO: 219666 - DNA, 20 bp, Artificial Sequence
  Description of Artificial Sequence: Synthetic oligonucleotide
  Target: ATXN1; (-) strand; PAM type: YTN; PAM sequence: CTG
tggctatcttattcagtatc

SEQ ID NO: 219667 - DNA, 20 bp, Artificial Sequence
  Description of Artificial Sequence: Synthetic oligonucleotide
  Target: ATXN1; (-) strand; PAM type: YTN; PAM sequence: TTC
aaaaaaaaaaaaaaaaaaaa

SEQ ID NO: 219668 - DNA, 20 bp, Artificial Sequence
  Description of Artificial Sequence: Synthetic oligonucleotide
  Target: ATXN1; (-) strand; PAM type: YTN; PAM sequence: TTT
caaaaaaaaaaaaaaaaaaa

SEQ ID NO: 219669 - DNA, 20 bp, Artificial Sequence
  Description of Artificial Sequence: Synthetic oligonucleotide
  Target: ATXN1; (-) strand; PAM type: YTN; PAM sequence: CTC
catttcaaaaaaaaaaaaaa

SEQ ID NO: 219670 - DNA, 20 bp, Artificial Sequence
  Description of Artificial Sequence: Synthetic oligonucleotide
  Target: ATXN1; (-) strand; PAM type: YTN; PAM sequence: CTG
ggcaacaagagcaaaactcc

SEQ ID NO: 219671 - DNA, 20 bp, Artificial Sequence
  Description of Artificial Sequence: Synthetic oligonucleotide
  Target: ATXN1; (-) strand; PAM type: YTN; PAM sequence: CTA
cagcctgggcaacaagagca

SEQ ID NO: 219672 - DNA, 20 bp, Artificial Sequence
  Description of Artificial Sequence: Synthetic oligonucleotide
  Target: ATXN1; (-) strand; PAM type: YTN; PAM sequence: TTG
cactacagcctgggcaacaa

SEQ ID NO: 219673 - DNA, 20 bp, Artificial Sequence
  Description of Artificial Sequence: Synthetic oligonucleotide
  Target: ATXN1; (-) strand; PAM type: YTN; PAM sequence: TTG
caccattgcactacagcctg

SEQ ID NO: 219674 - DNA, 20 bp, Artificial Sequence
  Description of Artificial Sequence: Synthetic oligonucleotide
  Target: ATXN1; (-) strand; PAM type: YTN; PAM sequence: TTG
cagcgagccgacattgcacc

SEQ ID NO: 219675 - DNA, 20 bp, Artificial Sequence
  Description of Artificial Sequence: Synthetic oligonucleotide
  Target: ATXN1; (-) strand; PAM type: YTN; PAM sequence: TTG
aacccgggaggcagaggttg

SEQ ID NO: 219676 - DNA, 20 bp, Artificial Sequence
  Description of Artificial Sequence: Synthetic oligonucleotide
  Target: ATXN1; (-) strand; PAM type: YTN; PAM sequence: CTT
gaacccgggaggcagaggtt

SEQ ID NO: 219677 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgcttgaa

SEQ ID NO: 219678 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagaat

SEQ ID NO: 219679 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagaa

SEQ ID NO: 219680 - DNA, 20 bp, Artificial Sequence
  Description of Artificial Sequence: Synthetic oligonucleotide
  Target: ATXN1; (-) strand; PAM type: YTN; PAM sequence: CTG
cttgggaggctgaggcagga

SEQ ID NO: 219681 - DNA, 20 bp, Artificial Sequence
  Description of Artificial Sequence: Synthetic oligonucleotide
  Target: ATXN1; (-) strand; PAM type: YTN; PAM sequence: CTG
taatcccagctgcttgggag

SEQ ID NO: 219682 - DNA, 20 bp, Artificial Sequence
  Description of Artificial Sequence: Synthetic oligonucleotide
  Target: ATXN1; (-) strand; PAM type: YTN; PAM sequence: TTA
gccaggcatggtggtggacg

SEQ ID NO: 219683 - DNA, 20 bp, Artificial Sequence
  Description of Artificial Sequence: Synthetic oligonucleotide
  Target: ATXN1; (-) strand; PAM type: YTN; PAM sequence: TTA
attagccaggcatggtggtg

SEQ ID NO: 219684 - DNA, 20 bp, Artificial Sequence
  Description of Artificial Sequence: Synthetic oligonucleotide
  Target: ATXN1; (-) strand; PAM type: YTN; PAM sequence: CTA
aagattaattagccaggcat

SEQ ID NO: 219685 - DNA, 20 bp, Artificial Sequence
  Description of Artificial Sequence: Synthetic oligonucleotide
  Target: ATXN1; (-) strand; PAM type: YTN; PAM sequence: CTA
ctaaagattaattagccagg

SEQ ID NO: 219686 - DNA, 20 bp, Artificial Sequence
  Description of Artificial Sequence: Synthetic oligonucleotide
  Target: ATXN1; (-) strand; PAM type: YTN; PAM sequence: CTC
tactaaagattaattagcca

SEQ ID NO: 219687 - DNA, 20 bp, Artificial Sequence
  Description of Artificial Sequence: Synthetic oligonucleotide
  Target: ATXN1; (-) strand; PAM type: YTN; PAM sequence: CTG
accaacatggtgaaaccccg

SEQ ID NO: 219688 - DNA, 20 bp, Artificial Sequence
  Description of Artificial Sequence: Synthetic oligonucleotide
  Target: ATXN1; (-) strand; PAM type: YTN; PAM sequence: TTA
gagaccagcctgaccaacat

SEQ ID NO: 219689 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttagagacca

SEQ ID NO: 219690 - DNA, 20 bp, Artificial Sequence
  Description of Artificial Sequence: Synthetic oligonucleotide
  Target: ATXN1; (-) strand; PAM type: YTN; PAM sequence: TTC
gggaggccgaggtgggtgga

SEQ ID NO: 219691 - DNA, 20 bp, Artificial Sequence
  Description of Artificial Sequence: Synthetic oligonucleotide
  Target: ATXN1; (-) strand; PAM type: YTN; PAM sequence: CTT
cgggaggccgaggtgggtgg

SEQ ID NO: 219692 - DNA, 20 bp, Artificial Sequence
  Description of Artificial Sequence: Synthetic oligonucleotide
  Target: ATXN1; (-) strand; PAM type: YTN; PAM sequence: CTA
gcacttcgggaggccgaggt

SEQ ID NO: 219693 - DNA, 20 bp, Artificial Sequence
  Description of Artificial Sequence: Synthetic oligonucleotide
  Target: ATXN1; (-) strand; PAM type: YTN; PAM sequence: CTG
taatcctagcacttcgggag

SEQ ID NO: 219694 - DNA, 20 bp, Artificial Sequence
  Description of Artificial Sequence: Synthetic oligonucleotide
  Target: ATXN1; (-) strand; PAM type: YTN; PAM sequence: CTG
cctgtaatcctagcacttcg

SEQ ID NO: 219695 - DNA, 20 bp, Artificial Sequence
  Description of Artificial Sequence: Synthetic oligonucleotide
  Target: ATXN1; (-) strand; PAM type: YTN; PAM sequence: CTC
ctgcctgtaatcctagcact

SEQ ID NO: 219696 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaatccagccgggca

SEQ ID NO: 219697 - DNA, 20 bp, Artificial Sequence
  Description of Artificial Sequence: Synthetic oligonucleotide
  Target: ATXN1; (-) strand; PAM type: YTN; PAM sequence: CTA
tattaaaaaaaaatccagcc

SEQ ID NO: 219698 - DNA, 20 bp, Artificial Sequence
  Description of Artificial Sequence: Synthetic oligonucleotide
  Target: ATXN1; (-) strand; PAM type: YTN; PAM sequence: TTC
ctatattaaaaaaaaatcca

SEQ ID NO: 219699 - DNA, 20 bp, Artificial Sequence
  Description of Artificial Sequence: Synthetic oligonucleotide
  Target: ATXN1; (-) strand; PAM type: YTN; PAM sequence: TTT
cctatattaaaaaaaaatcc

SEQ ID NO: 219700 - DNA, 20 bp, Artificial Sequence
  Description of Artificial Sequence: Synthetic oligonucleotide
  Target: ATXN1; (-) strand; PAM type: YTN; PAM sequence: TTT
tcctatattaaaaaaaaatc

SEQ ID NO: 219701 - DNA, 20 bp, Artificial Sequence
  Description of Artificial Sequence: Synthetic oligonucleotide
  Target: ATXN1; (-) strand; PAM type: YTN; PAM sequence: TTT
ttcctatattaaaaaaaaat

SEQ ID NO: 219702 - DNA, 20 bp, Artificial Sequence
  Description of Artificial Sequence: Synthetic oligonucleotide
  Target: ATXN1; (-) strand; PAM type: YTN; PAM sequence: TTT
tttcctatattaaaaaaaaa

SEQ ID NO: 219703 - DNA, 20 bp, Artificial Sequence
  Description of Artificial Sequence: Synthetic oligonucleotide
  Target: ATXN1; (-) strand; PAM type: YTN; PAM sequence: TTG
attttttcctatattaaaaa

SEQ ID NO: 219704 - DNA, 20 bp, Artificial Sequence
  Description of Artificial Sequence: Synthetic oligonucleotide
  Target: ATXN1; (-) strand; PAM type: YTN; PAM sequence: CTG
aaaattgattttttcctata

SEQ ID NO: 219705 - DNA, 20 bp, Artificial Sequence
  Description of Artificial Sequence: Synthetic oligonucleotide
  Target: ATXN1; (-) strand; PAM type: YTN; PAM sequence: TTG
ccaactgaaaattgattttt

SEQ ID NO: 219706 - DNA, 20 bp, Artificial Sequence
  Description of Artificial Sequence: Synthetic oligonucleotide
  Target: ATXN1; (-) strand; PAM type: YTN; PAM sequence: CTA
ttgccaactgaaaattgatt

SEQ ID NO: 219707 - DNA, 20 bp, Artificial Sequence
  Description of Artificial Sequence: Synthetic oligonucleotide
  Target: ATXN1; (-) strand; PAM type: YTN; PAM sequence: TTC
tattgccaactgaaaattga

SEQ ID NO: 219708 - DNA, 20 bp, Artificial Sequence
  Description of Artificial Sequence: Synthetic oligonucleotide
  Target: ATXN1; (-) strand; PAM type: YTN; PAM sequence: TTT
ctattgccaactgaaaattg

SEQ ID NO: 219709 - DNA, 20 bp, Artificial Sequence
  Description of Artificial Sequence: Synthetic oligonucleotide
  Target: ATXN1; (-) strand; PAM type: YTN; PAM sequence: CTT
tctattgccaactgaaaatt

SEQ ID NO: 219710 - DNA, 20 bp, Artificial Sequence
  Description of Artificial Sequence: Synthetic oligonucleotide
  Target: ATXN1; (-) strand; PAM type: YTN; PAM sequence: TTA
gtgactttctattgccaact

SEQ ID NO: 219711 - DNA, 20 bp, Artificial Sequence
  Description of Artificial Sequence: Synthetic oligonucleotide
  Target: ATXN1; (-) strand; PAM type: YTN; PAM sequence: CTT
agtgactttctattgccaac

SEQ ID NO: 219712 - DNA, 20 bp, Artificial Sequence
  Description of Artificial Sequence: Synthetic oligonucleotide
  Target: ATXN1; (-) strand; PAM type: YTN; PAM sequence: TTG
aatccttagtgactttctat

SEQ ID NO: 219713 - DNA, 20 bp, Artificial Sequence
  Description of Artificial Sequence: Synthetic oligonucleotide
  Target: ATXN1; (-) strand; PAM type: YTN; PAM sequence: TTT
gaatccttagtgactttcta

SEQ ID NO: 219714 - DNA, 20 bp, Artificial Sequence
  Description of Artificial Sequence: Synthetic oligonucleotide
  Target: ATXN1; (-) strand; PAM type: YTN; PAM sequence: TTC
gtacagtttgaatccttagt

SEQ ID NO: 219715 - DNA, 20 bp, Artificial Sequence
  Description of Artificial Sequence: Synthetic oligonucleotide
  Target: ATXN1; (-) strand; PAM type: YTN; PAM sequence: CTT
cgtacagtttgaatccttag

SEQ ID NO: 219716 - DNA, 20 bp, Artificial Sequence
  Description of Artificial Sequence: Synthetic oligonucleotide
  Target: ATXN1; (-) strand; PAM type: YTN; PAM sequence: CTG
aaacacttcgtacagtttga

SEQ ID NO: 219717 - DNA, 20 bp, Artificial Sequence
  Description of Artificial Sequence: Synthetic oligonucleotide
  Target: ATXN1; (-) strand; PAM type: YTN; PAM sequence: CTA
ctgaaacacttcgtacagtt

SEQ ID NO: 219718 - DNA, 20 bp, Artificial Sequence
  Description of Artificial Sequence: Synthetic oligonucleotide
  Target: ATXN1; (-) strand; PAM type: YTN; PAM sequence: TTC
ctactgaaacacttcgtaca

SEQ ID NO: 219719 - DNA, 20 bp, Artificial Sequence
  Description of Artificial Sequence: Synthetic oligonucleotide
  Target: ATXN1; (-) strand; PAM type: YTN; PAM sequence: TTG
ccggttcctactgaaacact

SEQ ID NO: 219720 - DNA, 20 bp, Artificial Sequence
  Description of Artificial Sequence: Synthetic oligonucleotide
  Target: ATXN1; (-) strand; PAM type: YTN; PAM sequence: CTT
gccggttcctactgaaacac

SEQ ID NO: 219721 - DNA, 20 bp, Artificial Sequence
  Description of Artificial Sequence: Synthetic oligonucleotide
  Target: ATXN1; (-) strand; PAM type: YTN; PAM sequence: TTG
gtcttgccggttcctactga

SEQ ID NO: 219722 - DNA, 20 bp, Artificial Sequence
  Description of Artificial Sequence: Synthetic oligonucleotide
  Target: ATXN1; (-) strand; PAM type: YTN; PAM sequence: TTT
ggtcttgccggttcctactg

SEQ ID NO: 219723 - DNA, 20 bp, Artificial Sequence
  Description of Artificial Sequence: Synthetic oligonucleotide
  Target: ATXN1; (-) strand; PAM type: YTN; PAM sequence: TTT
tggtcttgccggttcctact

SEQ ID NO: 219724 - DNA, 20 bp, Artificial Sequence
  Description of Artificial Sequence: Synthetic oligonucleotide
  Target: ATXN1; (-) strand; PAM type: YTN; PAM sequence: TTT
ttggtcttgccggttcctac

SEQ ID NO: 219725 - DNA, 20 bp, Artificial Sequence
  Description of Artificial Sequence: Synthetic oligonucleotide
  Target: ATXN1; (-) strand; PAM type: YTN; PAM sequence: TTT
tttggtcttgccggttccta

SEQ ID NO: 219726 - DNA, 20 bp, Artificial Sequence
  Description of Artificial Sequence: Synthetic oligonucleotide
  Target: ATXN1; (-) strand; PAM type: YTN; PAM sequence: TTA
aaaaattttttggtcttgcc

SEQ ID NO: 219727 - DNA, 20 bp, Artificial Sequence
  Description of Artificial Sequence: Synthetic oligonucleotide
  Target: ATXN1; (-) strand; PAM type: YTN; PAM sequence: TTT
aaaaaattttttggtcttgc

SEQ ID NO: 219728 - DNA, 20 bp, Artificial Sequence
  Description of Artificial Sequence: Synthetic oligonucleotide
  Target: ATXN1; (-) strand; PAM type: YTN; PAM sequence: TTT
taaaaaattttttggtcttg

SEQ ID NO: 219729 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaattttttggtctt

SEQ ID NO: 219730 - DNA, 20 bp, Artificial Sequence
  Description of Artificial Sequence: Synthetic oligonucleotide
  Target: ATXN1; (-) strand; PAM type: YTN; PAM sequence: CTT
tttaaaaaattttttggtct

SEQ ID NO: 219731 - DNA, 20 bp, Artificial Sequence
  Description of Artificial Sequence: Synthetic oligonucleotide
  Target: ATXN1; (-) strand; PAM type: YTN; PAM sequence: TTC
tttttaaaaaattttttggt

SEQ ID NO: 219732 - DNA, 20 bp, Artificial Sequence
  Description of Artificial Sequence: Synthetic oligonucleotide
  Target: ATXN1; (-) strand; PAM type: YTN; PAM sequence: TTC
aaaagttctttttaaaaaat

SEQ ID NO: 219733 - DNA, 20 bp, Artificial Sequence
  Description of Artificial Sequence: Synthetic oligonucleotide
  Target: ATXN1; (-) strand; PAM type: YTN; PAM sequence: TTA
tataattcaaaagttctttt

SEQ ID NO: 219734 - DNA, 20 bp, Artificial Sequence
  Description of Artificial Sequence: Synthetic oligonucleotide
  Target: ATXN1; (-) strand; PAM type: YTN; PAM sequence: TTT
atataattcaaaagttcttt

SEQ ID NO: 219735 - DNA, 20 bp, Artificial Sequence
  Description of Artificial Sequence: Synthetic oligonucleotide
  Target: ATXN1; (-) strand; PAM type: YTN; PAM sequence: TTT
tatataattcaaaagttctt

SEQ ID NO: 219736 - DNA, 20 bp, Artificial Sequence
  Description of Artificial Sequence: Synthetic oligonucleotide
  Target: ATXN1; (-) strand; PAM type: YTN; PAM sequence: CTG
tattttatataattcaaaag

SEQ ID NO: 219737 - DNA, 20 bp, Artificial Sequence
  Description of Artificial Sequence: Synthetic oligonucleotide
  Target: ATXN1; (-) strand; PAM type: YTN; PAM sequence: TTA
tagggacaatagtcactgta

SEQ ID NO: 219738 - DNA, 20 bp, Artificial Sequence
  Description of Artificial Sequence: Synthetic oligonucleotide
  Target: ATXN1; (-) strand; PAM type: YTN; PAM sequence: TTA
taataattatagggacaata

SEQ ID NO: 219739 - DNA, 20 bp, Artificial Sequence
  Description of Artificial Sequence: Synthetic oligonucleotide
  Target: ATXN1; (-) strand; PAM type: YTN; PAM sequence: TTG
ttataataattatagggaca

SEQ ID NO: 219740 - DNA, 20 bp, Artificial Sequence
  Description of Artificial Sequence: Synthetic oligonucleotide
  Target: ATXN1; (-) strand; PAM type: YTN; PAM sequence: TTT
gttataataattatagggac

SEQ ID NO: 219741 - DNA, 20 bp, Artificial Sequence
  Description of Artificial Sequence: Synthetic oligonucleotide
  Target: ATXN1; (-) strand; PAM type: YTN; PAM sequence: TTA
atttgttataataattatag

SEQ ID NO: 219742 - DNA, 20 bp, Artificial Sequence
  Description of Artificial Sequence: Synthetic oligonucleotide
  Target: ATXN1; (-) strand; PAM type: YTN; PAM sequence: CTT
aatttgttataataattata

SEQ ID NO: 219743 - DNA, 20 bp, Artificial Sequence
  Description of Artificial Sequence: Synthetic oligonucleotide
  Target: ATXN1; (-) strand; PAM type: YTN; PAM sequence: CTA
tgccacagaaagaatagaaa

SEQ ID NO: 219744 - DNA, 20 bp, Artificial Sequence
  Description of Artificial Sequence: Synthetic oligonucleotide
  Target: ATXN1; (-) strand; PAM type: YTN; PAM sequence: TTC
acatgtctatgccacagaaa

SEQ ID NO: 219745 - DNA, 20 bp, Artificial Sequence
  Description of Artificial Sequence: Synthetic oligonucleotide
  Target: ATXN1; (-) strand; PAM type: YTN; PAM sequence: TTT
cacatgtctatgccacagaa

SEQ ID NO: 219746 - DNA, 20 bp, Artificial Sequence
  Description of Artificial Sequence: Synthetic oligonucleotide
  Target: ATXN1; (-) strand; PAM type: YTN; PAM sequence: CTG
tatttcacatgtctatgcca

SEQ ID NO: 219747 - DNA, 20 bp, Artificial Sequence
  Description of Artificial Sequence: Synthetic oligonucleotide
  Target: ATXN1; (-) strand; PAM type: YTN; PAM sequence: TTC
tgtatttcacatgtctatgc

SEQ ID NO: 219748 - DNA, 20 bp, Artificial Sequence
  Description of Artificial Sequence: Synthetic oligonucleotide
  Target: ATXN1; (-) strand; PAM type: YTN; PAM sequence: CTT
ctgtatttcacatgtctatg

SEQ ID NO: 219749 - DNA, 20 bp, Artificial Sequence
  Description of Artificial Sequence: Synthetic oligonucleotide
  Target: ATXN1; (-) strand; PAM type: YTN; PAM sequence: CTC
cttctgtatttcacatgtct

SEQ ID NO: 219750 - DNA, 20 bp, Artificial Sequence
  Description of Artificial Sequence: Synthetic oligonucleotide
  Target: ATXN1; (-) strand; PAM type: YTN; PAM sequence: TTC
tccttctgtatttcacatgt

SEQ ID NO: 219751 - DNA, 20 bp, Artificial Sequence
  Description of Artificial Sequence: Synthetic oligonucleotide
  Target: ATXN1; (-) strand; PAM type: YTN; PAM sequence: TTT
ctccttctgtatttcacatg

SEQ ID NO: 219752 - DNA, 20 bp, Artificial Sequence
  Description of Artificial Sequence: Synthetic oligonucleotide
  Target: ATXN1; (-) strand; PAM type: YTN; PAM sequence: CTT
tctccttctgtatttcacat

SEQ ID NO: 219753 - DNA, 20 bp, Artificial Sequence
  Description of Artificial Sequence: Synthetic oligonucleotide
  Target: ATXN1; (-) strand; PAM type: YTN; PAM sequence: TTC
tttctccttctgtatttcac

SEQ ID NO: 219754 - DNA, 20 bp, Artificial Sequence
  Description of Artificial Sequence: Synthetic oligonucleotide
  Target: ATXN1; (-) strand; PAM type: YTN; PAM sequence: TTT
ctttctccttctgtatttca

SEQ ID NO: 219755 - DNA, 20 bp, Artificial Sequence
  Description of Artificial Sequence: Synthetic oligonucleotide
  Target: ATXN1; (-) strand; PAM type: YTN; PAM sequence: TTG
aggcaggagtgcagcgagaa

SEQ ID NO: 219756 - DNA, 20 bp, Artificial Sequence
  Description of Artificial Sequence: Synthetic oligonucleotide
  Target: ATXN1; (-) strand; PAM type: YTN; PAM sequence: TTG
tattgaggcaggagtgcagc

SEQ ID NO: 219757 - DNA, 20 bp, Artificial Sequence
  Description of Artificial Sequence: Synthetic oligonucleotide
  Target: ATXN1; (-) strand; PAM type: YTN; PAM sequence: TTT
gtattgaggcaggagtgcag

SEQ ID NO: 219758 - DNA, 20 bp, Artificial Sequence
  Description of Artificial Sequence: Synthetic oligonucleotide
  Target: ATXN1; (-) strand; PAM type: YTN; PAM sequence: CTA
aatttgtattgaggcaggag

SEQ ID NO: 219759 - DNA, 20 bp, Artificial Sequence
  Description of Artificial Sequence: Synthetic oligonucleotide
  Target: ATXN1; (-) strand; PAM type: YTN; PAM sequence: TTC
taaatttgtattgaggcagg

SEQ ID NO: 219760 - DNA, 20 bp, Artificial Sequence
  Description of Artificial Sequence: Synthetic oligonucleotide
  Target: ATXN1; (-) strand; PAM type: YTN; PAM sequence: TTC
ccggcacagtgccattctaa

SEQ ID NO: 219761 - DNA, 20 bp, Artificial Sequence
  Description of Artificial Sequence: Synthetic oligonucleotide
  Target: ATXN1; (-) strand; PAM type: YTN; PAM sequence: CTT
cccggcacagtgccattcta

SEQ ID NO: 219762 - DNA, 20 bp, Artificial Sequence
  Description of Artificial Sequence: Synthetic oligonucleotide
  Target: ATXN1; (-) strand; PAM type: YTN; PAM sequence: TTC
ttcccggcacagtgccattc

SEQ ID NO: 219763 - DNA, 20 bp, Artificial Sequence
  Description of Artificial Sequence: Synthetic oligonucleotide
  Target: ATXN1; (-) strand; PAM type: YTN; PAM sequence: TTT
cttcccggcacagtgccatt

SEQ ID NO: 219764 - DNA, 20 bp, Artificial Sequence
  Description of Artificial Sequence: Synthetic oligonucleotide
  Target: ATXN1; (-) strand; PAM type: YTN; PAM sequence: TTG
caccacccagcaccagtttc

SEQ ID NO: 219765 - DNA, 20 bp, Artificial Sequence
  Description of Artificial Sequence: Synthetic oligonucleotide
  Target: ATXN1; (-) strand; PAM type: YTN; PAM sequence: CTT
gcaccacccagcaccagttt

SEQ ID NO: 219766 - DNA, 20 bp, Artificial Sequence
  Description of Artificial Sequence: Synthetic oligonucleotide
  Target: ATXN1; (-) strand; PAM type: YTN; PAM sequence: CTG
atacttgcaccacccagcac

SEQ ID NO: 219767 - DNA, 20 bp, Artificial Sequence
  Description of Artificial Sequence: Synthetic oligonucleotide
  Target: ATXN1; (-) strand; PAM type: YTN; PAM sequence: CTA
agacatgagactgatacttg

SEQ ID NO: 219768 - DNA, 20 bp, Artificial Sequence
  Description of Artificial Sequence: Synthetic oligonucleotide
  Target: ATXN1; (-) strand; PAM type: YTN; PAM sequence: TTC
ctaagacatgagactgatac

SEQ ID NO: 219769 - DNA, 20 bp, Artificial Sequence
  Description of Artificial Sequence: Synthetic oligonucleotide
  Target: ATXN1; (-) strand; PAM type: YTN; PAM sequence: CTT
cctaagacatgagactgata

SEQ ID NO: 219770 - DNA, 20 bp, Artificial Sequence
  Description of Artificial Sequence: Synthetic oligonucleotide
  Target: ATXN1; (-) strand; PAM type: YTN; PAM sequence: CTG
cgtgatgagcatcatcttcc

SEQ ID NO: 219771 - DNA, 20 bp, Artificial Sequence
  Description of Artificial Sequence: Synthetic oligonucleotide
  Target: ATXN1; (-) strand; PAM type: YTN; PAM sequence: CTG
ctgcgtgatgagcatcatct

SEQ ID NO: 219772 - DNA, 20 bp, Artificial Sequence
  Description of Artificial Sequence: Synthetic oligonucleotide
  Target: ATXN1; (-) strand; PAM type: YTN; PAM sequence: CTG
gctgctgcgtgatgagcatc

SEQ ID NO: 219773 - DNA, 20 bp, Artificial Sequence
  Description of Artificial Sequence: Synthetic oligonucleotide
  Target: ATXN1; (-) strand; PAM type: YTN; PAM sequence: CTC
ctggctgctgcgtgatgagc

SEQ ID NO: 219774 - DNA, 20 bp, Artificial Sequence
  Description of Artificial Sequence: Synthetic oligonucleotide
  Target: ATXN1; (-) strand; PAM type: YTN; PAM sequence: TTA
aaaaacatgctcctggctgc

SEQ ID NO: 219775 - DNA, 20 bp, Artificial Sequence
  Description of Artificial Sequence: Synthetic oligonucleotide
  Target: ATXN1; (-) strand; PAM type: YTN; PAM sequence: CTA
aataaataaataaataaata

SEQ ID NO: 219776 - DNA, 20 bp, Artificial Sequence
  Description of Artificial Sequence: Synthetic oligonucleotide
  Target: ATXN1; (-) strand; PAM type: YTN; PAM sequence: CTC
taaataaataaataaataaa

SEQ ID NO: 219777 - DNA, 20 bp, Artificial Sequence
  Description of Artificial Sequence: Synthetic oligonucleotide
  Target: ATXN1; (-) strand; PAM type: YTN; PAM sequence: CTG
tctctaaataaataaataaa

SEQ ID NO: 219778 - DNA, 20 bp, Artificial Sequence
  Description of Artificial Sequence: Synthetic oligonucleotide
  Target: ATXN1; (-) strand; PAM type: YTN; PAM sequence: CTA
agtgacagagcaagaccctg

SEQ ID NO: 219779 - DNA, 20 bp, Artificial Sequence
  Description of Artificial Sequence: Synthetic oligonucleotide
  Target: ATXN1; (-) strand; PAM type: YTN; PAM sequence: CTC
cagcctaagtgacagagcaa

SEQ ID NO: 219780 - DNA, 20 bp, Artificial Sequence
  Description of Artificial Sequence: Synthetic oligonucleotide
  Target: ATXN1; (-) strand; PAM type: YTN; PAM sequence: CTA
cactccagcctaagtgacag

SEQ ID NO: 219781 - DNA, 20 bp, Artificial Sequence
  Description of Artificial Sequence: Synthetic oligonucleotide
  Target: ATXN1; (-) strand; PAM type: YTN; PAM sequence: CTA
tgatcacaccactacactcc

SEQ ID NO: 219782 - DNA, 20 bp, Artificial Sequence
  Description of Artificial Sequence: Synthetic oligonucleotide
  Target: ATXN1; (-) strand; PAM type: YTN; PAM sequence: TTG
ccgtgagctatgatcacacc

SEQ ID NO: 219783 - DNA, 20 bp, Artificial Sequence
  Description of Artificial Sequence: Synthetic oligonucleotide
  Target: ATXN1; (-) strand; PAM type: YTN; PAM sequence: TTC
gaggttgccgtgagctatga

SEQ ID NO: 219784 - DNA, 20 bp, Artificial Sequence
  Description of Artificial Sequence: Synthetic oligonucleotide
  Target: ATXN1; (-) strand; PAM type: YTN; PAM sequence: TTG
aggagttcgaggttgccgtg

SEQ ID NO: 219785 - DNA, 20 bp, Artificial Sequence
  Description of Artificial Sequence: Synthetic oligonucleotide
  Target: ATXN1; (-) strand; PAM type: YTN; PAM sequence: TTG
agttgaggagttcgaggttg

SEQ ID NO: 219786 - DNA, 20 bp, Artificial Sequence
  Description of Artificial Sequence: Synthetic oligonucleotide
  Target: ATXN1; (-) strand; PAM type: YTN; PAM sequence: CTT
gagttgaggagttcgaggtt

SEQ ID NO: 219787 - DNA, 20 bp, Artificial Sequence
  Description of Artificial Sequence: Synthetic oligonucleotide
  Target: ATXN1; (-) strand; PAM type: YTN; PAM sequence: CTG
cttgagttgaggagttcgag

SEQ ID NO: 219788 - DNA, 20 bp, Artificial Sequence
  Description of Artificial Sequence: Synthetic oligonucleotide
  Target: ATXN1; (-) strand; PAM type: YTN; PAM sequence: CTG
ggaggactgcttgagttgag

SEQ ID NO: 219789 - DNA, 20 bp, Artificial Sequence
  Description of Artificial Sequence: Synthetic oligonucleotide
  Target: ATXN1; (-) strand; PAM type: YTN; PAM sequence: CTG
agctgggaggactgcttgag

SEQ ID NO: 219790 - DNA, 20 bp, Artificial Sequence
  Description of Artificial Sequence: Synthetic oligonucleotide
  Target: ATXN1; (-) strand; PAM type: YTN; PAM sequence: TTG
ggaggctgagctgggaggac

SEQ ID NO: 219791 - DNA, 20 bp, Artificial Sequence
  Description of Artificial Sequence: Synthetic oligonucleotide
  Target: ATXN1; (-) strand; PAM type: YTN; PAM sequence: CTT
gggaggctgagctgggagga

SEQ ID NO: 219792 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgagctggga

SEQ ID NO: 219793 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacttgggag

SEQ ID NO: 219794 - DNA, 20 bp, Artificial Sequence
  Description of Artificial Sequence: Synthetic oligonucleotide
  Target: ATXN1; (-) strand; PAM type: YTN; PAM sequence: CTG
gccggacatgatgggtcaca

SEQ ID NO: 219795 - DNA, 20 bp, Artificial Sequence
  Description of Artificial Sequence: Synthetic oligonucleotide
  Target: ATXN1; (-) strand; PAM type: YTN; PAM sequence: TTC
ctggccggacatgatgggtc

SEQ ID NO: 219796 - DNA, 20 bp, Artificial Sequence
  Description of Artificial Sequence: Synthetic oligonucleotide
  Target: ATXN1; (-) strand; PAM type: YTN; PAM sequence: TTC
catcagtatggatcaaaaac

SEQ ID NO: 219797 - DNA, 20 bp, Artificial Sequence
  Description of Artificial Sequence: Synthetic oligonucleotide
  Target: ATXN1; (-) strand; PAM type: YTN; PAM sequence: CTA
agagtcagaccaaaataaag

SEQ ID NO: 219798 - DNA, 20 bp, Artificial Sequence
  Description of Artificial Sequence: Synthetic oligonucleotide
  Target: ATXN1; (-) strand; PAM type: YTN; PAM sequence: TTG
tgggtacaatcctaagagtc

SEQ ID NO: 219799 - DNA, 20 bp, Artificial Sequence
  Description of Artificial Sequence: Synthetic oligonucleotide
  Target: ATXN1; (-) strand; PAM type: YTN; PAM sequence: TTG
gttgtgggtacaatcctaag

SEQ ID NO: 219800 - DNA, 20 bp, Artificial Sequence
  Description of Artificial Sequence: Synthetic oligonucleotide
  Target: ATXN1; (-) strand; PAM type: YTN; PAM sequence: TTC
cattggttgtgggtacaatc

SEQ ID NO: 219801 - DNA, 20 bp, Artificial Sequence
  Description of Artificial Sequence: Synthetic oligonucleotide
  Target: ATXN1; (-) strand; PAM type: YTN; PAM sequence: TTT
ccattggttgtgggtacaat

SEQ ID NO: 219802 - DNA, 20 bp, Artificial Sequence
  Description of Artificial Sequence: Synthetic oligonucleotide
  Target: ATXN1; (-) strand; PAM type: YTN; PAM sequence: TTA
gtttccattggttgtgggta

SEQ ID NO: 219803 - DNA, 20 bp, Artificial Sequence
  Description of Artificial Sequence: Synthetic oligonucleotide
  Target: ATXN1; (-) strand; PAM type: YTN; PAM sequence: TTT
agtttccattggttgtgggt

SEQ ID NO: 219804 - DNA, 20 bp, Artificial Sequence
  Description of Artificial Sequence: Synthetic oligonucleotide
  Target: ATXN1; (-) strand; PAM type: YTN; PAM sequence: CTT
tagtttccattggttgtggg

SEQ ID NO: 219805 - DNA, 20 bp, Artificial Sequence
  Description of Artificial Sequence: Synthetic oligonucleotide
  Target: ATXN1; (-) strand; PAM type: YTN; PAM sequence: TTC
cagtgctttagtttccattg

SEQ ID NO: 219806 - DNA, 20 bp, Artificial Sequence
  Description of Artificial Sequence: Synthetic oligonucleotide
  Target: ATXN1; (-) strand; PAM type: YTN; PAM sequence: TTT
ccagtgctttagtttccatt

SEQ ID NO: 219807 - DNA, 20 bp, Artificial Sequence
  Description of Artificial Sequence: Synthetic oligonucleotide
  Target: ATXN1; (-) strand; PAM type: YTN; PAM sequence: CTT
tccagtgctttagtttccat

SEQ ID NO: 219808 - DNA, 20 bp, Artificial Sequence
  Description of Artificial Sequence: Synthetic oligonucleotide
  Target: ATXN1; (-) strand; PAM type: YTN; PAM sequence: TTC
tttccagtgctttagtttcc

SEQ ID NO: 219809 - DNA, 20 bp, Artificial Sequence
  Description of Artificial Sequence: Synthetic oligonucleotide
  Target: ATXN1; (-) strand; PAM type: YTN; PAM sequence: TTT
ctttccagtgctttagtttc

SEQ ID NO: 219810 - DNA, 20 bp, Artificial Sequence
  Description of Artificial Sequence: Synthetic oligonucleotide
  Target: ATXN1; (-) strand; PAM type: YTN; PAM sequence: CTT
tctttccagtgctttagttt

SEQ ID NO: 219811 - DNA, 20 bp, Artificial Sequence
  Description of Artificial Sequence: Synthetic oligonucleotide
  Target: ATXN1; (-) strand; PAM type: YTN; PAM sequence: TTC
tttctttccagtgctttagt

SEQ ID NO: 219812 - DNA, 20 bp, Artificial Sequence
  Description of Artificial Sequence: Synthetic oligonucleotide
  Target: ATXN1; (-) strand; PAM type: YTN; PAM sequence: TTA
tgattctttctttccagtgc

SEQ ID NO: 219813 - DNA, 20 bp, Artificial Sequence
  Description of Artificial Sequence: Synthetic oligonucleotide
  Target: ATXN1; (-) strand; PAM type: YTN; PAM sequence: TTT
atgattctttctttccagtg

SEQ ID NO: 219814 - DNA, 20 bp, Artificial Sequence
  Description of Artificial Sequence: Synthetic oligonucleotide
  Target: ATXN1; (-) strand; PAM type: YTN; PAM sequence: TTT
tatgattctttctttccagt

SEQ ID NO: 219815 - DNA, 20 bp, Artificial Sequence
  Description of Artificial Sequence: Synthetic oligonucleotide
  Target: ATXN1; (-) strand; PAM type: YTN; PAM sequence: TTT
ttatgattctttctttccag

SEQ ID NO: 219816 - DNA, 20 bp, Artificial Sequence
  Description of Artificial Sequence: Synthetic oligonucleotide
  Target: ATXN1; (-) strand; PAM type: YTN; PAM sequence: CTT
tttatgattctttctttcca

SEQ ID NO: 219817 - DNA, 20 bp, Artificial Sequence
  Description of Artificial Sequence: Synthetic oligonucleotide
  Target: ATXN1; (-) strand; PAM type: YTN; PAM sequence: TTC
tttttatgattctttctttc

SEQ ID NO: 219818 - DNA, 20 bp, Artificial Sequence
  Description of Artificial Sequence: Synthetic oligonucleotide
  Target: ATXN1; (-) strand; PAM type: YTN; PAM sequence: TTT
ctttttatgattctttcttt

SEQ ID NO: 219819 - DNA, 20 bp, Artificial Sequence
  Description of Artificial Sequence: Synthetic oligonucleotide
  Target: ATXN1; (-) strand; PAM type: YTN; PAM sequence: TTG
tatttctttttatgattctt

SEQ ID NO: 219820 - DNA, 20 bp, Artificial Sequence
  Description of Artificial Sequence: Synthetic oligonucleotide
  Target: ATXN1; (-) strand; PAM type: YTN; PAM sequence: TTG
ttgtatttctttttatgatt

SEQ ID NO: 219821 - DNA, 20 bp, Artificial Sequence
  Description of Artificial Sequence: Synthetic oligonucleotide
  Target: ATXN1; (-) strand; PAM type: YTN; PAM sequence: TTT
gttgtatttctttttatgat

SEQ ID NO: 219822 - DNA, 20 bp, Artificial Sequence
  Description of Artificial Sequence: Synthetic oligonucleotide
  Target: ATXN1; (-) strand; PAM type: YTN; PAM sequence: TTT
tgttgtatttctttttatga

SEQ ID NO: 219823 - DNA, 20 bp, Artificial Sequence
  Description of Artificial Sequence: Synthetic oligonucleotide
  Target: ATXN1; (-) strand; PAM type: YTN; PAM sequence: TTA
gaaatggcagtgggttttgt

SEQ ID NO: 219824 - DNA, 20 bp, Artificial Sequence
  Description of Artificial Sequence: Synthetic oligonucleotide
  Target: ATXN1; (-) strand; PAM type: YTN; PAM sequence: TTT
agaaatggcagtgggttttg

SEQ ID NO: 219825 - DNA, 20 bp, Artificial Sequence
  Description of Artificial Sequence: Synthetic oligonucleotide
  Target: ATXN1; (-) strand; PAM type: YTN; PAM sequence: TTG
ggtaacagaaagatttagaa

SEQ ID NO: 219826 - DNA, 20 bp, Artificial Sequence
  Description of Artificial Sequence: Synthetic oligonucleotide
  Target: ATXN1; (-) strand; PAM type: YTN; PAM sequence: TTT
gggtaacagaaagatttaga

SEQ ID NO: 219827 - DNA, 20 bp, Artificial Sequence
  Description of Artificial Sequence: Synthetic oligonucleotide
  Target: ATXN1; (-) strand; PAM type: YTN; PAM sequence: CTT
tgggtaacagaaagatttag

SEQ ID NO: 219828 - DNA, 20 bp, Artificial Sequence
  Description of Artificial Sequence: Synthetic oligonucleotide
  Target: ATXN1; (-) strand; PAM type: YTN; PAM sequence: TTA
ataaaacacagtcactttgg

SEQ ID NO: 219829 - DNA, 20 bp, Artificial Sequence
  Description of Artificial Sequence: Synthetic oligonucleotide
  Target: ATXN1; (-) strand; PAM type: YTN; PAM sequence: TTT
aataaaacacagtcactttg

SEQ ID NO: 219830 - DNA, 20 bp, Artificial Sequence
  Description of Artificial Sequence: Synthetic oligonucleotide
  Target: ATXN1; (-) strand; PAM type: YTN; PAM sequence: CTT
taataaaacacagtcacttt

SEQ ID NO: 219831 - DNA, 20 bp, Artificial Sequence
  Description of Artificial Sequence: Synthetic oligonucleotide
  Target: ATXN1; (-) strand; PAM type: YTN; PAM sequence: TTC
ggtgatgcatcacatgcctt

SEQ ID NO: 219832 - DNA, 20 bp, Artificial Sequence
  Description of Artificial Sequence: Synthetic oligonucleotide
  Target: ATXN1; (-) strand; PAM type: YTN; PAM sequence: CTT
cggtgatgcatcacatgcct

SEQ ID NO: 219833 - DNA, 20 bp, Artificial Sequence
  Description of Artificial Sequence: Synthetic oligonucleotide
  Target: ATXN1; (-) strand; PAM type: YTN; PAM sequence: TTA
aatggcaaaaaataccttcg

SEQ ID NO: 219834 - DNA, 20 bp, Artificial Sequence
  Description of Artificial Sequence: Synthetic oligonucleotide
  Target: ATXN1; (-) strand; PAM type: YTN; PAM sequence: TTT
aaatggcaaaaaataccttc

SEQ ID NO: 219835 - DNA, 20 bp, Artificial Sequence
  Description of Artificial Sequence: Synthetic oligonucleotide
  Target: ATXN1; (-) strand; PAM type: YTN; PAM sequence: TTT
taaatggcaaaaaatacctt

SEQ ID NO: 219836 - DNA, 20 bp, Artificial Sequence
  Description of Artificial Sequence: Synthetic oligonucleotide
  Target: ATXN1; (-) strand; PAM type: YTN; PAM sequence: TTT
ttaaatggcaaaaaatacct

SEQ ID NO: 219837 - DNA, 20 bp, Artificial Sequence
  Description of Artificial Sequence: Synthetic oligonucleotide
  Target: ATXN1; (-) strand; PAM type: YTN; PAM sequence: TTG
gtatttttaaatggcaaaaa

SEQ ID NO: 219838 - DNA, 20 bp, Artificial Sequence
  Description of Artificial Sequence: Synthetic oligonucleotide
  Target: ATXN1; (-) strand; PAM type: YTN; PAM sequence: TTT
ggtatttttaaatggcaaaa

SEQ ID NO: 219839 - DNA, 20 bp, Artificial Sequence
  Description of Artificial Sequence: Synthetic oligonucleotide
  Target: ATXN1; (-) strand; PAM type: YTN; PAM sequence: CTG
tttggtatttttaaatggca

SEQ ID NO: 219840 - DNA, 20 bp, Artificial Sequence
  Description of Artificial Sequence: Synthetic oligonucleotide
  Target: ATXN1; (-) strand; PAM type: YTN; PAM sequence: CTA
ctgtttggtatttttaaatg

SEQ ID NO: 219841 - DNA, 20 bp, Artificial Sequence
  Description of Artificial Sequence: Synthetic oligonucleotide
  Target: ATXN1; (-) strand; PAM type: YTN; PAM sequence: TTA
ctactgtttggtatttttaa

SEQ ID NO: 219842 - DNA, 20 bp, Artificial Sequence
  Description of Artificial Sequence: Synthetic oligonucleotide
  Target: ATXN1; (-) strand; PAM type: YTN; PAM sequence: CTG
ttactactgtttggtatttt

SEQ ID NO: 219843 - DNA, 20 bp, Artificial Sequence
  Description of Artificial Sequence: Synthetic oligonucleotide
  Target: ATXN1; (-) strand; PAM type: YTN; PAM sequence: TTG
agctgttactactgtttggt

SEQ ID NO: 219844 - DNA, 20 bp, Artificial Sequence
  Description of Artificial Sequence: Synthetic oligonucleotide
  Target: ATXN1; (-) strand; PAM type: YTN; PAM sequence: CTG
ttgagctgttactactgttt

SEQ ID NO: 219845 - DNA, 20 bp, Artificial Sequence
  Description of Artificial Sequence: Synthetic oligonucleotide
  Target: ATXN1; (-) strand; PAM type: YTN; PAM sequence: CTA
gctgttgagctgttactact

SEQ ID NO: 219846 - DNA, 20 bp, Artificial Sequence
  Description of Artificial Sequence: Synthetic oligonucleotide
  Target: ATXN1; (-) strand; PAM type: YTN; PAM sequence: TTA
agtggtagcagcctagctgt

SEQ ID NO: 219847 - DNA, 20 bp, Artificial Sequence
  Description of Artificial Sequence: Synthetic oligonucleotide
  Target: ATXN1; (-) strand; PAM type: YTN; PAM sequence: TTG
caggttaagtggtagcagcc

SEQ ID NO: 219848 - DNA, 20 bp, Artificial Sequence
  Description of Artificial Sequence: Synthetic oligonucleotide
  Target: ATXN1; (-) strand; PAM type: YTN; PAM sequence: TTG
tccaaattgcaggttaagtg

SEQ ID NO: 219849 - DNA, 20 bp, Artificial Sequence
  Description of Artificial Sequence: Synthetic oligonucleotide
  Target: ATXN1; (-) strand; PAM type: YTN; PAM sequence: TTC
atccccacaaaattgtccaa

SEQ ID NO: 219850 - DNA, 20 bp, Artificial Sequence
  Description of Artificial Sequence: Synthetic oligonucleotide
  Target: ATXN1; (-) strand; PAM type: YTN; PAM sequence: TTT
catccccacaaaattgtcca

SEQ ID NO: 219851 - DNA, 20 bp, Artificial Sequence
  Description of Artificial Sequence: Synthetic oligonucleotide
  Target: ATXN1; (-) strand; PAM type: YTN; PAM sequence: CTC
catgtgtcataagacaaagt

SEQ ID NO: 219852 - DNA, 20 bp, Artificial Sequence
  Description of Artificial Sequence: Synthetic oligonucleotide
  Target: ATXN1; (-) strand; PAM type: YTN; PAM sequence: CTG
ctccatgtgtcataagacaa

SEQ ID NO: 219853 - DNA, 20 bp, Artificial Sequence
  Description of Artificial Sequence: Synthetic oligonucleotide
  Target: ATXN1; (-) strand; PAM type: YTN; PAM sequence: TTA
gtagcatctgctccatgtgt

SEQ ID NO: 219854 - DNA, 20 bp, Artificial Sequence
  Description of Artificial Sequence: Synthetic oligonucleotide
  Target: ATXN1; (-) strand; PAM type: YTN; PAM sequence: TTA
attagtagcatctgctccat

SEQ ID NO: 219855 - DNA, 20 bp, Artificial Sequence
  Description of Artificial Sequence: Synthetic oligonucleotide
  Target: ATXN1; (-) strand; PAM type: YTN; PAM sequence: TTG
tgtgttaattagtagcatct

SEQ ID NO: 219856 - DNA, 20 bp, Artificial Sequence
  Description of Artificial Sequence: Synthetic oligonucleotide
  Target: ATXN1; (-) strand; PAM type: YTN; PAM sequence: TTT
gtgtgttaattagtagcatc

SEQ ID NO: 219857 - DNA, 20 bp, Artificial Sequence
  Description of Artificial Sequence: Synthetic oligonucleotide
  Target: ATXN1; (-) strand; PAM type: YTN; PAM sequence: TTT
tgtgtgttaattagtagcat

SEQ ID NO: 219858 - DNA, 20 bp, Artificial Sequence
  Description of Artificial Sequence: Synthetic oligonucleotide
  Target: ATXN1; (-) strand; PAM type: YTN; PAM sequence: TTT
ttgtgtgttaattagtagca

SEQ ID NO: 219859 - DNA, 20 bp, Artificial Sequence
  Description of Artificial Sequence: Synthetic oligonucleotide
  Target: ATXN1; (-) strand; PAM type: YTN; PAM sequence: TTA
gacatttttgtgtgttaatt

SEQ ID NO: 219860 - DNA, 20 bp, Artificial Sequence
  Description of Artificial Sequence: Synthetic oligonucleotide
  Target: ATXN1; (-) strand; PAM type: YTN; PAM sequence: TTT
agacatttttgtgtgttaat

SEQ ID NO: 219861 - DNA, 20 bp, Artificial Sequence
  Description of Artificial Sequence: Synthetic oligonucleotide
  Target: ATXN1; (-) strand; PAM type: YTN; PAM sequence: TTT
tagacatttttgtgtgttaa

SEQ ID NO: 219862 - DNA, 20 bp, Artificial Sequence
  Description of Artificial Sequence: Synthetic oligonucleotide
  Target: ATXN1; (-) strand; PAM type: YTN; PAM sequence: CTG
ttttagacatttttgtgtgt

SEQ ID NO: 219863 - DNA, 20 bp, Artificial Sequence
  Description of Artificial Sequence: Synthetic oligonucleotide
  Target: ATXN1; (-) strand; PAM type: YTN; PAM sequence: CTC
tgttttagacatttttgtgt

SEQ ID NO: 219864 - DNA, 20 bp, Artificial Sequence
  Description of Artificial Sequence: Synthetic oligonucleotide
  Target: ATXN1; (-) strand; PAM type: YTN; PAM sequence: TTA
aagctctgttttagacattt

SEQ ID NO: 219865 - DNA, 20 bp, Artificial Sequence
  Description of Artificial Sequence: Synthetic oligonucleotide
  Target: ATXN1; (-) strand; PAM type: YTN; PAM sequence: TTT
aaagctctgttttagacatt

SEQ ID NO: 219866 - DNA, 20 bp, Artificial Sequence
  Description of Artificial Sequence: Synthetic oligonucleotide
  Target: ATXN1; (-) strand; PAM type: YTN; PAM sequence: TTT
taaagctctgttttagacat

SEQ ID NO: 219867 - DNA, 20 bp, Artificial Sequence
  Description of Artificial Sequence: Synthetic oligonucleotide
  Target: ATXN1; (-) strand; PAM type: YTN; PAM sequence: TTT
ttaaagctctgttttagaca

SEQ ID NO: 219868 - DNA, 20 bp, Artificial Sequence
  Description of Artificial Sequence: Synthetic oligonucleotide
  Target: ATXN1; (-) strand; PAM type: YTN; PAM sequence: TTT
tttaaagctctgttttagac

SEQ ID NO: 219869 - DNA, 20 bp, Artificial Sequence
  Description of Artificial Sequence: Synthetic oligonucleotide
  Target: ATXN1; (-) strand; PAM type: YTN; PAM sequence: TTT
ttttaaagctctgttttaga

SEQ ID NO: 219870 - DNA, 20 bp, Artificial Sequence
  Description of Artificial Sequence: Synthetic oligonucleotide
  Target: ATXN1; (-) strand; PAM type: YTN; PAM sequence: TTC
caaatgcatatgttttttta

SEQ ID NO: 219871 - DNA, 20 bp, Artificial Sequence
  Description of Artificial Sequence: Synthetic oligonucleotide
  Target: ATXN1; (-) strand; PAM type: YTN; PAM sequence: TTT
ccaaatgcatatgttttttt

SEQ ID NO: 219872 - DNA, 20 bp, Artificial Sequence
  Description of Artificial Sequence: Synthetic oligonucleotide
  Target: ATXN1; (-) strand; PAM type: YTN; PAM sequence: CTG
tttccaaatgcatatgtttt

SEQ ID NO: 219873 - DNA, 20 bp, Artificial Sequence
  Description of Artificial Sequence: Synthetic oligonucleotide
  Target: ATXN1; (-) strand; PAM type: YTN; PAM sequence: TTC
tgtttccaaatgcatatgtt

SEQ ID NO: 219874 - DNA, 20 bp, Artificial Sequence
  Description of Artificial Sequence: Synthetic oligonucleotide
  Target: ATXN1; (-) strand; PAM type: YTN; PAM sequence: CTT
ctgtttccaaatgcatatgt

SEQ ID NO: 219875 - DNA, 20 bp, Artificial Sequence
  Description of Artificial Sequence: Synthetic oligonucleotide
  Target: ATXN1; (-) strand; PAM type: YTN; PAM sequence: CTA
cttctgtttccaaatgcata

SEQ ID NO: 219876 - DNA, 20 bp, Artificial Sequence
  Description of Artificial Sequence: Synthetic oligonucleotide
  Target: ATXN1; (-) strand; PAM type: YTN; PAM sequence: TTC
tacttctgtttccaaatgca

SEQ ID NO: 219877 - DNA, 20 bp, Artificial Sequence
  Description of Artificial Sequence: Synthetic oligonucleotide
  Target: ATXN1; (-) strand; PAM type: YTN; PAM sequence: TTT
ctacttctgtttccaaatgc

SEQ ID NO: 219878 - DNA, 20 bp, Artificial Sequence
  Description of Artificial Sequence: Synthetic oligonucleotide
  Target: ATXN1; (-) strand; PAM type: YTN; PAM sequence: CTG
tttctacttctgtttccaaa

SEQ ID NO: 219879 - DNA, 20 bp, Artificial Sequence
  Description of Artificial Sequence: Synthetic oligonucleotide
  Target: ATXN1; (-) strand; PAM type: YTN; PAM sequence: TTG
aagctgtttctacttctgtt

SEQ ID NO: 219880 - DNA, 20 bp, Artificial Sequence
  Description of Artificial Sequence: Synthetic oligonucleotide
  Target: ATXN1; (-) strand; PAM type: YTN; PAM sequence: TTT
gaagctgtttctacttctgt

SEQ ID NO: 219881 - DNA, 20 bp, Artificial Sequence
  Description of Artificial Sequence: Synthetic oligonucleotide
  Target: ATXN1; (-) strand; PAM type: YTN; PAM sequence: CTT
tgaagctgtttctacttctg

SEQ ID NO: 219882 - DNA, 20 bp, Artificial Sequence
  Description of Artificial Sequence: Synthetic oligonucleotide
  Target: ATXN1; (-) strand; PAM type: YTN; PAM sequence: CTC
tttgaagctgtttctacttc

SEQ ID NO: 219883 - DNA, 20 bp, Artificial Sequence
  Description of Artificial Sequence: Synthetic oligonucleotide
  Target: ATXN1; (-) strand; PAM type: YTN; PAM sequence: TTA
tactctttgaagctgtttct

SEQ ID NO: 219884 - DNA, 20 bp, Artificial Sequence
  Description of Artificial Sequence: Synthetic oligonucleotide
  Target: ATXN1; (-) strand; PAM type: YTN; PAM sequence: CTT
atactctttgaagctgtttc

SEQ ID NO: 219885 - DNA, 20 bp, Artificial Sequence
  Description of Artificial Sequence: Synthetic oligonucleotide
  Target: ATXN1; (-) strand; PAM type: YTN; PAM sequence: TTG
cttatactctttgaagctgt

SEQ ID NO: 219886 - DNA, 20 bp, Artificial Sequence
  Description of Artificial Sequence: Synthetic oligonucleotide
  Target: ATXN1; (-) strand; PAM type: YTN; PAM sequence: TTT
gcttatactctttgaagctg

SEQ ID NO: 219887 - DNA, 20 bp, Artificial Sequence
  Description of Artificial Sequence: Synthetic oligonucleotide
  Target: ATXN1; (-) strand; PAM type: YTN; PAM sequence: TTT
tgcttatactctttgaagct

SEQ ID NO: 219888 - DNA, 20 bp, Artificial Sequence
  Description of Artificial Sequence: Synthetic oligonucleotide
  Target: ATXN1; (-) strand; PAM type: YTN; PAM sequence: TTA
tgccattttgcttatactct

SEQ ID NO: 219889 - DNA, 20 bp, Artificial Sequence
  Description of Artificial Sequence: Synthetic oligonucleotide
  Target: ATXN1; (-) strand; PAM type: YTN; PAM sequence: TTG
tattatgccattttgcttat

SEQ ID NO: 219890 - DNA, 20 bp, Artificial Sequence
  Description of Artificial Sequence: Synthetic oligonucleotide
  Target: ATXN1; (-) strand; PAM type: YTN; PAM sequence: TTC
attgtattatgccattttgc

SEQ ID NO: 219891 - DNA, 20 bp, Artificial Sequence
  Description of Artificial Sequence: Synthetic oligonucleotide
  Target: ATXN1; (-) strand; PAM type: YTN; PAM sequence: TTC
attcattgtattatgccatt

SEQ ID NO: 219892 - DNA, 20 bp, Artificial Sequence
  Description of Artificial Sequence: Synthetic oligonucleotide
  Target: ATXN1; (-) strand; PAM type: YTN; PAM sequence: CTT
cattcattgtattatgccat

SEQ ID NO: 219893 - DNA, 20 bp, Artificial Sequence
  Description of Artificial Sequence: Synthetic oligonucleotide
  Target: ATXN1; (-) strand; PAM type: YTN; PAM sequence: CTC
ttcattcattgtattatgcc

SEQ ID NO: 219894 - DNA, 20 bp, Artificial Sequence
  Description of Artificial Sequence: Synthetic oligonucleotide
  Target: ATXN1; (-) strand; PAM type: YTN; PAM sequence: TTA
aaaaaacatactcttcattc

SEQ ID NO: 219895 - DNA, 20 bp, Artificial Sequence
  Description of Artificial Sequence: Synthetic oligonucleotide
  Target: ATXN1; (-) strand; PAM type: YTN; PAM sequence: CTT
aaaaaaacatactcttcatt

SEQ ID NO: 219896 - DNA, 20 bp, Artificial Sequence
  Description of Artificial Sequence: Synthetic oligonucleotide
  Target: ATXN1; (-) strand; PAM type: YTN; PAM sequence: TTC
ttaaaaaaacatactcttca

SEQ ID NO: 219897 - DNA, 20 bp, Artificial Sequence
  Description of Artificial Sequence: Synthetic oligonucleotide
  Target: ATXN1; (-) strand; PAM type: YTN; PAM sequence: TTT
cttaaaaaaacatactcttc

SEQ ID NO: 219898 - DNA, 20 bp, Artificial Sequence
  Description of Artificial Sequence: Synthetic oligonucleotide
  Target: ATXN1; (-) strand; PAM type: YTN; PAM sequence: CTT
tcttaaaaaaacatactctt

SEQ ID NO: 219899 - DNA, 20 bp, Artificial Sequence
  Description of Artificial Sequence: Synthetic oligonucleotide
  Target: ATXN1; (-) strand; PAM type: YTN; PAM sequence: TTG
actttcttaaaaaaacatac

SEQ ID NO: 219900 - DNA, 20 bp, Artificial Sequence
  Description of Artificial Sequence: Synthetic oligonucleotide
  Target: ATXN1; (-) strand; PAM type: YTN; PAM sequence: CTG
attgactttcttaaaaaaac

SEQ ID NO: 219901 - DNA, 20 bp, Artificial Sequence
  Description of Artificial Sequence: Synthetic oligonucleotide
  Target: ATXN1; (-) strand; PAM type: YTN; PAM sequence: TTG
cgaatctgattgactttctt

SEQ ID NO: 219902 - DNA, 20 bp, Artificial Sequence
  Description of Artificial Sequence: Synthetic oligonucleotide
  Target: ATXN1; (-) strand; PAM type: YTN; PAM sequence: CTT
gcgaatctgattgactttct

SEQ ID NO: 219903 - DNA, 20 bp, Artificial Sequence
  Description of Artificial Sequence: Synthetic oligonucleotide
  Target: ATXN1; (-) strand; PAM type: YTN; PAM sequence: TTC
acttgcgaatctgattgact

SEQ ID NO: 219904 - DNA, 20 bp, Artificial Sequence
  Description of Artificial Sequence: Synthetic oligonucleotide
  Target: ATXN1; (-) strand; PAM type: YTN; PAM sequence: CTA
taaaattcacttgcgaatct

SEQ ID NO: 219905 - DNA, 20 bp, Artificial Sequence
  Description of Artificial Sequence: Synthetic oligonucleotide
  Target: ATXN1; (-) strand; PAM type: YTN; PAM sequence: TTA
gagagaggcctataaaattc

SEQ ID NO: 219906 - DNA, 20 bp, Artificial Sequence
  Description of Artificial Sequence: Synthetic oligonucleotide
  Target: ATXN1; (-) strand; PAM type: YTN; PAM sequence: TTT
agagagaggcctataaaatt

SEQ ID NO: 219907 - DNA, 20 bp, Artificial Sequence
  Description of Artificial Sequence: Synthetic oligonucleotide
  Target: ATXN1; (-) strand; PAM type: YTN; PAM sequence: TTA
tttagagagaggcctataaa

SEQ ID NO: 219908 - DNA, 20 bp, Artificial Sequence
  Description of Artificial Sequence: Synthetic oligonucleotide
  Target: ATXN1; (-) strand; PAM type: YTN; PAM sequence: TTT
atttagagagaggcctataa

SEQ ID NO: 219909 - DNA, 20 bp, Artificial Sequence
  Description of Artificial Sequence: Synthetic oligonucleotide
  Target: ATXN1; (-) strand; PAM type: YTN; PAM sequence: CTT
tatttagagagaggcctata

SEQ ID NO: 219910 - DNA, 20 bp, Artificial Sequence
  Description of Artificial Sequence: Synthetic oligonucleotide
  Target: ATXN1; (-) strand; PAM type: YTN; PAM sequence: TTC
aaatccatactttatttaga

SEQ ID NO: 219911 - DNA, 20 bp, Artificial Sequence
  Description of Artificial Sequence: Synthetic oligonucleotide
  Target: ATXN1; (-) strand; PAM type: YTN; PAM sequence: CTT
caaatccatactttatttag

SEQ ID NO: 219912 - DNA, 20 bp, Artificial Sequence
  Description of Artificial Sequence: Synthetic oligonucleotide
  Target: ATXN1; (-) strand; PAM type: YTN; PAM sequence: TTC
cttcaaatccatactttatt

SEQ ID NO: 219913 - DNA, 20 bp, Artificial Sequence
  Description of Artificial Sequence: Synthetic oligonucleotide
  Target: ATXN1; (-) strand; PAM type: YTN; PAM sequence: TTT
ccttcaaatccatactttat

SEQ ID NO: 219914 - DNA, 20 bp, Artificial Sequence
  Description of Artificial Sequence: Synthetic oligonucleotide
  Target: ATXN1; (-) strand; PAM type: YTN; PAM sequence: TTT
tccttcaaatccatacttta

SEQ ID NO: 219915 - DNA, 20 bp, Artificial Sequence
  Description of Artificial Sequence: Synthetic oligonucleotide
  Target: ATXN1; (-) strand; PAM type: YTN; PAM sequence: TTA
aaagcaagacattttccttc

SEQ ID NO: 219916 - DNA, 20 bp, Artificial Sequence
  Description of Artificial Sequence: Synthetic oligonucleotide
  Target: ATXN1; (-) strand; PAM type: YTN; PAM sequence: TTA
acaaaaaaattaaaagcaag

SEQ ID NO: 219917 - DNA, 20 bp, Artificial Sequence
  Description of Artificial Sequence: Synthetic oligonucleotide
  Target: ATXN1; (-) strand; PAM type: YTN; PAM sequence: TTC
cgttaacaaaaaaattaaaa

SEQ ID NO: 219918 - DNA, 20 bp, Artificial Sequence
  Description of Artificial Sequence: Synthetic oligonucleotide
  Target: ATXN1; (-) strand; PAM type: YTN; PAM sequence: TTT
ccgttaacaaaaaaattaaa

SEQ ID NO: 219919 - DNA, 20 bp, Artificial Sequence
  Description of Artificial Sequence: Synthetic oligonucleotide
  Target: ATXN1; (-) strand; PAM type: YTN; PAM sequence: CTT
tccgttaacaaaaaaattaa

SEQ ID NO: 219920 - DNA, 20 bp, Artificial Sequence
  Description of Artificial Sequence: Synthetic oligonucleotide
  Target: ATXN1; (-) strand; PAM type: YTN; PAM sequence: CTC
tttccgttaacaaaaaaatt

SEQ ID NO: 219921 - DNA, 20 bp, Artificial Sequence
  Description of Artificial Sequence: Synthetic oligonucleotide
  Target: ATXN1; (-) strand; PAM type: YTN; PAM sequence: CTG
ccctctttccgttaacaaaa

SEQ ID NO: 219922 - DNA, 20 bp, Artificial Sequence
  Description of Artificial Sequence: Synthetic oligonucleotide
  Target: ATXN1; (-) strand; PAM type: YTN; PAM sequence: CTG
gtatatgatatgggctgccc

SEQ ID NO: 219923 - DNA, 20 bp, Artificial Sequence
  Description of Artificial Sequence: Synthetic oligonucleotide
  Target: ATXN1; (-) strand; PAM type: YTN; PAM sequence: CTA
tggaacgtaccggctggtat

SEQ ID NO: 219924 - DNA, 20 bp, Artificial Sequence
  Description of Artificial Sequence: Synthetic oligonucleotide
  Target: ATXN1; (-) strand; PAM type: YTN; PAM sequence: TTC
cacaatggaatataacatcc

SEQ ID NO: 219925 - DNA, 20 bp, Artificial Sequence
  Description of Artificial Sequence: Synthetic oligonucleotide
  Target: ATXN1; (-) strand; PAM type: YTN; PAM sequence: TTG
gcacaacataatgttccaca

SEQ ID NO: 219926 - DNA, 20 bp, Artificial Sequence
  Description of Artificial Sequence: Synthetic oligonucleotide
  Target: ATXN1; (-) strand; PAM type: YTN; PAM sequence: TTT
ggcacaacataatgttccac

SEQ ID NO: 219927 - DNA, 20 bp, Artificial Sequence
  Description of Artificial Sequence: Synthetic oligonucleotide
  Target: ATXN1; (-) strand; PAM type: YTN; PAM sequence: TTT
tggcacaacataatgttcca

SEQ ID NO: 219928 - DNA, 20 bp, Artificial Sequence
  Description of Artificial Sequence: Synthetic oligonucleotide
  Target: ATXN1; (-) strand; PAM type: YTN; PAM sequence: TTA
attttggcacaacataatgt

SEQ ID NO: 219929 - DNA, 20 bp, Artificial Sequence
  Description of Artificial Sequence: Synthetic oligonucleotide
  Target: ATXN1; (-) strand; PAM type: YTN; PAM sequence: TTT
aattttggcacaacataatg

SEQ ID NO: 219930 - DNA, 20 bp, Artificial Sequence
  Description of Artificial Sequence: Synthetic oligonucleotide
  Target: ATXN1; (-) strand; PAM type: YTN; PAM sequence: TTT
taattttggcacaacataat

SEQ ID NO: 219931 - DNA, 20 bp, Artificial Sequence
  Description of Artificial Sequence: Synthetic oligonucleotide
  Target: ATXN1; (-) strand; PAM type: YTN; PAM sequence: CTT
ttaattttggcacaacataa

SEQ ID NO: 219932 - DNA, 20 bp, Artificial Sequence
  Description of Artificial Sequence: Synthetic oligonucleotide
  Target: ATXN1; (-) strand; PAM type: YTN; PAM sequence: CTC
cttttaattttggcacaaca

SEQ ID NO: 219933 - DNA, 20 bp, Artificial Sequence
  Description of Artificial Sequence: Synthetic oligonucleotide
  Target: ATXN1; (-) strand; PAM type: YTN; PAM sequence: TTA
tcctccttttaattttggca

SEQ ID NO: 219934 - DNA, 20 bp, Artificial Sequence
  Description of Artificial Sequence: Synthetic oligonucleotide
  Target: ATXN1; (-) strand; PAM type: YTN; PAM sequence: TTT
atcctccttttaattttggc

SEQ ID NO: 219935 - DNA, 20 bp, Artificial Sequence
  Description of Artificial Sequence: Synthetic oligonucleotide
  Target: ATXN1; (-) strand; PAM type: YTN; PAM sequence: TTT
tatcctccttttaattttgg

SEQ ID NO: 219936 - DNA, 20 bp, Artificial Sequence
  Description of Artificial Sequence: Synthetic oligonucleotide
  Target: ATXN1; (-) strand; PAM type: YTN; PAM sequence: TTT
ttatcctccttttaattttg

SEQ ID NO: 219937 - DNA, 20 bp, Artificial Sequence
  Description of Artificial Sequence: Synthetic oligonucleotide
  Target: ATXN1; (-) strand; PAM type: YTN; PAM sequence: TTT
tttatcctccttttaatttt

SEQ ID NO: 219938 - DNA, 20 bp, Artificial Sequence
  Description of Artificial Sequence: Synthetic oligonucleotide
  Target: ATXN1; (-) strand; PAM type: YTN; PAM sequence: TTT
ttttatcctccttttaattt

SEQ ID NO: 219939 - DNA, 20 bp, Artificial Sequence
  Description of Artificial Sequence: Synthetic oligonucleotide
  Target: ATXN1; (-) strand; PAM type: YTN; PAM sequence: CTT
tttttatcctccttttaatt

SEQ ID NO: 219940 - DNA, 20 bp, Artificial Sequence
  Description of Artificial Sequence: Synthetic oligonucleotide
  Target: ATXN1; (-) strand; PAM type: YTN; PAM sequence: TTA
tcccaacctttttttatcct

SEQ ID NO: 219941 - DNA, 20 bp, Artificial Sequence
  Description of Artificial Sequence: Synthetic oligonucleotide
  Target: ATXN1; (-) strand; PAM type: YTN; PAM sequence: TTA
aaaacaaattatcccaacct

SEQ ID NO: 219942 - DNA, 20 bp, Artificial Sequence
  Description of Artificial Sequence: Synthetic oligonucleotide
  Target: ATXN1; (-) strand; PAM type: YTN; PAM sequence: TTT
aaaaacaaattatcccaacc

SEQ ID NO: 219943 - DNA, 20 bp, Artificial Sequence
  Description of Artificial Sequence: Synthetic oligonucleotide
  Target: ATXN1; (-) strand; PAM type: YTN; PAM sequence: CTT
taaaaacaaattatcccaac

SEQ ID NO: 219944 - DNA, 20 bp, Artificial Sequence
  Description of Artificial Sequence: Synthetic oligonucleotide
  Target: ATXN1; (-) strand; PAM type: YTN; PAM sequence: TTA
tcccaacctttaaaaacaaa

SEQ ID NO: 219945 - DNA, 20 bp, Artificial Sequence
  Description of Artificial Sequence: Synthetic oligonucleotide
  Target: ATXN1; (-) strand; PAM type: YTN; PAM sequence: TTT
atcccaacctttaaaaacaa

SEQ ID NO: 219946 - DNA, 20 bp, Artificial Sequence
  Description of Artificial Sequence: Synthetic oligonucleotide
  Target: ATXN1; (-) strand; PAM type: YTN; PAM sequence: TTC
ccaaatttatcccaaccttt

SEQ ID NO: 219947 - DNA, 20 bp, Artificial Sequence
  Description of Artificial Sequence: Synthetic oligonucleotide
  Target: ATXN1; (-) strand; PAM type: YTN; PAM sequence: TTT
cccaaatttatcccaacctt

SEQ ID NO: 219948 - DNA, 20 bp, Artificial Sequence
  Description of Artificial Sequence: Synthetic oligonucleotide
  Target: ATXN1; (-) strand; PAM type: YTN; PAM sequence: CTT
tcccaaatttatcccaacct

SEQ ID NO: 219949 - DNA, 20 bp, Artificial Sequence
  Description of Artificial Sequence: Synthetic oligonucleotide
  Target: ATXN1; (-) strand; PAM type: YTN; PAM sequence: CTC
caaagtctttcccaaattta

SEQ ID NO: 219950 - DNA, 20 bp, Artificial Sequence
  Description of Artificial Sequence: Synthetic oligonucleotide
  Target: ATXN1; (-) strand; PAM type: YTN; PAM sequence: TTA
caatacacatgaacatatga

SEQ ID NO: 219951 - DNA, 20 bp, Artificial Sequence
  Description of Artificial Sequence: Synthetic oligonucleotide
  Target: ATXN1; (-) strand; PAM type: YTN; PAM sequence: TTT
acaatacacatgaacatatg

SEQ ID NO: 219952 - DNA, 20 bp, Artificial Sequence
  Description of Artificial Sequence: Synthetic oligonucleotide
  Target: ATXN1; (-) strand; PAM type: YTN; PAM sequence: CTC
atagatttacaatacacatg

SEQ ID NO: 219953 - DNA, 20 bp, Artificial Sequence
  Description of Artificial Sequence: Synthetic oligonucleotide
  Target: ATXN1; (-) strand; PAM type: YTN; PAM sequence: CTC
ccctcatagatttacaatac

SEQ ID NO: 219954 - DNA, 20 bp, Artificial Sequence
  Description of Artificial Sequence: Synthetic oligonucleotide
  Target: ATXN1; (-) strand; PAM type: YTN; PAM sequence: TTC
tcccctcatagatttacaat

SEQ ID NO: 219955 - DNA, 20 bp, Artificial Sequence
  Description of Artificial Sequence: Synthetic oligonucleotide
  Target: ATXN1; (-) strand; PAM type: YTN; PAM sequence: TTT
ctcccctcatagatttacaa

SEQ ID NO: 219956 - DNA, 20 bp, Artificial Sequence
  Description of Artificial Sequence: Synthetic oligonucleotide
  Target: ATXN1; (-) strand; PAM type: YTN; PAM sequence: CTT
tctcccctcatagatttaca

SEQ ID NO: 219957 - DNA, 20 bp, Artificial Sequence
  Description of Artificial Sequence: Synthetic oligonucleotide
  Target: ATXN1; (-) strand; PAM type: YTN; PAM sequence: CTA
gatgagtgctttctcccctc

SEQ ID NO: 219958 - DNA, 20 bp, Artificial Sequence
  Description of Artificial Sequence: Synthetic oligonucleotide
  Target: ATXN1; (-) strand; PAM type: YTN; PAM sequence: TTG
ggcctagatgagtgctttct

SEQ ID NO: 219959 - DNA, 20 bp, Artificial Sequence
  Description of Artificial Sequence: Synthetic oligonucleotide
  Target: ATXN1; (-) strand; PAM type: YTN; PAM sequence: TTT
gggcctagatgagtgctttc

SEQ ID NO: 219960 - DNA, 20 bp, Artificial Sequence
  Description of Artificial Sequence: Synthetic oligonucleotide
  Target: ATXN1; (-) strand; PAM type: YTN; PAM sequence: TTT
tgggcctagatgagtgcttt

SEQ ID NO: 219961 - DNA, 20 bp, Artificial Sequence
  Description of Artificial Sequence: Synthetic oligonucleotide
  Target: ATXN1; (-) strand; PAM type: YTN; PAM sequence: CTG
tggtaaaatatattttgggc

SEQ ID NO: 219962 - DNA, 20 bp, Artificial Sequence
  Description of Artificial Sequence: Synthetic oligonucleotide
  Target: ATXN1; (-) strand; PAM type: YTN; PAM sequence: TTC
tgtggtaaaatatattttgg

SEQ ID NO: 219963 - DNA, 20 bp, Artificial Sequence
  Description of Artificial Sequence: Synthetic oligonucleotide
  Target: ATXN1; (-) strand; PAM type: YTN; PAM sequence: CTG
gaaaaagtgttctgtggtaa

SEQ ID NO: 219964 - DNA, 20 bp, Artificial Sequence
  Description of Artificial Sequence: Synthetic oligonucleotide
  Target: ATXN1; (-) strand; PAM type: YTN; PAM sequence: TTC
tggaaaaagtgttctgtggt

SEQ ID NO: 219965 - DNA, 20 bp, Artificial Sequence
  Description of Artificial Sequence: Synthetic oligonucleotide
  Target: ATXN1; (-) strand; PAM type: YTN; PAM sequence: CTT
ctggaaaaagtgttctgtgg

SEQ ID NO: 219966 - DNA, 20 bp, Artificial Sequence
  Description of Artificial Sequence: Synthetic oligonucleotide
  Target: ATXN1; (-) strand; PAM type: YTN; PAM sequence: TTC
ttctggaaaaagtgttctgt

SEQ ID NO: 219967 - DNA, 20 bp, Artificial Sequence
  Description of Artificial Sequence: Synthetic oligonucleotide
  Target: ATXN1; (-) strand; PAM type: YTN; PAM sequence: TTT
cttctggaaaaagtgttctg

SEQ ID NO: 219968 - DNA, 20 bp, Artificial Sequence
  Description of Artificial Sequence: Synthetic oligonucleotide
  Target: ATXN1; (-) strand; PAM type: YTN; PAM sequence: CTT
tcttctggaaaaagtgttct

SEQ ID NO: 219969 - DNA, 20 bp, Artificial Sequence
  Description of Artificial Sequence: Synthetic oligonucleotide
  Target: ATXN1; (-) strand; PAM type: YTN; PAM sequence: TTC
acctttcttctggaaaaagt

SEQ ID NO: 219970 - DNA, 20 bp, Artificial Sequence
  Description of Artificial Sequence: Synthetic oligonucleotide
  Target: ATXN1; (-) strand; PAM type: YTN; PAM sequence: TTT
cacctttcttctggaaaaag

SEQ ID NO: 219971 - DNA, 20 bp, Artificial Sequence
  Description of Artificial Sequence: Synthetic oligonucleotide
  Target: ATXN1; (-) strand; PAM type: YTN; PAM sequence: CTG
gtttcacctttcttctggaa

SEQ ID NO: 219972 - DNA, 20 bp, Artificial Sequence
  Description of Artificial Sequence: Synthetic oligonucleotide
  Target: ATXN1; (-) strand; PAM type: YTN; PAM sequence: CTG
tgtccactggtttcaccttt

SEQ ID NO: 219973 - DNA, 20 bp, Artificial Sequence
  Description of Artificial Sequence: Synthetic oligonucleotide
  Target: ATXN1; (-) strand; PAM type: YTN; PAM sequence: CTA
caccctgtgtccactggttt

SEQ ID NO: 219974 - DNA, 20 bp, Artificial Sequence
  Description of Artificial Sequence: Synthetic oligonucleotide
  Target: ATXN1; (-) strand; PAM type: YTN; PAM sequence: CTG
gtcagtgtctacaccctgtg

SEQ ID NO: 219975 - DNA, 20 bp, Artificial Sequence
  Description of Artificial Sequence: Synthetic oligonucleotide
  Target: ATXN1; (-) strand; PAM type: YTN; PAM sequence: CTA
gtctggtcagtgtctacacc

SEQ ID NO: 219976 - DNA, 20 bp, Artificial Sequence
  Description of Artificial Sequence: Synthetic oligonucleotide
  Target: ATXN1; (-) strand; PAM type: YTN; PAM sequence: CTG
gcctagtctggtcagtgtct

SEQ ID NO: 219977 - DNA, 20 bp, Artificial Sequence
  Description of Artificial Sequence: Synthetic oligonucleotide
  Target: ATXN1; (-) strand; PAM type: YTN; PAM sequence: TTA
agtgtgaggaccaaaagtgt

SEQ ID NO: 219978 - DNA, 20 bp, Artificial Sequence
  Description of Artificial Sequence: Synthetic oligonucleotide
  Target: ATXN1; (-) strand; PAM type: YTN; PAM sequence: TTT
aagtgtgaggaccaaaagtg

SEQ ID NO: 219979 - DNA, 20 bp, Artificial Sequence
  Description of Artificial Sequence: Synthetic oligonucleotide
  Target: ATXN1; (-) strand; PAM type: YTN; PAM sequence: TTT
taagtgtgaggaccaaaagt

SEQ ID NO: 219980 - DNA, 20 bp, Artificial Sequence
  Description of Artificial Sequence: Synthetic oligonucleotide
  Target: ATXN1; (-) strand; PAM type: YTN; PAM sequence: CTT
ttaagtgtgaggaccaaaag

SEQ ID NO: 219981 - DNA, 20 bp, Artificial Sequence
  Description of Artificial Sequence: Synthetic oligonucleotide
  Target: ATXN1; (-) strand; PAM type: YTN; PAM sequence: TTG
aggacccaaggagcttttaa

SEQ ID NO: 219982 - DNA, 20 bp, Artificial Sequence
  Description of Artificial Sequence: Synthetic oligonucleotide
  Target: ATXN1; (-) strand; PAM type: YTN; PAM sequence: TTA
ttgaggacccaaggagcttt

SEQ ID NO: 219983 - DNA, 20 bp, Artificial Sequence
  Description of Artificial Sequence: Synthetic oligonucleotide
  Target: ATXN1; (-) strand; PAM type: YTN; PAM sequence: TTT
attgaggacccaaggagctt

SEQ ID NO: 219984 - DNA, 20 bp, Artificial Sequence
  Description of Artificial Sequence: Synthetic oligonucleotide
  Target: ATXN1; (-) strand; PAM type: YTN; PAM sequence: TTA
aaatttattgaggacccaag

SEQ ID NO: 219985 - DNA, 20 bp, Artificial Sequence
  Description of Artificial Sequence: Synthetic oligonucleotide
  Target: ATXN1; (-) strand; PAM type: YTN; PAM sequence: CTT
aaaatttattgaggacccaa

SEQ ID NO: 219986 - DNA, 20 bp, Artificial Sequence
  Description of Artificial Sequence: Synthetic oligonucleotide
  Target: ATXN1; (-) strand; PAM type: YTN; PAM sequence: CTC
ttaaaatttattgaggaccc

SEQ ID NO: 219987 - DNA, 20 bp, Artificial Sequence
  Description of Artificial Sequence: Synthetic oligonucleotide
  Target: ATXN1; (-) strand; PAM type: YTN; PAM sequence: TTA
tactcttaaaatttattgag

SEQ ID NO: 219988 - DNA, 20 bp, Artificial Sequence
  Description of Artificial Sequence: Synthetic oligonucleotide
  Target: ATXN1; (-) strand; PAM type: YTN; PAM sequence: TTT
atactcttaaaatttattga

SEQ ID NO: 219989 - DNA, 20 bp, Artificial Sequence
  Description of Artificial Sequence: Synthetic oligonucleotide
  Target: ATXN1; (-) strand; PAM type: YTN; PAM sequence: CTT
tatactcttaaaatttattg

SEQ ID NO: 219990 - DNA, 20 bp, Artificial Sequence
  Description of Artificial Sequence: Synthetic oligonucleotide
  Target: ATXN1; (-) strand; PAM type: YTN; PAM sequence: TTA
ggagtatagaggaaacttta

SEQ ID NO: 219991 - DNA, 20 bp, Artificial Sequence
  Description of Artificial Sequence: Synthetic oligonucleotide
  Target: ATXN1; (-) strand; PAM type: YTN; PAM sequence: TTT
aggagtatagaggaaacttt

SEQ ID NO: 219992 - DNA, 20 bp, Artificial Sequence
  Description of Artificial Sequence: Synthetic oligonucleotide
  Target: ATXN1; (-) strand; PAM type: YTN; PAM sequence: TTT
taggagtatagaggaaactt

SEQ ID NO: 219993 - DNA, 20 bp, Artificial Sequence
  Description of Artificial Sequence: Synthetic oligonucleotide
  Target: ATXN1; (-) strand; PAM type: YTN; PAM sequence: CTC
aataaattttaggagtatag

SEQ ID NO: 219994 - DNA, 20 bp, Artificial Sequence
  Description of Artificial Sequence: Synthetic oligonucleotide
  Target: ATXN1; (-) strand; PAM type: YTN; PAM sequence: TTG
gggtcctcaataaattttag

SEQ ID NO: 219995 - DNA, 20 bp, Artificial Sequence
  Description of Artificial Sequence: Synthetic oligonucleotide
  Target: ATXN1; (-) strand; PAM type: YTN; PAM sequence: CTT
ggggtcctcaataaatttta

SEQ ID NO: 219996 - DNA, 20 bp, Artificial Sequence
  Description of Artificial Sequence: Synthetic oligonucleotide
  Target: ATXN1; (-) strand; PAM type: YTN; PAM sequence: TTC
cttggggtcctcaataaatt

SEQ ID NO: 219997 - DNA, 20 bp, Artificial Sequence
  Description of Artificial Sequence: Synthetic oligonucleotide
  Target: ATXN1; (-) strand; PAM type: YTN; PAM sequence: CTA
atgaaaagttccttggggtc

SEQ ID NO: 219998 - DNA, 20 bp, Artificial Sequence
  Description of Artificial Sequence: Synthetic oligonucleotide
  Target: ATXN1; (-) strand; PAM type: YTN; PAM sequence: CTA
cctaatgaaaagttccttgg

SEQ ID NO: 219999 - DNA, 20 bp, Artificial Sequence
  Description of Artificial Sequence: Synthetic oligonucleotide
  Target: ATXN1; (-) strand; PAM type: YTN; PAM sequence: TTA
aatatgatctacctaatgaa

SEQ ID NO: 220000 - DNA, 20 bp, Artificial Sequence
  Description of Artificial Sequence: Synthetic oligonucleotide
  Target: ATXN1; (-) strand; PAM type: YTN; PAM sequence: TTG
ttaaatatgatctacctaat

SEQ ID NO: 220001 - DNA, 20 bp, Artificial Sequence
  Description of Artificial Sequence: Synthetic oligonucleotide
  Target: ATXN1; (-) strand; PAM type: YTN; PAM sequence: CTA
atatggtataatagttgtta

SEQ ID NO: 220002 - DNA, 20 bp, Artificial Sequence
  Description of Artificial Sequence: Synthetic oligonucleotide
  Target: ATXN1; (-) strand; PAM type: YTN; PAM sequence: TTC
taatatggtataatagttgt

SEQ ID NO: 220003 - DNA, 20 bp, Artificial Sequence
  Description of Artificial Sequence: Synthetic oligonucleotide
  Target: ATXN1; (-) strand; PAM type: YTN; PAM sequence: CTT
ctaatatggtataatagttg

SEQ ID NO: 220004 - DNA, 20 bp, Artificial Sequence
  Description of Artificial Sequence: Synthetic oligonucleotide
  Target: ATXN1; (-) strand; PAM type: YTN; PAM sequence: TTG
cttctaatatggtataatag

SEQ ID NO: 220005 - DNA, 20 bp, Artificial Sequence
  Description of Artificial Sequence: Synthetic oligonucleotide
  Target: ATXN1; (-) strand; PAM type: YTN; PAM sequence: TTT
gcttctaatatggtataata

SEQ ID NO: 220006 - DNA, 20 bp, Artificial Sequence
  Description of Artificial Sequence: Synthetic oligonucleotide
  Target: ATXN1; (-) strand; PAM type: YTN; PAM sequence: TTT
tgcttctaatatggtataat

SEQ ID NO: 220007 - DNA, 20 bp, Artificial Sequence
  Description of Artificial Sequence: Synthetic oligonucleotide
  Target: ATXN1; (-) strand; PAM type: YTN; PAM sequence: CTC
aattttgcttctaatatggt

SEQ ID NO: 220008 - DNA, 20 bp, Artificial Sequence
  Description of Artificial Sequence: Synthetic oligonucleotide
  Target: ATXN1; (-) strand; PAM type: YTN; PAM sequence: TTC
tcaattttgcttctaatatg

SEQ ID NO: 220009 - DNA, 20 bp, Artificial Sequence
  Description of Artificial Sequence: Synthetic oligonucleotide
  Target: ATXN1; (-) strand; PAM type: YTN; PAM sequence: TTT
ctcaattttgcttctaatat

SEQ ID NO: 220010 - DNA, 20 bp, Artificial Sequence
  Description of Artificial Sequence: Synthetic oligonucleotide
  Target: ATXN1; (-) strand; PAM type: YTN; PAM sequence: TTT
tctcaattttgcttctaata

SEQ ID NO: 220011 - DNA, 20 bp, Artificial Sequence
  Description of Artificial Sequence: Synthetic oligonucleotide
  Target: ATXN1; (-) strand; PAM type: YTN; PAM sequence: TTT
ttctcaattttgcttctaat

SEQ ID NO: 220012 - DNA, 20 bp, Artificial Sequence
  Description of Artificial Sequence: Synthetic oligonucleotide
  Target: ATXN1; (-) strand; PAM type: YTN; PAM sequence: TTA
catttttctcaattttgctt

SEQ ID NO: 220013 - DNA, 20 bp, Artificial Sequence
  Description of Artificial Sequence: Synthetic oligonucleotide
  Target: ATXN1; (-) strand; PAM type: YTN; PAM sequence: TTT
acatttttctcaattttgct

SEQ ID NO: 220014 - DNA, 20 bp, Artificial Sequence
  Description of Artificial Sequence: Synthetic oligonucleotide
  Target: ATXN1; (-) strand; PAM type: YTN; PAM sequence: TTT
tacatttttctcaattttgc

SEQ ID NO: 220015 - DNA, 20 bp, Artificial Sequence
  Description of Artificial Sequence: Synthetic oligonucleotide
  Target: ATXN1; (-) strand; PAM type: YTN; PAM sequence: CTA
atgaatattttacatttttc

SEQ ID NO: 220016 - DNA, 20 bp, Artificial Sequence
  Description of Artificial Sequence: Synthetic oligonucleotide
  Target: ATXN1; (-) strand; PAM type: YTN; PAM sequence: TTA
aatgaactaatgaatatttt

SEQ ID NO: 220017 - DNA, 20 bp, Artificial Sequence
  Description of Artificial Sequence: Synthetic oligonucleotide
  Target: ATXN1; (-) strand; PAM type: YTN; PAM sequence: CTA
ttaaatgaactaatgaatat

SEQ ID NO: 220018 - DNA, 20 bp, Artificial Sequence
  Description of Artificial Sequence: Synthetic oligonucleotide
  Target: ATXN1; (-) strand; PAM type: YTN; PAM sequence: TTC
tattaaatgaactaatgaat

SEQ ID NO: 220019 - DNA, 20 bp, Artificial Sequence
  Description of Artificial Sequence: Synthetic oligonucleotide
  Target: ATXN1; (-) strand; PAM type: YTN; PAM sequence: TTT
ctattaaatgaactaatgaa

SEQ ID NO: 220020 - DNA, 20 bp, Artificial Sequence
  Description of Artificial Sequence: Synthetic oligonucleotide
  Target: ATXN1; (-) strand; PAM type: YTN; PAM sequence: TTA
gtatttctattaaatgaact

SEQ ID NO: 220021 - DNA, 20 bp, Artificial Sequence
  Description of Artificial Sequence: Synthetic oligonucleotide
  Target: ATXN1; (-) strand; PAM type: YTN; PAM sequence: TTC
atgtagtatgcaatgggtat

SEQ ID NO: 220022 - DNA, 20 bp, Artificial Sequence
  Description of Artificial Sequence: Synthetic oligonucleotide
  Target: ATXN1; (-) strand; PAM type: YTN; PAM sequence: TTT
catgtagtatgcaatgggta

SEQ ID NO: 220023 - DNA, 20 bp, Artificial Sequence
  Description of Artificial Sequence: Synthetic oligonucleotide
  Target: ATXN1; (-) strand; PAM type: YTN; PAM sequence: TTA
tttcatgtagtatgcaatgg

SEQ ID NO: 220024 - DNA, 20 bp, Artificial Sequence
  Description of Artificial Sequence: Synthetic oligonucleotide
  Target: ATXN1; (-) strand; PAM type: YTN; PAM sequence: TTC
ataaagatgttatttcatgt

SEQ ID NO: 220025 - DNA, 20 bp, Artificial Sequence
  Description of Artificial Sequence: Synthetic oligonucleotide
  Target: ATXN1; (-) strand; PAM type: YTN; PAM sequence: TTT
cataaagatgttatttcatg

SEQ ID NO: 220026 - DNA, 20 bp, Artificial Sequence
  Description of Artificial Sequence: Synthetic oligonucleotide
  Target: ATXN1; (-) strand; PAM type: YTN; PAM sequence: TTT
tcataaagatgttatttcat

SEQ ID NO: 220027 - DNA, 20 bp, Artificial Sequence
  Description of Artificial Sequence: Synthetic oligonucleotide
  Target: ATXN1; (-) strand; PAM type: YTN; PAM sequence: TTT
ttcataaagatgttatttca

SEQ ID NO: 220028 - DNA, 20 bp, Artificial Sequence
  Description of Artificial Sequence: Synthetic oligonucleotide
  Target: ATXN1; (-) strand; PAM type: YTN; PAM sequence: TTT
tttcataaagatgttatttc

SEQ ID NO: 220029 - DNA, 20 bp, Artificial Sequence
  Description of Artificial Sequence: Synthetic oligonucleotide
  Target: ATXN1; (-) strand; PAM type: YTN; PAM sequence: TTA
ttttttcataaagatgttat

SEQ ID NO: 220030 - DNA, 20 bp, Artificial Sequence
  Description of Artificial Sequence: Synthetic oligonucleotide
  Target: ATXN1; (-) strand; PAM type: YTN; PAM sequence: CTG
aaaaatataattattttttc

SEQ ID NO: 220031 - DNA, 20 bp, Artificial Sequence
  Description of Artificial Sequence: Synthetic oligonucleotide
  Target: ATXN1; (-) strand; PAM type: YTN; PAM sequence: TTC
tgaaaaatataattattttt

SEQ ID NO: 220032 - DNA, 20 bp, Artificial Sequence
  Description of Artificial Sequence: Synthetic oligonucleotide
  Target: ATXN1; (-) strand; PAM type: YTN; PAM sequence: TTG
ttctgaaaaatataattatt

SEQ ID NO: 220033 - DNA, 20 bp, Artificial Sequence
  Description of Artificial Sequence: Synthetic oligonucleotide
  Target: ATXN1; (-) strand; PAM type: YTN; PAM sequence: TTT
gttctgaaaaatataattat

SEQ ID NO: 220034 - DNA, 20 bp, Artificial Sequence
  Description of Artificial Sequence: Synthetic oligonucleotide
  Target: ATXN1; (-) strand; PAM type: YTN; PAM sequence: TTT
tgttctgaaaaatataatta

SEQ ID NO: 220035 - DNA, 20 bp, Artificial Sequence
  Description of Artificial Sequence: Synthetic oligonucleotide
  Target: ATXN1; (-) strand; PAM type: YTN; PAM sequence: TTT
ttgttctgaaaaatataatt

SEQ ID NO: 220036 - DNA, 20 bp, Artificial Sequence
  Description of Artificial Sequence: Synthetic oligonucleotide
  Target: ATXN1; (-) strand; PAM type: YTN; PAM sequence: TTT
tttgttctgaaaaatataat

SEQ ID NO: 220037 - DNA, 20 bp, Artificial Sequence
  Description of Artificial Sequence: Synthetic oligonucleotide
  Target: ATXN1; (-) strand; PAM type: YTN; PAM sequence: CTT
ttttgttctgaaaaatataa

SEQ ID NO: 220038 - DNA, 20 bp, Artificial Sequence
  Description of Artificial Sequence: Synthetic oligonucleotide
  Target: ATXN1; (-) strand; PAM type: YTN; PAM sequence: CTA
acttttttgttctgaaaaat

SEQ ID NO: 220039 - DNA, 20 bp, Artificial Sequence
  Description of Artificial Sequence: Synthetic oligonucleotide
  Target: ATXN1; (-) strand; PAM type: YTN; PAM sequence: TTG
tcactaacttttttgttctg

SEQ ID NO: 220040 - DNA, 20 bp, Artificial Sequence
  Description of Artificial Sequence: Synthetic oligonucleotide
  Target: ATXN1; (-) strand; PAM type: YTN; PAM sequence: CTT
gtcactaacttttttgttct

SEQ ID NO: 220041 - DNA, 20 bp, Artificial Sequence
  Description of Artificial Sequence: Synthetic oligonucleotide
  Target: ATXN1; (-) strand; PAM type: YTN; PAM sequence: CTC
ttgtcactaacttttttgtt

SEQ ID NO: 220042 - DNA, 20 bp, Artificial Sequence
  Description of Artificial Sequence: Synthetic oligonucleotide
  Target: ATXN1; (-) strand; PAM type: YTN; PAM sequence: CTC
actcttgtcactaacttttt

SEQ ID NO: 220043 - DNA, 20 bp, Artificial Sequence
  Description of Artificial Sequence: Synthetic oligonucleotide
  Target: ATXN1; (-) strand; PAM type: YTN; PAM sequence: CTA
aatggatctcactcttgtca

SEQ ID NO: 220044 - DNA, 20 bp, Artificial Sequence
  Description of Artificial Sequence: Synthetic oligonucleotide
  Target: ATXN1; (-) strand; PAM type: YTN; PAM sequence: CTG
caaaaatctaaatggatctc

SEQ ID NO: 220045 - DNA, 20 bp, Artificial Sequence
  Description of Artificial Sequence: Synthetic oligonucleotide
  Target: ATXN1; (-) strand; PAM type: YTN; PAM sequence: TTA
aagagagctgcaaaaatcta

SEQ ID NO: 220046 - DNA, 20 bp, Artificial Sequence
  Description of Artificial Sequence: Synthetic oligonucleotide
  Target: ATXN1; (-) strand; PAM type: YTN; PAM sequence: TTA
agccaggcattaaagagagc

SEQ ID NO: 220047 - DNA, 20 bp, Artificial Sequence
  Description of Artificial Sequence: Synthetic oligonucleotide
  Target: ATXN1; (-) strand; PAM type: YTN; PAM sequence: TTC
cattaagccaggcattaaag

SEQ ID NO: 220048 - DNA, 20 bp, Artificial Sequence
  Description of Artificial Sequence: Synthetic oligonucleotide
  Target: ATXN1; (-) strand; PAM type: YTN; PAM sequence: TTT
ccattaagccaggcattaaa

SEQ ID NO: 220049 - DNA, 20 bp, Artificial Sequence
  Description of Artificial Sequence: Synthetic oligonucleotide
  Target: ATXN1; (-) strand; PAM type: YTN; PAM sequence: TTT
tccattaagccaggcattaa

SEQ ID NO: 220050 - DNA, 20 bp, Artificial Sequence
  Description of Artificial Sequence: Synthetic oligonucleotide
  Target: ATXN1; (-) strand; PAM type: YTN; PAM sequence: TTA
accattttccattaagccag

SEQ ID NO: 220051 - DNA, 20 bp, Artificial Sequence
  Description of Artificial Sequence: Synthetic oligonucleotide
  Target: ATXN1; (-) strand; PAM type: YTN; PAM sequence: TTT
aaccattttccattaagcca

SEQ ID NO: 220052 - DNA, 20 bp, Artificial Sequence
  Description of Artificial Sequence: Synthetic oligonucleotide
  Target: ATXN1; (-) strand; PAM type: YTN; PAM sequence: TTC
agaggcacagaagagaattt

SEQ ID NO: 220053 - DNA, 20 bp, Artificial Sequence
  Description of Artificial Sequence: Synthetic oligonucleotide
  Target: ATXN1; (-) strand; PAM type: YTN; PAM sequence: CTG
aattcagaggcacagaagag

SEQ ID NO: 220054 - DNA, 20 bp, Artificial Sequence
  Description of Artificial Sequence: Synthetic oligonucleotide
  Target: ATXN1; (-) strand; PAM type: YTN; PAM sequence: TTC
aaccaaacaacatatcacag

SEQ ID NO: 220055 - DNA, 20 bp, Artificial Sequence
  Description of Artificial Sequence: Synthetic oligonucleotide
  Target: ATXN1; (-) strand; PAM type: YTN; PAM sequence: CTT
caaccaaacaacatatcaca

SEQ ID NO: 220056 - DNA, 20 bp, Artificial Sequence
  Description of Artificial Sequence: Synthetic oligonucleotide
  Target: ATXN1; (-) strand; PAM type: YTN; PAM sequence: CTC
cacatacttcaaccaaacaa

SEQ ID NO: 220057 - DNA, 20 bp, Artificial Sequence
  Description of Artificial Sequence: Synthetic oligonucleotide
  Target: ATXN1; (-) strand; PAM type: YTN; PAM sequence: TTC
tccacatacttcaaccaaac

SEQ ID NO: 220058 - DNA, 20 bp, Artificial Sequence
  Description of Artificial Sequence: Synthetic oligonucleotide
  Target: ATXN1; (-) strand; PAM type: YTN; PAM sequence: CTT
ctccacatacttcaaccaaa

SEQ ID NO: 220059 - DNA, 20 bp, Artificial Sequence
  Description of Artificial Sequence: Synthetic oligonucleotide
  Target: ATXN1; (-) strand; PAM type: YTN; PAM sequence: TTG
gccacatcttctccacatac

SEQ ID NO: 220060 - DNA, 20 bp, Artificial Sequence
  Description of Artificial Sequence: Synthetic oligonucleotide
  Target: ATXN1; (-) strand; PAM type: YTN; PAM sequence: CTA
ttggccacatcttctccaca

SEQ ID NO: 220061 - DNA, 20 bp, Artificial Sequence
  Description of Artificial Sequence: Synthetic oligonucleotide
  Target: ATXN1; (-) strand; PAM type: YTN; PAM sequence: CTG
aaactattggccacatcttc

SEQ ID NO: 220062 - DNA, 20 bp, Artificial Sequence
  Description of Artificial Sequence: Synthetic oligonucleotide
  Target: ATXN1; (-) strand; PAM type: YTN; PAM sequence: TTG
ctgaaactattggccacatc

SEQ ID NO: 220063 - DNA, 20 bp, Artificial Sequence
  Description of Artificial Sequence: Synthetic oligonucleotide
  Target: ATXN1; (-) strand; PAM type: YTN; PAM sequence: TTG
gtatgatataaaaaaagaat

SEQ ID NO: 220064 - DNA, 20 bp, Artificial Sequence
  Description of Artificial Sequence: Synthetic oligonucleotide
  Target: ATXN1; (-) strand; PAM type: YTN; PAM sequence: TTT
ggtatgatataaaaaaagaa

SEQ ID NO: 220065 - DNA, 20 bp, Artificial Sequence
  Description of Artificial Sequence: Synthetic oligonucleotide
  Target: ATXN1; (-) strand; PAM type: YTN; PAM sequence: TTT
tggtatgatataaaaaaaga

SEQ ID NO: 220066 - DNA, 20 bp, Artificial Sequence
  Description of Artificial Sequence: Synthetic oligonucleotide
  Target: ATXN1; (-) strand; PAM type: YTN; PAM sequence: TTG
agttttggtatgatataaaa

SEQ ID NO: 220067 - DNA, 20 bp, Artificial Sequence
  Description of Artificial Sequence: Synthetic oligonucleotide
  Target: ATXN1; (-) strand; PAM type: YTN; PAM sequence: TTA
ttgagttttggtatgatata

SEQ ID NO: 220068 - DNA, 20 bp, Artificial Sequence
  Description of Artificial Sequence: Synthetic oligonucleotide
  Target: ATXN1; (-) strand; PAM type: YTN; PAM sequence: CTT
attgagttttggtatgatat

SEQ ID NO: 220069 - DNA, 20 bp, Artificial Sequence
  Description of Artificial Sequence: Synthetic oligonucleotide
  Target: ATXN1; (-) strand; PAM type: YTN; PAM sequence: CTA
ccacttattgagttttggta

SEQ ID NO: 220070 - DNA, 20 bp, Artificial Sequence
  Description of Artificial Sequence: Synthetic oligonucleotide
  Target: ATXN1; (-) strand; PAM type: YTN; PAM sequence: TTA
agaaactaccacttattgag

SEQ ID NO: 220071 - DNA, 20 bp, Artificial Sequence
  Description of Artificial Sequence: Synthetic oligonucleotide
  Target: ATXN1; (-) strand; PAM type: YTN; PAM sequence: TTT
aagaaactaccacttattga

SEQ ID NO: 220072 - DNA, 20 bp, Artificial Sequence
  Description of Artificial Sequence: Synthetic oligonucleotide
  Target: ATXN1; (-) strand; PAM type: YTN; PAM sequence: CTT
taagaaactaccacttattg

SEQ ID NO: 220073 - DNA, 20 bp, Artificial Sequence
  Description of Artificial Sequence: Synthetic oligonucleotide
  Target: ATXN1; (-) strand; PAM type: YTN; PAM sequence: CTC
ccctttaagaaactaccact

SEQ ID NO: 220074 - DNA, 20 bp, Artificial Sequence
  Description of Artificial Sequence: Synthetic oligonucleotide
  Target: ATXN1; (-) strand; PAM type: YTN; PAM sequence: CTG
ctcccctttaagaaactacc

SEQ ID NO: 220075 - DNA, 20 bp, Artificial Sequence
  Description of Artificial Sequence: Synthetic oligonucleotide
  Target: ATXN1; (-) strand; PAM type: YTN; PAM sequence: TTC
catggtgctgctccccttta

SEQ ID NO: 220076 - DNA, 20 bp, Artificial Sequence
  Description of Artificial Sequence: Synthetic oligonucleotide
  Target: ATXN1; (-) strand; PAM type: YTN; PAM sequence: TTC
agattccatggtgctgctcc

SEQ ID NO: 220077 - DNA, 20 bp, Artificial Sequence
  Description of Artificial Sequence: Synthetic oligonucleotide
  Target: ATXN1; (-) strand; PAM type: YTN; PAM sequence: CTT
cagattccatggtgctgctc

SEQ ID NO: 220078 - DNA, 20 bp, Artificial Sequence
  Description of Artificial Sequence: Synthetic oligonucleotide
  Target: ATXN1; (-) strand; PAM type: YTN; PAM sequence: CTA
tgcttcagattccatggtgc

SEQ ID NO: 220079 - DNA, 20 bp, Artificial Sequence
  Description of Artificial Sequence: Synthetic oligonucleotide
  Target: ATXN1; (-) strand; PAM type: YTN; PAM sequence: TTC
tatgcttcagattccatggt

SEQ ID NO: 220080 - DNA, 20 bp, Artificial Sequence
  Description of Artificial Sequence: Synthetic oligonucleotide
  Target: ATXN1; (-) strand; PAM type: YTN; PAM sequence: TTT
ctatgcttcagattccatgg

SEQ ID NO: 220081 - DNA, 20 bp, Artificial Sequence
  Description of Artificial Sequence: Synthetic oligonucleotide
  Target: ATXN1; (-) strand; PAM type: YTN; PAM sequence: TTA
tttctatgcttcagattcca

SEQ ID NO: 220082 - DNA, 20 bp, Artificial Sequence
  Description of Artificial Sequence: Synthetic oligonucleotide
  Target: ATXN1; (-) strand; PAM type: YTN; PAM sequence: TTT
atttctatgcttcagattcc

SEQ ID NO: 220083 - DNA, 20 bp, Artificial Sequence
  Description of Artificial Sequence: Synthetic oligonucleotide
  Target: ATXN1; (-) strand; PAM type: YTN; PAM sequence: TTA
gagtttatttctatgcttca

SEQ ID NO: 220084 - DNA, 20 bp, Artificial Sequence
  Description of Artificial Sequence: Synthetic oligonucleotide
  Target: ATXN1; (-) strand; PAM type: YTN; PAM sequence: CTT
agagtttatttctatgcttc

SEQ ID NO: 220085 - DNA, 20 bp, Artificial Sequence
  Description of Artificial Sequence: Synthetic oligonucleotide
  Target: ATXN1; (-) strand; PAM type: YTN; PAM sequence: TTA
atataaaagaatacttagag

SEQ ID NO: 220086 - DNA, 20 bp, Artificial Sequence
  Description of Artificial Sequence: Synthetic oligonucleotide
  Target: ATXN1; (-) strand; PAM type: YTN; PAM sequence: TTT
aatataaaagaatacttaga

SEQ ID NO: 220087 - DNA, 20 bp, Artificial Sequence
  Description of Artificial Sequence: Synthetic oligonucleotide
  Target: ATXN1; (-) strand; PAM type: YTN; PAM sequence: TTT
taatataaaagaatacttag

SEQ ID NO: 220088 - DNA, 20 bp, Artificial Sequence
  Description of Artificial Sequence: Synthetic oligonucleotide
  Target: ATXN1; (-) strand; PAM type: YTN; PAM sequence: CTA
atgaattttaatataaaaga

SEQ ID NO: 220089 - DNA, 20 bp, Artificial Sequence
  Description of Artificial Sequence: Synthetic oligonucleotide
  Target: ATXN1; (-) strand; PAM type: YTN; PAM sequence: TTC
aagatagactaatgaatttt

SEQ ID NO: 220090 - DNA, 20 bp, Artificial Sequence
  Description of Artificial Sequence: Synthetic oligonucleotide
  Target: ATXN1; (-) strand; PAM type: YTN; PAM sequence: CTA
aagatccatccaaagttcaa

SEQ ID NO: 220091 - DNA, 20 bp, Artificial Sequence
  Description of Artificial Sequence: Synthetic oligonucleotide
  Target: ATXN1; (-) strand; PAM type: YTN; PAM sequence: TTA
caaaatcatgcatagctaaa

SEQ ID NO: 220092 - DNA, 20 bp, Artificial Sequence
  Description of Artificial Sequence: Synthetic oligonucleotide
  Target: ATXN1; (-) strand; PAM type: YTN; PAM sequence: TTC
caaatgaccagggtatgatg

SEQ ID NO: 220093 - DNA, 20 bp, Artificial Sequence
  Description of Artificial Sequence: Synthetic oligonucleotide
  Target: ATXN1; (-) strand; PAM type: YTN; PAM sequence: TTT
ccaaatgaccagggtatgat

SEQ ID NO: 220094 - DNA, 20 bp, Artificial Sequence
  Description of Artificial Sequence: Synthetic oligonucleotide
  Target: ATXN1; (-) strand; PAM type: YTN; PAM sequence: TTT
tccaaatgaccagggtatga

SEQ ID NO: 220095 - DNA, 20 bp, Artificial Sequence
  Description of Artificial Sequence: Synthetic oligonucleotide
  Target: ATXN1; (-) strand; PAM type: YTN; PAM sequence: CTA
atataattttccaaatgacc

SEQ ID NO: 220096 - DNA, 20 bp, Artificial Sequence
  Description of Artificial Sequence: Synthetic oligonucleotide
  Target: ATXN1; (-) strand; PAM type: YTN; PAM sequence: CTG
aactaatataattttccaaa

SEQ ID NO: 220097 - DNA, 20 bp, Artificial Sequence
  Description of Artificial Sequence: Synthetic oligonucleotide
  Target: ATXN1; (-) strand; PAM type: YTN; PAM sequence: TTC
actgaactaatataattttc

SEQ ID NO: 220098 - DNA, 20 bp, Artificial Sequence
  Description of Artificial Sequence: Synthetic oligonucleotide
  Target: ATXN1; (-) strand; PAM type: YTN; PAM sequence: TTG
cataattcactgaactaata

SEQ ID NO: 220099 - DNA, 20 bp, Artificial Sequence
  Description of Artificial Sequence: Synthetic oligonucleotide
  Target: ATXN1; (-) strand; PAM type: YTN; PAM sequence: TTT
gcataattcactgaactaat

SEQ ID NO: 220100 - DNA, 20 bp, Artificial Sequence
  Description of Artificial Sequence: Synthetic oligonucleotide
  Target: ATXN1; (-) strand; PAM type: YTN; PAM sequence: TTG
gaagatttgcataattcact

SEQ ID NO: 220101 - DNA, 20 bp, Artificial Sequence
  Description of Artificial Sequence: Synthetic oligonucleotide
  Target: ATXN1; (-) strand; PAM type: YTN; PAM sequence: TTT
ggaagatttgcataattcac

SEQ ID NO: 220102 - DNA, 20 bp, Artificial Sequence
  Description of Artificial Sequence: Synthetic oligonucleotide
  Target: ATXN1; (-) strand; PAM type: YTN; PAM sequence: TTT
tggaagatttgcataattca

SEQ ID NO: 220103 - DNA, 20 bp, Artificial Sequence
  Description of Artificial Sequence: Synthetic oligonucleotide
  Target: ATXN1; (-) strand; PAM type: YTN; PAM sequence: CTT
ttggaagatttgcataattc

SEQ ID NO: 220104 - DNA, 20 bp, Artificial Sequence
  Description of Artificial Sequence: Synthetic oligonucleotide
  Target: ATXN1; (-) strand; PAM type: YTN; PAM sequence: TTG
tgtaatgaaatgtgtcaact

SEQ ID NO: 220105 - DNA, 20 bp, Artificial Sequence
  Description of Artificial Sequence: Synthetic oligonucleotide
  Target: ATXN1; (-) strand; PAM type: YTN; PAM sequence: CTA
tatgatgtgtgatgatattg

SEQ ID NO: 220106 - DNA, 20 bp, Artificial Sequence
  Description of Artificial Sequence: Synthetic oligonucleotide
  Target: ATXN1; (-) strand; PAM type: YTN; PAM sequence: TTC
agaggctatatgatgtgtga

SEQ ID NO: 220107 - DNA, 20 bp, Artificial Sequence
  Description of Artificial Sequence: Synthetic oligonucleotide
  Target: ATXN1; (-) strand; PAM type: YTN; PAM sequence: TTT
cagaggctatatgatgtgtg

SEQ ID NO: 220108 - DNA, 20 bp, Artificial Sequence
  Description of Artificial Sequence: Synthetic oligonucleotide
  Target: ATXN1; (-) strand; PAM type: YTN; PAM sequence: TTT
tcagaggctatatgatgtgt

SEQ ID NO: 220109 - DNA, 20 bp, Artificial Sequence
  Description of Artificial Sequence: Synthetic oligonucleotide
  Target: ATXN1; (-) strand; PAM type: YTN; PAM sequence: TTT
ttcagaggctatatgatgtg

SEQ ID NO: 220110 - DNA, 20 bp, Artificial Sequence
  Description of Artificial Sequence: Synthetic oligonucleotide
  Target: ATXN1; (-) strand; PAM type: YTN; PAM sequence: TTC
catgtgtacagcggagtttt

SEQ ID NO: 220111 - DNA, 20 bp, Artificial Sequence
  Description of Artificial Sequence: Synthetic oligonucleotide
  Target: ATXN1; (-) strand; PAM type: YTN; PAM sequence: CTT
ccatgtgtacagcggagttt

SEQ ID NO: 220112 - DNA, 20 bp, Artificial Sequence
  Description of Artificial Sequence: Synthetic oligonucleotide
  Target: ATXN1; (-) strand; PAM type: YTN; PAM sequence: CTC
ttccatgtgtacagcggagt

SEQ ID NO: 220113 - DNA, 20 bp, Artificial Sequence
  Description of Artificial Sequence: Synthetic oligonucleotide
  Target: ATXN1; (-) strand; PAM type: YTN; PAM sequence: TTC
tcttccatgtgtacagcgga

SEQ ID NO: 220114 - DNA, 20 bp, Artificial Sequence
  Description of Artificial Sequence: Synthetic oligonucleotide
  Target: ATXN1; (-) strand; PAM type: YTN; PAM sequence: TTC
ccattctcttccatgtgtac

SEQ ID NO: 220115 - DNA, 20 bp, Artificial Sequence
  Description of Artificial Sequence: Synthetic oligonucleotide
  Target: ATXN1; (-) strand; PAM type: YTN; PAM sequence: TTC
cattcccattctcttccatg

SEQ ID NO: 220116 - DNA, 20 bp, Artificial Sequence
  Description of Artificial Sequence: Synthetic oligonucleotide
  Target: ATXN1; (-) strand; PAM type: YTN; PAM sequence: CTA
ttccattcccattctcttcc

SEQ ID NO: 220117 - DNA, 20 bp, Artificial Sequence
  Description of Artificial Sequence: Synthetic oligonucleotide
  Target: ATXN1; (-) strand; PAM type: YTN; PAM sequence: TTA
cctattccattcccattctc

SEQ ID NO: 220118 - DNA, 20 bp, Artificial Sequence
  Description of Artificial Sequence: Synthetic oligonucleotide
  Target: ATXN1; (-) strand; PAM type: YTN; PAM sequence: TTT
acctattccattcccattct

SEQ ID NO: 220119 - DNA, 20 bp, Artificial Sequence
  Description of Artificial Sequence: Synthetic oligonucleotide
  Target: ATXN1; (-) strand; PAM type: YTN; PAM sequence: TTA
tttacctattccattcccat

SEQ ID NO: 220120 - DNA, 20 bp, Artificial Sequence
  Description of Artificial Sequence: Synthetic oligonucleotide
  Target: ATXN1; (-) strand; PAM type: YTN; PAM sequence: CTA
agacattatttacctattcc

SEQ ID NO: 220121 - DNA, 20 bp, Artificial Sequence
  Description of Artificial Sequence: Synthetic oligonucleotide
  Target: ATXN1; (-) strand; PAM type: YTN; PAM sequence: TTA
tggtaatactaagacattat

SEQ ID NO: 220122 - DNA, 20 bp, Artificial Sequence
  Description of Artificial Sequence: Synthetic oligonucleotide
  Target: ATXN1; (-) strand; PAM type: YTN; PAM sequence: TTT
atggtaatactaagacatta

SEQ ID NO: 220123 - DNA, 20 bp, Artificial Sequence
  Description of Artificial Sequence: Synthetic oligonucleotide
  Target: ATXN1; (-) strand; PAM type: YTN; PAM sequence: TTT
tatggtaatactaagacatt

SEQ ID NO: 220124 - DNA, 20 bp, Artificial Sequence
  Description of Artificial Sequence: Synthetic oligonucleotide
  Target: ATXN1; (-) strand; PAM type: YTN; PAM sequence: TTT
ttatggtaatactaagacat

SEQ ID NO: 220125 - DNA, 20 bp, Artificial Sequence
  Description of Artificial Sequence: Synthetic oligonucleotide
  Target: ATXN1; (-) strand; PAM type: YTN; PAM sequence: TTA
tttttatggtaatactaaga

SEQ ID NO: 220126 - DNA, 20 bp, Artificial Sequence
  Description of Artificial Sequence: Synthetic oligonucleotide
  Target: ATXN1; (-) strand; PAM type: YTN; PAM sequence: CTG
taagatcaagattattttta

SEQ ID NO: 220127 - DNA, 20 bp, Artificial Sequence
  Description of Artificial Sequence: Synthetic oligonucleotide
  Target: ATXN1; (-) strand; PAM type: YTN; PAM sequence: CTG
gagggacatctgtaagatca

SEQ ID NO: 220128 - DNA, 20 bp, Artificial Sequence
  Description of Artificial Sequence: Synthetic oligonucleotide
  Target: ATXN1; (-) strand; PAM type: YTN; PAM sequence: TTC
tggagggacatctgtaagat

SEQ ID NO: 220129 - DNA, 20 bp, Artificial Sequence
  Description of Artificial Sequence: Synthetic oligonucleotide
  Target: ATXN1; (-) strand; PAM type: YTN; PAM sequence: TTT
ctggagggacatctgtaaga

SEQ ID NO: 220130 - DNA, 20 bp, Artificial Sequence
  Description of Artificial Sequence: Synthetic oligonucleotide
  Target: ATXN1; (-) strand; PAM type: YTN; PAM sequence: TTT
tctggagggacatctgtaag

SEQ ID NO: 220131 - DNA, 20 bp, Artificial Sequence
  Description of Artificial Sequence: Synthetic oligonucleotide
  Target: ATXN1; (-) strand; PAM type: YTN; PAM sequence: CTT
ttctggagggacatctgtaa

SEQ ID NO: 220132 - DNA, 20 bp, Artificial Sequence
  Description of Artificial Sequence: Synthetic oligonucleotide
  Target: ATXN1; (-) strand; PAM type: YTN; PAM sequence: TTG
ggaacccccccacccccacc

SEQ ID NO: 220133 - DNA, 20 bp, Artificial Sequence
  Description of Artificial Sequence: Synthetic oligonucleotide
  Target: ATXN1; (-) strand; PAM type: YTN; PAM sequence: TTT
gggaacccccccacccccac

SEQ ID NO: 220134 - DNA, 20 bp, Artificial Sequence
  Description of Artificial Sequence: Synthetic oligonucleotide
  Target: ATXN1; (-) strand; PAM type: YTN; PAM sequence: CTT
tgggaacccccccaccccca

SEQ ID NO: 220135 - DNA, 20 bp, Artificial Sequence
  Description of Artificial Sequence: Synthetic oligonucleotide
  Target: ATXN1; (-) strand; PAM type: YTN; PAM sequence: CTC
actttgggaacccccccacc

SEQ ID NO: 220136 - DNA, 20 bp, Artificial Sequence
  Description of Artificial Sequence: Synthetic oligonucleotide
  Target: ATXN1; (-) strand; PAM type: YTN; PAM sequence: TTC
tcactttgggaaccccccca

SEQ ID NO: 220137 - DNA, 20 bp, Artificial Sequence
  Description of Artificial Sequence: Synthetic oligonucleotide
  Target: ATXN1; (-) strand; PAM type: YTN; PAM sequence: CTG
gtcagcagttctcactttgg

SEQ ID NO: 220138 - DNA, 20 bp, Artificial Sequence
  Description of Artificial Sequence: Synthetic oligonucleotide
  Target: ATXN1; (-) strand; PAM type: YTN; PAM sequence: CTG
cctggtcagcagttctcact

SEQ ID NO: 220139 - DNA, 20 bp, Artificial Sequence
  Description of Artificial Sequence: Synthetic oligonucleotide
  Target: ATXN1; (-) strand; PAM type: YTN; PAM sequence: TTA
gaatgtctgcctggtcagca

SEQ ID NO: 220140 - DNA, 20 bp, Artificial Sequence
  Description of Artificial Sequence: Synthetic oligonucleotide
  Target: ATXN1; (-) strand; PAM type: YTN; PAM sequence: TTT
agaatgtctgcctggtcagc

SEQ ID NO: 220141 - DNA, 20 bp, Artificial Sequence
  Description of Artificial Sequence: Synthetic oligonucleotide
  Target: ATXN1; (-) strand; PAM type: YTN; PAM sequence: CTG
tggggtttagaatgtctgcc

SEQ ID NO: 220142 - DNA, 20 bp, Artificial Sequence
  Description of Artificial Sequence: Synthetic oligonucleotide
  Target: ATXN1; (-) strand; PAM type: YTN; PAM sequence: TTC
cagtagggatctgtggggtt

SEQ ID NO: 220143 - DNA, 20 bp, Artificial Sequence
  Description of Artificial Sequence: Synthetic oligonucleotide
  Target: ATXN1; (-) strand; PAM type: YTN; PAM sequence: CTT
ccagtagggatctgtggggt

SEQ ID NO: 220144 - DNA, 20 bp, Artificial Sequence
  Description of Artificial Sequence: Synthetic oligonucleotide
  Target: ATXN1; (-) strand; PAM type: YTN; PAM sequence: TTA
cttccagtagggatctgtgg

SEQ ID NO: 220145 - DNA, 20 bp, Artificial Sequence
  Description of Artificial Sequence: Synthetic oligonucleotide
  Target: ATXN1; (-) strand; PAM type: YTN; PAM sequence: TTT
acttccagtagggatctgtg

SEQ ID NO: 220146 - DNA, 20 bp, Artificial Sequence
  Description of Artificial Sequence: Synthetic oligonucleotide
  Target: ATXN1; (-) strand; PAM type: YTN; PAM sequence: TTT
tacttccagtagggatctgt

SEQ ID NO: 220147 - DNA, 20 bp, Artificial Sequence
  Description of Artificial Sequence: Synthetic oligonucleotide
  Target: ATXN1; (-) strand; PAM type: YTN; PAM sequence: CTT
ttacttccagtagggatctg

SEQ ID NO: 220148 - DNA, 20 bp, Artificial Sequence
  Description of Artificial Sequence: Synthetic oligonucleotide
  Target: ATXN1; (-) strand; PAM type: YTN; PAM sequence: CTG
tgcttttacttccagtaggg

SEQ ID NO: 220149 - DNA, 20 bp, Artificial Sequence
  Description of Artificial Sequence: Synthetic oligonucleotide
  Target: ATXN1; (-) strand; PAM type: YTN; PAM sequence: TTC
tgtgcttttacttccagtag

SEQ ID NO: 220150 - DNA, 20 bp, Artificial Sequence
  Description of Artificial Sequence: Synthetic oligonucleotide
  Target: ATXN1; (-) strand; PAM type: YTN; PAM sequence: CTA
gagttctgtgcttttacttc

SEQ ID NO: 220151 - DNA, 20 bp, Artificial Sequence
  Description of Artificial Sequence: Synthetic oligonucleotide
  Target: ATXN1; (-) strand; PAM type: YTN; PAM sequence: TTG
aggccagaaggaaacctaga

SEQ ID NO: 220152 - DNA, 20 bp, Artificial Sequence
  Description of Artificial Sequence: Synthetic oligonucleotide
  Target: ATXN1; (-) strand; PAM type: YTN; PAM sequence: TTA
tggaaattgaggccagaagg

SEQ ID NO: 220153 - DNA, 20 bp, Artificial Sequence
  Description of Artificial Sequence: Synthetic oligonucleotide
  Target: ATXN1; (-) strand; PAM type: YTN; PAM sequence: CTC
agtgatccccaagaggacaa

SEQ ID NO: 220154 - DNA, 20 bp, Artificial Sequence
  Description of Artificial Sequence: Synthetic oligonucleotide
  Target: ATXN1; (-) strand; PAM type: YTN; PAM sequence: TTG
tactcagtgatccccaagag

SEQ ID NO: 220155 - DNA, 20 bp, Artificial Sequence
  Description of Artificial Sequence: Synthetic oligonucleotide
  Target: ATXN1; (-) strand; PAM type: YTN; PAM sequence: TTA
ggttgtactcagtgatcccc

SEQ ID NO: 220156 - DNA, 20 bp, Artificial Sequence
  Description of Artificial Sequence: Synthetic oligonucleotide
  Target: ATXN1; (-) strand; PAM type: YTN; PAM sequence: TTG
ttaggttgtactcagtgatc

SEQ ID NO: 220157 - DNA, 20 bp, Artificial Sequence
  Description of Artificial Sequence: Synthetic oligonucleotide
  Target: ATXN1; (-) strand; PAM type: YTN; PAM sequence: TTT
gttaggttgtactcagtgat

SEQ ID NO: 220158 - DNA, 20 bp, Artificial Sequence
  Description of Artificial Sequence: Synthetic oligonucleotide
  Target: ATXN1; (-) strand; PAM type: YTN; PAM sequence: CTT
tgttaggttgtactcagtga

SEQ ID NO: 220159 - DNA, 20 bp, Artificial Sequence
  Description of Artificial Sequence: Synthetic oligonucleotide
  Target: ATXN1; (-) strand; PAM type: YTN; PAM sequence: TTA
atggtctttgttaggttgta

SEQ ID NO: 220160 - DNA, 20 bp, Artificial Sequence
  Description of Artificial Sequence: Synthetic oligonucleotide
  Target: ATXN1; (-) strand; PAM type: YTN; PAM sequence: TTG
accacatgggttaatggtct

SEQ ID NO: 220161 - DNA, 20 bp, Artificial Sequence
  Description of Artificial Sequence: Synthetic oligonucleotide
  Target: ATXN1; (-) strand; PAM type: YTN; PAM sequence: CTT
gaccacatgggttaatggtc

SEQ ID NO: 220162 - DNA, 20 bp, Artificial Sequence
  Description of Artificial Sequence: Synthetic oligonucleotide
  Target: ATXN1; (-) strand; PAM type: YTN; PAM sequence: TTC
ttgaccacatgggttaatgg

SEQ ID NO: 220163 - DNA, 20 bp, Artificial Sequence
  Description of Artificial Sequence: Synthetic oligonucleotide
  Target: ATXN1; (-) strand; PAM type: YTN; PAM sequence: CTC
atgttcttgaccacatgggt

SEQ ID NO: 220164 - DNA, 20 bp, Artificial Sequence
  Description of Artificial Sequence: Synthetic oligonucleotide
  Target: ATXN1; (-) strand; PAM type: YTN; PAM sequence: TTA
tctcatgttcttgaccacat

SEQ ID NO: 220165 - DNA, 20 bp, Artificial Sequence
  Description of Artificial Sequence: Synthetic oligonucleotide
  Target: ATXN1; (-) strand; PAM type: YTN; PAM sequence: TTT
atctcatgttcttgaccaca

SEQ ID NO: 220166 - DNA, 20 bp, Artificial Sequence
  Description of Artificial Sequence: Synthetic oligonucleotide
  Target: ATXN1; (-) strand; PAM type: YTN; PAM sequence: CTC
atggtttatctcatgttctt

SEQ ID NO: 220167 - DNA, 20 bp, Artificial Sequence
  Description of Artificial Sequence: Synthetic oligonucleotide
  Target: ATXN1; (-) strand; PAM type: YTN; PAM sequence: CTG
gtgccctcatggtttatctc

SEQ ID NO: 220168 - DNA, 20 bp, Artificial Sequence
  Description of Artificial Sequence: Synthetic oligonucleotide
  Target: ATXN1; (-) strand; PAM type: YTN; PAM sequence: CTC
tggtgccctcatggtttatc

SEQ ID NO: 220169 - DNA, 20 bp, Artificial Sequence
  Description of Artificial Sequence: Synthetic oligonucleotide
  Target: ATXN1; (-) strand; PAM type: YTN; PAM sequence: TTC
cctctggtgccctcatggtt

SEQ ID NO: 220170 - DNA, 20 bp, Artificial Sequence
  Description of Artificial Sequence: Synthetic oligonucleotide
  Target: ATXN1; (-) strand; PAM type: YTN; PAM sequence: CTT
ccctctggtgccctcatggt

SEQ ID NO: 220171 - DNA, 20 bp, Artificial Sequence
  Description of Artificial Sequence: Synthetic oligonucleotide
  Target: ATXN1; (-) strand; PAM type: YTN; PAM sequence: CTC
ttccctctggtgccctcatg

SEQ ID NO: 220172 - DNA, 20 bp, Artificial Sequence
  Description of Artificial Sequence: Synthetic oligonucleotide
  Target: ATXN1; (-) strand; PAM type: YTN; PAM sequence: TTC
cgcccacagataactcttcc

SEQ ID NO: 220173 - DNA, 20 bp, Artificial Sequence
  Description of Artificial Sequence: Synthetic oligonucleotide
  Target: ATXN1; (-) strand; PAM type: YTN; PAM sequence: TTT
ccgcccacagataactcttc

SEQ ID NO: 220174 - DNA, 20 bp, Artificial Sequence
  Description of Artificial Sequence: Synthetic oligonucleotide
  Target: ATXN1; (-) strand; PAM type: YTN; PAM sequence: TTT
tccgcccacagataactctt

SEQ ID NO: 220175 - DNA, 20 bp, Artificial Sequence
  Description of Artificial Sequence: Synthetic oligonucleotide
  Target: ATXN1; (-) strand; PAM type: YTN; PAM sequence: CTA
gtagaatccaagtaaataca

SEQ ID NO: 220176 - DNA, 20 bp, Artificial Sequence
  Description of Artificial Sequence: Synthetic oligonucleotide
  Target: ATXN1; (-) strand; PAM type: YTN; PAM sequence: TTG
cctagtagaatccaagtaaa

SEQ ID NO: 220177 - DNA, 20 bp, Artificial Sequence
  Description of Artificial Sequence: Synthetic oligonucleotide
  Target: ATXN1; (-) strand; PAM type: YTN; PAM sequence: CTT
gcctagtagaatccaagtaa

SEQ ID NO: 220178 - DNA, 20 bp, Artificial Sequence
  Description of Artificial Sequence: Synthetic oligonucleotide
  Target: ATXN1; (-) strand; PAM type: YTN; PAM sequence: TTC
ttgcctagtagaatccaagt

SEQ ID NO: 220179 - DNA, 20 bp, Artificial Sequence
  Description of Artificial Sequence: Synthetic oligonucleotide
  Target: ATXN1; (-) strand; PAM type: YTN; PAM sequence: TTT
cttgcctagtagaatccaag

SEQ ID NO: 220180 - DNA, 20 bp, Artificial Sequence
  Description of Artificial Sequence: Synthetic oligonucleotide
  Target: ATXN1; (-) strand; PAM type: YTN; PAM sequence: CTC
acagtttcttgcctagtaga

SEQ ID NO: 220181 - DNA, 20 bp, Artificial Sequence
  Description of Artificial Sequence: Synthetic oligonucleotide
  Target: ATXN1; (-) strand; PAM type: YTN; PAM sequence: TTC
tcacagtttcttgcctagta

SEQ ID NO: 220182 - DNA, 20 bp, Artificial Sequence
  Description of Artificial Sequence: Synthetic oligonucleotide
  Target: ATXN1; (-) strand; PAM type: YTN; PAM sequence: CTT
ctcacagtttcttgcctagt

SEQ ID NO: 220183 - DNA, 20 bp, Artificial Sequence
  Description of Artificial Sequence: Synthetic oligonucleotide
  Target: ATXN1; (-) strand; PAM type: YTN; PAM sequence: TTA
aaaatgcacacttctcacag

SEQ ID NO: 220184 - DNA, 20 bp, Artificial Sequence
  Description of Artificial Sequence: Synthetic oligonucleotide
  Target: ATXN1; (-) strand; PAM type: YTN; PAM sequence: TTG
tatcaaaaaatcacatgtac

SEQ ID NO: 220185 - DNA, 20 bp, Artificial Sequence
  Description of Artificial Sequence: Synthetic oligonucleotide
  Target: ATXN1; (-) strand; PAM type: YTN; PAM sequence: CTT
gtatcaaaaaatcacatgta

SEQ ID NO: 220186 - DNA, 20 bp, Artificial Sequence
  Description of Artificial Sequence: Synthetic oligonucleotide
  Target: ATXN1; (-) strand; PAM type: YTN; PAM sequence: TTG
tgtgcttgtatcaaaaaatc

SEQ ID NO: 220187 - DNA, 20 bp, Artificial Sequence
  Description of Artificial Sequence: Synthetic oligonucleotide
  Target: ATXN1; (-) strand; PAM type: YTN; PAM sequence: TTA
cacattgtgtgcttgtatca

SEQ ID NO: 220188 - DNA, 20 bp, Artificial Sequence
  Description of Artificial Sequence: Synthetic oligonucleotide
  Target: ATXN1; (-) strand; PAM type: YTN; PAM sequence: TTG
accattacacattgtgtgct

SEQ ID NO: 220189 - DNA, 20 bp, Artificial Sequence
  Description of Artificial Sequence: Synthetic oligonucleotide
  Target: ATXN1; (-) strand; PAM type: YTN; PAM sequence: TTT
gaccattacacattgtgtgc

SEQ ID NO: 220190 - DNA, 20 bp, Artificial Sequence
  Description of Artificial Sequence: Synthetic oligonucleotide
  Target: ATXN1; (-) strand; PAM type: YTN; PAM sequence: TTG
atttgaccattacacattgt

SEQ ID NO: 220191 - DNA, 20 bp, Artificial Sequence
  Description of Artificial Sequence: Synthetic oligonucleotide
  Target: ATXN1; (-) strand; PAM type: YTN; PAM sequence: CTT
gatttgaccattacacattg

SEQ ID NO: 220192 - DNA, 20 bp, Artificial Sequence
  Description of Artificial Sequence: Synthetic oligonucleotide
  Target: ATXN1; (-) strand; PAM type: YTN; PAM sequence: CTA
acaaaaagaaatgaagtgat

SEQ ID NO: 220193 - DNA, 20 bp, Artificial Sequence
  Description of Artificial Sequence: Synthetic oligonucleotide
  Target: ATXN1; (-) strand; PAM type: YTN; PAM sequence: TTG
gaatgtccctaacaaaaaga

SEQ ID NO: 220194 - DNA, 20 bp, Artificial Sequence
  Description of Artificial Sequence: Synthetic oligonucleotide
  Target: ATXN1; (-) strand; PAM type: YTN; PAM sequence: TTT
ggaatgtccctaacaaaaag

SEQ ID NO: 220195 - DNA, 20 bp, Artificial Sequence
  Description of Artificial Sequence: Synthetic oligonucleotide
  Target: ATXN1; (-) strand; PAM type: YTN; PAM sequence: CTA
gaggaatgaatttggaatgt

SEQ ID NO: 220196 - DNA, 20 bp, Artificial Sequence
  Description of Artificial Sequence: Synthetic oligonucleotide
  Target: ATXN1; (-) strand; PAM type: YTN; PAM sequence: TTC
aaaataactagaggaatgaa

SEQ ID NO: 220197 - DNA, 20 bp, Artificial Sequence
  Description of Artificial Sequence: Synthetic oligonucleotide
  Target: ATXN1; (-) strand; PAM type: YTN; PAM sequence: TTT
caaaataactagaggaatga

SEQ ID NO: 220198 - DNA, 20 bp, Artificial Sequence
  Description of Artificial Sequence: Synthetic oligonucleotide
  Target: ATXN1; (-) strand; PAM type: YTN; PAM sequence: TTG
tatatttcaaaataactaga

SEQ ID NO: 220199 - DNA, 20 bp, Artificial Sequence
  Description of Artificial Sequence: Synthetic oligonucleotide
  Target: ATXN1; (-) strand; PAM type: YTN; PAM sequence: TTA
ttgtatatttcaaaataact

SEQ ID NO: 220200 - DNA, 20 bp, Artificial Sequence
  Description of Artificial Sequence: Synthetic oligonucleotide
  Target: ATXN1; (-) strand; PAM type: YTN; PAM sequence: CTT
attgtatatttcaaaataac

SEQ ID NO: 220201 - DNA, 20 bp, Artificial Sequence
  Description of Artificial Sequence: Synthetic oligonucleotide
  Target: ATXN1; (-) strand; PAM type: YTN; PAM sequence: TTA
acaataacttattgtatatt

SEQ ID NO: 220202 - DNA, 20 bp, Artificial Sequence
  Description of Artificial Sequence: Synthetic oligonucleotide
  Target: ATXN1; (-) strand; PAM type: YTN; PAM sequence: TTC
agtagcacaatagggcaaca

SEQ ID NO: 220203 - DNA, 20 bp, Artificial Sequence
  Description of Artificial Sequence: Synthetic oligonucleotide
  Target: ATXN1; (-) strand; PAM type: YTN; PAM sequence: CTA
gtgttcagtagcacaatagg

SEQ ID NO: 220204 - DNA, 20 bp, Artificial Sequence
  Description of Artificial Sequence: Synthetic oligonucleotide
  Target: ATXN1; (-) strand; PAM type: YTN; PAM sequence: TTA
gatagtaggaataagagcta

SEQ ID NO: 220205 - DNA, 20 bp, Artificial Sequence
  Description of Artificial Sequence: Synthetic oligonucleotide
  Target: ATXN1; (-) strand; PAM type: YTN; PAM sequence: CTA
taaaaatatagttagatagt

SEQ ID NO: 220206 - DNA, 20 bp, Artificial Sequence
  Description of Artificial Sequence: Synthetic oligonucleotide
  Target: ATXN1; (-) strand; PAM type: YTN; PAM sequence: TTA
gtggctataaaaatatagtt

SEQ ID NO: 220207 - DNA, 20 bp, Artificial Sequence
  Description of Artificial Sequence: Synthetic oligonucleotide
  Target: ATXN1; (-) strand; PAM type: YTN; PAM sequence: TTG
gttagtggctataaaaatat

SEQ ID NO: 220208 - DNA, 20 bp, Artificial Sequence
  Description of Artificial Sequence: Synthetic oligonucleotide
  Target: ATXN1; (-) strand; PAM type: YTN; PAM sequence: TTA
gcagaggatggaaagggtag

SEQ ID NO: 220209 - DNA, 20 bp, Artificial Sequence
  Description of Artificial Sequence: Synthetic oligonucleotide
  Target: ATXN1; (-) strand; PAM type: YTN; PAM sequence: CTA
agaaacatgacgtcatggag

SEQ ID NO: 220210 - DNA, 20 bp, Artificial Sequence
  Description of Artificial Sequence: Synthetic oligonucleotide
  Target: ATXN1; (-) strand; PAM type: YTN; PAM sequence: CTC
atatgagggagctaagaaac

SEQ ID NO: 220211 - DNA, 20 bp, Artificial Sequence
  Description of Artificial Sequence: Synthetic oligonucleotide
  Target: ATXN1; (-) strand; PAM type: YTN; PAM sequence: CTC
actcatatgagggagctaag

SEQ ID NO: 220212 - DNA, 20 bp, Artificial Sequence
  Description of Artificial Sequence: Synthetic oligonucleotide
  Target: ATXN1; (-) strand; PAM type: YTN; PAM sequence: TTC
tcactcatatgagggagcta

SEQ ID NO: 220213 - DNA, 20 bp, Artificial Sequence
  Description of Artificial Sequence: Synthetic oligonucleotide
  Target: ATXN1; (-) strand; PAM type: YTN; PAM sequence: TTA
agtaaaataagccaggcaca

SEQ ID NO: 220214 - DNA, 20 bp, Artificial Sequence
  Description of Artificial Sequence: Synthetic oligonucleotide
  Target: ATXN1; (-) strand; PAM type: YTN; PAM sequence: TTA
tgttaagtaaaataagccag

SEQ ID NO: 220215 - DNA, 20 bp, Artificial Sequence
  Description of Artificial Sequence: Synthetic oligonucleotide
  Target: ATXN1; (-) strand; PAM type: YTN; PAM sequence: CTG
gaagacgttatgttaagtaa

SEQ ID NO: 220216 - DNA, 20 bp, Artificial Sequence
  Description of Artificial Sequence: Synthetic oligonucleotide
  Target: ATXN1; (-) strand; PAM type: YTN; PAM sequence: CTG
gaactggaagacgttatgtt

SEQ ID NO: 220217 - DNA, 20 bp, Artificial Sequence
  Description of Artificial Sequence: Synthetic oligonucleotide
  Target: ATXN1; (-) strand; PAM type: YTN; PAM sequence: TTG
taacaacatggctggaactg

SEQ ID NO: 220218 - DNA, 20 bp, Artificial Sequence
  Description of Artificial Sequence: Synthetic oligonucleotide
  Target: ATXN1; (-) strand; PAM type: YTN; PAM sequence: TTT
gtaacaacatggctggaact

SEQ ID NO: 220219 - DNA, 20 bp, Artificial Sequence
  Description of Artificial Sequence: Synthetic oligonucleotide
  Target: ATXN1; (-) strand; PAM type: YTN; PAM sequence: CTG
tcatttgtaacaacatggct

SEQ ID NO: 220220 - DNA, 20 bp, Artificial Sequence
  Description of Artificial Sequence: Synthetic oligonucleotide
  Target: ATXN1; (-) strand; PAM type: YTN; PAM sequence: TTC
tgtcatttgtaacaacatgg

SEQ ID NO: 220221 - DNA, 20 bp, Artificial Sequence
  Description of Artificial Sequence: Synthetic oligonucleotide
  Target: ATXN1; (-) strand; PAM type: YTN; PAM sequence: TTC
agccatacaaaagaatgaaa

SEQ ID NO: 220222 - DNA, 20 bp, Artificial Sequence
  Description of Artificial Sequence: Synthetic oligonucleotide
  Target: ATXN1; (-) strand; PAM type: YTN; PAM sequence: TTA
ttcagccatacaaaagaatg

SEQ ID NO: 220223 - DNA, 20 bp, Artificial Sequence
  Description of Artificial Sequence: Synthetic oligonucleotide
  Target: ATXN1; (-) strand; PAM type: YTN; PAM sequence: CTC
catcaatgaaggaatggata

SEQ ID NO: 220224 - DNA, 20 bp, Artificial Sequence
  Description of Artificial Sequence: Synthetic oligonucleotide
  Target: ATXN1; (-) strand; PAM type: YTN; PAM sequence: CTA
agtctccatcaatgaaggaa

SEQ ID NO: 220225 - DNA, 20 bp, Artificial Sequence
  Description of Artificial Sequence: Synthetic oligonucleotide
  Target: ATXN1; (-) strand; PAM type: YTN; PAM sequence: TTA
tagccaagatatggaatcaa

SEQ ID NO: 220226 - DNA, 20 bp, Artificial Sequence
  Description of Artificial Sequence: Synthetic oligonucleotide
  Target: ATXN1; (-) strand; PAM type: YTN; PAM sequence: TTC
attatagccaagatatggaa

SEQ ID NO: 220227 - DNA, 20 bp, Artificial Sequence
  Description of Artificial Sequence: Synthetic oligonucleotide
  Target: ATXN1; (-) strand; PAM type: YTN; PAM sequence: CTA
ttcattatagccaagatatg

SEQ ID NO: 220228 - DNA, 20 bp, Artificial Sequence
  Description of Artificial Sequence: Synthetic oligonucleotide
  Target: ATXN1; (-) strand; PAM type: YTN; PAM sequence: TTG
cagctattcattatagccaa

SEQ ID NO: 220229 - DNA, 20 bp, Artificial Sequence
  Description of Artificial Sequence: Synthetic oligonucleotide
  Target: ATXN1; (-) strand; PAM type: YTN; PAM sequence: TTG
ttgcagctattcattatagc

SEQ ID NO: 220230 - DNA, 20 bp, Artificial Sequence
  Description of Artificial Sequence: Synthetic oligonucleotide
  Target: ATXN1; (-) strand; PAM type: YTN; PAM sequence: TTT
gttgcagctattcattatag

SEQ ID NO: 220231 - DNA, 20 bp, Artificial Sequence
  Description of Artificial Sequence: Synthetic oligonucleotide
  Target: ATXN1; (-) strand; PAM type: YTN; PAM sequence: CTC
ccatgtttgttgcagctatt

SEQ ID NO: 220232 - DNA, 20 bp, Artificial Sequence
  Description of Artificial Sequence: Synthetic oligonucleotide
  Target: ATXN1; (-) strand; PAM type: YTN; PAM sequence: CTG
cactcccatgtttgttgcag

SEQ ID NO: 220233 - DNA, 20 bp, Artificial Sequence
  Description of Artificial Sequence: Synthetic oligonucleotide
  Target: ATXN1; (-) strand; PAM type: YTN; PAM sequence: TTG
aagagatacctgcactccca

SEQ ID NO: 220234 - DNA, 20 bp, Artificial Sequence
  Description of Artificial Sequence: Synthetic oligonucleotide
  Target: ATXN1; (-) strand; PAM type: YTN; PAM sequence: CTC
caaaaaaaaagaaagaaaga

SEQ ID NO: 220235 - DNA, 20 bp, Artificial Sequence
  Description of Artificial Sequence: Synthetic oligonucleotide
  Target: ATXN1; (-) strand; PAM type: YTN; PAM sequence: CTA
gactccaaaaaaaaagaaag

SEQ ID NO: 220236 - DNA, 20 bp, Artificial Sequence
  Description of Artificial Sequence: Synthetic oligonucleotide
  Target: ATXN1; (-) strand; PAM type: YTN; PAM sequence: CTG
gtgacacagctagactccaa

SEQ ID NO: 220237 - DNA, 20 bp, Artificial Sequence
  Description of Artificial Sequence: Synthetic oligonucleotide
  Target: ATXN1; (-) strand; PAM type: YTN; PAM sequence: CTC
cagcctggtgacacagctag

SEQ ID NO: 220238 - DNA, 20 bp, Artificial Sequence
  Description of Artificial Sequence: Synthetic oligonucleotide
  Target: ATXN1; (-) strand; PAM type: YTN; PAM sequence: CTA
cactccagcctggtgacaca

SEQ ID NO: 220239 - DNA, 20 bp, Artificial Sequence
  Description of Artificial Sequence: Synthetic oligonucleotide
  Target: ATXN1; (-) strand; PAM type: YTN; PAM sequence: CTG
agatcacagtactacactcc

SEQ ID NO: 220240 - DNA, 20 bp, Artificial Sequence
  Description of Artificial Sequence: Synthetic oligonucleotide
  Target: ATXN1; (-) strand; PAM type: YTN; PAM sequence: TTG
cagtgagctgagatcacagt

SEQ ID NO: 220241 - DNA, 20 bp, Artificial Sequence
  Description of Artificial Sequence: Synthetic oligonucleotide
  Target: ATXN1; (-) strand; PAM type: YTN; PAM sequence: CTG
gaaccagggagtcagaggtt

SEQ ID NO: 220242 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcactggaa

SEQ ID NO: 220243 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaggcaggagaa

SEQ ID NO: 220244 - DNA, 20 bp, Artificial Sequence
  Description of Artificial Sequence: Synthetic oligonucleotide
  Target: ATXN1; (-) strand; PAM type: YTN; PAM sequence: CTA
ctcgggaggctgaggcagga

SEQ ID NO: 220245 - DNA, 20 bp, Artificial Sequence
  Description of Artificial Sequence: Synthetic oligonucleotide
  Target: ATXN1; (-) strand; PAM type: YTN; PAM sequence: CTG
agtgtggtggcatgtgccag

SEQ ID NO: 220246 - DNA, 20 bp, Artificial Sequence
  Description of Artificial Sequence: Synthetic oligonucleotide
  Target: ATXN1; (-) strand; PAM type: YTN; PAM sequence: CTA
taaatgcaaaaagtaactga

SEQ ID NO: 220247 - DNA, 20 bp, Artificial Sequence
  Description of Artificial Sequence: Synthetic oligonucleotide
  Target: ATXN1; (-) strand; PAM type: YTN; PAM sequence: CTA
ctataaatgcaaaaagtaac

SEQ ID NO: 220248 - DNA, 20 bp, Artificial Sequence
  Description of Artificial Sequence: Synthetic oligonucleotide
  Target: ATXN1; (-) strand; PAM type: YTN; PAM sequence: CTC
tactataaatgcaaaaagta

SEQ ID NO: 220249 - DNA, 20 bp, Artificial Sequence
  Description of Artificial Sequence: Synthetic oligonucleotide
  Target: ATXN1; (-) strand; PAM type: YTN; PAM sequence: CTC
cgtctctactataaatgcaa

SEQ ID NO: 220250 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaactccg

SEQ ID NO: 220251 - DNA, 20 bp, Artificial Sequence
  Description of Artificial Sequence: Synthetic oligonucleotide
  Target: ATXN1; (-) strand; PAM type: YTN; PAM sequence: TTG
ggagaccgaggcgaacggat

SEQ ID NO: 220252 - DNA, 20 bp, Artificial Sequence
  Description of Artificial Sequence: Synthetic oligonucleotide
  Target: ATXN1; (-) strand; PAM type: YTN; PAM sequence: TTT
gggagaccgaggcgaacgga

SEQ ID NO: 220253 - DNA, 20 bp, Artificial Sequence
  Description of Artificial Sequence: Synthetic oligonucleotide
  Target: ATXN1; (-) strand; PAM type: YTN; PAM sequence: CTT
tgggagaccgaggcgaacgg

SEQ ID NO: 220254 - DNA, 20 bp, Artificial Sequence
  Description of Artificial Sequence: Synthetic oligonucleotide
  Target: ATXN1; (-) strand; PAM type: YTN; PAM sequence: CTG
taatgccagcactttgggag

SEQ ID NO: 220255 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatgccagcact

SEQ ID NO: 220256 - DNA, 20 bp, Artificial Sequence
  Description of Artificial Sequence: Synthetic oligonucleotide
  Target: ATXN1; (-) strand; PAM type: YTN; PAM sequence: CTG
ggtgcagtggctcacacctg

SEQ ID NO: 220257 - DNA, 20 bp, Artificial Sequence
  Description of Artificial Sequence: Synthetic oligonucleotide
  Target: ATXN1; (-) strand; PAM type: YTN; PAM sequence: CTA
aaaaaaaagtcatggctggg

SEQ ID NO: 220258 - DNA, 20 bp, Artificial Sequence
  Description of Artificial Sequence: Synthetic oligonucleotide
  Target: ATXN1; (-) strand; PAM type: YTN; PAM sequence: TTG
ctaaaaaaaaagtcatggct

SEQ ID NO: 220259 - DNA, 20 bp, Artificial Sequence
  Description of Artificial Sequence: Synthetic oligonucleotide
  Target: ATXN1; (-) strand; PAM type: YTN; PAM sequence: TTT
gctaaaaaaaaagtcatggc

SEQ ID NO: 220260 - DNA, 20 bp, Artificial Sequence
  Description of Artificial Sequence: Synthetic oligonucleotide
  Target: ATXN1; (-) strand; PAM type: YTN; PAM sequence: TTG
gaagaaagtgtttgctaaaa

SEQ ID NO: 220261 - DNA, 20 bp, Artificial Sequence
  Description of Artificial Sequence: Synthetic oligonucleotide
  Target: ATXN1; (-) strand; PAM type: YTN; PAM sequence: CTA
gattggaagaaagtgtttgc

SEQ ID NO: 220262 - DNA, 20 bp, Artificial Sequence
  Description of Artificial Sequence: Synthetic oligonucleotide
  Target: ATXN1; (-) strand; PAM type: YTN; PAM sequence: TTA
aagcctagattggaagaaag

SEQ ID NO: 220263 - DNA, 20 bp, Artificial Sequence
  Description of Artificial Sequence: Synthetic oligonucleotide
  Target: ATXN1; (-) strand; PAM type: YTN; PAM sequence: CTT
aaagcctagattggaagaaa

SEQ ID NO: 220264 - DNA, 20 bp, Artificial Sequence
  Description of Artificial Sequence: Synthetic oligonucleotide
  Target: ATXN1; (-) strand; PAM type: YTN; PAM sequence: TTC
ttaaagcctagattggaaga

SEQ ID NO: 220265 - DNA, 20 bp, Artificial Sequence
  Description of Artificial Sequence: Synthetic oligonucleotide
  Target: ATXN1; (-) strand; PAM type: YTN; PAM sequence: CTA
gattcttaaagcctagattg

SEQ ID NO: 220266 - DNA, 20 bp, Artificial Sequence
  Description of Artificial Sequence: Synthetic oligonucleotide
  Target: ATXN1; (-) strand; PAM type: YTN; PAM sequence: TTA
actagattcttaaagcctag

SEQ ID NO: 220267 - DNA, 20 bp, Artificial Sequence
  Description of Artificial Sequence: Synthetic oligonucleotide
  Target: ATXN1; (-) strand; PAM type: YTN; PAM sequence: TTT
aactagattcttaaagccta

SEQ ID NO: 220268 - DNA, 20 bp, Artificial Sequence
  Description of Artificial Sequence: Synthetic oligonucleotide
  Target: ATXN1; (-) strand; PAM type: YTN; PAM sequence: TTT
taactagattcttaaagcct

SEQ ID NO: 220269 - DNA, 20 bp, Artificial Sequence
  Description of Artificial Sequence: Synthetic oligonucleotide
  Target: ATXN1; (-) strand; PAM type: YTN; PAM sequence: TTA
aaagaaattttaactagatt

SEQ ID NO: 220270 - DNA, 20 bp, Artificial Sequence
  Description of Artificial Sequence: Synthetic oligonucleotide
  Target: ATXN1; (-) strand; PAM type: YTN; PAM sequence: TTA
gttaaaagaaattttaacta

SEQ ID NO: 220271 - DNA, 20 bp, Artificial Sequence
  Description of Artificial Sequence: Synthetic oligonucleotide
  Target: ATXN1; (-) strand; PAM type: YTN; PAM sequence: TTT
agttaaaagaaattttaact

SEQ ID NO: 220272 - DNA, 20 bp, Artificial Sequence
  Description of Artificial Sequence: Synthetic oligonucleotide
  Target: ATXN1; (-) strand; PAM type: YTN; PAM sequence: CTT
tagttaaaagaaattttaac

SEQ ID NO: 220273 - DNA, 20 bp, Artificial Sequence
  Description of Artificial Sequence: Synthetic oligonucleotide
  Target: ATXN1; (-) strand; PAM type: YTN; PAM sequence: TTC
ctttagttaaaagaaatttt

SEQ ID NO: 220274 - DNA, 20 bp, Artificial Sequence
  Description of Artificial Sequence: Synthetic oligonucleotide
  Target: ATXN1; (-) strand; PAM type: YTN; PAM sequence: TTA
ttcctttagttaaaagaaat

SEQ ID NO: 220275 - DNA, 20 bp, Artificial Sequence
  Description of Artificial Sequence: Synthetic oligonucleotide
  Target: ATXN1; (-) strand; PAM type: YTN; PAM sequence: TTT
attcctttagttaaaagaaa

SEQ ID NO: 220276 - DNA, 20 bp, Artificial Sequence
  Description of Artificial Sequence: Synthetic oligonucleotide
  Target: ATXN1; (-) strand; PAM type: YTN; PAM sequence: TTA
aaagtttattcctttagtta

SEQ ID NO: 220277 - DNA, 20 bp, Artificial Sequence
  Description of Artificial Sequence: Synthetic oligonucleotide
  Target: ATXN1; (-) strand; PAM type: YTN; PAM sequence: TTT
aaaagtttattcctttagtt

SEQ ID NO: 220278 - DNA, 20 bp, Artificial Sequence
  Description of Artificial Sequence: Synthetic oligonucleotide
  Target: ATXN1; (-) strand; PAM type: YTN; PAM sequence: CTT
taaaagtttattcctttagt

SEQ ID NO: 220279 - DNA, 20 bp, Artificial Sequence
  Description of Artificial Sequence: Synthetic oligonucleotide
  Target: ATXN1; (-) strand; PAM type: YTN; PAM sequence: TTC
catgtactttaaaagtttat

SEQ ID NO: 220280 - DNA, 20 bp, Artificial Sequence
  Description of Artificial Sequence: Synthetic oligonucleotide
  Target: ATXN1; (-) strand; PAM type: YTN; PAM sequence: TTT
ccatgtactttaaaagttta

SEQ ID NO: 220281 - DNA, 20 bp, Artificial Sequence
  Description of Artificial Sequence: Synthetic oligonucleotide
  Target: ATXN1; (-) strand; PAM type: YTN; PAM sequence: CTT
tccatgtactttaaaagttt

SEQ ID NO: 220282 - DNA, 20 bp, Artificial Sequence
  Description of Artificial Sequence: Synthetic oligonucleotide
  Target: ATXN1; (-) strand; PAM type: YTN; PAM sequence: CTC
tttccatgtactttaaaagt

SEQ ID NO: 220283 - DNA, 20 bp, Artificial Sequence
  Description of Artificial Sequence: Synthetic oligonucleotide
  Target: ATXN1; (-) strand; PAM type: YTN; PAM sequence: CTG
aatctctttccatgtacttt

SEQ ID NO: 220284 - DNA, 20 bp, Artificial Sequence
  Description of Artificial Sequence: Synthetic oligonucleotide
  Target: ATXN1; (-) strand; PAM type: YTN; PAM sequence: TTC
tgaatctctttccatgtact

SEQ ID NO: 220285 - DNA, 20 bp, Artificial Sequence
  Description of Artificial Sequence: Synthetic oligonucleotide
  Target: ATXN1; (-) strand; PAM type: YTN; PAM sequence: TTT
ctgaatctctttccatgtac

SEQ ID NO: 220286 - DNA, 20 bp, Artificial Sequence
  Description of Artificial Sequence: Synthetic oligonucleotide
  Target: ATXN1; (-) strand; PAM type: YTN; PAM sequence: CTT
tctgaatctctttccatgta

SEQ ID NO: 220287 - DNA, 20 bp, Artificial Sequence
  Description of Artificial Sequence: Synthetic oligonucleotide
  Target: ATXN1; (-) strand; PAM type: YTN; PAM sequence: TTC
atgaaaaaggtctttctgaa

SEQ ID NO: 220288 - DNA, 20 bp, Artificial Sequence
  Description of Artificial Sequence: Synthetic oligonucleotide
  Target: ATXN1; (-) strand; PAM type: YTN; PAM sequence: TTT
catgaaaaaggtctttctga

SEQ ID NO: 220289 - DNA, 20 bp, Artificial Sequence
  Description of Artificial Sequence: Synthetic oligonucleotide
  Target: ATXN1; (-) strand; PAM type: YTN; PAM sequence: TTG
atttcatgaaaaaggtcttt

SEQ ID NO: 220290 - DNA, 20 bp, Artificial Sequence
  Description of Artificial Sequence: Synthetic oligonucleotide
  Target: ATXN1; (-) strand; PAM type: YTN; PAM sequence: TTC
atgaattgatttcatgaaaa

SEQ ID NO: 220291 - DNA, 20 bp, Artificial Sequence
  Description of Artificial Sequence: Synthetic oligonucleotide
  Target: ATXN1; (-) strand; PAM type: YTN; PAM sequence: CTT
catgaattgatttcatgaaa

SEQ ID NO: 220292 - DNA, 20 bp, Artificial Sequence
  Description of Artificial Sequence: Synthetic oligonucleotide
  Target: ATXN1; (-) strand; PAM type: YTN; PAM sequence: TTA
cttcatgaattgatttcatg

SEQ ID NO: 220293 - DNA, 20 bp, Artificial Sequence
  Description of Artificial Sequence: Synthetic oligonucleotide
  Target: ATXN1; (-) strand; PAM type: YTN; PAM sequence: CTA
gttacttcatgaattgattt

SEQ ID NO: 220294 - DNA, 20 bp, Artificial Sequence
  Description of Artificial Sequence: Synthetic oligonucleotide
  Target: ATXN1; (-) strand; PAM type: YTN; PAM sequence: TTA
cctagttacttcatgaattg

SEQ ID NO: 220295 - DNA, 20 bp, Artificial Sequence
  Description of Artificial Sequence: Synthetic oligonucleotide
  Target: ATXN1; (-) strand; PAM type: YTN; PAM sequence: TTT
acctagttacttcatgaatt

SEQ ID NO: 220296 - DNA, 20 bp, Artificial Sequence
  Description of Artificial Sequence: Synthetic oligonucleotide
  Target: ATXN1; (-) strand; PAM type: YTN; PAM sequence: TTA
taatttacctagttacttca

SEQ ID NO: 220297 - DNA, 20 bp, Artificial Sequence
  Description of Artificial Sequence: Synthetic oligonucleotide
  Target: ATXN1; (-) strand; PAM type: YTN; PAM sequence: TTT
ataatttacctagttacttc

SEQ ID NO: 220298 - DNA, 20 bp, Artificial Sequence
  Description of Artificial Sequence: Synthetic oligonucleotide
  Target: ATXN1; (-) strand; PAM type: YTN; PAM sequence: CTA
aatagataatgatttataat

SEQ ID NO: 220299 - DNA, 20 bp, Artificial Sequence
  Description of Artificial Sequence: Synthetic oligonucleotide
  Target: ATXN1; (-) strand; PAM type: YTN; PAM sequence: TTC
taaatagataatgatttata

SEQ ID NO: 220300 - DNA, 20 bp, Artificial Sequence
  Description of Artificial Sequence: Synthetic oligonucleotide
  Target: ATXN1; (-) strand; PAM type: YTN; PAM sequence: TTT
ctaaatagataatgatttat

SEQ ID NO: 220301 - DNA, 20 bp, Artificial Sequence
  Description of Artificial Sequence: Synthetic oligonucleotide
  Target: ATXN1; (-) strand; PAM type: YTN; PAM sequence: CTT
tctaaatagataatgattta

SEQ ID NO: 220302 - DNA, 20 bp, Artificial Sequence
  Description of Artificial Sequence: Synthetic oligonucleotide
  Target: ATXN1; (-) strand; PAM type: YTN; PAM sequence: TTC
tttctaaatagataatgatt

SEQ ID NO: 220303 - DNA, 20 bp, Artificial Sequence
  Description of Artificial Sequence: Synthetic oligonucleotide
  Target: ATXN1; (-) strand; PAM type: YTN; PAM sequence: TTT
ctttctaaatagataatgat

SEQ ID NO: 220304 - DNA, 20 bp, Artificial Sequence
  Description of Artificial Sequence: Synthetic oligonucleotide
  Target: ATXN1; (-) strand; PAM type: YTN; PAM sequence: TTT
tctttctaaatagataatga

SEQ ID NO: 220305 - DNA, 20 bp, Artificial Sequence
  Description of Artificial Sequence: Synthetic oligonucleotide
  Target: ATXN1; (-) strand; PAM type: YTN; PAM sequence: TTG
cgtattttctttctaaatag

SEQ ID NO: 220306 - DNA, 20 bp, Artificial Sequence
  Description of Artificial Sequence: Synthetic oligonucleotide
  Target: ATXN1; (-) strand; PAM type: YTN; PAM sequence: TTT
gcgtattttctttctaaata

SEQ ID NO: 220307 - DNA, 20 bp, Artificial Sequence
  Description of Artificial Sequence: Synthetic oligonucleotide
  Target: ATXN1; (-) strand; PAM type: YTN; PAM sequence: CTT
tgcgtattttctttctaaat

SEQ ID NO: 220308 - DNA, 20 bp, Artificial Sequence
  Description of Artificial Sequence: Synthetic oligonucleotide
  Target: ATXN1; (-) strand; PAM type: YTN; PAM sequence: TTC
tttgcgtattttctttctaa

SEQ ID NO: 220309 - DNA, 20 bp, Artificial Sequence
  Description of Artificial Sequence: Synthetic oligonucleotide
  Target: ATXN1; (-) strand; PAM type: YTN; PAM sequence: TTA
gtagttctttgcgtattttc

SEQ ID NO: 220310 - DNA, 20 bp, Artificial Sequence
  Description of Artificial Sequence: Synthetic oligonucleotide
  Target: ATXN1; (-) strand; PAM type: YTN; PAM sequence: TTT
agtagttctttgcgtatttt

SEQ ID NO: 220311 - DNA, 20 bp, Artificial Sequence
  Description of Artificial Sequence: Synthetic oligonucleotide
  Target: ATXN1; (-) strand; PAM type: YTN; PAM sequence: TTG
tttagtagttctttgcgtat

SEQ ID NO: 220312 - DNA, 20 bp, Artificial Sequence
  Description of Artificial Sequence: Synthetic oligonucleotide
  Target: ATXN1; (-) strand; PAM type: YTN; PAM sequence: TTA
acacccaaagataaccagtg

SEQ ID NO: 220313 - DNA, 20 bp, Artificial Sequence
  Description of Artificial Sequence: Synthetic oligonucleotide
  Target: ATXN1; (-) strand; PAM type: YTN; PAM sequence: TTG
catgtgtccattaacaccca

SEQ ID NO: 220314 - DNA, 20 bp, Artificial Sequence
  Description of Artificial Sequence: Synthetic oligonucleotide
  Target: ATXN1; (-) strand; PAM type: YTN; PAM sequence: TTA
tcattgcatgtgtccattaa

SEQ ID NO: 220315 - DNA, 20 bp, Artificial Sequence
  Description of Artificial Sequence: Synthetic oligonucleotide
  Target: ATXN1; (-) strand; PAM type: YTN; PAM sequence: CTA
ttatcattgcatgtgtccat

SEQ ID NO: 220316 - DNA, 20 bp, Artificial Sequence
  Description of Artificial Sequence: Synthetic oligonucleotide
  Target: ATXN1; (-) strand; PAM type: YTN; PAM sequence: TTA
gctattatcattgcatgtgt

SEQ ID NO: 220317 - DNA, 20 bp, Artificial Sequence
  Description of Artificial Sequence: Synthetic oligonucleotide
  Target: ATXN1; (-) strand; PAM type: YTN; PAM sequence: TTA
acatgtgaatgttagctatt

SEQ ID NO: 220318 - DNA, 20 bp, Artificial Sequence
  Description of Artificial Sequence: Synthetic oligonucleotide
  Target: ATXN1; (-) strand; PAM type: YTN; PAM sequence: CTT
aacatgtgaatgttagctat

SEQ ID NO: 220319 - DNA, 20 bp, Artificial Sequence
  Description of Artificial Sequence: Synthetic oligonucleotide
  Target: ATXN1; (-) strand; PAM type: YTN; PAM sequence: CTC
aagggcttaacatgtgaatg

SEQ ID NO: 220320 - DNA, 20 bp, Artificial Sequence
  Description of Artificial Sequence: Synthetic oligonucleotide
  Target: ATXN1; (-) strand; PAM type: YTN; PAM sequence: TTA
gaggagataatgaaactcaa

SEQ ID NO: 220321 - DNA, 20 bp, Artificial Sequence
  Description of Artificial Sequence: Synthetic oligonucleotide
  Target: ATXN1; (-) strand; PAM type: YTN; PAM sequence: CTT
agaggagataatgaaactca

SEQ ID NO: 220322 - DNA, 20 bp, Artificial Sequence
  Description of Artificial Sequence: Synthetic oligonucleotide
  Target: ATXN1; (-) strand; PAM type: YTN; PAM sequence: CTA
gggcttagaggagataatga

SEQ ID NO: 220323 - DNA, 20 bp, Artificial Sequence
  Description of Artificial Sequence: Synthetic oligonucleotide
  Target: ATXN1; (-) strand; PAM type: YTN; PAM sequence: TTC
tagggcttagaggagataat

SEQ ID NO: 220324 - DNA, 20 bp, Artificial Sequence
  Description of Artificial Sequence: Synthetic oligonucleotide
  Target: ATXN1; (-) strand; PAM type: YTN; PAM sequence: CTA
ggatggttctagggcttaga

SEQ ID NO: 220325 - DNA, 20 bp, Artificial Sequence
  Description of Artificial Sequence: Synthetic oligonucleotide
  Target: ATXN1; (-) strand; PAM type: YTN; PAM sequence: CTG
cctaggatggttctagggct

SEQ ID NO: 220326 - DNA, 20 bp, Artificial Sequence
  Description of Artificial Sequence: Synthetic oligonucleotide
  Target: ATXN1; (-) strand; PAM type: YTN; PAM sequence: TTA
gaaggcgggtaataaaagtg

SEQ ID NO: 220327 - DNA, 20 bp, Artificial Sequence
  Description of Artificial Sequence: Synthetic oligonucleotide
  Target: ATXN1; (-) strand; PAM type: YTN; PAM sequence: TTA
ttagaaggcgggtaataaaa

SEQ ID NO: 220328 - DNA, 20 bp, Artificial Sequence
  Description of Artificial Sequence: Synthetic oligonucleotide
  Target: ATXN1; (-) strand; PAM type: YTN; PAM sequence: TTT
attagaaggcgggtaataaa

SEQ ID NO: 220329 - DNA, 20 bp, Artificial Sequence
  Description of Artificial Sequence: Synthetic oligonucleotide
  Target: ATXN1; (-) strand; PAM type: YTN; PAM sequence: TTA
tttattagaaggcgggtaat

SEQ ID NO: 220330 - DNA, 20 bp, Artificial Sequence
  Description of Artificial Sequence: Synthetic oligonucleotide
  Target: ATXN1; (-) strand; PAM type: YTN; PAM sequence: TTT
atttattagaaggcgggtaa

SEQ ID NO: 220331 - DNA, 20 bp, Artificial Sequence
  Description of Artificial Sequence: Synthetic oligonucleotide
  Target: ATXN1; (-) strand; PAM type: YTN; PAM sequence: CTT
tatttattagaaggcgggta

SEQ ID NO: 220332 - DNA, 20 bp, Artificial Sequence
  Description of Artificial Sequence: Synthetic oligonucleotide
  Target: ATXN1; (-) strand; PAM type: YTN; PAM sequence: TTC
tttatttattagaaggcggg

SEQ ID NO: 220333 - DNA, 20 bp, Artificial Sequence
  Description of Artificial Sequence: Synthetic oligonucleotide
  Target: ATXN1; (-) strand; PAM type: YTN; PAM sequence: TTT
ctttatttattagaaggcgg

SEQ ID NO: 220334 - DNA, 20 bp, Artificial Sequence
  Description of Artificial Sequence: Synthetic oligonucleotide
  Target: ATXN1; (-) strand; PAM type: YTN; PAM sequence: CTC
catttctttatttattagaa

SEQ ID NO: 220335 - DNA, 20 bp, Artificial Sequence
  Description of Artificial Sequence: Synthetic oligonucleotide
  Target: ATXN1; (-) strand; PAM type: YTN; PAM sequence: TTC
acctccatttctttatttat

SEQ ID NO: 220336 - DNA, 20 bp, Artificial Sequence
  Description of Artificial Sequence: Synthetic oligonucleotide
  Target: ATXN1; (-) strand; PAM type: YTN; PAM sequence: CTT
cacctccatttctttattta

SEQ ID NO: 220337 - DNA, 20 bp, Artificial Sequence
  Description of Artificial Sequence: Synthetic oligonucleotide
  Target: ATXN1; (-) strand; PAM type: YTN; PAM sequence: CTC
cttcacctccatttctttat

SEQ ID NO: 220338 - DNA, 20 bp, Artificial Sequence
  Description of Artificial Sequence: Synthetic oligonucleotide
  Target: ATXN1; (-) strand; PAM type: YTN; PAM sequence: TTA
tgtagctccttcacctccat

SEQ ID NO: 220339 - DNA, 20 bp, Artificial Sequence
  Description of Artificial Sequence: Synthetic oligonucleotide
  Target: ATXN1; (-) strand; PAM type: YTN; PAM sequence: TTG
tgggtacattatgtagctcc

SEQ ID NO: 220340 - DNA, 20 bp, Artificial Sequence
  Description of Artificial Sequence: Synthetic oligonucleotide
  Target: ATXN1; (-) strand; PAM type: YTN; PAM sequence: CTT
gtgggtacattatgtagctc

SEQ ID NO: 220341 - DNA, 20 bp, Artificial Sequence
  Description of Artificial Sequence: Synthetic oligonucleotide
  Target: ATXN1; (-) strand; PAM type: YTN; PAM sequence: CTG
tcacttgtgggtacattatg

SEQ ID NO: 220342 - DNA, 20 bp, Artificial Sequence
  Description of Artificial Sequence: Synthetic oligonucleotide
  Target: ATXN1; (-) strand; PAM type: YTN; PAM sequence: CTC
aatctgtcacttgtgggtac

SEQ ID NO: 220343 - DNA, 20 bp, Artificial Sequence
  Description of Artificial Sequence: Synthetic oligonucleotide
  Target: ATXN1; (-) strand; PAM type: YTN; PAM sequence: TTG
gagtcctcaatctgtcactt

SEQ ID NO: 220344 - DNA, 20 bp, Artificial Sequence
  Description of Artificial Sequence: Synthetic oligonucleotide
  Target: ATXN1; (-) strand; PAM type: YTN; PAM sequence: CTC
aggtggatggaggttggagt

SEQ ID NO: 220345 - DNA, 20 bp, Artificial Sequence
  Description of Artificial Sequence: Synthetic oligonucleotide
  Target: ATXN1; (-) strand; PAM type: YTN; PAM sequence: CTC
tcaggtggatggaggttgga

SEQ ID NO: 220346 - DNA, 20 bp, Artificial Sequence
  Description of Artificial Sequence: Synthetic oligonucleotide
  Target: ATXN1; (-) strand; PAM type: YTN; PAM sequence: TTG
ctctcaggtggatggaggtt

SEQ ID NO: 220347 - DNA, 20 bp, Artificial Sequence
  Description of Artificial Sequence: Synthetic oligonucleotide
  Target: ATXN1; (-) strand; PAM type: YTN; PAM sequence: TTT
gctctcaggtggatggaggt

SEQ ID NO: 220348 - DNA, 20 bp, Artificial Sequence
  Description of Artificial Sequence: Synthetic oligonucleotide
  Target: ATXN1; (-) strand; PAM type: YTN; PAM sequence: CTT
tgctctcaggtggatggagg

SEQ ID NO: 220349 - DNA, 20 bp, Artificial Sequence
  Description of Artificial Sequence: Synthetic oligonucleotide
  Target: ATXN1; (-) strand; PAM type: YTN; PAM sequence: CTG
aggagatagagaatctttgc

SEQ ID NO: 220350 - DNA, 20 bp, Artificial Sequence
  Description of Artificial Sequence: Synthetic oligonucleotide
  Target: ATXN1; (-) strand; PAM type: YTN; PAM sequence: TTG
gaaaggaggcagcagactga

SEQ ID NO: 220351 - DNA, 20 bp, Artificial Sequence
  Description of Artificial Sequence: Synthetic oligonucleotide
  Target: ATXN1; (-) strand; PAM type: YTN; PAM sequence: TTA
attggaaaggaggcagcaga

SEQ ID NO: 220352 - DNA, 20 bp, Artificial Sequence
  Description of Artificial Sequence: Synthetic oligonucleotide
  Target: ATXN1; (-) strand; PAM type: YTN; PAM sequence: CTA
ttaattggaaaggaggcagc

SEQ ID NO: 220353 - DNA, 20 bp, Artificial Sequence
  Description of Artificial Sequence: Synthetic oligonucleotide
  Target: ATXN1; (-) strand; PAM type: YTN; PAM sequence: TTC
agtcaactattaattggaaa

SEQ ID NO: 220354 - DNA, 20 bp, Artificial Sequence
  Description of Artificial Sequence: Synthetic oligonucleotide
  Target: ATXN1; (-) strand; PAM type: YTN; PAM sequence: CTA
ccgaagttcagtcaactatt

SEQ ID NO: 220355 - DNA, 20 bp, Artificial Sequence
  Description of Artificial Sequence: Synthetic oligonucleotide
  Target: ATXN1; (-) strand; PAM type: YTN; PAM sequence: CTG
ccagaggaagaatctaccga

SEQ ID NO: 220356 - DNA, 20 bp, Artificial Sequence
  Description of Artificial Sequence: Synthetic oligonucleotide
  Target: ATXN1; (-) strand; PAM type: YTN; PAM sequence: TTG
tggaatacctgccagaggaa

SEQ ID NO: 220357 - DNA, 20 bp, Artificial Sequence
  Description of Artificial Sequence: Synthetic oligonucleotide
  Target: ATXN1; (-) strand; PAM type: YTN; PAM sequence: TTC
atgattgtggaatacctgcc

SEQ ID NO: 220358 - DNA, 20 bp, Artificial Sequence
  Description of Artificial Sequence: Synthetic oligonucleotide
  Target: ATXN1; (-) strand; PAM type: YTN; PAM sequence: TTT
catgattgtggaatacctgc

SEQ ID NO: 220359 - DNA, 20 bp, Artificial Sequence
  Description of Artificial Sequence: Synthetic oligonucleotide
  Target: ATXN1; (-) strand; PAM type: YTN; PAM sequence: TTG
aaacaagaaagtgaagagga

SEQ ID NO: 220360 - DNA, 20 bp, Artificial Sequence
  Description of Artificial Sequence: Synthetic oligonucleotide
  Target: ATXN1; (-) strand; PAM type: YTN; PAM sequence: TTT
gaaacaagaaagtgaagagg

SEQ ID NO: 220361 - DNA, 20 bp, Artificial Sequence
  Description of Artificial Sequence: Synthetic oligonucleotide
  Target: ATXN1; (-) strand; PAM type: YTN; PAM sequence: CTT
tgaaacaagaaagtgaagag

SEQ ID NO: 220362 - DNA, 20 bp, Artificial Sequence
  Description of Artificial Sequence: Synthetic oligonucleotide
  Target: ATXN1; (-) strand; PAM type: YTN; PAM sequence: CTC
actttgaaacaagaaagtga

SEQ ID NO: 220363 - DNA, 20 bp, Artificial Sequence
  Description of Artificial Sequence: Synthetic oligonucleotide
  Target: ATXN1; (-) strand; PAM type: YTN; PAM sequence: CTC
ctcactttgaaacaagaaag

SEQ ID NO: 220364 - DNA, 20 bp, Artificial Sequence
  Description of Artificial Sequence: Synthetic oligonucleotide
  Target: ATXN1; (-) strand; PAM type: YTN; PAM sequence: TTC
atcaagccaactcctcactt

SEQ ID NO: 220365 - DNA, 20 bp, Artificial Sequence
  Description of Artificial Sequence: Synthetic oligonucleotide
  Target: ATXN1; (-) strand; PAM type: YTN; PAM sequence: CTG
agccaattcatcaagccaac

SEQ ID NO: 220366 - DNA, 20 bp, Artificial Sequence
  Description of Artificial Sequence: Synthetic oligonucleotide
  Target: ATXN1; (-) strand; PAM type: YTN; PAM sequence: CTC
tgagccaattcatcaagcca

SEQ ID NO: 220367 - DNA, 20 bp, Artificial Sequence
  Description of Artificial Sequence: Synthetic oligonucleotide
  Target: ATXN1; (-) strand; PAM type: YTN; PAM sequence: TTA
ggatgggctctgagccaatt

SEQ ID NO: 220368 - DNA, 20 bp, Artificial Sequence
  Description of Artificial Sequence: Synthetic oligonucleotide
  Target: ATXN1; (-) strand; PAM type: YTN; PAM sequence: TTT
aggatgggctctgagccaat

SEQ ID NO: 220369 - DNA, 20 bp, Artificial Sequence
  Description of Artificial Sequence: Synthetic oligonucleotide
  Target: ATXN1; (-) strand; PAM type: YTN; PAM sequence: TTT
taggatgggctctgagccaa

SEQ ID NO: 220370 - DNA, 20 bp, Artificial Sequence
  Description of Artificial Sequence: Synthetic oligonucleotide
  Target: ATXN1; (-) strand; PAM type: YTN; PAM sequence: TTA
ccgacacgtacatattttag

SEQ ID NO: 220371 - DNA, 20 bp, Artificial Sequence
  Description of Artificial Sequence: Synthetic oligonucleotide
  Target: ATXN1; (-) strand; PAM type: YTN; PAM sequence: CTT
accgacacgtacatatttta

SEQ ID NO: 220372 - DNA, 20 bp, Artificial Sequence
  Description of Artificial Sequence: Synthetic oligonucleotide
  Target: ATXN1; (-) strand; PAM type: YTN; PAM sequence: TTG
gggaggcaaaagaatcttac

SEQ ID NO: 220373 - DNA, 20 bp, Artificial Sequence
  Description of Artificial Sequence: Synthetic oligonucleotide
  Target: ATXN1; (-) strand; PAM type: YTN; PAM sequence: TTT
ggggaggcaaaagaatctta

SEQ ID NO: 220374 - DNA, 20 bp, Artificial Sequence
  Description of Artificial Sequence: Synthetic oligonucleotide
  Target: ATXN1; (-) strand; PAM type: YTN; PAM sequence: CTT
tggggaggcaaaagaatctt

SEQ ID NO: 220375 - DNA, 20 bp, Artificial Sequence
  Description of Artificial Sequence: Synthetic oligonucleotide
  Target: ATXN1; (-) strand; PAM type: YTN; PAM sequence: CTG
ctttggggaggcaaaagaat

SEQ ID NO: 220376 - DNA, 20 bp, Artificial Sequence
  Description of Artificial Sequence: Synthetic oligonucleotide
  Target: ATXN1; (-) strand; PAM type: YTN; PAM sequence: TTC
catgtgataaccggtctgct

SEQ ID NO: 220377 - DNA, 20 bp, Artificial Sequence
  Description of Artificial Sequence: Synthetic oligonucleotide
  Target: ATXN1; (-) strand; PAM type: YTN; PAM sequence: TTT
ccatgtgataaccggtctgc

SEQ ID NO: 220378 - DNA, 20 bp, Artificial Sequence
  Description of Artificial Sequence: Synthetic oligonucleotide
  Target: ATXN1; (-) strand; PAM type: YTN; PAM sequence: TTT
tccatgtgataaccggtctg

SEQ ID NO: 220379 - DNA, 20 bp, Artificial Sequence
  Description of Artificial Sequence: Synthetic oligonucleotide
  Target: ATXN1; (-) strand; PAM type: YTN; PAM sequence: TTT
ttccatgtgataaccggtct

SEQ ID NO: 220380 - DNA, 20 bp, Artificial Sequence
  Description of Artificial Sequence: Synthetic oligonucleotide
  Target: ATXN1; (-) strand; PAM type: YTN; PAM sequence: CTT
tttccatgtgataaccggtc

SEQ ID NO: 220381 - DNA, 20 bp, Artificial Sequence
  Description of Artificial Sequence: Synthetic oligonucleotide
  Target: ATXN1; (-) strand; PAM type: YTN; PAM sequence: CTC
ctttttccatgtgataaccg

SEQ ID NO: 220382 - DNA, 20 bp, Artificial Sequence
  Description of Artificial Sequence: Synthetic oligonucleotide
  Target: ATXN1; (-) strand; PAM type: YTN; PAM sequence: TTG
tgagtgagactcctttttcc

SEQ ID NO: 220383 - DNA, 20 bp, Artificial Sequence
  Description of Artificial Sequence: Synthetic oligonucleotide
  Target: ATXN1; (-) strand; PAM type: YTN; PAM sequence: CTT
gtgagtgagactcctttttc

SEQ ID NO: 220384 - DNA, 20 bp, Artificial Sequence
  Description of Artificial Sequence: Synthetic oligonucleotide
  Target: ATXN1; (-) strand; PAM type: YTN; PAM sequence: CTC
acagaatccagcgtgtggct

SEQ ID NO: 220385 - DNA, 20 bp, Artificial Sequence
  Description of Artificial Sequence: Synthetic oligonucleotide
  Target: ATXN1; (-) strand; PAM type: YTN; PAM sequence: TTA
acctcacagaatccagcgtg

SEQ ID NO: 220386 - DNA, 20 bp, Artificial Sequence
  Description of Artificial Sequence: Synthetic oligonucleotide
  Target: ATXN1; (-) strand; PAM type: YTN; PAM sequence: TTT
aacctcacagaatccagcgt

SEQ ID NO: 220387 - DNA, 20 bp, Artificial Sequence
  Description of Artificial Sequence: Synthetic oligonucleotide
  Target: ATXN1; (-) strand; PAM type: YTN; PAM sequence: TTT
taacctcacagaatccagcg

SEQ ID NO: 220388 - DNA, 20 bp, Artificial Sequence
  Description of Artificial Sequence: Synthetic oligonucleotide
  Target: ATXN1; (-) strand; PAM type: YTN; PAM sequence: CTA
agaatcaaaagttttaacct

SEQ ID NO: 220389 - DNA, 20 bp, Artificial Sequence
  Description of Artificial Sequence: Synthetic oligonucleotide
  Target: ATXN1; (-) strand; PAM type: YTN; PAM sequence: TTC
taagaatcaaaagttttaac

SEQ ID NO: 220390 - DNA, 20 bp, Artificial Sequence
  Description of Artificial Sequence: Synthetic oligonucleotide
  Target: ATXN1; (-) strand; PAM type: YTN; PAM sequence: CTT
ctaagaatcaaaagttttaa

SEQ ID NO: 220391 - DNA, 20 bp, Artificial Sequence
  Description of Artificial Sequence: Synthetic oligonucleotide
  Target: ATXN1; (-) strand; PAM type: YTN; PAM sequence: CTC
atgtccttctaagaatcaaa

SEQ ID NO: 220392 - DNA, 20 bp, Artificial Sequence
  Description of Artificial Sequence: Synthetic oligonucleotide
  Target: ATXN1; (-) strand; PAM type: YTN; PAM sequence: CTA
tcctcatgtccttctaagaa

SEQ ID NO: 220393 - DNA, 20 bp, Artificial Sequence
  Description of Artificial Sequence: Synthetic oligonucleotide
  Target: ATXN1; (-) strand; PAM type: YTN; PAM sequence: CTC
tatcctcatgtccttctaag

SEQ ID NO: 220394 - DNA, 20 bp, Artificial Sequence
  Description of Artificial Sequence: Synthetic oligonucleotide
  Target: ATXN1; (-) strand; PAM type: YTN; PAM sequence: TTA
cagaacatcagtgctctatc

SEQ ID NO: 220395 - DNA, 20 bp, Artificial Sequence
  Description of Artificial Sequence: Synthetic oligonucleotide
  Target: ATXN1; (-) strand; PAM type: YTN; PAM sequence: TTT
acagaacatcagtgctctat

SEQ ID NO: 220396 - DNA, 20 bp, Artificial Sequence
  Description of Artificial Sequence: Synthetic oligonucleotide
  Target: ATXN1; (-) strand; PAM type: YTN; PAM sequence: TTG
tttacagaacatcagtgctc

SEQ ID NO: 220397 - DNA, 20 bp, Artificial Sequence
  Description of Artificial Sequence: Synthetic oligonucleotide
  Target: ATXN1; (-) strand; PAM type: YTN; PAM sequence: TTT
gtttacagaacatcagtgct

SEQ ID NO: 220398 - DNA, 20 bp, Artificial Sequence
  Description of Artificial Sequence: Synthetic oligonucleotide
  Target: ATXN1; (-) strand; PAM type: YTN; PAM sequence: TTT
tgtttacagaacatcagtgc

SEQ ID NO: 220399 - DNA, 20 bp, Artificial Sequence
  Description of Artificial Sequence: Synthetic oligonucleotide
  Target: ATXN1; (-) strand; PAM type: YTN; PAM sequence: TTA
cagaccatcattttgtttac

SEQ ID NO: 220400 - DNA, 20 bp, Artificial Sequence
  Description of Artificial Sequence: Synthetic oligonucleotide
  Target: ATXN1; (-) strand; PAM type: YTN; PAM sequence: TTT
acagaccatcattttgttta

SEQ ID NO: 220401 - DNA, 20 bp, Artificial Sequence
  Description of Artificial Sequence: Synthetic oligonucleotide
  Target: ATXN1; (-) strand; PAM type: YTN; PAM sequence: TTG
tttacagaccatcattttgt

SEQ ID NO: 220402 - DNA, 20 bp, Artificial Sequence
  Description of Artificial Sequence: Synthetic oligonucleotide
  Target: ATXN1; (-) strand; PAM type: YTN; PAM sequence: TTT
gtttacagaccatcattttg

SEQ ID NO: 220403 - DNA, 20 bp, Artificial Sequence
  Description of Artificial Sequence: Synthetic oligonucleotide
  Target: ATXN1; (-) strand; PAM type: YTN; PAM sequence: TTT
tgtttacagaccatcatttt

SEQ ID NO: 220404 - DNA, 20 bp, Artificial Sequence
  Description of Artificial Sequence: Synthetic oligonucleotide
  Target: ATXN1; (-) strand; PAM type: YTN; PAM sequence: TTG
aattttgtttacagaccatc

SEQ ID NO: 220405 - DNA, 20 bp, Artificial Sequence
  Description of Artificial Sequence: Synthetic oligonucleotide
  Target: ATXN1; (-) strand; PAM type: YTN; PAM sequence: CTT
gaattttgtttacagaccat

SEQ ID NO: 220406 - DNA, 20 bp, Artificial Sequence
  Description of Artificial Sequence: Synthetic oligonucleotide
  Target: ATXN1; (-) strand; PAM type: YTN; PAM sequence: CTG
aggataccttgaattttgtt

SEQ ID NO: 220407 - DNA, 20 bp, Artificial Sequence
  Description of Artificial Sequence: Synthetic oligonucleotide
  Target: ATXN1; (-) strand; PAM type: YTN; PAM sequence: CTG
ggctgaggataccttgaatt

SEQ ID NO: 220408 - DNA, 20 bp, Artificial Sequence
  Description of Artificial Sequence: Synthetic oligonucleotide
  Target: ATXN1; (-) strand; PAM type: YTN; PAM sequence: TTC
gggctgggctgaggatacct

SEQ ID NO: 220409 - DNA, 20 bp, Artificial Sequence
  Description of Artificial Sequence: Synthetic oligonucleotide
  Target: ATXN1; (-) strand; PAM type: YTN; PAM sequence: TTC
agaggaataaacaggggatt

SEQ ID NO: 220410 - DNA, 20 bp, Artificial Sequence
  Description of Artificial Sequence: Synthetic oligonucleotide
  Target: ATXN1; (-) strand; PAM type: YTN; PAM sequence: TTT
cagaggaataaacaggggat

SEQ ID NO: 220411 - DNA, 20 bp, Artificial Sequence
  Description of Artificial Sequence: Synthetic oligonucleotide
  Target: ATXN1; (-) strand; PAM type: YTN; PAM sequence: CTT
tcagaggaataaacagggga

SEQ ID NO: 220412 - DNA, 20 bp, Artificial Sequence
  Description of Artificial Sequence: Synthetic oligonucleotide
  Target: ATXN1; (-) strand; PAM type: YTN; PAM sequence: TTC
ataaatgtgctttcagagga

SEQ ID NO: 220413 - DNA, 20 bp, Artificial Sequence
  Description of Artificial Sequence: Synthetic oligonucleotide
  Target: ATXN1; (-) strand; PAM type: YTN; PAM sequence: TTT
cataaatgtgctttcagagg

SEQ ID NO: 220414 - DNA, 20 bp, Artificial Sequence
  Description of Artificial Sequence: Synthetic oligonucleotide
  Target: ATXN1; (-) strand; PAM type: YTN; PAM sequence: TTG
tttcataaatgtgctttcag

SEQ ID NO: 220415 - DNA, 20 bp, Artificial Sequence
  Description of Artificial Sequence: Synthetic oligonucleotide
  Target: ATXN1; (-) strand; PAM type: YTN; PAM sequence: CTT
gtttcataaatgtgctttca

SEQ ID NO: 220416 - DNA, 20 bp, Artificial Sequence
  Description of Artificial Sequence: Synthetic oligonucleotide
  Target: ATXN1; (-) strand; PAM type: YTN; PAM sequence: TTG
cagagcttgtttcataaatg

SEQ ID NO: 220417 - DNA, 20 bp, Artificial Sequence
  Description of Artificial Sequence: Synthetic oligonucleotide
  Target: ATXN1; (-) strand; PAM type: YTN; PAM sequence: TTT
gcagagcttgtttcataaat

SEQ ID NO: 220418 - DNA, 20 bp, Artificial Sequence
  Description of Artificial Sequence: Synthetic oligonucleotide
  Target: ATXN1; (-) strand; PAM type: YTN; PAM sequence: TTT
tgcagagcttgtttcataaa

SEQ ID NO: 220419 - DNA, 20 bp, Artificial Sequence
  Description of Artificial Sequence: Synthetic oligonucleotide
  Target: ATXN1; (-) strand; PAM type: YTN; PAM sequence: TTT
ttgcagagcttgtttcataa

SEQ ID NO: 220420 - DNA, 20 bp, Artificial Sequence
  Description of Artificial Sequence: Synthetic oligonucleotide
  Target: ATXN1; (-) strand; PAM type: YTN; PAM sequence: CTG
gcatttttgcagagcttgtt

SEQ ID NO: 220421 - DNA, 20 bp, Artificial Sequence
  Description of Artificial Sequence: Synthetic oligonucleotide
  Target: ATXN1; (-) strand; PAM type: YTN; PAM sequence: TTA
gagatgactggcatttttgc

SEQ ID NO: 220422 - DNA, 20 bp, Artificial Sequence
  Description of Artificial Sequence: Synthetic oligonucleotide
  Target: ATXN1; (-) strand; PAM type: YTN; PAM sequence: CTT
agagatgactggcatttttg

SEQ ID NO: 220423 - DNA, 20 bp, Artificial Sequence
  Description of Artificial Sequence: Synthetic oligonucleotide
  Target: ATXN1; (-) strand; PAM type: YTN; PAM sequence: CTG
tggtgccttagagatgactg

SEQ ID NO: 220424 - DNA, 20 bp, Artificial Sequence
  Description of Artificial Sequence: Synthetic oligonucleotide
  Target: ATXN1; (-) strand; PAM type: YTN; PAM sequence: TTA
ctgtggtgccttagagatga

SEQ ID NO: 220425 - DNA, 20 bp, Artificial Sequence
  Description of Artificial Sequence: Synthetic oligonucleotide
  Target: ATXN1; (-) strand; PAM type: YTN; PAM sequence: CTT
actgtggtgccttagagatg

SEQ ID NO: 220426 - DNA, 20 bp, Artificial Sequence
  Description of Artificial Sequence: Synthetic oligonucleotide
  Target: ATXN1; (-) strand; PAM type: YTN; PAM sequence: TTG
ccttactgtggtgccttaga

SEQ ID NO: 220427 - DNA, 20 bp, Artificial Sequence
  Description of Artificial Sequence: Synthetic oligonucleotide
  Target: ATXN1; (-) strand; PAM type: YTN; PAM sequence: CTT
gccttactgtggtgccttag

SEQ ID NO: 220428 - DNA, 20 bp, Artificial Sequence
  Description of Artificial Sequence: Synthetic oligonucleotide
  Target: ATXN1; (-) strand; PAM type: YTN; PAM sequence: CTC
cttgccttactgtggtgcct

SEQ ID NO: 220429 - DNA, 20 bp, Artificial Sequence
  Description of Artificial Sequence: Synthetic oligonucleotide
  Target: ATXN1; (-) strand; PAM type: YTN; PAM sequence: CTA
catagctccttgccttactg

SEQ ID NO: 220430 - DNA, 20 bp, Artificial Sequence
  Description of Artificial Sequence: Synthetic oligonucleotide
  Target: ATXN1; (-) strand; PAM type: YTN; PAM sequence: TTC
aaaaggataacactacatag

SEQ ID NO: 220431 - DNA, 20 bp, Artificial Sequence
  Description of Artificial Sequence: Synthetic oligonucleotide
  Target: ATXN1; (-) strand; PAM type: YTN; PAM sequence: CTT
caaaaggataacactacata

SEQ ID NO: 220432 - DNA, 20 bp, Artificial Sequence
  Description of Artificial Sequence: Synthetic oligonucleotide
  Target: ATXN1; (-) strand; PAM type: YTN; PAM sequence: TTA
gaaagcacttcaaaaggata

SEQ ID NO: 220433 - DNA, 20 bp, Artificial Sequence
  Description of Artificial Sequence: Synthetic oligonucleotide
  Target: ATXN1; (-) strand; PAM type: YTN; PAM sequence: TTT
agaaagcacttcaaaaggat

SEQ ID NO: 220434 - DNA, 20 bp, Artificial Sequence
  Description of Artificial Sequence: Synthetic oligonucleotide
  Target: ATXN1; (-) strand; PAM type: YTN; PAM sequence: TTA
agcgtttagaaagcacttca

SEQ ID NO: 220435 - DNA, 20 bp, Artificial Sequence
  Description of Artificial Sequence: Synthetic oligonucleotide
  Target: ATXN1; (-) strand; PAM type: YTN; PAM sequence: CTG
acccaagggagttaagcgtt

SEQ ID NO: 220436 - DNA, 20 bp, Artificial Sequence
  Description of Artificial Sequence: Synthetic oligonucleotide
  Target: ATXN1; (-) strand; PAM type: YTN; PAM sequence: CTG
aggtgagagaaataataagc

SEQ ID NO: 220437 - DNA, 20 bp, Artificial Sequence
  Description of Artificial Sequence: Synthetic oligonucleotide
  Target: ATXN1; (-) strand; PAM type: YTN; PAM sequence: TTA
gcagaaggaaagccatctga

SEQ ID NO: 220438 - DNA, 20 bp, Artificial Sequence
  Description of Artificial Sequence: Synthetic oligonucleotide
  Target: ATXN1; (-) strand; PAM type: YTN; PAM sequence: TTG
tgggttagcagaaggaaagc

SEQ ID NO: 220439 - DNA, 20 bp, Artificial Sequence
  Description of Artificial Sequence: Synthetic oligonucleotide
  Target: ATXN1; (-) strand; PAM type: YTN; PAM sequence: TTA
acgattgtgggttagcagaa

SEQ ID NO: 220440 - DNA, 20 bp, Artificial Sequence
  Description of Artificial Sequence: Synthetic oligonucleotide
  Target: ATXN1; (-) strand; PAM type: YTN; PAM sequence: TTT
aacgattgtgggttagcaga

SEQ ID NO: 220441 - DNA, 20 bp, Artificial Sequence
  Description of Artificial Sequence: Synthetic oligonucleotide
  Target: ATXN1; (-) strand; PAM type: YTN; PAM sequence: TTT
taacgattgtgggttagcag

SEQ ID NO: 220442 - DNA, 20 bp, Artificial Sequence
  Description of Artificial Sequence: Synthetic oligonucleotide
  Target: ATXN1; (-) strand; PAM type: YTN; PAM sequence: TTT
ttaacgattgtgggttagca

SEQ ID NO: 220443 - DNA, 20 bp, Artificial Sequence
  Description of Artificial Sequence: Synthetic oligonucleotide
  Target: ATXN1; (-) strand; PAM type: YTN; PAM sequence: TTC
agtatgtttttaacgattgt

SEQ ID NO: 220444 - DNA, 20 bp, Artificial Sequence
  Description of Artificial Sequence: Synthetic oligonucleotide
  Target: ATXN1; (-) strand; PAM type: YTN; PAM sequence: CTA
gaaagtgttcagtatgtttt

SEQ ID NO: 220445 - DNA, 20 bp, Artificial Sequence
  Description of Artificial Sequence: Synthetic oligonucleotide
  Target: ATXN1; (-) strand; PAM type: YTN; PAM sequence: CTA
agaataatctagaaagtgtt

SEQ ID NO: 220446 - DNA, 20 bp, Artificial Sequence
  Description of Artificial Sequence: Synthetic oligonucleotide
  Target: ATXN1; (-) strand; PAM type: YTN; PAM sequence: TTG
aaaaatgactaagaataatc

SEQ ID NO: 220447 - DNA, 20 bp, Artificial Sequence
  Description of Artificial Sequence: Synthetic oligonucleotide
  Target: ATXN1; (-) strand; PAM type: YTN; PAM sequence: TTG
agccgggcattgaaaaatga

SEQ ID NO: 220448 - DNA, 20 bp, Artificial Sequence
  Description of Artificial Sequence: Synthetic oligonucleotide
  Target: ATXN1; (-) strand; PAM type: YTN; PAM sequence: CTT
gagccgggcattgaaaaatg

SEQ ID NO: 220449 - DNA, 20 bp, Artificial Sequence
  Description of Artificial Sequence: Synthetic oligonucleotide
  Target: ATXN1; (-) strand; PAM type: YTN; PAM sequence: TTA
tagaaagacaaatgtcttga

SEQ ID NO: 220450 - DNA, 20 bp, Artificial Sequence
  Description of Artificial Sequence: Synthetic oligonucleotide
  Target: ATXN1; (-) strand; PAM type: YTN; PAM sequence: CTG
cagtggttatagaaagacaa

SEQ ID NO: 220451 - DNA, 20 bp, Artificial Sequence
  Description of Artificial Sequence: Synthetic oligonucleotide
  Target: ATXN1; (-) strand; PAM type: YTN; PAM sequence: TTG
gggaaagagtgagctgcagt

SEQ ID NO: 220452 - DNA, 20 bp, Artificial Sequence
  Description of Artificial Sequence: Synthetic oligonucleotide
  Target: ATXN1; (-) strand; PAM type: YTN; PAM sequence: TTT
ggggaaagagtgagctgcag

SEQ ID NO: 220453 - DNA, 20 bp, Artificial Sequence
  Description of Artificial Sequence: Synthetic oligonucleotide
  Target: ATXN1; (-) strand; PAM type: YTN; PAM sequence: CTT
tggggaaagagtgagctgca

SEQ ID NO: 220454 - DNA, 20 bp, Artificial Sequence
  Description of Artificial Sequence: Synthetic oligonucleotide
  Target: ATXN1; (-) strand; PAM type: YTN; PAM sequence: CTG
gcccgaggcactttggggaa

SEQ ID NO: 220455 - DNA, 20 bp, Artificial Sequence
  Description of Artificial Sequence: Synthetic oligonucleotide
  Target: ATXN1; (-) strand; PAM type: YTN; PAM sequence: TTG
atgggagtcctggcccgagg

SEQ ID NO: 220456 - DNA, 20 bp, Artificial Sequence
  Description of Artificial Sequence: Synthetic oligonucleotide
  Target: ATXN1; (-) strand; PAM type: YTN; PAM sequence: CTT
gatgggagtcctggcccgag

SEQ ID NO: 220457 - DNA, 20 bp, Artificial Sequence
  Description of Artificial Sequence: Synthetic oligonucleotide
  Target: ATXN1; (-) strand; PAM type: YTN; PAM sequence: TTA
cagggggtcagagagcacat

SEQ ID NO: 220458 - DNA, 20 bp, Artificial Sequence
  Description of Artificial Sequence: Synthetic oligonucleotide
  Target: ATXN1; (-) strand; PAM type: YTN; PAM sequence: CTC
acacaaatgaggcaacatta

SEQ ID NO: 220459 - DNA, 20 bp, Artificial Sequence
  Description of Artificial Sequence: Synthetic oligonucleotide
  Target: ATXN1; (-) strand; PAM type: YTN; PAM sequence: TTA
cgaaagccgagactcacaca

SEQ ID NO: 220460 - DNA, 20 bp, Artificial Sequence
  Description of Artificial Sequence: Synthetic oligonucleotide
  Target: ATXN1; (-) strand; PAM type: YTN; PAM sequence: TTA
atagttacgaaagccgagac

SEQ ID NO: 220461 - DNA, 20 bp, Artificial Sequence
  Description of Artificial Sequence: Synthetic oligonucleotide
  Target: ATXN1; (-) strand; PAM type: YTN; PAM sequence: CTA
ttaatagttacgaaagccga

SEQ ID NO: 220462 - DNA, 20 bp, Artificial Sequence
  Description of Artificial Sequence: Synthetic oligonucleotide
  Target: ATXN1; (-) strand; PAM type: YTN; PAM sequence: CTG
tcatctattaatagttacga

SEQ ID NO: 220463 - DNA, 20 bp, Artificial Sequence
  Description of Artificial Sequence: Synthetic oligonucleotide
  Target: ATXN1; (-) strand; PAM type: YTN; PAM sequence: TTA
agaacatctgtcatctatta

SEQ ID NO: 220464 - DNA, 20 bp, Artificial Sequence
  Description of Artificial Sequence: Synthetic oligonucleotide
  Target: ATXN1; (-) strand; PAM type: YTN; PAM sequence: TTT
aagaacatctgtcatctatt

SEQ ID NO: 220465 - DNA, 20 bp, Artificial Sequence
  Description of Artificial Sequence: Synthetic oligonucleotide
  Target: ATXN1; (-) strand; PAM type: YTN; PAM sequence: TTT
taagaacatctgtcatctat

SEQ ID NO: 220466 - DNA, 20 bp, Artificial Sequence
  Description of Artificial Sequence: Synthetic oligonucleotide
  Target: ATXN1; (-) strand; PAM type: YTN; PAM sequence: CTA
gaaggttttaagaacatctg

SEQ ID NO: 220467 - DNA, 20 bp, Artificial Sequence
  Description of Artificial Sequence: Synthetic oligonucleotide
  Target: ATXN1; (-) strand; PAM type: YTN; PAM sequence: CTC
tagaaggttttaagaacatc

SEQ ID NO: 220468 - DNA, 20 bp, Artificial Sequence
  Description of Artificial Sequence: Synthetic oligonucleotide
  Target: ATXN1; (-) strand; PAM type: YTN; PAM sequence: TTC
tctagaaggttttaagaaca

SEQ ID NO: 220469 - DNA, 20 bp, Artificial Sequence
  Description of Artificial Sequence: Synthetic oligonucleotide
  Target: ATXN1; (-) strand; PAM type: YTN; PAM sequence: TTT
ctctagaaggttttaagaac

SEQ ID NO: 220470 - DNA, 20 bp, Artificial Sequence
  Description of Artificial Sequence: Synthetic oligonucleotide
  Target: ATXN1; (-) strand; PAM type: YTN; PAM sequence: TTG
agagatttctctagaaggtt

SEQ ID NO: 220471 - DNA, 20 bp, Artificial Sequence
  Description of Artificial Sequence: Synthetic oligonucleotide
  Target: ATXN1; (-) strand; PAM type: YTN; PAM sequence: CTT
gagagatttctctagaaggt

SEQ ID NO: 220472 - DNA, 20 bp, Artificial Sequence
  Description of Artificial Sequence: Synthetic oligonucleotide
  Target: ATXN1; (-) strand; PAM type: YTN; PAM sequence: CTG
ccttgagagatttctctaga

SEQ ID NO: 220473 - DNA, 20 bp, Artificial Sequence
  Description of Artificial Sequence: Synthetic oligonucleotide
  Target: ATXN1; (-) strand; PAM type: YTN; PAM sequence: CTA
tgtgcactgccttgagagat

SEQ ID NO: 220474 - DNA, 20 bp, Artificial Sequence
  Description of Artificial Sequence: Synthetic oligonucleotide
  Target: ATXN1; (-) strand; PAM type: YTN; PAM sequence: CTG
gcactatgtgcactgccttg

SEQ ID NO: 220475 - DNA, 20 bp, Artificial Sequence
  Description of Artificial Sequence: Synthetic oligonucleotide
  Target: ATXN1; (-) strand; PAM type: YTN; PAM sequence: TTG
tatctggcactatgtgcact

SEQ ID NO: 220476 - DNA, 20 bp, Artificial Sequence
  Description of Artificial Sequence: Synthetic oligonucleotide
  Target: ATXN1; (-) strand; PAM type: YTN; PAM sequence: TTT
gtatctggcactatgtgcac

SEQ ID NO: 220477 - DNA, 20 bp, Artificial Sequence
  Description of Artificial Sequence: Synthetic oligonucleotide
  Target: ATXN1; (-) strand; PAM type: YTN; PAM sequence: TTT
tgtatctggcactatgtgca

SEQ ID NO: 220478 - DNA, 20 bp, Artificial Sequence
  Description of Artificial Sequence: Synthetic oligonucleotide
  Target: ATXN1; (-) strand; PAM type: YTN; PAM sequence: TTA
gagaaaaatgagagcaagca

SEQ ID NO: 220479 - DNA, 20 bp, Artificial Sequence
  Description of Artificial Sequence: Synthetic oligonucleotide
  Target: ATXN1; (-) strand; PAM type: YTN; PAM sequence: CTC
aattagagaaaaatgagagc

SEQ ID NO: 220480 - DNA, 20 bp, Artificial Sequence
  Description of Artificial Sequence: Synthetic oligonucleotide
  Target: ATXN1; (-) strand; PAM type: YTN; PAM sequence: CTC
actcaattagagaaaaatga

SEQ ID NO: 220481 - DNA, 20 bp, Artificial Sequence
  Description of Artificial Sequence: Synthetic oligonucleotide
  Target: ATXN1; (-) strand; PAM type: YTN; PAM sequence: TTA
gtcctcactcaattagagaa

SEQ ID NO: 220482 - DNA, 20 bp, Artificial Sequence
  Description of Artificial Sequence: Synthetic oligonucleotide
  Target: ATXN1; (-) strand; PAM type: YTN; PAM sequence: TTT
agtcctcactcaattagaga

SEQ ID NO: 220483 - DNA, 20 bp, Artificial Sequence
  Description of Artificial Sequence: Synthetic oligonucleotide
  Target: ATXN1; (-) strand; PAM type: YTN; PAM sequence: CTT
tagtcctcactcaattagag

SEQ ID NO: 220484 - DNA, 20 bp, Artificial Sequence
  Description of Artificial Sequence: Synthetic oligonucleotide
  Target: ATXN1; (-) strand; PAM type: YTN; PAM sequence: TTC
tttagtcctcactcaattag

SEQ ID NO: 220485 - DNA, 20 bp, Artificial Sequence
  Description of Artificial Sequence: Synthetic oligonucleotide
  Target: ATXN1; (-) strand; PAM type: YTN; PAM sequence: TTA
gtaataaaaacaaaaaaata

SEQ ID NO: 220486 - DNA, 20 bp, Artificial Sequence
  Description of Artificial Sequence: Synthetic oligonucleotide
  Target: ATXN1; (-) strand; PAM type: YTN; PAM sequence: TTT
agtaataaaaacaaaaaaat

SEQ ID NO: 220487 - DNA, 20 bp, Artificial Sequence
  Description of Artificial Sequence: Synthetic oligonucleotide
  Target: ATXN1; (-) strand; PAM type: YTN; PAM sequence: CTT
tagtaataaaaacaaaaaaa

SEQ ID NO: 220488 - DNA, 20 bp, Artificial Sequence
  Description of Artificial Sequence: Synthetic oligonucleotide
  Target: ATXN1; (-) strand; PAM type: YTN; PAM sequence: CTA
aaactttagtaataaaaaca

SEQ ID NO: 220489 - DNA, 20 bp, Artificial Sequence
  Description of Artificial Sequence: Synthetic oligonucleotide
  Target: ATXN1; (-) strand; PAM type: YTN; PAM sequence: TTG
tgcacatgtaccctaaaact

SEQ ID NO: 220490 - DNA, 20 bp, Artificial Sequence
  Description of Artificial Sequence: Synthetic oligonucleotide
  Target: ATXN1; (-) strand; PAM type: YTN; PAM sequence: CTG
cacattgtgcacatgtaccc

SEQ ID NO: 220491 - DNA, 20 bp, Artificial Sequence
  Description of Artificial Sequence: Synthetic oligonucleotide
  Target: ATXN1; (-) strand; PAM type: YTN; PAM sequence: TTG
cagcacaccaacatggcaca

SEQ ID NO: 220492 - DNA, 20 bp, Artificial Sequence
  Description of Artificial Sequence: Synthetic oligonucleotide
  Target: ATXN1; (-) strand; PAM type: YTN; PAM sequence: TTA
atggttgcagcacaccaaca

SEQ ID NO: 220493 - DNA, 20 bp, Artificial Sequence
  Description of Artificial Sequence: Synthetic oligonucleotide
  Target: ATXN1; (-) strand; PAM type: YTN; PAM sequence: CTA
aatgacgagttaatggttgc

SEQ ID NO: 220494 - DNA, 20 bp, Artificial Sequence
  Description of Artificial Sequence: Synthetic oligonucleotide
  Target: ATXN1; (-) strand; PAM type: YTN; PAM sequence: CTA
atgctaaatgacgagttaat

SEQ ID NO: 220495 - DNA, 20 bp, Artificial Sequence
  Description of Artificial Sequence: Synthetic oligonucleotide
  Target: ATXN1; (-) strand; PAM type: YTN; PAM sequence: TTA
ggagatatacctaatgctaa

SEQ ID NO: 220496 - DNA, 20 bp, Artificial Sequence
  Description of Artificial Sequence: Synthetic oligonucleotide
  Target: ATXN1; (-) strand; PAM type: YTN; PAM sequence: TTG
ggggaggggggagggatagc

SEQ ID NO: 220497 - DNA, 20 bp, Artificial Sequence
  Description of Artificial Sequence: Synthetic oligonucleotide
  Target: ATXN1; (-) strand; PAM type: YTN; PAM sequence: TTG
tggggttgggggagggggga

SEQ ID NO: 220498 - DNA, 20 bp, Artificial Sequence
  Description of Artificial Sequence: Synthetic oligonucleotide
  Target: ATXN1; (-) strand; PAM type: YTN; PAM sequence: CTG
ttgtggggttgggggagggg

SEQ ID NO: 220499 - DNA, 20 bp, Artificial Sequence
  Description of Artificial Sequence: Synthetic oligonucleotide
  Target: ATXN1; (-) strand; PAM type: YTN; PAM sequence: CTG
gggcctgttgtggggttggg

SEQ ID NO: 220500 - DNA, 20 bp, Artificial Sequence
  Description of Artificial Sequence: Synthetic oligonucleotide
  Target: ATXN1; (-) strand; PAM type: YTN; PAM sequence: TTC
catggacacaggaaggggaa

SEQ ID NO: 220501 - DNA, 20 bp, Artificial Sequence
  Description of Artificial Sequence: Synthetic oligonucleotide
  Target: ATXN1; (-) strand; PAM type: YTN; PAM sequence: CTG
tgttccatggacacaggaag

SEQ ID NO: 220502 - DNA, 20 bp, Artificial Sequence
  Description of Artificial Sequence: Synthetic oligonucleotide
  Target: ATXN1; (-) strand; PAM type: YTN; PAM sequence: TTA
aaaacatgcctgtgttccat

SEQ ID NO: 220503 - DNA, 20 bp, Artificial Sequence
  Description of Artificial Sequence: Synthetic oligonucleotide
  Target: ATXN1; (-) strand; PAM type: YTN; PAM sequence: TTA
aaaataaaatcaacgttaaa

SEQ ID NO: 220504 - DNA, 20 bp, Artificial Sequence
  Description of Artificial Sequence: Synthetic oligonucleotide
  Target: ATXN1; (-) strand; PAM type: YTN; PAM sequence: TTT
aaaaataaaatcaacgttaa

SEQ ID NO: 220505 - DNA, 20 bp, Artificial Sequence
  Description of Artificial Sequence: Synthetic oligonucleotide
  Target: ATXN1; (-) strand; PAM type: YTN; PAM sequence: CTC
aagaccaaaaggcaagatgt

SEQ ID NO: 220506 - DNA, 20 bp, Artificial Sequence
  Description of Artificial Sequence: Synthetic oligonucleotide
  Target: ATXN1; (-) strand; PAM type: YTN; PAM sequence: CTC
tcaagaccaaaaggcaagat

SEQ ID NO: 220507 - DNA, 20 bp, Artificial Sequence
  Description of Artificial Sequence: Synthetic oligonucleotide
  Target: ATXN1; (-) strand; PAM type: YTN; PAM sequence: TTG
actctcaagaccaaaaggca

SEQ ID NO: 220508 - DNA, 20 bp, Artificial Sequence
  Description of Artificial Sequence: Synthetic oligonucleotide
  Target: ATXN1; (-) strand; PAM type: YTN; PAM sequence: CTT
gactctcaagaccaaaaggc

SEQ ID NO: 220509 - DNA, 20 bp, Artificial Sequence
  Description of Artificial Sequence: Synthetic oligonucleotide
  Target: ATXN1; (-) strand; PAM type: YTN; PAM sequence: CTA
atatcttgactctcaagacc

SEQ ID NO: 220510 - DNA, 20 bp, Artificial Sequence
  Description of Artificial Sequence: Synthetic oligonucleotide
  Target: ATXN1; (-) strand; PAM type: YTN; PAM sequence: TTA
catggctaatatcttgactc

SEQ ID NO: 220511 - DNA, 20 bp, Artificial Sequence
  Description of Artificial Sequence: Synthetic oligonucleotide
  Target: ATXN1; (-) strand; PAM type: YTN; PAM sequence: TTC
aattacatggctaatatctt

SEQ ID NO: 220512 - DNA, 20 bp, Artificial Sequence
  Description of Artificial Sequence: Synthetic oligonucleotide
  Target: ATXN1; (-) strand; PAM type: YTN; PAM sequence: CTG
gttcaattacatggctaata

SEQ ID NO: 220513 - DNA, 20 bp, Artificial Sequence
  Description of Artificial Sequence: Synthetic oligonucleotide
  Target: ATXN1; (-) strand; PAM type: YTN; PAM sequence: TTC
tggttcaattacatggctaa

SEQ ID NO: 220514 - DNA, 20 bp, Artificial Sequence
  Description of Artificial Sequence: Synthetic oligonucleotide
  Target: ATXN1; (-) strand; PAM type: YTN; PAM sequence: CTT
ctggttcaattacatggcta

SEQ ID NO: 220515 - DNA, 20 bp, Artificial Sequence
  Description of Artificial Sequence: Synthetic oligonucleotide
  Target: ATXN1; (-) strand; PAM type: YTN; PAM sequence: CTA
aagcttctggttcaattaca

SEQ ID NO: 220516 - DNA, 20 bp, Artificial Sequence
  Description of Artificial Sequence: Synthetic oligonucleotide
  Target: ATXN1; (-) strand; PAM type: YTN; PAM sequence: TTA
ataatatctaaagcttctgg

SEQ ID NO: 220517 - DNA, 20 bp, Artificial Sequence
  Description of Artificial Sequence: Synthetic oligonucleotide
  Target: ATXN1; (-) strand; PAM type: YTN; PAM sequence: TTT
aataatatctaaagcttctg

SEQ ID NO: 220518 - DNA, 20 bp, Artificial Sequence
  Description of Artificial Sequence: Synthetic oligonucleotide
  Target: ATXN1; (-) strand; PAM type: YTN; PAM sequence: CTT
taataatatctaaagcttct

SEQ ID NO: 220519 - DNA, 20 bp, Artificial Sequence
  Description of Artificial Sequence: Synthetic oligonucleotide
  Target: ATXN1; (-) strand; PAM type: YTN; PAM sequence: CTC
tttaataatatctaaagctt

SEQ ID NO: 220520 - DNA, 20 bp, Artificial Sequence
  Description of Artificial Sequence: Synthetic oligonucleotide
  Target: ATXN1; (-) strand; PAM type: YTN; PAM sequence: TTC
tctttaataatatctaaagc

SEQ ID NO: 220521 - DNA, 20 bp, Artificial Sequence
  Description of Artificial Sequence: Synthetic oligonucleotide
  Target: ATXN1; (-) strand; PAM type: YTN; PAM sequence: CTG
ttctctttaataatatctaa

SEQ ID NO: 220522 - DNA, 20 bp, Artificial Sequence
  Description of Artificial Sequence: Synthetic oligonucleotide
  Target: ATXN1; (-) strand; PAM type: YTN; PAM sequence: CTC
ctgttctctttaataatatc

SEQ ID NO: 220523 - DNA, 20 bp, Artificial Sequence
  Description of Artificial Sequence: Synthetic oligonucleotide
  Target: ATXN1; (-) strand; PAM type: YTN; PAM sequence: CTA
tagactcctgttctctttaa

SEQ ID NO: 220524 - DNA, 20 bp, Artificial Sequence
  Description of Artificial Sequence: Synthetic oligonucleotide
  Target: ATXN1; (-) strand; PAM type: YTN; PAM sequence: CTC
tatagactcctgttctcttt

SEQ ID NO: 220525 - DNA, 20 bp, Artificial Sequence
  Description of Artificial Sequence: Synthetic oligonucleotide
  Target: ATXN1; (-) strand; PAM type: YTN; PAM sequence: CTG
aactctatagactcctgttc

SEQ ID NO: 220526 - DNA, 20 bp, Artificial Sequence
  Description of Artificial Sequence: Synthetic oligonucleotide
  Target: ATXN1; (-) strand; PAM type: YTN; PAM sequence: TTG
gctgaactctatagactcct

SEQ ID NO: 220527 - DNA, 20 bp, Artificial Sequence
  Description of Artificial Sequence: Synthetic oligonucleotide
  Target: ATXN1; (-) strand; PAM type: YTN; PAM sequence: CTT
ggctgaactctatagactcc

SEQ ID NO: 220528 - DNA, 20 bp, Artificial Sequence
  Description of Artificial Sequence: Synthetic oligonucleotide
  Target: ATXN1; (-) strand; PAM type: YTN; PAM sequence: CTC
agtgggcacccttggctgaa

SEQ ID NO: 220529 - DNA, 20 bp, Artificial Sequence
  Description of Artificial Sequence: Synthetic oligonucleotide
  Target: ATXN1; (-) strand; PAM type: YTN; PAM sequence: TTC
tcagtgggcacccttggctg

SEQ ID NO: 220530 - DNA, 20 bp, Artificial Sequence
  Description of Artificial Sequence: Synthetic oligonucleotide
  Target: ATXN1; (-) strand; PAM type: YTN; PAM sequence: CTT
ctcagtgggcacccttggct

SEQ ID NO: 220531 - DNA, 20 bp, Artificial Sequence
  Description of Artificial Sequence: Synthetic oligonucleotide
  Target: ATXN1; (-) strand; PAM type: YTN; PAM sequence: CTA
gcatggagcttctcagtggg

SEQ ID NO: 220532 - DNA, 20 bp, Artificial Sequence
  Description of Artificial Sequence: Synthetic oligonucleotide
  Target: ATXN1; (-) strand; PAM type: YTN; PAM sequence: CTG
agaaagtcacaaataaacta

SEQ ID NO: 220533 - DNA, 20 bp, Artificial Sequence
  Description of Artificial Sequence: Synthetic oligonucleotide
  Target: ATXN1; (-) strand; PAM type: YTN; PAM sequence: TTC
cctgagaaagtcacaaataa

SEQ ID NO: 220534 - DNA, 20 bp, Artificial Sequence
  Description of Artificial Sequence: Synthetic oligonucleotide
  Target: ATXN1; (-) strand; PAM type: YTN; PAM sequence: CTT
ccctgagaaagtcacaaata

SEQ ID NO: 220535 - DNA, 20 bp, Artificial Sequence
  Description of Artificial Sequence: Synthetic oligonucleotide
  Target: ATXN1; (-) strand; PAM type: YTN; PAM sequence: CTC
ttccctgagaaagtcacaaa

SEQ ID NO: 220536 - DNA, 20 bp, Artificial Sequence
  Description of Artificial Sequence: Synthetic oligonucleotide
  Target: ATXN1; (-) strand; PAM type: YTN; PAM sequence: TTC
tcttccctgagaaagtcaca

SEQ ID NO: 220537 - DNA, 20 bp, Artificial Sequence
  Description of Artificial Sequence: Synthetic oligonucleotide
  Target: ATXN1; (-) strand; PAM type: YTN; PAM sequence: CTA
attctcttccctgagaaagt

SEQ ID NO: 220538 - DNA, 20 bp, Artificial Sequence
  Description of Artificial Sequence: Synthetic oligonucleotide
  Target: ATXN1; (-) strand; PAM type: YTN; PAM sequence: TTG
cagtaggacagacctaattc

SEQ ID NO: 220539 - DNA, 20 bp, Artificial Sequence
  Description of Artificial Sequence: Synthetic oligonucleotide
  Target: ATXN1; (-) strand; PAM type: YTN; PAM sequence: TTT
gcagtaggacagacctaatt

SEQ ID NO: 220540 - DNA, 20 bp, Artificial Sequence
  Description of Artificial Sequence: Synthetic oligonucleotide
  Target: ATXN1; (-) strand; PAM type: YTN; PAM sequence: TTC
agtttgcagtaggacagacc

SEQ ID NO: 220541 - DNA, 20 bp, Artificial Sequence
  Description of Artificial Sequence: Synthetic oligonucleotide
  Target: ATXN1; (-) strand; PAM type: YTN; PAM sequence: TTT
cagtttgcagtaggacagac

SEQ ID NO: 220542 - DNA, 20 bp, Artificial Sequence
  Description of Artificial Sequence: Synthetic oligonucleotide
  Target: ATXN1; (-) strand; PAM type: YTN; PAM sequence: CTA
tttcagtttgcagtaggaca

SEQ ID NO: 220543 - DNA, 20 bp, Artificial Sequence
  Description of Artificial Sequence: Synthetic oligonucleotide
  Target: ATXN1; (-) strand; PAM type: YTN; PAM sequence: TTC
tatttcagtttgcagtagga

SEQ ID NO: 220544 - DNA, 20 bp, Artificial Sequence
  Description of Artificial Sequence: Synthetic oligonucleotide
  Target: ATXN1; (-) strand; PAM type: YTN; PAM sequence: TTA
ttctatttcagtttgcagta

SEQ ID NO: 220545 - DNA, 20 bp, Artificial Sequence
  Description of Artificial Sequence: Synthetic oligonucleotide
  Target: ATXN1; (-) strand; PAM type: YTN; PAM sequence: TTT
attctatttcagtttgcagt

SEQ ID NO: 220546 - DNA, 20 bp, Artificial Sequence
  Description of Artificial Sequence: Synthetic oligonucleotide
  Target: ATXN1; (-) strand; PAM type: YTN; PAM sequence: CTT
tattctatttcagtttgcag

SEQ ID NO: 220547 - DNA, 20 bp, Artificial Sequence
  Description of Artificial Sequence: Synthetic oligonucleotide
  Target: ATXN1; (-) strand; PAM type: YTN; PAM sequence: CTA
ctttattctatttcagtttg

SEQ ID NO: 220548 - DNA, 20 bp, Artificial Sequence
  Description of Artificial Sequence: Synthetic oligonucleotide
  Target: ATXN1; (-) strand; PAM type: YTN; PAM sequence: CTA
tcctactttattctatttca

SEQ ID NO: 220549 - DNA, 20 bp, Artificial Sequence
  Description of Artificial Sequence: Synthetic oligonucleotide
  Target: ATXN1; (-) strand; PAM type: YTN; PAM sequence: TTA
gtatactatcctactttatt

SEQ ID NO: 220550 - DNA, 20 bp, Artificial Sequence
  Description of Artificial Sequence: Synthetic oligonucleotide
  Target: ATXN1; (-) strand; PAM type: YTN; PAM sequence: TTG
ccaagagttagtatactatc

SEQ ID NO: 220551 - DNA, 20 bp, Artificial Sequence
  Description of Artificial Sequence: Synthetic oligonucleotide
  Target: ATXN1; (-) strand; PAM type: YTN; PAM sequence: TTT
gccaagagttagtatactat

SEQ ID NO: 220552 - DNA, 20 bp, Artificial Sequence
  Description of Artificial Sequence: Synthetic oligonucleotide
  Target: ATXN1; (-) strand; PAM type: YTN; PAM sequence: TTT
tgccaagagttagtatacta

SEQ ID NO: 220553 - DNA, 20 bp, Artificial Sequence
  Description of Artificial Sequence: Synthetic oligonucleotide
  Target: ATXN1; (-) strand; PAM type: YTN; PAM sequence: TTT
ttgccaagagttagtatact

SEQ ID NO: 220554 - DNA, 20 bp, Artificial Sequence
  Description of Artificial Sequence: Synthetic oligonucleotide
  Target: ATXN1; (-) strand; PAM type: YTN; PAM sequence: TTT
tttgccaagagttagtatac

SEQ ID NO: 220555 - DNA, 20 bp, Artificial Sequence
  Description of Artificial Sequence: Synthetic oligonucleotide
  Target: ATXN1; (-) strand; PAM type: YTN; PAM sequence: CTG
agaattttttgccaagagtt

SEQ ID NO: 220556 - DNA, 20 bp, Artificial Sequence
  Description of Artificial Sequence: Synthetic oligonucleotide
  Target: ATXN1; (-) strand; PAM type: YTN; PAM sequence: TTA
agaatggctgagaatttttt

SEQ ID NO: 220557 - DNA, 20 bp, Artificial Sequence
  Description of Artificial Sequence: Synthetic oligonucleotide
  Target: ATXN1; (-) strand; PAM type: YTN; PAM sequence: CTG
gaggtatggatgtcattaag

SEQ ID NO: 220558 - DNA, 20 bp, Artificial Sequence
  Description of Artificial Sequence: Synthetic oligonucleotide
  Target: ATXN1; (-) strand; PAM type: YTN; PAM sequence: TTG
aacagggcatggaactggag

SEQ ID NO: 220559 - DNA, 20 bp, Artificial Sequence
  Description of Artificial Sequence: Synthetic oligonucleotide
  Target: ATXN1; (-) strand; PAM type: YTN; PAM sequence: CTT
gaacagggcatggaactgga

SEQ ID NO: 220560 - DNA, 20 bp, Artificial Sequence
  Description of Artificial Sequence: Synthetic oligonucleotide
  Target: ATXN1; (-) strand; PAM type: YTN; PAM sequence: CTG
aaaacagaggtatacgaaat

SEQ ID NO: 220561 - DNA, 20 bp, Artificial Sequence
  Description of Artificial Sequence: Synthetic oligonucleotide
  Target: ATXN1; (-) strand; PAM type: YTN; PAM sequence: CTA
ctgaaaacagaggtatacga

SEQ ID NO: 220562 - DNA, 20 bp, Artificial Sequence
  Description of Artificial Sequence: Synthetic oligonucleotide
  Target: ATXN1; (-) strand; PAM type: YTN; PAM sequence: TTC
ctactgaaaacagaggtata

SEQ ID NO: 220563 - DNA, 20 bp, Artificial Sequence
  Description of Artificial Sequence: Synthetic oligonucleotide
  Target: ATXN1; (-) strand; PAM type: YTN; PAM sequence: TTG
tggcattcctactgaaaaca

SEQ ID NO: 220564 - DNA, 20 bp, Artificial Sequence
  Description of Artificial Sequence: Synthetic oligonucleotide
  Target: ATXN1; (-) strand; PAM type: YTN; PAM sequence: TTT
gtggcattcctactgaaaac

SEQ ID NO: 220565 - DNA, 20 bp, Artificial Sequence
  Description of Artificial Sequence: Synthetic oligonucleotide
  Target: ATXN1; (-) strand; PAM type: YTN; PAM sequence: CTC
cataccagtttgtggcattc

SEQ ID NO: 220566 - DNA, 20 bp, Artificial Sequence
  Description of Artificial Sequence: Synthetic oligonucleotide
  Target: ATXN1; (-) strand; PAM type: YTN; PAM sequence: CTC
aaaataaaataaagtaaata

SEQ ID NO: 220567 - DNA, 20 bp, Artificial Sequence
  Description of Artificial Sequence: Synthetic oligonucleotide
  Target: ATXN1; (-) strand; PAM type: YTN; PAM sequence: CTA
tctcaaaataaaataaagta

SEQ ID NO: 220568 - DNA, 20 bp, Artificial Sequence
  Description of Artificial Sequence: Synthetic oligonucleotide
  Target: ATXN1; (-) strand; PAM type: YTN; PAM sequence: CTG
ggcaacatagacccctatct

SEQ ID NO: 220569 - DNA, 20 bp, Artificial Sequence
  Description of Artificial Sequence: Synthetic oligonucleotide
  Target: ATXN1; (-) strand; PAM type: YTN; PAM sequence: TTC
aagaccagactgggcaacat

SEQ ID NO: 220570 - DNA, 20 bp, Artificial Sequence
  Description of Artificial Sequence: Synthetic oligonucleotide
  Target: ATXN1; (-) strand; PAM type: YTN; PAM sequence: TTG
aggccaggagttcaagacca

SEQ ID NO: 220571 - DNA, 20 bp, Artificial Sequence
  Description of Artificial Sequence: Synthetic oligonucleotide
  Target: ATXN1; (-) strand; PAM type: YTN; PAM sequence: CTT
gaggccaggagttcaagacc

SEQ ID NO: 220572 - DNA, 20 bp, Artificial Sequence
  Description of Artificial Sequence: Synthetic oligonucleotide
  Target: ATXN1; (-) strand; PAM type: YTN; PAM sequence: TTG
cttgaggccaggagttcaag

SEQ ID NO: 220573 - DNA, 20 bp, Artificial Sequence
  Description of Artificial Sequence: Synthetic oligonucleotide
  Target: ATXN1; (-) strand; PAM type: YTN; PAM sequence: TTA
cccaggaggccaaggtggga

SEQ ID NO: 220574 - DNA, 20 bp, Artificial Sequence
  Description of Artificial Sequence: Synthetic oligonucleotide
  Target: ATXN1; (-) strand; PAM type: YTN; PAM sequence: CTT
acccaggaggccaaggtggg

SEQ ID NO: 220575 - DNA, 20 bp, Artificial Sequence
  Description of Artificial Sequence: Synthetic oligonucleotide
  Target: ATXN1; (-) strand; PAM type: YTN; PAM sequence: TTA
caaagatccttacccaggag

SEQ ID NO: 220576 - DNA, 20 bp, Artificial Sequence
  Description of Artificial Sequence: Synthetic oligonucleotide
  Target: ATXN1; (-) strand; PAM type: YTN; PAM sequence: TTC
attacaaagatccttaccca

SEQ ID NO: 220577 - DNA, 20 bp, Artificial Sequence
  Description of Artificial Sequence: Synthetic oligonucleotide
  Target: ATXN1; (-) strand; PAM type: YTN; PAM sequence: CTG
tcatccaaataataatattc

SEQ ID NO: 220578 - DNA, 20 bp, Artificial Sequence
  Description of Artificial Sequence: Synthetic oligonucleotide
  Target: ATXN1; (-) strand; PAM type: YTN; PAM sequence: CTG
cagtctgtcatccaaataat

SEQ ID NO: 220579 - DNA, 20 bp, Artificial Sequence
  Description of Artificial Sequence: Synthetic oligonucleotide
  Target: ATXN1; (-) strand; PAM type: YTN; PAM sequence: TTC
ctgcagtctgtcatccaaat

SEQ ID NO: 220580 - DNA, 20 bp, Artificial Sequence
  Description of Artificial Sequence: Synthetic oligonucleotide
  Target: ATXN1; (-) strand; PAM type: YTN; PAM sequence: CTT
cctgcagtctgtcatccaaa

SEQ ID NO: 220581 - DNA, 20 bp, Artificial Sequence
  Description of Artificial Sequence: Synthetic oligonucleotide
  Target: ATXN1; (-) strand; PAM type: YTN; PAM sequence: CTG
ggcttcctgcagtctgtcat

SEQ ID NO: 220582 - DNA, 20 bp, Artificial Sequence
  Description of Artificial Sequence: Synthetic oligonucleotide
  Target: ATXN1; (-) strand; PAM type: YTN; PAM sequence: TTC
tgggcttcctgcagtctgtc

SEQ ID NO: 220583 - DNA, 20 bp, Artificial Sequence
  Description of Artificial Sequence: Synthetic oligonucleotide
  Target: ATXN1; (-) strand; PAM type: YTN; PAM sequence: TTA
tgatgccaagaaaatggggt

SEQ ID NO: 220584 - DNA, 20 bp, Artificial Sequence
  Description of Artificial Sequence: Synthetic oligonucleotide
  Target: ATXN1; (-) strand; PAM type: YTN; PAM sequence: CTC
aaagagtaattatgatgcca

SEQ ID NO: 220585 - DNA, 20 bp, Artificial Sequence
  Description of Artificial Sequence: Synthetic oligonucleotide
  Target: ATXN1; (-) strand; PAM type: YTN; PAM sequence: TTC
tcaaagagtaattatgatgc

SEQ ID NO: 220586 - DNA, 20 bp, Artificial Sequence
  Description of Artificial Sequence: Synthetic oligonucleotide
  Target: ATXN1; (-) strand; PAM type: YTN; PAM sequence: TTT
ctcaaagagtaattatgatg

SEQ ID NO: 220587 - DNA, 20 bp, Artificial Sequence
  Description of Artificial Sequence: Synthetic oligonucleotide
  Target: ATXN1; (-) strand; PAM type: YTN; PAM sequence: TTA
tacaaagtgtacagcacaat

SEQ ID NO: 220588 - DNA, 20 bp, Artificial Sequence
  Description of Artificial Sequence: Synthetic oligonucleotide
  Target: ATXN1; (-) strand; PAM type: YTN; PAM sequence: TTT
atacaaagtgtacagcacaa

SEQ ID NO: 220589 - DNA, 20 bp, Artificial Sequence
  Description of Artificial Sequence: Synthetic oligonucleotide
  Target: ATXN1; (-) strand; PAM type: YTN; PAM sequence: TTT
tatacaaagtgtacagcaca

SEQ ID NO: 220590 - DNA, 20 bp, Artificial Sequence
  Description of Artificial Sequence: Synthetic oligonucleotide
  Target: ATXN1; (-) strand; PAM type: YTN; PAM sequence: CTC
attttatacaaagtgtacag

SEQ ID NO: 220591 - DNA, 20 bp, Artificial Sequence
  Description of Artificial Sequence: Synthetic oligonucleotide
  Target: ATXN1; (-) strand; PAM type: YTN; PAM sequence: CTC
tcattttatacaaagtgtac

SEQ ID NO: 220592 - DNA, 20 bp, Artificial Sequence
  Description of Artificial Sequence: Synthetic oligonucleotide
  Target: ATXN1; (-) strand; PAM type: YTN; PAM sequence: TTA
catgctctcattttatacaa

SEQ ID NO: 220593 - DNA, 20 bp, Artificial Sequence
  Description of Artificial Sequence: Synthetic oligonucleotide
  Target: ATXN1; (-) strand; PAM type: YTN; PAM sequence: TTT
acatgctctcattttataca

SEQ ID NO: 220594 - DNA, 20 bp, Artificial Sequence
  Description of Artificial Sequence: Synthetic oligonucleotide
  Target: ATXN1; (-) strand; PAM type: YTN; PAM sequence: TTG
atttacatgctctcatttta

SEQ ID NO: 220595 - DNA, 20 bp, Artificial Sequence
  Description of Artificial Sequence: Synthetic oligonucleotide
  Target: ATXN1; (-) strand; PAM type: YTN; PAM sequence: CTT
gatttacatgctctcatttt

SEQ ID NO: 220596 - DNA, 20 bp, Artificial Sequence
  Description of Artificial Sequence: Synthetic oligonucleotide
  Target: ATXN1; (-) strand; PAM type: YTN; PAM sequence: TTG
cttgatttacatgctctcat

SEQ ID NO: 220597 - DNA, 20 bp, Artificial Sequence
  Description of Artificial Sequence: Synthetic oligonucleotide
  Target: ATXN1; (-) strand; PAM type: YTN; PAM sequence: TTA
ttgcttgatttacatgctct

SEQ ID NO: 220598 - DNA, 20 bp, Artificial Sequence
  Description of Artificial Sequence: Synthetic oligonucleotide
  Target: ATXN1; (-) strand; PAM type: YTN; PAM sequence: TTA
ttattgcttgatttacatgc

SEQ ID NO: 220599 - DNA, 20 bp, Artificial Sequence
  Description of Artificial Sequence: Synthetic oligonucleotide
  Target: ATXN1; (-) strand; PAM type: YTN; PAM sequence: TTG
ttattattgcttgatttaca

SEQ ID NO: 220600 - DNA, 20 bp, Artificial Sequence
  Description of Artificial Sequence: Synthetic oligonucleotide
  Target: ATXN1; (-) strand; PAM type: YTN; PAM sequence: TTG
ttgttattattgcttgattt

SEQ ID NO: 220601 - DNA, 20 bp, Artificial Sequence
  Description of Artificial Sequence: Synthetic oligonucleotide
  Target: ATXN1; (-) strand; PAM type: YTN; PAM sequence: CTA
tgggaggattgttgttatta

SEQ ID NO: 220602 - DNA, 20 bp, Artificial Sequence
  Description of Artificial Sequence: Synthetic oligonucleotide
  Target: ATXN1; (-) strand; PAM type: YTN; PAM sequence: TTG
acatactatgggaggattgt

SEQ ID NO: 220603 - DNA, 20 bp, Artificial Sequence
  Description of Artificial Sequence: Synthetic oligonucleotide
  Target: ATXN1; (-) strand; PAM type: YTN; PAM sequence: TTT
gacatactatgggaggattg

SEQ ID NO: 220604 - DNA, 20 bp, Artificial Sequence
  Description of Artificial Sequence: Synthetic oligonucleotide
  Target: ATXN1; (-) strand; PAM type: YTN; PAM sequence: CTC
gtgagtttgacatactatgg

SEQ ID NO: 220605 - DNA, 20 bp, Artificial Sequence
  Description of Artificial Sequence: Synthetic oligonucleotide
  Target: ATXN1; (-) strand; PAM type: YTN; PAM sequence: TTG
gaggagaaggaaatgcctcg

SEQ ID NO: 220606 - DNA, 20 bp, Artificial Sequence
  Description of Artificial Sequence: Synthetic oligonucleotide
  Target: ATXN1; (-) strand; PAM type: YTN; PAM sequence: TTT
ggaggagaaggaaatgcctc

SEQ ID NO: 220607 - DNA, 20 bp, Artificial Sequence
  Description of Artificial Sequence: Synthetic oligonucleotide
  Target: ATXN1; (-) strand; PAM type: YTN; PAM sequence: CTG
agagaaaggagggtttggag

SEQ ID NO: 220608 - DNA, 20 bp, Artificial Sequence
  Description of Artificial Sequence: Synthetic oligonucleotide
  Target: ATXN1; (-) strand; PAM type: YTN; PAM sequence: TTG
tctgagagaaaggagggttt

SEQ ID NO: 220609 - DNA, 20 bp, Artificial Sequence
  Description of Artificial Sequence: Synthetic oligonucleotide
  Target: ATXN1; (-) strand; PAM type: YTN; PAM sequence: TTT
gtctgagagaaaggagggtt

SEQ ID NO: 220610 - DNA, 20 bp, Artificial Sequence
  Description of Artificial Sequence: Synthetic oligonucleotide
  Target: ATXN1; (-) strand; PAM type: YTN; PAM sequence: TTG
gtttgtctgagagaaaggag

SEQ ID NO: 220611 - DNA, 20 bp, Artificial Sequence
  Description of Artificial Sequence: Synthetic oligonucleotide
  Target: ATXN1; (-) strand; PAM type: YTN; PAM sequence: CTT
ggtttgtctgagagaaagga

SEQ ID NO: 220612 - DNA, 20 bp, Artificial Sequence
  Description of Artificial Sequence: Synthetic oligonucleotide
  Target: ATXN1; (-) strand; PAM type: YTN; PAM sequence: TTA
cttggtttgtctgagagaaa

SEQ ID NO: 220613 - DNA, 20 bp, Artificial Sequence
  Description of Artificial Sequence: Synthetic oligonucleotide
  Target: ATXN1; (-) strand; PAM type: YTN; PAM sequence: TTC
aattacttggtttgtctgag

SEQ ID NO: 220614 - DNA, 20 bp, Artificial Sequence
  Description of Artificial Sequence: Synthetic oligonucleotide
  Target: ATXN1; (-) strand; PAM type: YTN; PAM sequence: CTT
caattacttggtttgtctga

SEQ ID NO: 220615 - DNA, 20 bp, Artificial Sequence
  Description of Artificial Sequence: Synthetic oligonucleotide
  Target: ATXN1; (-) strand; PAM type: YTN; PAM sequence: TTG
aaaatacatgtcttcaatta

SEQ ID NO: 220616 - DNA, 20 bp, Artificial Sequence
  Description of Artificial Sequence: Synthetic oligonucleotide
  Target: ATXN1; (-) strand; PAM type: YTN; PAM sequence: CTT
gaaaatacatgtcttcaatt

SEQ ID NO: 220617 - DNA, 20 bp, Artificial Sequence
  Description of Artificial Sequence: Synthetic oligonucleotide
  Target: ATXN1; (-) strand; PAM type: YTN; PAM sequence: TTC
cttgaaaatacatgtcttca

SEQ ID NO: 220618 - DNA, 20 bp, Artificial Sequence
  Description of Artificial Sequence: Synthetic oligonucleotide
  Target: ATXN1; (-) strand; PAM type: YTN; PAM sequence: TTA
gccatgttccttgaaaatac

SEQ ID NO: 220619 - DNA, 20 bp, Artificial Sequence
  Description of Artificial Sequence: Synthetic oligonucleotide
  Target: ATXN1; (-) strand; PAM type: YTN; PAM sequence: CTT
agccatgttccttgaaaata

SEQ ID NO: 220620 - DNA, 20 bp, Artificial Sequence
  Description of Artificial Sequence: Synthetic oligonucleotide
  Target: ATXN1; (-) strand; PAM type: YTN; PAM sequence: CTC
ttagccatgttccttgaaaa

SEQ ID NO: 220621 - DNA, 20 bp, Artificial Sequence
  Description of Artificial Sequence: Synthetic oligonucleotide
  Target: ATXN1; (-) strand; PAM type: YTN; PAM sequence: CTG
ctcttagccatgttccttga

SEQ ID NO: 220622 - DNA, 20 bp, Artificial Sequence
  Description of Artificial Sequence: Synthetic oligonucleotide
  Target: ATXN1; (-) strand; PAM type: YTN; PAM sequence: TTG
atgtggtaaagaaacagtct

SEQ ID NO: 220623 - DNA, 20 bp, Artificial Sequence
  Description of Artificial Sequence: Synthetic oligonucleotide
  Target: ATXN1; (-) strand; PAM type: YTN; PAM sequence: TTT
gatgtggtaaagaaacagtc

SEQ ID NO: 220624 - DNA, 20 bp, Artificial Sequence
  Description of Artificial Sequence: Synthetic oligonucleotide
  Target: ATXN1; (-) strand; PAM type: YTN; PAM sequence: CTG
cacagaagtttgatgtggta

SEQ ID NO: 220625 - DNA, 20 bp, Artificial Sequence
  Description of Artificial Sequence: Synthetic oligonucleotide
  Target: ATXN1; (-) strand; PAM type: YTN; PAM sequence: TTC
tgcacagaagtttgatgtgg

SEQ ID NO: 220626 - DNA, 20 bp, Artificial Sequence
  Description of Artificial Sequence: Synthetic oligonucleotide
  Target: ATXN1; (-) strand; PAM type: YTN; PAM sequence: CTT
ctgcacagaagtttgatgtg

SEQ ID NO: 220627 - DNA, 20 bp, Artificial Sequence
  Description of Artificial Sequence: Synthetic oligonucleotide
  Target: ATXN1; (-) strand; PAM type: YTN; PAM sequence: TTA
acttctgcacagaagtttga

SEQ ID NO: 220628 - DNA, 20 bp, Artificial Sequence
  Description of Artificial Sequence: Synthetic oligonucleotide
  Target: ATXN1; (-) strand; PAM type: YTN; PAM sequence: CTT
aacttctgcacagaagtttg

SEQ ID NO: 220629 - DNA, 20 bp, Artificial Sequence
  Description of Artificial Sequence: Synthetic oligonucleotide
  Target: ATXN1; (-) strand; PAM type: YTN; PAM sequence: TTC
ttaacttctgcacagaagtt

SEQ ID NO: 220630 - DNA, 20 bp, Artificial Sequence
  Description of Artificial Sequence: Synthetic oligonucleotide
  Target: ATXN1; (-) strand; PAM type: YTN; PAM sequence: TTT
cttaacttctgcacagaagt

SEQ ID NO: 220631 - DNA, 20 bp, Artificial Sequence
  Description of Artificial Sequence: Synthetic oligonucleotide
  Target: ATXN1; (-) strand; PAM type: YTN; PAM sequence: CTT
tcttaacttctgcacagaag

SEQ ID NO: 220632 - DNA, 20 bp, Artificial Sequence
  Description of Artificial Sequence: Synthetic oligonucleotide
  Target: ATXN1; (-) strand; PAM type: YTN; PAM sequence: CTC
ctttcttaacttctgcacag

SEQ ID NO: 220633 - DNA, 20 bp, Artificial Sequence
  Description of Artificial Sequence: Synthetic oligonucleotide
  Target: ATXN1; (-) strand; PAM type: YTN; PAM sequence: TTC
tcctttcttaacttctgcac

SEQ ID NO: 220634 - DNA, 20 bp, Artificial Sequence
  Description of Artificial Sequence: Synthetic oligonucleotide
  Target: ATXN1; (-) strand; PAM type: YTN; PAM sequence: TTA
gagtgattctcctttcttaa

SEQ ID NO: 220635 - DNA, 20 bp, Artificial Sequence
  Description of Artificial Sequence: Synthetic oligonucleotide
  Target: ATXN1; (-) strand; PAM type: YTN; PAM sequence: TTA
ggaataagcattagagtgat

SEQ ID NO: 220636 - DNA, 20 bp, Artificial Sequence
  Description of Artificial Sequence: Synthetic oligonucleotide
  Target: ATXN1; (-) strand; PAM type: YTN; PAM sequence: CTA
tcacagtcattaggaataag

SEQ ID NO: 220637 - DNA, 20 bp, Artificial Sequence
  Description of Artificial Sequence: Synthetic oligonucleotide
  Target: ATXN1; (-) strand; PAM type: YTN; PAM sequence: TTC
aaggcagaaagtctatcaca

SEQ ID NO: 220638 - DNA, 20 bp, Artificial Sequence
  Description of Artificial Sequence: Synthetic oligonucleotide
  Target: ATXN1; (-) strand; PAM type: YTN; PAM sequence: TTA
caaatggaaatgcaccattc

SEQ ID NO: 220639 - DNA, 20 bp, Artificial Sequence
  Description of Artificial Sequence: Synthetic oligonucleotide
  Target: ATXN1; (-) strand; PAM type: YTN; PAM sequence: CTT
acaaatggaaatgcaccatt

SEQ ID NO: 220640 - DNA, 20 bp, Artificial Sequence
  Description of Artificial Sequence: Synthetic oligonucleotide
  Target: ATXN1; (-) strand; PAM type: YTN; PAM sequence: CTA
taaatggagcttacaaatgg

SEQ ID NO: 220641 - DNA, 20 bp, Artificial Sequence
  Description of Artificial Sequence: Synthetic oligonucleotide
  Target: ATXN1; (-) strand; PAM type: YTN; PAM sequence: TTC
tataaatggagcttacaaat

SEQ ID NO: 220642 - DNA, 20 bp, Artificial Sequence
  Description of Artificial Sequence: Synthetic oligonucleotide
  Target: ATXN1; (-) strand; PAM type: YTN; PAM sequence: TTG
tgtgattctataaatggagc

SEQ ID NO: 220643 - DNA, 20 bp, Artificial Sequence
  Description of Artificial Sequence: Synthetic oligonucleotide
  Target: ATXN1; (-) strand; PAM type: YTN; PAM sequence: CTT
gtgtgattctataaatggag

SEQ ID NO: 220644 - DNA, 20 bp, Artificial Sequence
  Description of Artificial Sequence: Synthetic oligonucleotide
  Target: ATXN1; (-) strand; PAM type: YTN; PAM sequence: TTC
agaggaaggcaaaaacttgt

SEQ ID NO: 220645 - DNA, 20 bp, Artificial Sequence
  Description of Artificial Sequence: Synthetic oligonucleotide
  Target: ATXN1; (-) strand; PAM type: YTN; PAM sequence: TTT
cagaggaaggcaaaaacttg

SEQ ID NO: 220646 - DNA, 20 bp, Artificial Sequence
  Description of Artificial Sequence: Synthetic oligonucleotide
  Target: ATXN1; (-) strand; PAM type: YTN; PAM sequence: TTA
ggtttcagaggaaggcaaaa

SEQ ID NO: 220647 - DNA, 20 bp, Artificial Sequence
  Description of Artificial Sequence: Synthetic oligonucleotide
  Target: ATXN1; (-) strand; PAM type: YTN; PAM sequence: TTC
caccaagagtgatgtataca

SEQ ID NO: 220648 - DNA, 20 bp, Artificial Sequence
  Description of Artificial Sequence: Synthetic oligonucleotide
  Target: ATXN1; (-) strand; PAM type: YTN; PAM sequence: TTT
ccaccaagagtgatgtatac

SEQ ID NO: 220649 - DNA, 20 bp, Artificial Sequence
  Description of Artificial Sequence: Synthetic oligonucleotide
  Target: ATXN1; (-) strand; PAM type: YTN; PAM sequence: TTG
aaaatttccaccaagagtga

SEQ ID NO: 220650 - DNA, 20 bp, Artificial Sequence
  Description of Artificial Sequence: Synthetic oligonucleotide
  Target: ATXN1; (-) strand; PAM type: YTN; PAM sequence: TTG
ttgaaaatttccaccaagag

SEQ ID NO: 220651 - DNA, 20 bp, Artificial Sequence
  Description of Artificial Sequence: Synthetic oligonucleotide
  Target: ATXN1; (-) strand; PAM type: YTN; PAM sequence: TTG
tggttgttgaaaatttccac

SEQ ID NO: 220652 - DNA, 20 bp, Artificial Sequence
  Description of Artificial Sequence: Synthetic oligonucleotide
  Target: ATXN1; (-) strand; PAM type: YTN; PAM sequence: TTT
gtggttgttgaaaatttcca

SEQ ID NO: 220653 - DNA, 20 bp, Artificial Sequence
  Description of Artificial Sequence: Synthetic oligonucleotide
  Target: ATXN1; (-) strand; PAM type: YTN; PAM sequence: CTT
tgtggttgttgaaaatttcc

SEQ ID NO: 220654 - DNA, 20 bp, Artificial Sequence
  Description of Artificial Sequence: Synthetic oligonucleotide
  Target: ATXN1; (-) strand; PAM type: YTN; PAM sequence: TTC
ccccacctttgtggttgttg

SEQ ID NO: 220655 - DNA, 20 bp, Artificial Sequence
  Description of Artificial Sequence: Synthetic oligonucleotide
  Target: ATXN1; (-) strand; PAM type: YTN; PAM sequence: TTT
cccccacctttgtggttgtt

SEQ ID NO: 220656 - DNA, 20 bp, Artificial Sequence
  Description of Artificial Sequence: Synthetic oligonucleotide
  Target: ATXN1; (-) strand; PAM type: YTN; PAM sequence: CTT
tcccccacctttgtggttgt

SEQ ID NO: 220657 - DNA, 20 bp, Artificial Sequence
  Description of Artificial Sequence: Synthetic oligonucleotide
  Target: ATXN1; (-) strand; PAM type: YTN; PAM sequence: CTA
aggagtcagtgtacgccacg

SEQ ID NO: 220658 - DNA, 20 bp, Artificial Sequence
  Description of Artificial Sequence: Synthetic oligonucleotide
  Target: ATXN1; (-) strand; PAM type: YTN; PAM sequence: CTA
aaatggcaacatcaggaaac

SEQ ID NO: 220659 - DNA, 20 bp, Artificial Sequence
  Description of Artificial Sequence: Synthetic oligonucleotide
  Target: ATXN1; (-) strand; PAM type: YTN; PAM sequence: TTA
aaatacactaaaatggcaac

SEQ ID NO: 220660 - DNA, 20 bp, Artificial Sequence
  Description of Artificial Sequence: Synthetic oligonucleotide
  Target: ATXN1; (-) strand; PAM type: YTN; PAM sequence: CTT
aaaatacactaaaatggcaa

SEQ ID NO: 220661 - DNA, 20 bp, Artificial Sequence
  Description of Artificial Sequence: Synthetic oligonucleotide
  Target: ATXN1; (-) strand; PAM type: YTN; PAM sequence: TTG
ccataagtaaatacttaaaa

SEQ ID NO: 220662 - DNA, 20 bp, Artificial Sequence
  Description of Artificial Sequence: Synthetic oligonucleotide
  Target: ATXN1; (-) strand; PAM type: YTN; PAM sequence: TTG
ttgccataagtaaatactta

SEQ ID NO: 220663 - DNA, 20 bp, Artificial Sequence
  Description of Artificial Sequence: Synthetic oligonucleotide
  Target: ATXN1; (-) strand; PAM type: YTN; PAM sequence: CTA
taattgttgccataagtaaa

SEQ ID NO: 220664 - DNA, 20 bp, Artificial Sequence
  Description of Artificial Sequence: Synthetic oligonucleotide
  Target: ATXN1; (-) strand; PAM type: YTN; PAM sequence: TTG
tgaactataattgttgccat

SEQ ID NO: 220665 - DNA, 20 bp, Artificial Sequence
  Description of Artificial Sequence: Synthetic oligonucleotide
  Target: ATXN1; (-) strand; PAM type: YTN; PAM sequence: TTT
gtgaactataattgttgcca

SEQ ID NO: 220666 - DNA, 20 bp, Artificial Sequence
  Description of Artificial Sequence: Synthetic oligonucleotide
  Target: ATXN1; (-) strand; PAM type: YTN; PAM sequence: CTT
tgtgaactataattgttgcc

SEQ ID NO: 220667 - DNA, 20 bp, Artificial Sequence
  Description of Artificial Sequence: Synthetic oligonucleotide
  Target: ATXN1; (-) strand; PAM type: YTN; PAM sequence: CTG
ccggatggaaaaagagaaca

SEQ ID NO: 220668 - DNA, 20 bp, Artificial Sequence
  Description of Artificial Sequence: Synthetic oligonucleotide
  Target: ATXN1; (-) strand; PAM type: YTN; PAM sequence: TTG
tagtagagcacaccaagggg

SEQ ID NO: 220669 - DNA, 20 bp, Artificial Sequence
  Description of Artificial Sequence: Synthetic oligonucleotide
  Target: ATXN1; (-) strand; PAM type: YTN; PAM sequence: TTT
gtagtagagcacaccaaggg

SEQ ID NO: 220670 - DNA, 20 bp, Artificial Sequence
  Description of Artificial Sequence: Synthetic oligonucleotide
  Target: ATXN1; (-) strand; PAM type: YTN; PAM sequence: TTT
tgtagtagagcacaccaagg

SEQ ID NO: 220671 - DNA, 20 bp, Artificial Sequence
  Description of Artificial Sequence: Synthetic oligonucleotide
  Target: ATXN1; (-) strand; PAM type: YTN; PAM sequence: CTT
ttgtagtagagcacaccaag

SEQ ID NO: 220672 - DNA, 20 bp, Artificial Sequence
  Description of Artificial Sequence: Synthetic oligonucleotide
  Target: ATXN1; (-) strand; PAM type: YTN; PAM sequence: CTG
ccttttgtagtagagcacac

SEQ ID NO: 220673 - DNA, 20 bp, Artificial Sequence
  Description of Artificial Sequence: Synthetic oligonucleotide
  Target: ATXN1; (-) strand; PAM type: YTN; PAM sequence: TTC
agaaaactgccttttgtagt

SEQ ID NO: 220674 - DNA, 20 bp, Artificial Sequence
  Description of Artificial Sequence: Synthetic oligonucleotide
  Target: ATXN1; (-) strand; PAM type: YTN; PAM sequence: TTA
atagcagtgattcagaaaac

SEQ ID NO: 220675 - DNA, 20 bp, Artificial Sequence
  Description of Artificial Sequence: Synthetic oligonucleotide
  Target: ATXN1; (-) strand; PAM type: YTN; PAM sequence: CTG
attaatagcagtgattcaga

SEQ ID NO: 220676 - DNA, 20 bp, Artificial Sequence
  Description of Artificial Sequence: Synthetic oligonucleotide
  Target: ATXN1; (-) strand; PAM type: YTN; PAM sequence: TTA
ctgattaatagcagtgattc

SEQ ID NO: 220677 - DNA, 20 bp, Artificial Sequence
  Description of Artificial Sequence: Synthetic oligonucleotide
  Target: ATXN1; (-) strand; PAM type: YTN; PAM sequence: TTT
actgattaatagcagtgatt

SEQ ID NO: 220678 - DNA, 20 bp, Artificial Sequence
  Description of Artificial Sequence: Synthetic oligonucleotide
  Target: ATXN1; (-) strand; PAM type: YTN; PAM sequence: CTT
tactgattaatagcagtgat

SEQ ID NO: 220679 - DNA, 20 bp, Artificial Sequence
  Description of Artificial Sequence: Synthetic oligonucleotide
  Target: ATXN1; (-) strand; PAM type: YTN; PAM sequence: TTC
tttactgattaatagcagtg

SEQ ID NO: 220680 - DNA, 20 bp, Artificial Sequence
  Description of Artificial Sequence: Synthetic oligonucleotide
  Target: ATXN1; (-) strand; PAM type: YTN; PAM sequence: TTC
accaaatagggacatcaatt

SEQ ID NO: 220681 - DNA, 20 bp, Artificial Sequence
  Description of Artificial Sequence: Synthetic oligonucleotide
  Target: ATXN1; (-) strand; PAM type: YTN; PAM sequence: CTA
ttcaccaaatagggacatca

SEQ ID NO: 220682 - DNA, 20 bp, Artificial Sequence
  Description of Artificial Sequence: Synthetic oligonucleotide
  Target: ATXN1; (-) strand; PAM type: YTN; PAM sequence: TTG
ctattcaccaaatagggaca

SEQ ID NO: 220683 - DNA, 20 bp, Artificial Sequence
  Description of Artificial Sequence: Synthetic oligonucleotide
  Target: ATXN1; (-) strand; PAM type: YTN; PAM sequence: TTT
gctattcaccaaatagggac

SEQ ID NO: 220684 - DNA, 20 bp, Artificial Sequence
  Description of Artificial Sequence: Synthetic oligonucleotide
  Target: ATXN1; (-) strand; PAM type: YTN; PAM sequence: TTC
agagagcaataggagcagtt

SEQ ID NO: 220685 - DNA, 20 bp, Artificial Sequence
  Description of Artificial Sequence: Synthetic oligonucleotide
  Target: ATXN1; (-) strand; PAM type: YTN; PAM sequence: TTC
agttcagagagcaataggag

SEQ ID NO: 220686 - DNA, 20 bp, Artificial Sequence
  Description of Artificial Sequence: Synthetic oligonucleotide
  Target: ATXN1; (-) strand; PAM type: YTN; PAM sequence: TTC
agttcagttcagagagcaat

SEQ ID NO: 220687 - DNA, 20 bp, Artificial Sequence
  Description of Artificial Sequence: Synthetic oligonucleotide
  Target: ATXN1; (-) strand; PAM type: YTN; PAM sequence: TTG
ttcagttcagttcagagagc

SEQ ID NO: 220688 - DNA, 20 bp, Artificial Sequence
  Description of Artificial Sequence: Synthetic oligonucleotide
  Target: ATXN1; (-) strand; PAM type: YTN; PAM sequence: TTA
aagtaaaaaaaaaaaaaaaa

SEQ ID NO: 220689 - DNA, 20 bp, Artificial Sequence
  Description of Artificial Sequence: Synthetic oligonucleotide
  Target: ATXN1; (-) strand; PAM type: YTN; PAM sequence: CTT
aaagtaaaaaaaaaaaaaaa

SEQ ID NO: 220690 - DNA, 20 bp, Artificial Sequence
  Description of Artificial Sequence: Synthetic oligonucleotide
  Target: ATXN1; (-) strand; PAM type: YTN; PAM sequence: TTG
tcccagaacttaaagtaaaa

SEQ ID NO: 220691 - DNA, 20 bp, Artificial Sequence
  Description of Artificial Sequence: Synthetic oligonucleotide
  Target: ATXN1; (-) strand; PAM type: YTN; PAM sequence: TTT
gtcccagaacttaaagtaaa

SEQ ID NO: 220692 - DNA, 20 bp, Artificial Sequence
  Description of Artificial Sequence: Synthetic oligonucleotide
  Target: ATXN1; (-) strand; PAM type: YTN; PAM sequence: CTG
cacatttgtcccagaactta

SEQ ID NO: 220693 - DNA, 20 bp, Artificial Sequence
  Description of Artificial Sequence: Synthetic oligonucleotide
  Target: ATXN1; (-) strand; PAM type: YTN; PAM sequence: TTC
tgcacatttgtcccagaact

SEQ ID NO: 220694 - DNA, 20 bp, Artificial Sequence
  Description of Artificial Sequence: Synthetic oligonucleotide
  Target: ATXN1; (-) strand; PAM type: YTN; PAM sequence: CTG
cacgttctgcacatttgtcc

SEQ ID NO: 220695 - DNA, 20 bp, Artificial Sequence
  Description of Artificial Sequence: Synthetic oligonucleotide
  Target: ATXN1; (-) strand; PAM type: YTN; PAM sequence: TTA
tgtaacaaacctgcacgttc

SEQ ID NO: 220696 - DNA, 20 bp, Artificial Sequence
  Description of Artificial Sequence: Synthetic oligonucleotide
  Target: ATXN1; (-) strand; PAM type: YTN; PAM sequence: CTT
atgtaacaaacctgcacgtt

SEQ ID NO: 220697 - DNA, 20 bp, Artificial Sequence
  Description of Artificial Sequence: Synthetic oligonucleotide
  Target: ATXN1; (-) strand; PAM type: YTN; PAM sequence: TTG
aagggtacaacaaaccaccg

SEQ ID NO: 220698 - DNA, 20 bp, Artificial Sequence
  Description of Artificial Sequence: Synthetic oligonucleotide
  Target: ATXN1; (-) strand; PAM type: YTN; PAM sequence: CTA
gatgacgggttgaagggtac

SEQ ID NO: 220699 - DNA, 20 bp, Artificial Sequence
  Description of Artificial Sequence: Synthetic oligonucleotide
  Target: ATXN1; (-) strand; PAM type: YTN; PAM sequence: TTA
aaacctagatgacgggttga

SEQ ID NO: 220700 - DNA, 20 bp, Artificial Sequence
  Description of Artificial Sequence: Synthetic oligonucleotide
  Target: ATXN1; (-) strand; PAM type: YTN; PAM sequence: CTT
aaaacctagatgacgggttg

SEQ ID NO: 220701 - DNA, 20 bp, Artificial Sequence
  Description of Artificial Sequence: Synthetic oligonucleotide
  Target: ATXN1; (-) strand; PAM type: YTN; PAM sequence: TTG
gggcttaaaacctagatgac

SEQ ID NO: 220702 - DNA, 20 bp, Artificial Sequence
  Description of Artificial Sequence: Synthetic oligonucleotide
  Target: ATXN1; (-) strand; PAM type: YTN; PAM sequence: TTT
ggggcttaaaacctagatga

SEQ ID NO: 220703 - DNA, 20 bp, Artificial Sequence
  Description of Artificial Sequence: Synthetic oligonucleotide
  Target: ATXN1; (-) strand; PAM type: YTN; PAM sequence: CTA
atgcatttggggcttaaaac

SEQ ID NO: 220704 - DNA, 20 bp, Artificial Sequence
  Description of Artificial Sequence: Synthetic oligonucleotide
  Target: ATXN1; (-) strand; PAM type: YTN; PAM sequence: TTG
gacaaatacctaatgcattt

SEQ ID NO: 220705 - DNA, 20 bp, Artificial Sequence
  Description of Artificial Sequence: Synthetic oligonucleotide
  Target: ATXN1; (-) strand; PAM type: YTN; PAM sequence: TTT
ggacaaatacctaatgcatt

SEQ ID NO: 220706 - DNA, 20 bp, Artificial Sequence
  Description of Artificial Sequence: Synthetic oligonucleotide
  Target: ATXN1; (-) strand; PAM type: YTN; PAM sequence: TTC
catttggacaaatacctaat

SEQ ID NO: 220707 - DNA, 20 bp, Artificial Sequence
  Description of Artificial Sequence: Synthetic oligonucleotide
  Target: ATXN1; (-) strand; PAM type: YTN; PAM sequence: CTG
agttccatttggacaaatac

SEQ ID NO: 220708 - DNA, 20 bp, Artificial Sequence
  Description of Artificial Sequence: Synthetic oligonucleotide
  Target: ATXN1; (-) strand; PAM type: YTN; PAM sequence: CTG
ctgagttccatttggacaaa

SEQ ID NO: 220709 - DNA, 20 bp, Artificial Sequence
  Description of Artificial Sequence: Synthetic oligonucleotide
  Target: ATXN1; (-) strand; PAM type: YTN; PAM sequence: CTG
actgctgagttccatttgga

SEQ ID NO: 220710 - DNA, 20 bp, Artificial Sequence
  Description of Artificial Sequence: Synthetic oligonucleotide
  Target: ATXN1; (-) strand; PAM type: YTN; PAM sequence: TTG
ctgactgctgagttccattt

SEQ ID NO: 220711 - DNA, 20 bp, Artificial Sequence
  Description of Artificial Sequence: Synthetic oligonucleotide
  Target: ATXN1; (-) strand; PAM type: YTN; PAM sequence: TTT
gctgactgctgagttccatt

SEQ ID NO: 220712 - DNA, 20 bp, Artificial Sequence
  Description of Artificial Sequence: Synthetic oligonucleotide
  Target: ATXN1; (-) strand; PAM type: YTN; PAM sequence: TTT
tgctgactgctgagttccat

SEQ ID NO: 220713 - DNA, 20 bp, Artificial Sequence
  Description of Artificial Sequence: Synthetic oligonucleotide
  Target: ATXN1; (-) strand; PAM type: YTN; PAM sequence: TTA
atatattttgctgactgctg

SEQ ID NO: 220714 - DNA, 20 bp, Artificial Sequence
  Description of Artificial Sequence: Synthetic oligonucleotide
  Target: ATXN1; (-) strand; PAM type: YTN; PAM sequence: TTT
aatatattttgctgactgct

SEQ ID NO: 220715 - DNA, 20 bp, Artificial Sequence
  Description of Artificial Sequence: Synthetic oligonucleotide
  Target: ATXN1; (-) strand; PAM type: YTN; PAM sequence: CTG
acaaatttaatatattttgc

SEQ ID NO: 220716 - DNA, 20 bp, Artificial Sequence
  Description of Artificial Sequence: Synthetic oligonucleotide
  Target: ATXN1; (-) strand; PAM type: YTN; PAM sequence: CTA
gaactgacaaatttaatata

SEQ ID NO: 220717 - DNA, 20 bp, Artificial Sequence
  Description of Artificial Sequence: Synthetic oligonucleotide
  Target: ATXN1; (-) strand; PAM type: YTN; PAM sequence: TTC
tagaactgacaaatttaata

SEQ ID NO: 220718 - DNA, 20 bp, Artificial Sequence
  Description of Artificial Sequence: Synthetic oligonucleotide
  Target: ATXN1; (-) strand; PAM type: YTN; PAM sequence: TTA
ttctagaactgacaaattta

SEQ ID NO: 220719 - DNA, 20 bp, Artificial Sequence
  Description of Artificial Sequence: Synthetic oligonucleotide
  Target: ATXN1; (-) strand; PAM type: YTN; PAM sequence: CTC
aggagtgaggacagggagta

SEQ ID NO: 220720 - DNA, 20 bp, Artificial Sequence
  Description of Artificial Sequence: Synthetic oligonucleotide
  Target: ATXN1; (-) strand; PAM type: YTN; PAM sequence: CTG
aggtgacaggtgctcaggag

SEQ ID NO: 220721 - DNA, 20 bp, Artificial Sequence
  Description of Artificial Sequence: Synthetic oligonucleotide
  Target: ATXN1; (-) strand; PAM type: YTN; PAM sequence: TTC
agtggtgtggtctgaggtga

SEQ ID NO: 220722 - DNA, 20 bp, Artificial Sequence
  Description of Artificial Sequence: Synthetic oligonucleotide
  Target: ATXN1; (-) strand; PAM type: YTN; PAM sequence: CTT
cagtggtgtggtctgaggtg

SEQ ID NO: 220723 - DNA, 20 bp, Artificial Sequence
  Description of Artificial Sequence: Synthetic oligonucleotide
  Target: ATXN1; (-) strand; PAM type: YTN; PAM sequence: TTG
ggggtcatggggtggtcagc

SEQ ID NO: 220724 - DNA, 20 bp, Artificial Sequence
  Description of Artificial Sequence: Synthetic oligonucleotide
  Target: ATXN1; (-) strand; PAM type: YTN; PAM sequence: TTG
gttgggggtcatggggtggt

SEQ ID NO: 220725 - DNA, 20 bp, Artificial Sequence
  Description of Artificial Sequence: Synthetic oligonucleotide
  Target: ATXN1; (-) strand; PAM type: YTN; PAM sequence: CTT
ggttgggggtcatggggtgg

SEQ ID NO: 220726 - DNA, 20 bp, Artificial Sequence
  Description of Artificial Sequence: Synthetic oligonucleotide
  Target: ATXN1; (-) strand; PAM type: YTN; PAM sequence: TTC
ttggttgggggtcatggggt

SEQ ID NO: 220727 - DNA, 20 bp, Artificial Sequence
  Description of Artificial Sequence: Synthetic oligonucleotide
  Target: ATXN1; (-) strand; PAM type: YTN; PAM sequence: TTT
cttggttgggggtcatgggg

SEQ ID NO: 220728 - DNA, 20 bp, Artificial Sequence
  Description of Artificial Sequence: Synthetic oligonucleotide
  Target: ATXN1; (-) strand; PAM type: YTN; PAM sequence: CTT
tcttggttgggggtcatggg

SEQ ID NO: 220729 - DNA, 20 bp, Artificial Sequence
  Description of Artificial Sequence: Synthetic oligonucleotide
  Target: ATXN1; (-) strand; PAM type: YTN; PAM sequence: TTA
ccctttcttggttgggggtc

SEQ ID NO: 220730 - DNA, 20 bp, Artificial Sequence
  Description of Artificial Sequence: Synthetic oligonucleotide
  Target: ATXN1; (-) strand; PAM type: YTN; PAM sequence: CTT
accctttcttggttgggggt

SEQ ID NO: 220731 - DNA, 20 bp, Artificial Sequence
  Description of Artificial Sequence: Synthetic oligonucleotide
  Target: ATXN1; (-) strand; PAM type: YTN; PAM sequence: TTG
gcttaccctttcttggttgg

SEQ ID NO: 220732 - DNA, 20 bp, Artificial Sequence
  Description of Artificial Sequence: Synthetic oligonucleotide
  Target: ATXN1; (-) strand; PAM type: YTN; PAM sequence: CTG
tgttggcttaccctttcttg

SEQ ID NO: 220733 - DNA, 20 bp, Artificial Sequence
  Description of Artificial Sequence: Synthetic oligonucleotide
  Target: ATXN1; (-) strand; PAM type: YTN; PAM sequence: CTC
tgtgttggcttaccctttct

SEQ ID NO: 220734 - DNA, 20 bp, Artificial Sequence
  Description of Artificial Sequence: Synthetic oligonucleotide
  Target: ATXN1; (-) strand; PAM type: YTN; PAM sequence: TTC
tctgtgttggcttacccttt

SEQ ID NO: 220735 - DNA, 20 bp, Artificial Sequence
  Description of Artificial Sequence: Synthetic oligonucleotide
  Target: ATXN1; (-) strand; PAM type: YTN; PAM sequence: CTT
ctctgtgttggcttaccctt

SEQ ID NO: 220736 - DNA, 20 bp, Artificial Sequence
  Description of Artificial Sequence: Synthetic oligonucleotide
  Target: ATXN1; (-) strand; PAM type: YTN; PAM sequence: CTG
gcttctctgtgttggcttac

SEQ ID NO: 220737 - DNA, 20 bp, Artificial Sequence
  Description of Artificial Sequence: Synthetic oligonucleotide
  Target: ATXN1; (-) strand; PAM type: YTN; PAM sequence: CTG
agcgcccaccctggcttctc

SEQ ID NO: 220738 - DNA, 20 bp, Artificial Sequence
  Description of Artificial Sequence: Synthetic oligonucleotide
  Target: ATXN1; (-) strand; PAM type: YTN; PAM sequence: CTC
tgagcgcccaccctggcttc

SEQ ID NO: 220739 - DNA, 20 bp, Artificial Sequence
  Description of Artificial Sequence: Synthetic oligonucleotide
  Target: ATXN1; (-) strand; PAM type: YTN; PAM sequence: CTC
tctgagcgcccaccctggct

SEQ ID NO: 220740 - DNA, 20 bp, Artificial Sequence
  Description of Artificial Sequence: Synthetic oligonucleotide
  Target: ATXN1; (-) strand; PAM type: YTN; PAM sequence: TTA
gtggacccacagaagtgacc

SEQ ID NO: 220741 - DNA, 20 bp, Artificial Sequence
  Description of Artificial Sequence: Synthetic oligonucleotide
  Target: ATXN1; (-) strand; PAM type: YTN; PAM sequence: CTT
agtggacccacagaagtgac

SEQ ID NO: 220742 - DNA, 20 bp, Artificial Sequence
  Description of Artificial Sequence: Synthetic oligonucleotide
  Target: ATXN1; (-) strand; PAM type: YTN; PAM sequence: TTG
gggtaccaggaacaggctta

SEQ ID NO: 220743 - DNA, 20 bp, Artificial Sequence
  Description of Artificial Sequence: Synthetic oligonucleotide
  Target: ATXN1; (-) strand; PAM type: YTN; PAM sequence: TTA
gtgatattggggtaccagga

SEQ ID NO: 220744 - DNA, 20 bp, Artificial Sequence
  Description of Artificial Sequence: Synthetic oligonucleotide
  Target: ATXN1; (-) strand; PAM type: YTN; PAM sequence: CTT
agtgatattggggtaccagg

SEQ ID NO: 220745 - DNA, 20 bp, Artificial Sequence
  Description of Artificial Sequence: Synthetic oligonucleotide
  Target: ATXN1; (-) strand; PAM type: YTN; PAM sequence: TTG
ggccacttagtgatattggg

SEQ ID NO: 220746 - DNA, 20 bp, Artificial Sequence
  Description of Artificial Sequence: Synthetic oligonucleotide
  Target: ATXN1; (-) strand; PAM type: YTN; PAM sequence: CTA
agttgggccacttagtgata

SEQ ID NO: 220747 - DNA, 20 bp, Artificial Sequence
  Description of Artificial Sequence: Synthetic oligonucleotide
  Target: ATXN1; (-) strand; PAM type: YTN; PAM sequence: TTC
taagttgggccacttagtga

SEQ ID NO: 220748 - DNA, 20 bp, Artificial Sequence
  Description of Artificial Sequence: Synthetic oligonucleotide
  Target: ATXN1; (-) strand; PAM type: YTN; PAM sequence: TTT
ctaagttgggccacttagtg

SEQ ID NO: 220749 - DNA, 20 bp, Artificial Sequence
  Description of Artificial Sequence: Synthetic oligonucleotide
  Target: ATXN1; (-) strand; PAM type: YTN; PAM sequence: CTA
gtatttctaagttgggccac

SEQ ID NO: 220750 - DNA, 20 bp, Artificial Sequence
  Description of Artificial Sequence: Synthetic oligonucleotide
  Target: ATXN1; (-) strand; PAM type: YTN; PAM sequence: TTC
tagtatttctaagttgggcc

SEQ ID NO: 220751 - DNA, 20 bp, Artificial Sequence
  Description of Artificial Sequence: Synthetic oligonucleotide
  Target: ATXN1; (-) strand; PAM type: YTN; PAM sequence: TTG
attctagtatttctaagttg

SEQ ID NO: 220752 - DNA, 20 bp, Artificial Sequence
  Description of Artificial Sequence: Synthetic oligonucleotide
  Target: ATXN1; (-) strand; PAM type: YTN; PAM sequence: CTG
tggaataagggggaaggcag

SEQ ID NO: 220753 - DNA, 20 bp, Artificial Sequence
  Description of Artificial Sequence: Synthetic oligonucleotide
  Target: ATXN1; (-) strand; PAM type: YTN; PAM sequence: CTG
acctgtggaataagggggaa

SEQ ID NO: 220754 - DNA, 20 bp, Artificial Sequence
  Description of Artificial Sequence: Synthetic oligonucleotide
  Target: ATXN1; (-) strand; PAM type: YTN; PAM sequence: CTG
ctgacctgtggaataagggg

SEQ ID NO: 220755 - DNA, 20 bp, Artificial Sequence
  Description of Artificial Sequence: Synthetic oligonucleotide
  Target: ATXN1; (-) strand; PAM type: YTN; PAM sequence: TTG
gtccctgctgacctgtggaa

SEQ ID NO: 220756 - DNA, 20 bp, Artificial Sequence
  Description of Artificial Sequence: Synthetic oligonucleotide
  Target: ATXN1; (-) strand; PAM type: YTN; PAM sequence: TTT
ggtccctgctgacctgtgga

SEQ ID NO: 220757 - DNA, 20 bp, Artificial Sequence
  Description of Artificial Sequence: Synthetic oligonucleotide
  Target: ATXN1; (-) strand; PAM type: YTN; PAM sequence: TTG
ataggatttggtccctgctg

SEQ ID NO: 220758 - DNA, 20 bp, Artificial Sequence
  Description of Artificial Sequence: Synthetic oligonucleotide
  Target: ATXN1; (-) strand; PAM type: YTN; PAM sequence: TTC
aagtagcataaccaggaaat

SEQ ID NO: 220759 - DNA, 20 bp, Artificial Sequence
  Description of Artificial Sequence: Synthetic oligonucleotide
  Target: ATXN1; (-) strand; PAM type: YTN; PAM sequence: CTG
gagaggcagaaagggaagga

SEQ ID NO: 220760 - DNA, 20 bp, Artificial Sequence
  Description of Artificial Sequence: Synthetic oligonucleotide
  Target: ATXN1; (-) strand; PAM type: YTN; PAM sequence: TTG
ctggagaggcagaaagggaa

SEQ ID NO: 220761 - DNA, 20 bp, Artificial Sequence
  Description of Artificial Sequence: Synthetic oligonucleotide
  Target: ATXN1; (-) strand; PAM type: YTN; PAM sequence: CTT
gctggagaggcagaaaggga

SEQ ID NO: 220762 - DNA, 20 bp, Artificial Sequence
  Description of Artificial Sequence: Synthetic oligonucleotide
  Target: ATXN1; (-) strand; PAM type: YTN; PAM sequence: CTG
ggtgagagggcacgaggggt

SEQ ID NO: 220763 - DNA, 20 bp, Artificial Sequence
  Description of Artificial Sequence: Synthetic oligonucleotide
  Target: ATXN1; (-) strand; PAM type: YTN; PAM sequence: TTG
gagaaccatgagagcaggca

SEQ ID NO: 220764 - DNA, 20 bp, Artificial Sequence
  Description of Artificial Sequence: Synthetic oligonucleotide
  Target: ATXN1; (-) strand; PAM type: YTN; PAM sequence: CTG
gagaggtgattggagaacca

SEQ ID NO: 220765 - DNA, 20 bp, Artificial Sequence
  Description of Artificial Sequence: Synthetic oligonucleotide
  Target: ATXN1; (-) strand; PAM type: YTN; PAM sequence: TTC
tggagaggtgattggagaac

SEQ ID NO: 220766 - DNA, 20 bp, Artificial Sequence
  Description of Artificial Sequence: Synthetic oligonucleotide
  Target: ATXN1; (-) strand; PAM type: YTN; PAM sequence: TTG
tggcattctggagaggtgat

SEQ ID NO: 220767 - DNA, 20 bp, Artificial Sequence
  Description of Artificial Sequence: Synthetic oligonucleotide
  Target: ATXN1; (-) strand; PAM type: YTN; PAM sequence: TTT
gtggcattctggagaggtga

SEQ ID NO: 220768 - DNA, 20 bp, Artificial Sequence
  Description of Artificial Sequence: Synthetic oligonucleotide
  Target: ATXN1; (-) strand; PAM type: YTN; PAM sequence: TTT
tgtggcattctggagaggtg

SEQ ID NO: 220769 - DNA, 20 bp, Artificial Sequence
  Description of Artificial Sequence: Synthetic oligonucleotide
  Target: ATXN1; (-) strand; PAM type: YTN; PAM sequence: CTT
ttgtggcattctggagaggt

SEQ ID NO: 220770 - DNA, 20 bp, Artificial Sequence
  Description of Artificial Sequence: Synthetic oligonucleotide
  Target: ATXN1; (-) strand; PAM type: YTN; PAM sequence: CTA
gagccagcttttgtggcatt

SEQ ID NO: 220771 - DNA, 20 bp, Artificial Sequence
  Description of Artificial Sequence: Synthetic oligonucleotide
  Target: ATXN1; (-) strand; PAM type: YTN; PAM sequence: TTC
tagagccagcttttgtggca

SEQ ID NO: 220772 - DNA, 20 bp, Artificial Sequence
  Description of Artificial Sequence: Synthetic oligonucleotide
  Target: ATXN1; (-) strand; PAM type: YTN; PAM sequence: TTT
ctagagccagcttttgtggc

SEQ ID NO: 220773 - DNA, 20 bp, Artificial Sequence
  Description of Artificial Sequence: Synthetic oligonucleotide
  Target: ATXN1; (-) strand; PAM type: YTN; PAM sequence: TTT
tctagagccagcttttgtgg

SEQ ID NO: 220774 - DNA, 20 bp, Artificial Sequence
  Description of Artificial Sequence: Synthetic oligonucleotide
  Target: ATXN1; (-) strand; PAM type: YTN; PAM sequence: CTG
tattttctagagccagcttt

SEQ ID NO: 220775 - DNA, 20 bp, Artificial Sequence
  Description of Artificial Sequence: Synthetic oligonucleotide
  Target: ATXN1; (-) strand; PAM type: YTN; PAM sequence: TTG
gagagtacaaggatcagatc

SEQ ID NO: 220776 - DNA, 20 bp, Artificial Sequence
  Description of Artificial Sequence: Synthetic oligonucleotide
  Target: ATXN1; (-) strand; PAM type: YTN; PAM sequence: TTT
ggagagtacaaggatcagat

SEQ ID NO: 220777 - DNA, 20 bp, Artificial Sequence
  Description of Artificial Sequence: Synthetic oligonucleotide
  Target: ATXN1; (-) strand; PAM type: YTN; PAM sequence: TTC
agtttggagagtacaaggat

SEQ ID NO: 220778 - DNA, 20 bp, Artificial Sequence
  Description of Artificial Sequence: Synthetic oligonucleotide
  Target: ATXN1; (-) strand; PAM type: YTN; PAM sequence: TTT
cagtttggagagtacaagga

SEQ ID NO: 220779 - DNA, 20 bp, Artificial Sequence
  Description of Artificial Sequence: Synthetic oligonucleotide
  Target: ATXN1; (-) strand; PAM type: YTN; PAM sequence: TTT
tcagtttggagagtacaagg

SEQ ID NO: 220780 - DNA, 20 bp, Artificial Sequence
  Description of Artificial Sequence: Synthetic oligonucleotide
  Target: ATXN1; (-) strand; PAM type: YTN; PAM sequence: CTG
cagtcaccatggttttcagt

SEQ ID NO: 220781 - DNA, 20 bp, Artificial Sequence
  Description of Artificial Sequence: Synthetic oligonucleotide
  Target: ATXN1; (-) strand; PAM type: YTN; PAM sequence: TTG
gagagtatactgcagtcacc

SEQ ID NO: 220782 - DNA, 20 bp, Artificial Sequence
  Description of Artificial Sequence: Synthetic oligonucleotide
  Target: ATXN1; (-) strand; PAM type: YTN; PAM sequence: TTT
ggagagtatactgcagtcac

SEQ ID NO: 220783 - DNA, 20 bp, Artificial Sequence
  Description of Artificial Sequence: Synthetic oligonucleotide
  Target: ATXN1; (-) strand; PAM type: YTN; PAM sequence: TTA
gtgatagtttggagagtata

SEQ ID NO: 220784 - DNA, 20 bp, Artificial Sequence
  Description of Artificial Sequence: Synthetic oligonucleotide
  Target: ATXN1; (-) strand; PAM type: YTN; PAM sequence: TTT
agtgatagtttggagagtat

SEQ ID NO: 220785 - DNA, 20 bp, Artificial Sequence
  Description of Artificial Sequence: Synthetic oligonucleotide
  Target: ATXN1; (-) strand; PAM type: YTN; PAM sequence: CTT
tagtgatagtttggagagta

SEQ ID NO: 220786 - DNA, 20 bp, Artificial Sequence
  Description of Artificial Sequence: Synthetic oligonucleotide
  Target: ATXN1; (-) strand; PAM type: YTN; PAM sequence: CTC
tttagtgatagtttggagag

SEQ ID NO: 220787 - DNA, 20 bp, Artificial Sequence
  Description of Artificial Sequence: Synthetic oligonucleotide
  Target: ATXN1; (-) strand; PAM type: YTN; PAM sequence: TTC
ctctttagtgatagtttgga

SEQ ID NO: 220788 - DNA, 20 bp, Artificial Sequence
  Description of Artificial Sequence: Synthetic oligonucleotide
  Target: ATXN1; (-) strand; PAM type: YTN; PAM sequence: CTT
cctctttagtgatagtttgg

SEQ ID NO: 220789 - DNA, 20 bp, Artificial Sequence
  Description of Artificial Sequence: Synthetic oligonucleotide
  Target: ATXN1; (-) strand; PAM type: YTN; PAM sequence: TTC
acatcccccttcctctttag

SEQ ID NO: 220790 - DNA, 20 bp, Artificial Sequence
  Description of Artificial Sequence: Synthetic oligonucleotide
  Target: ATXN1; (-) strand; PAM type: YTN; PAM sequence: TTT
cacatcccccttcctcttta

SEQ ID NO: 220791 - DNA, 20 bp, Artificial Sequence
  Description of Artificial Sequence: Synthetic oligonucleotide
  Target: ATXN1; (-) strand; PAM type: YTN; PAM sequence: CTG
tatatgtttcacatccccct

SEQ ID NO: 220792 - DNA, 20 bp, Artificial Sequence
  Description of Artificial Sequence: Synthetic oligonucleotide
  Target: ATXN1; (-) strand; PAM type: YTN; PAM sequence: TTG
atagcacagaggaagatcgc

SEQ ID NO: 220793 - DNA, 20 bp, Artificial Sequence
  Description of Artificial Sequence: Synthetic oligonucleotide
  Target: ATXN1; (-) strand; PAM type: YTN; PAM sequence: TTG
ttgatagcacagaggaagat

SEQ ID NO: 220794 - DNA, 20 bp, Artificial Sequence
  Description of Artificial Sequence: Synthetic oligonucleotide
  Target: ATXN1; (-) strand; PAM type: YTN; PAM sequence: CTT
gttgatagcacagaggaaga

SEQ ID NO: 220795 - DNA, 20 bp, Artificial Sequence
  Description of Artificial Sequence: Synthetic oligonucleotide
  Target: ATXN1; (-) strand; PAM type: YTN; PAM sequence: TTG
cttgttgatagcacagagga

SEQ ID NO: 220796 - DNA, 20 bp, Artificial Sequence
  Description of Artificial Sequence: Synthetic oligonucleotide
  Target: ATXN1; (-) strand; PAM type: YTN; PAM sequence: CTT
gcttgttgatagcacagagg

SEQ ID NO: 220797 - DNA, 20 bp, Artificial Sequence
  Description of Artificial Sequence: Synthetic oligonucleotide
  Target: ATXN1; (-) strand; PAM type: YTN; PAM sequence: TTC
ttgcttgttgatagcacaga

SEQ ID NO: 220798 - DNA, 20 bp, Artificial Sequence
  Description of Artificial Sequence: Synthetic oligonucleotide
  Target: ATXN1; (-) strand; PAM type: YTN; PAM sequence: TTT
cttgcttgttgatagcacag

SEQ ID NO: 220799 - DNA, 20 bp, Artificial Sequence
  Description of Artificial Sequence: Synthetic oligonucleotide
  Target: ATXN1; (-) strand; PAM type: YTN; PAM sequence: TTT
tcttgcttgttgatagcaca

SEQ ID NO: 220800 - DNA, 20 bp, Artificial Sequence
  Description of Artificial Sequence: Synthetic oligonucleotide
  Target: ATXN1; (-) strand; PAM type: YTN; PAM sequence: TTT
ttcttgcttgttgatagcac

SEQ ID NO: 220801 - DNA, 20 bp, Artificial Sequence
  Description of Artificial Sequence: Synthetic oligonucleotide
  Target: ATXN1; (-) strand; PAM type: YTN; PAM sequence: TTT
tttcttgcttgttgatagca

SEQ ID NO: 220802 - DNA, 20 bp, Artificial Sequence
  Description of Artificial Sequence: Synthetic oligonucleotide
  Target: ATXN1; (-) strand; PAM type: YTN; PAM sequence: CTT
ttttcttgcttgttgatagc

SEQ ID NO: 220803 - DNA, 20 bp, Artificial Sequence
  Description of Artificial Sequence: Synthetic oligonucleotide
  Target: ATXN1; (-) strand; PAM type: YTN; PAM sequence: CTC
ttttttcttgcttgttgata

SEQ ID NO: 220804 - DNA, 20 bp, Artificial Sequence
  Description of Artificial Sequence: Synthetic oligonucleotide
  Target: ATXN1; (-) strand; PAM type: YTN; PAM sequence: CTC
cagatctcttttttcttgct

SEQ ID NO: 220805 - DNA, 20 bp, Artificial Sequence
  Description of Artificial Sequence: Synthetic oligonucleotide
  Target: ATXN1; (-) strand; PAM type: YTN; PAM sequence: TTC
tccagatctcttttttcttg

SEQ ID NO: 220806 - DNA, 20 bp, Artificial Sequence
  Description of Artificial Sequence: Synthetic oligonucleotide
  Target: ATXN1; (-) strand; PAM type: YTN; PAM sequence: TTT
ctccagatctcttttttctt

SEQ ID NO: 220807 - DNA, 20 bp, Artificial Sequence
  Description of Artificial Sequence: Synthetic oligonucleotide
  Target: ATXN1; (-) strand; PAM type: YTN; PAM sequence: TTT
tctccagatctcttttttct

SEQ ID NO: 220808 - DNA, 20 bp, Artificial Sequence
  Description of Artificial Sequence: Synthetic oligonucleotide
  Target: ATXN1; (-) strand; PAM type: YTN; PAM sequence: CTG
ttttctccagatctcttttt

SEQ ID NO: 220809 - DNA, 20 bp, Artificial Sequence
  Description of Artificial Sequence: Synthetic oligonucleotide
  Target: ATXN1; (-) strand; PAM type: YTN; PAM sequence: CTC
cacatctgttttctccagat

SEQ ID NO: 220810 - DNA, 20 bp, Artificial Sequence
  Description of Artificial Sequence: Synthetic oligonucleotide
  Target: ATXN1; (-) strand; PAM type: YTN; PAM sequence: CTG
catgtatcctccacatctgt

SEQ ID NO: 220811 - DNA, 20 bp, Artificial Sequence
  Description of Artificial Sequence: Synthetic oligonucleotide
  Target: ATXN1; (-) strand; PAM type: YTN; PAM sequence: CTC
tgcatgtatcctccacatct

SEQ ID NO: 220812 - DNA, 20 bp, Artificial Sequence
  Description of Artificial Sequence: Synthetic oligonucleotide
  Target: ATXN1; (-) strand; PAM type: YTN; PAM sequence: TTG
gtcctctgcatgtatcctcc

SEQ ID NO: 220813 - DNA, 20 bp, Artificial Sequence
  Description of Artificial Sequence: Synthetic oligonucleotide
  Target: ATXN1; (-) strand; PAM type: YTN; PAM sequence: CTT
ggtcctctgcatgtatcctc

SEQ ID NO: 220814 - DNA, 20 bp, Artificial Sequence
  Description of Artificial Sequence: Synthetic oligonucleotide
  Target: ATXN1; (-) strand; PAM type: YTN; PAM sequence: TTC
ttggtcctctgcatgtatcc

SEQ ID NO: 220815 - DNA, 20 bp, Artificial Sequence
  Description of Artificial Sequence: Synthetic oligonucleotide
  Target: ATXN1; (-) strand; PAM type: YTN; PAM sequence: TTG
gttcttggtcctctgcatgt

SEQ ID NO: 220816 - DNA, 20 bp, Artificial Sequence
  Description of Artificial Sequence: Synthetic oligonucleotide
  Target: ATXN1; (-) strand; PAM type: YTN; PAM sequence: CTT
ggttcttggtcctctgcatg

SEQ ID NO: 220817 - DNA, 20 bp, Artificial Sequence
  Description of Artificial Sequence: Synthetic oligonucleotide
  Target: ATXN1; (-) strand; PAM type: YTN; PAM sequence: CTG
aataaaatcttggttcttgg

SEQ ID NO: 220818 - DNA, 20 bp, Artificial Sequence
  Description of Artificial Sequence: Synthetic oligonucleotide
  Target: ATXN1; (-) strand; PAM type: YTN; PAM sequence: CTG
acccaaaatatagatgagcc

SEQ ID NO: 220819 - DNA, 20 bp, Artificial Sequence
  Description of Artificial Sequence: Synthetic oligonucleotide
  Target: ATXN1; (-) strand; PAM type: YTN; PAM sequence: CTA
aaaaactgacccaaaatata

SEQ ID NO: 220820 - DNA, 20 bp, Artificial Sequence
  Description of Artificial Sequence: Synthetic oligonucleotide
  Target: ATXN1; (-) strand; PAM type: YTN; PAM sequence: TTC
taaaaaactgacccaaaata

SEQ ID NO: 220821 - DNA, 20 bp, Artificial Sequence
  Description of Artificial Sequence: Synthetic oligonucleotide
  Target: ATXN1; (-) strand; PAM type: YTN; PAM sequence: TTG
agttctaaaaaactgaccca

SEQ ID NO: 220822 - DNA, 20 bp, Artificial Sequence
  Description of Artificial Sequence: Synthetic oligonucleotide
  Target: ATXN1; (-) strand; PAM type: YTN; PAM sequence: TTA
aaagtcaaattgagttctaa

SEQ ID NO: 220823 - DNA, 20 bp, Artificial Sequence
  Description of Artificial Sequence: Synthetic oligonucleotide
  Target: ATXN1; (-) strand; PAM type: YTN; PAM sequence: TTA
atgattaaaagtcaaattga

SEQ ID NO: 220824 - DNA, 20 bp, Artificial Sequence
  Description of Artificial Sequence: Synthetic oligonucleotide
  Target: ATXN1; (-) strand; PAM type: YTN; PAM sequence: TTT
aatgattaaaagtcaaattg

SEQ ID NO: 220825 - DNA, 20 bp, Artificial Sequence
  Description of Artificial Sequence: Synthetic oligonucleotide
  Target: ATXN1; (-) strand; PAM type: YTN; PAM sequence: TTT
taatgattaaaagtcaaatt

SEQ ID NO: 220826 - DNA, 20 bp, Artificial Sequence
  Description of Artificial Sequence: Synthetic oligonucleotide
  Target: ATXN1; (-) strand; PAM type: YTN; PAM sequence: TTT
ttaatgattaaaagtcaaat

SEQ ID NO: 220827 - DNA, 20 bp, Artificial Sequence
  Description of Artificial Sequence: Synthetic oligonucleotide
  Target: ATXN1; (-) strand; PAM type: YTN; PAM sequence: CTA
ggatcatttttaatgattaa

SEQ ID NO: 220828 - DNA, 20 bp, Artificial Sequence
  Description of Artificial Sequence: Synthetic oligonucleotide
  Target: ATXN1; (-) strand; PAM type: YTN; PAM sequence: TTC
taggatcatttttaatgatt

SEQ ID NO: 220829 - DNA, 20 bp, Artificial Sequence
  Description of Artificial Sequence: Synthetic oligonucleotide
  Target: ATXN1; (-) strand; PAM type: YTN; PAM sequence: CTT
ctaggatcatttttaatgat

SEQ ID NO: 220830 - DNA, 20 bp, Artificial Sequence
  Description of Artificial Sequence: Synthetic oligonucleotide
  Target: ATXN1; (-) strand; PAM type: YTN; PAM sequence: CTC
acaggacatgcttctaggat

SEQ ID NO: 220831 - DNA, 20 bp, Artificial Sequence
  Description of Artificial Sequence: Synthetic oligonucleotide
  Target: ATXN1; (-) strand; PAM type: YTN; PAM sequence: TTG
gcagtgcctcacaggacatg

SEQ ID NO: 220832 - DNA, 20 bp, Artificial Sequence
  Description of Artificial Sequence: Synthetic oligonucleotide
  Target: ATXN1; (-) strand; PAM type: YTN; PAM sequence: CTT
ggcagtgcctcacaggacat

SEQ ID NO: 220833 - DNA, 20 bp, Artificial Sequence
  Description of Artificial Sequence: Synthetic oligonucleotide
  Target: ATXN1; (-) strand; PAM type: YTN; PAM sequence: TTC
aagcagtaatgaaatgcatc

SEQ ID NO: 220834 - DNA, 20 bp, Artificial Sequence
  Description of Artificial Sequence: Synthetic oligonucleotide
  Target: ATXN1; (-) strand; PAM type: YTN; PAM sequence: TTT
caagcagtaatgaaatgcat

SEQ ID NO: 220835 - DNA, 20 bp, Artificial Sequence
  Description of Artificial Sequence: Synthetic oligonucleotide
  Target: ATXN1; (-) strand; PAM type: YTN; PAM sequence: CTT
tcaagcagtaatgaaatgca

SEQ ID NO: 220836 - DNA, 20 bp, Artificial Sequence
  Description of Artificial Sequence: Synthetic oligonucleotide
  Target: ATXN1; (-) strand; PAM type: YTN; PAM sequence: TTG
aatatgtggcctttcaagca

SEQ ID NO: 220837 - DNA, 20 bp, Artificial Sequence
  Description of Artificial Sequence: Synthetic oligonucleotide
  Target: ATXN1; (-) strand; PAM type: YTN; PAM sequence: TTT
gaatatgtggcctttcaagc

SEQ ID NO: 220838 - DNA, 20 bp, Artificial Sequence
  Description of Artificial Sequence: Synthetic oligonucleotide
  Target: ATXN1; (-) strand; PAM type: YTN; PAM sequence: TTT
tgaatatgtggcctttcaag

SEQ ID NO: 220839 - DNA, 20 bp, Artificial Sequence
  Description of Artificial Sequence: Synthetic oligonucleotide
  Target: ATXN1; (-) strand; PAM type: YTN; PAM sequence: CTA
gtagtgttttgaatatgtgg

SEQ ID NO: 220840 - DNA, 20 bp, Artificial Sequence
  Description of Artificial Sequence: Synthetic oligonucleotide
  Target: ATXN1; (-) strand; PAM type: YTN; PAM sequence: TTC
tagtagtgttttgaatatgt

SEQ ID NO: 220841 - DNA, 20 bp, Artificial Sequence
  Description of Artificial Sequence: Synthetic oligonucleotide
  Target: ATXN1; (-) strand; PAM type: YTN; PAM sequence: CTT
ctagtagtgttttgaatatg

SEQ ID NO: 220842 - DNA, 20 bp, Artificial Sequence
  Description of Artificial Sequence: Synthetic oligonucleotide
  Target: ATXN1; (-) strand; PAM type: YTN; PAM sequence: CTG
acttctagtagtgttttgaa

SEQ ID NO: 220843 - DNA, 20 bp, Artificial Sequence
  Description of Artificial Sequence: Synthetic oligonucleotide
  Target: ATXN1; (-) strand; PAM type: YTN; PAM sequence: TTA
gcctgacttctagtagtgtt

SEQ ID NO: 220844 - DNA, 20 bp, Artificial Sequence
  Description of Artificial Sequence: Synthetic oligonucleotide
  Target: ATXN1; (-) strand; PAM type: YTN; PAM sequence: TTT
agcctgacttctagtagtgt

SEQ ID NO: 220845 - DNA, 20 bp, Artificial Sequence
  Description of Artificial Sequence: Synthetic oligonucleotide
  Target: ATXN1; (-) strand; PAM type: YTN; PAM sequence: CTT
tagcctgacttctagtagtg

SEQ ID NO: 220846 - DNA, 20 bp, Artificial Sequence
  Description of Artificial Sequence: Synthetic oligonucleotide
  Target: ATXN1; (-) strand; PAM type: YTN; PAM sequence: TTC
tttagcctgacttctagtag

SEQ ID NO: 220847 - DNA, 20 bp, Artificial Sequence
  Description of Artificial Sequence: Synthetic oligonucleotide
  Target: ATXN1; (-) strand; PAM type: YTN; PAM sequence: TTT
ctttagcctgacttctagta

SEQ ID NO: 220848 - DNA, 20 bp, Artificial Sequence
  Description of Artificial Sequence: Synthetic oligonucleotide
  Target: ATXN1; (-) strand; PAM type: YTN; PAM sequence: TTT
tctttagcctgacttctagt

SEQ ID NO: 220849 - DNA, 20 bp, Artificial Sequence
  Description of Artificial Sequence: Synthetic oligonucleotide
  Target: ATXN1; (-) strand; PAM type: YTN; PAM sequence: TTA
ttttctttagcctgacttct

SEQ ID NO: 220850 - DNA, 20 bp, Artificial Sequence
  Description of Artificial Sequence: Synthetic oligonucleotide
  Target: ATXN1; (-) strand; PAM type: YTN; PAM sequence: TTT
attttctttagcctgacttc

SEQ ID NO: 220851 - DNA, 20 bp, Artificial Sequence
  Description of Artificial Sequence: Synthetic oligonucleotide
  Target: ATXN1; (-) strand; PAM type: YTN; PAM sequence: TTT
tattttctttagcctgactt

SEQ ID NO: 220852 - DNA, 20 bp, Artificial Sequence
  Description of Artificial Sequence: Synthetic oligonucleotide
  Target: ATXN1; (-) strand; PAM type: YTN; PAM sequence: TTA
aaaatatccaaaatcatttt

SEQ ID NO: 220853 - DNA, 20 bp, Artificial Sequence
  Description of Artificial Sequence: Synthetic oligonucleotide
  Target: ATXN1; (-) strand; PAM type: YTN; PAM sequence: CTT
aaaaatatccaaaatcattt

SEQ ID NO: 220854 - DNA, 20 bp, Artificial Sequence
  Description of Artificial Sequence: Synthetic oligonucleotide
  Target: ATXN1; (-) strand; PAM type: YTN; PAM sequence: CTG
cttaaaaatatccaaaatca

SEQ ID NO: 220855 - DNA, 20 bp, Artificial Sequence
  Description of Artificial Sequence: Synthetic oligonucleotide
  Target: ATXN1; (-) strand; PAM type: YTN; PAM sequence: TTA
gtaactgcttaaaaatatcc

SEQ ID NO: 220856 - DNA, 20 bp, Artificial Sequence
  Description of Artificial Sequence: Synthetic oligonucleotide
  Target: ATXN1; (-) strand; PAM type: YTN; PAM sequence: TTT
agtaactgcttaaaaatatc

SEQ ID NO: 220857 - DNA, 20 bp, Artificial Sequence
  Description of Artificial Sequence: Synthetic oligonucleotide
  Target: ATXN1; (-) strand; PAM type: YTN; PAM sequence: TTT
tagtaactgcttaaaaatat

SEQ ID NO: 220858 - DNA, 20 bp, Artificial Sequence
  Description of Artificial Sequence: Synthetic oligonucleotide
  Target: ATXN1; (-) strand; PAM type: YTN; PAM sequence: CTG
ttttagtaactgcttaaaaa

SEQ ID NO: 220859 - DNA, 20 bp, Artificial Sequence
  Description of Artificial Sequence: Synthetic oligonucleotide
  Target: ATXN1; (-) strand; PAM type: YTN; PAM sequence: TTC
tgttttagtaactgcttaaa

SEQ ID NO: 220860 - DNA, 20 bp, Artificial Sequence
  Description of Artificial Sequence: Synthetic oligonucleotide
  Target: ATXN1; (-) strand; PAM type: YTN; PAM sequence: TTT
ctgttttagtaactgcttaa

SEQ ID NO: 220861 - DNA, 20 bp, Artificial Sequence
  Description of Artificial Sequence: Synthetic oligonucleotide
  Target: ATXN1; (-) strand; PAM type: YTN; PAM sequence: TTG
tttctgttttagtaactgct

SEQ ID NO: 220862 - DNA, 20 bp, Artificial Sequence
  Description of Artificial Sequence: Synthetic oligonucleotide
  Target: ATXN1; (-) strand; PAM type: YTN; PAM sequence: TTT
gtttctgttttagtaactgc

SEQ ID NO: 220863 - DNA, 20 bp, Artificial Sequence
  Description of Artificial Sequence: Synthetic oligonucleotide
  Target: ATXN1; (-) strand; PAM type: YTN; PAM sequence: TTA
aaaataacatttgtttctgt

SEQ ID NO: 220864 - DNA, 20 bp, Artificial Sequence
  Description of Artificial Sequence: Synthetic oligonucleotide
  Target: ATXN1; (-) strand; PAM type: YTN; PAM sequence: TTA
cagtgagccagagattaaaa

SEQ ID NO: 220865 - DNA, 20 bp, Artificial Sequence
  Description of Artificial Sequence: Synthetic oligonucleotide
  Target: ATXN1; (-) strand; PAM type: YTN; PAM sequence: TTT
acagtgagccagagattaaa

SEQ ID NO: 220866 - DNA, 20 bp, Artificial Sequence
  Description of Artificial Sequence: Synthetic oligonucleotide
  Target: ATXN1; (-) strand; PAM type: YTN; PAM sequence: TTG
tcagtttacagtgagccaga

SEQ ID NO: 220867 - DNA, 20 bp, Artificial Sequence
  Description of Artificial Sequence: Synthetic oligonucleotide
  Target: ATXN1; (-) strand; PAM type: YTN; PAM sequence: CTT
gtcagtttacagtgagccag

SEQ ID NO: 220868 - DNA, 20 bp, Artificial Sequence
  Description of Artificial Sequence: Synthetic oligonucleotide
  Target: ATXN1; (-) strand; PAM type: YTN; PAM sequence: TTC
atatcttgtcagtttacagt

SEQ ID NO: 220869 - DNA, 20 bp, Artificial Sequence
  Description of Artificial Sequence: Synthetic oligonucleotide
  Target: ATXN1; (-) strand; PAM type: YTN; PAM sequence: TTC
atattcatatcttgtcagtt

SEQ ID NO: 220870 - DNA, 20 bp, Artificial Sequence
  Description of Artificial Sequence: Synthetic oligonucleotide
  Target: ATXN1; (-) strand; PAM type: YTN; PAM sequence: TTG
gtaaaattcatattcatatc

SEQ ID NO: 220871 - DNA, 20 bp, Artificial Sequence
  Description of Artificial Sequence: Synthetic oligonucleotide
  Target: ATXN1; (-) strand; PAM type: YTN; PAM sequence: CTT
ggtaaaattcatattcatat

SEQ ID NO: 220872 - DNA, 20 bp, Artificial Sequence
  Description of Artificial Sequence: Synthetic oligonucleotide
  Target: ATXN1; (-) strand; PAM type: YTN; PAM sequence: TTA
cttggtaaaattcatattca

SEQ ID NO: 220873 - DNA, 20 bp, Artificial Sequence
  Description of Artificial Sequence: Synthetic oligonucleotide
  Target: ATXN1; (-) strand; PAM type: YTN; PAM sequence: TTA
tacattacttggtaaaattc

SEQ ID NO: 220874 - DNA, 20 bp, Artificial Sequence
  Description of Artificial Sequence: Synthetic oligonucleotide
  Target: ATXN1; (-) strand; PAM type: YTN; PAM sequence: TTA
ttatacattacttggtaaaa

SEQ ID NO: 220875 - DNA, 20 bp, Artificial Sequence
  Description of Artificial Sequence: Synthetic oligonucleotide
  Target: ATXN1; (-) strand; PAM type: YTN; PAM sequence: TTG
tggtgagcagaagcagttat

SEQ ID NO: 220876 - DNA, 20 bp, Artificial Sequence
  Description of Artificial Sequence: Synthetic oligonucleotide
  Target: ATXN1; (-) strand; PAM type: YTN; PAM sequence: TTG
gcatgtggttgtggtgagca

SEQ ID NO: 220877 - DNA, 20 bp, Artificial Sequence
  Description of Artificial Sequence: Synthetic oligonucleotide
  Target: ATXN1; (-) strand; PAM type: YTN; PAM sequence: TTG
ttggcatgtggttgtggtga

SEQ ID NO: 220878 - DNA, 20 bp, Artificial Sequence
  Description of Artificial Sequence: Synthetic oligonucleotide
  Target: ATXN1; (-) strand; PAM type: YTN; PAM sequence: TTG
agttgttggcatgtggttgt

SEQ ID NO: 220879 - DNA, 20 bp, Artificial Sequence
  Description of Artificial Sequence: Synthetic oligonucleotide
  Target: ATXN1; (-) strand; PAM type: YTN; PAM sequence: TTC
cacatgtaacatcgaaatga

SEQ ID NO: 220880 - DNA, 20 bp, Artificial Sequence
  Description of Artificial Sequence: Synthetic oligonucleotide
  Target: ATXN1; (-) strand; PAM type: YTN; PAM sequence: TTA
tatgttccacatgtaacatc

SEQ ID NO: 220881 - DNA, 20 bp, Artificial Sequence
  Description of Artificial Sequence: Synthetic oligonucleotide
  Target: ATXN1; (-) strand; PAM type: YTN; PAM sequence: CTA
gattatatgttccacatgta

SEQ ID NO: 220882 - DNA, 20 bp, Artificial Sequence
  Description of Artificial Sequence: Synthetic oligonucleotide
  Target: ATXN1; (-) strand; PAM type: YTN; PAM sequence: TTG
taatctagattatatgttcc

SEQ ID NO: 220883 - DNA, 20 bp, Artificial Sequence
  Description of Artificial Sequence: Synthetic oligonucleotide
  Target: ATXN1; (-) strand; PAM type: YTN; PAM sequence: TTT
gtaatctagattatatgttc

SEQ ID NO: 220884 - DNA, 20 bp, Artificial Sequence
  Description of Artificial Sequence: Synthetic oligonucleotide
  Target: ATXN1; (-) strand; PAM type: YTN; PAM sequence: CTG
taatgaggatggtttgtaat

SEQ ID NO: 220885 - DNA, 20 bp, Artificial Sequence
  Description of Artificial Sequence: Synthetic oligonucleotide
  Target: ATXN1; (-) strand; PAM type: YTN; PAM sequence: CTA
gagtaaatggactgtaatga

SEQ ID NO: 220886 - DNA, 20 bp, Artificial Sequence
  Description of Artificial Sequence: Synthetic oligonucleotide
  Target: ATXN1; (-) strand; PAM type: YTN; PAM sequence: TTA
gctagagtaaatggactgta

SEQ ID NO: 220887 - DNA, 20 bp, Artificial Sequence
  Description of Artificial Sequence: Synthetic oligonucleotide
  Target: ATXN1; (-) strand; PAM type: YTN; PAM sequence: CTA
tcaaaaattagctagagtaa

SEQ ID NO: 220888 - DNA, 20 bp, Artificial Sequence
  Description of Artificial Sequence: Synthetic oligonucleotide
  Target: ATXN1; (-) strand; PAM type: YTN; PAM sequence: CTA
atgatgtcatgctatcaaaa

SEQ ID NO: 220889 - DNA, 20 bp, Artificial Sequence
  Description of Artificial Sequence: Synthetic oligonucleotide
  Target: ATXN1; (-) strand; PAM type: YTN; PAM sequence: TTA
tgctaatgatgtcatgctat

SEQ ID NO: 220890 - DNA, 20 bp, Artificial Sequence
  Description of Artificial Sequence: Synthetic oligonucleotide
  Target: ATXN1; (-) strand; PAM type: YTN; PAM sequence: TTT
atgctaatgatgtcatgcta

SEQ ID NO: 220891 - DNA, 20 bp, Artificial Sequence
  Description of Artificial Sequence: Synthetic oligonucleotide
  Target: ATXN1; (-) strand; PAM type: YTN; PAM sequence: TTT
tatgctaatgatgtcatgct

SEQ ID NO: 220892 - DNA, 20 bp, Artificial Sequence
  Description of Artificial Sequence: Synthetic oligonucleotide
  Target: ATXN1; (-) strand; PAM type: YTN; PAM sequence: TTT
ttatgctaatgatgtcatgc

SEQ ID NO: 220893 - DNA, 20 bp, Artificial Sequence
  Description of Artificial Sequence: Synthetic oligonucleotide
  Target: ATXN1; (-) strand; PAM type: YTN; PAM sequence: TTT
tttatgctaatgatgtcatg

SEQ ID NO: 220894 - DNA, 20 bp, Artificial Sequence
  Description of Artificial Sequence: Synthetic oligonucleotide
  Target: ATXN1; (-) strand; PAM type: YTN; PAM sequence: CTT
ttttatgctaatgatgtcat

SEQ ID NO: 220895 - DNA, 20 bp, Artificial Sequence
  Description of Artificial Sequence: Synthetic oligonucleotide
  Target: ATXN1; (-) strand; PAM type: YTN; PAM sequence: CTA
agcttttttatgctaatgat

SEQ ID NO: 220896 - DNA, 20 bp, Artificial Sequence
  Description of Artificial Sequence: Synthetic oligonucleotide
  Target: ATXN1; (-) strand; PAM type: YTN; PAM sequence: TTC
actaagcttttttatgctaa

SEQ ID NO: 220897 - DNA, 20 bp, Artificial Sequence
  Description of Artificial Sequence: Synthetic oligonucleotide
  Target: ATXN1; (-) strand; PAM type: YTN; PAM sequence: TTA
ttcactaagcttttttatgc

SEQ ID NO: 220898 - DNA, 20 bp, Artificial Sequence
  Description of Artificial Sequence: Synthetic oligonucleotide
  Target: ATXN1; (-) strand; PAM type: YTN; PAM sequence: TTC
agaatagttattcactaagc

SEQ ID NO: 220899 - DNA, 20 bp, Artificial Sequence
  Description of Artificial Sequence: Synthetic oligonucleotide
  Target: ATXN1; (-) strand; PAM type: YTN; PAM sequence: TTT
cagaatagttattcactaag

SEQ ID NO: 220900 - DNA, 20 bp, Artificial Sequence
  Description of Artificial Sequence: Synthetic oligonucleotide
  Target: ATXN1; (-) strand; PAM type: YTN; PAM sequence: TTA
taaaagcaaatttcagaata

SEQ ID NO: 220901 - DNA, 20 bp, Artificial Sequence
  Description of Artificial Sequence: Synthetic oligonucleotide
  Target: ATXN1; (-) strand; PAM type: YTN; PAM sequence: TTT
ataaaagcaaatttcagaat

SEQ ID NO: 220902 - DNA, 20 bp, Artificial Sequence
  Description of Artificial Sequence: Synthetic oligonucleotide
  Target: ATXN1; (-) strand; PAM type: YTN; PAM sequence: TTT
tataaaagcaaatttcagaa

SEQ ID NO: 220903 - DNA, 20 bp, Artificial Sequence
  Description of Artificial Sequence: Synthetic oligonucleotide
  Target: ATXN1; (-) strand; PAM type: YTN; PAM sequence: CTT
ttataaaagcaaatttcaga

SEQ ID NO: 220904 - DNA, 20 bp, Artificial Sequence
  Description of Artificial Sequence: Synthetic oligonucleotide
  Target: ATXN1; (-) strand; PAM type: YTN; PAM sequence: TTG
caaggacttttataaaagca

SEQ ID NO: 220905 - DNA, 20 bp, Artificial Sequence
  Description of Artificial Sequence: Synthetic oligonucleotide
  Target: ATXN1; (-) strand; PAM type: YTN; PAM sequence: TTT
gcaaggacttttataaaagc

SEQ ID NO: 220906 - DNA, 20 bp, Artificial Sequence
  Description of Artificial Sequence: Synthetic oligonucleotide
  Target: ATXN1; (-) strand; PAM type: YTN; PAM sequence: CTT
tgcaaggacttttataaaag

SEQ ID NO: 220907 - DNA, 20 bp, Artificial Sequence
  Description of Artificial Sequence: Synthetic oligonucleotide
  Target: ATXN1; (-) strand; PAM type: YTN; PAM sequence: TTA
gaaatgtaaaactttgcaag

SEQ ID NO: 220908 - DNA, 20 bp, Artificial Sequence
  Description of Artificial Sequence: Synthetic oligonucleotide
  Target: ATXN1; (-) strand; PAM type: YTN; PAM sequence: TTT
agaaatgtaaaactttgcaa

SEQ ID NO: 220909 - DNA, 20 bp, Artificial Sequence
  Description of Artificial Sequence: Synthetic oligonucleotide
  Target: ATXN1; (-) strand; PAM type: YTN; PAM sequence: TTG
tttagaaatgtaaaactttg

SEQ ID NO: 220910 - DNA, 20 bp, Artificial Sequence
  Description of Artificial Sequence: Synthetic oligonucleotide
  Target: ATXN1; (-) strand; PAM type: YTN; PAM sequence: CTT
gtttagaaatgtaaaacttt

SEQ ID NO: 220911 - DNA, 20 bp, Artificial Sequence
  Description of Artificial Sequence: Synthetic oligonucleotide
  Target: ATXN1; (-) strand; PAM type: YTN; PAM sequence: TTC
acttgtttagaaatgtaaaa

SEQ ID NO: 220912 - DNA, 20 bp, Artificial Sequence
  Description of Artificial Sequence: Synthetic oligonucleotide
  Target: ATXN1; (-) strand; PAM type: YTN; PAM sequence: TTT
cacttgtttagaaatgtaaa

SEQ ID NO: 220913 - DNA, 20 bp, Artificial Sequence
  Description of Artificial Sequence: Synthetic oligonucleotide
  Target: ATXN1; (-) strand; PAM type: YTN; PAM sequence: TTT
tcacttgtttagaaatgtaa

SEQ ID NO: 220914 - DNA, 20 bp, Artificial Sequence
  Description of Artificial Sequence: Synthetic oligonucleotide
  Target: ATXN1; (-) strand; PAM type: YTN; PAM sequence: TTG
gttttcacttgtttagaaat

SEQ ID NO: 220915 - DNA, 20 bp, Artificial Sequence
  Description of Artificial Sequence: Synthetic oligonucleotide
  Target: ATXN1; (-) strand; PAM type: YTN; PAM sequence: CTA
ttggttttcacttgtttaga

SEQ ID NO: 220916 - DNA, 20 bp, Artificial Sequence
  Description of Artificial Sequence: Synthetic oligonucleotide
  Target: ATXN1; (-) strand; PAM type: YTN; PAM sequence: TTC
agctattggttttcacttgt

SEQ ID NO: 220917 - DNA, 20 bp, Artificial Sequence
  Description of Artificial Sequence: Synthetic oligonucleotide
  Target: ATXN1; (-) strand; PAM type: YTN; PAM sequence: TTT
cagctattggttttcacttg

SEQ ID NO: 220918 - DNA, 20 bp, Artificial Sequence
  Description of Artificial Sequence: Synthetic oligonucleotide
  Target: ATXN1; (-) strand; PAM type: YTN; PAM sequence: TTT
tcagctattggttttcactt

SEQ ID NO: 220919 - DNA, 20 bp, Artificial Sequence
  Description of Artificial Sequence: Synthetic oligonucleotide
  Target: ATXN1; (-) strand; PAM type: YTN; PAM sequence: TTT
ttcagctattggttttcact

SEQ ID NO: 220920 - DNA, 20 bp, Artificial Sequence
  Description of Artificial Sequence: Synthetic oligonucleotide
  Target: ATXN1; (-) strand; PAM type: YTN; PAM sequence: TTA
caatttttcagctattggtt

SEQ ID NO: 220921 - DNA, 20 bp, Artificial Sequence
  Description of Artificial Sequence: Synthetic oligonucleotide
  Target: ATXN1; (-) strand; PAM type: YTN; PAM sequence: CTT
acaatttttcagctattggt

SEQ ID NO: 220922 - DNA, 20 bp, Artificial Sequence
  Description of Artificial Sequence: Synthetic oligonucleotide
  Target: ATXN1; (-) strand; PAM type: YTN; PAM sequence: TTA
tggcatcatcttacaatttt

SEQ ID NO: 220923 - DNA, 20 bp, Artificial Sequence
  Description of Artificial Sequence: Synthetic oligonucleotide
  Target: ATXN1; (-) strand; PAM type: YTN; PAM sequence: TTG
gacaattatggcatcatctt

SEQ ID NO: 220924 - DNA, 20 bp, Artificial Sequence
  Description of Artificial Sequence: Synthetic oligonucleotide
  Target: ATXN1; (-) strand; PAM type: YTN; PAM sequence: TTT
ggacaattatggcatcatct

SEQ ID NO: 220925 - DNA, 20 bp, Artificial Sequence
  Description of Artificial Sequence: Synthetic oligonucleotide
  Target: ATXN1; (-) strand; PAM type: YTN; PAM sequence: CTG
agcaacatttggacaattat

SEQ ID NO: 220926 - DNA, 20 bp, Artificial Sequence
  Description of Artificial Sequence: Synthetic oligonucleotide
  Target: ATXN1; (-) strand; PAM type: YTN; PAM sequence: TTG
gtgaactgagcaacatttgg

SEQ ID NO: 220927 - DNA, 20 bp, Artificial Sequence
  Description of Artificial Sequence: Synthetic oligonucleotide
  Target: ATXN1; (-) strand; PAM type: YTN; PAM sequence: CTG
ttggtgaactgagcaacatt

SEQ ID NO: 220928 - DNA, 20 bp, Artificial Sequence
  Description of Artificial Sequence: Synthetic oligonucleotide
  Target: ATXN1; (-) strand; PAM type: YTN; PAM sequence: CTC
agtaagcctgttggtgaact

SEQ ID NO: 220929 - DNA, 20 bp, Artificial Sequence
  Description of Artificial Sequence: Synthetic oligonucleotide
  Target: ATXN1; (-) strand; PAM type: YTN; PAM sequence: CTA
ctcagtaagcctgttggtga

SEQ ID NO: 220930 - DNA, 20 bp, Artificial Sequence
  Description of Artificial Sequence: Synthetic oligonucleotide
  Target: ATXN1; (-) strand; PAM type: YTN; PAM sequence: CTA
aagaacctactcagtaagcc

SEQ ID NO: 220931 - DNA, 20 bp, Artificial Sequence
  Description of Artificial Sequence: Synthetic oligonucleotide
  Target: ATXN1; (-) strand; PAM type: YTN; PAM sequence: TTC
taaagaacctactcagtaag

SEQ ID NO: 220932 - DNA, 20 bp, Artificial Sequence
  Description of Artificial Sequence: Synthetic oligonucleotide
  Target: ATXN1; (-) strand; PAM type: YTN; PAM sequence: TTT
ctaaagaacctactcagtaa

SEQ ID NO: 220933 - DNA, 20 bp, Artificial Sequence
  Description of Artificial Sequence: Synthetic oligonucleotide
  Target: ATXN1; (-) strand; PAM type: YTN; PAM sequence: CTT
tctaaagaacctactcagta

SEQ ID NO: 220934 - DNA, 20 bp, Artificial Sequence
  Description of Artificial Sequence: Synthetic oligonucleotide
  Target: ATXN1; (-) strand; PAM type: YTN; PAM sequence: TTC
tttctaaagaacctactcag

SEQ ID NO: 220935 - DNA, 20 bp, Artificial Sequence
  Description of Artificial Sequence: Synthetic oligonucleotide
  Target: ATXN1; (-) strand; PAM type: YTN; PAM sequence: TTT
ctttctaaagaacctactca

SEQ ID NO: 220936 - DNA, 20 bp, Artificial Sequence
  Description of Artificial Sequence: Synthetic oligonucleotide
  Target: ATXN1; (-) strand; PAM type: YTN; PAM sequence: CTG
gcagaatttctttctaaaga

SEQ ID NO: 220937 - DNA, 20 bp, Artificial Sequence
  Description of Artificial Sequence: Synthetic oligonucleotide
  Target: ATXN1; (-) strand; PAM type: YTN; PAM sequence: CTA
cctggcagaatttctttcta

SEQ ID NO: 220938 - DNA, 20 bp, Artificial Sequence
  Description of Artificial Sequence: Synthetic oligonucleotide
  Target: ATXN1; (-) strand; PAM type: YTN; PAM sequence: TTA
caaactacctggcagaattt

SEQ ID NO: 220939 - DNA, 20 bp, Artificial Sequence
  Description of Artificial Sequence: Synthetic oligonucleotide
  Target: ATXN1; (-) strand; PAM type: YTN; PAM sequence: TTA
ttacaaactacctggcagaa

SEQ ID NO: 220940 - DNA, 20 bp, Artificial Sequence
  Description of Artificial Sequence: Synthetic oligonucleotide
  Target: ATXN1; (-) strand; PAM type: YTN; PAM sequence: CTT
attacaaactacctggcaga

SEQ ID NO: 220941 - DNA, 20 bp, Artificial Sequence
  Description of Artificial Sequence: Synthetic oligonucleotide
  Target: ATXN1; (-) strand; PAM type: YTN; PAM sequence: TTC
ttattacaaactacctggca

SEQ ID NO: 220942 - DNA, 20 bp, Artificial Sequence
  Description of Artificial Sequence: Synthetic oligonucleotide
  Target: ATXN1; (-) strand; PAM type: YTN; PAM sequence: CTT
cttattacaaactacctggc

SEQ ID NO: 220943 - DNA, 20 bp, Artificial Sequence
  Description of Artificial Sequence: Synthetic oligonucleotide
  Target: ATXN1; (-) strand; PAM type: YTN; PAM sequence: TTG
taaaggcatgatccatagca

SEQ ID NO: 220944 - DNA, 20 bp, Artificial Sequence
  Description of Artificial Sequence: Synthetic oligonucleotide
  Target: ATXN1; (-) strand; PAM type: YTN; PAM sequence: TTT
gtaaaggcatgatccatagc

SEQ ID NO: 220945 - DNA, 20 bp, Artificial Sequence
  Description of Artificial Sequence: Synthetic oligonucleotide
  Target: ATXN1; (-) strand; PAM type: YTN; PAM sequence: CTT
tgtaaaggcatgatccatag

SEQ ID NO: 220946 - DNA, 20 bp, Artificial Sequence
  Description of Artificial Sequence: Synthetic oligonucleotide
  Target: ATXN1; (-) strand; PAM type: YTN; PAM sequence: CTG
gaatgtaaactttgtaaagg

SEQ ID NO: 220947 - DNA, 20 bp, Artificial Sequence
  Description of Artificial Sequence: Synthetic oligonucleotide
  Target: ATXN1; (-) strand; PAM type: YTN; PAM sequence: CTG
ctggaatgtaaactttgtaa

SEQ ID NO: 220948 - DNA, 20 bp, Artificial Sequence
  Description of Artificial Sequence: Synthetic oligonucleotide
  Target: ATXN1; (-) strand; PAM type: YTN; PAM sequence: CTC
cctgctggaatgtaaacttt

SEQ ID NO: 220949 - DNA, 20 bp, Artificial Sequence
  Description of Artificial Sequence: Synthetic oligonucleotide
  Target: ATXN1; (-) strand; PAM type: YTN; PAM sequence: TTC
ctccctgctggaatgtaaac

SEQ ID NO: 220950 - DNA, 20 bp, Artificial Sequence
  Description of Artificial Sequence: Synthetic oligonucleotide
  Target: ATXN1; (-) strand; PAM type: YTN; PAM sequence: TTT
cctccctgctggaatgtaaa

SEQ ID NO: 220951 - DNA, 20 bp, Artificial Sequence
  Description of Artificial Sequence: Synthetic oligonucleotide
  Target: ATXN1; (-) strand; PAM type: YTN; PAM sequence: CTT
tcctccctgctggaatgtaa

SEQ ID NO: 220952 - DNA, 20 bp, Artificial Sequence
  Description of Artificial Sequence: Synthetic oligonucleotide
  Target: ATXN1; (-) strand; PAM type: YTN; PAM sequence: TTG
tgtacatgctttcctccctg

SEQ ID NO: 220953 - DNA, 20 bp, Artificial Sequence
  Description of Artificial Sequence: Synthetic oligonucleotide
  Target: ATXN1; (-) strand; PAM type: YTN; PAM sequence: CTG
caaaaaaaaaaaaaaagaaa

SEQ ID NO: 220954 - DNA, 20 bp, Artificial Sequence
  Description of Artificial Sequence: Synthetic oligonucleotide
  Target: ATXN1; (-) strand; PAM type: YTN; PAM sequence: TTA
ctgcaaaaaaaaaaaaaaag

SEQ ID NO: 220955 - DNA, 20 bp, Artificial Sequence
  Description of Artificial Sequence: Synthetic oligonucleotide
  Target: ATXN1; (-) strand; PAM type: YTN; PAM sequence: TTA
cgttactgcaaaaaaaaaaa

SEQ ID NO: 220956 - DNA, 20 bp, Artificial Sequence
  Description of Artificial Sequence: Synthetic oligonucleotide
  Target: ATXN1; (-) strand; PAM type: YTN; PAM sequence: CTG
ttacgttactgcaaaaaaaa

SEQ ID NO: 220957 - DNA, 20 bp, Artificial Sequence
  Description of Artificial Sequence: Synthetic oligonucleotide
  Target: ATXN1; (-) strand; PAM type: YTN; PAM sequence: TTC
tgttacgttactgcaaaaaa

SEQ ID NO: 220958 - DNA, 20 bp, Artificial Sequence
  Description of Artificial Sequence: Synthetic oligonucleotide
  Target: ATXN1; (-) strand; PAM type: YTN; PAM sequence: TTA
ttctgttacgttactgcaaa

SEQ ID NO: 220959 - DNA, 20 bp, Artificial Sequence
  Description of Artificial Sequence: Synthetic oligonucleotide
  Target: ATXN1; (-) strand; PAM type: YTN; PAM sequence: CTT
attctgttacgttactgcaa

SEQ ID NO: 220960 - DNA, 20 bp, Artificial Sequence
  Description of Artificial Sequence: Synthetic oligonucleotide
  Target: ATXN1; (-) strand; PAM type: YTN; PAM sequence: CTC
ttattctgttacgttactgc

SEQ ID NO: 220961 - DNA, 20 bp, Artificial Sequence
  Description of Artificial Sequence: Synthetic oligonucleotide
  Target: ATXN1; (-) strand; PAM type: YTN; PAM sequence: TTC
tcttattctgttacgttact

SEQ ID NO: 220962 - DNA, 20 bp, Artificial Sequence
  Description of Artificial Sequence: Synthetic oligonucleotide
  Target: ATXN1; (-) strand; PAM type: YTN; PAM sequence: CTT
ctcttattctgttacgttac

SEQ ID NO: 220963 - DNA, 20 bp, Artificial Sequence
  Description of Artificial Sequence: Synthetic oligonucleotide
  Target: ATXN1; (-) strand; PAM type: YTN; PAM sequence: TTG
tacttctcttattctgttac

SEQ ID NO: 220964 - DNA, 20 bp, Artificial Sequence
  Description of Artificial Sequence: Synthetic oligonucleotide
  Target: ATXN1; (-) strand; PAM type: YTN; PAM sequence: TTT
gtacttctcttattctgtta

SEQ ID NO: 220965 - DNA, 20 bp, Artificial Sequence
  Description of Artificial Sequence: Synthetic oligonucleotide
  Target: ATXN1; (-) strand; PAM type: YTN; PAM sequence: TTT
tgtacttctcttattctgtt

SEQ ID NO: 220966 - DNA, 20 bp, Artificial Sequence
  Description of Artificial Sequence: Synthetic oligonucleotide
  Target: ATXN1; (-) strand; PAM type: YTN; PAM sequence: CTT
ttgtacttctcttattctgt

SEQ ID NO: 220967 - DNA, 20 bp, Artificial Sequence
  Description of Artificial Sequence: Synthetic oligonucleotide
  Target: ATXN1; (-) strand; PAM type: YTN; PAM sequence: CTC
ttttgtacttctcttattct

SEQ ID NO: 220968 - DNA, 20 bp, Artificial Sequence
  Description of Artificial Sequence: Synthetic oligonucleotide
  Target: ATXN1; (-) strand; PAM type: YTN; PAM sequence: TTG
tagctcttttgtacttctct

SEQ ID NO: 220969 - DNA, 20 bp, Artificial Sequence
  Description of Artificial Sequence: Synthetic oligonucleotide
  Target: ATXN1; (-) strand; PAM type: YTN; PAM sequence: TTT
gtagctcttttgtacttctc

SEQ ID NO: 220970 - DNA, 20 bp, Artificial Sequence
  Description of Artificial Sequence: Synthetic oligonucleotide
  Target: ATXN1; (-) strand; PAM type: YTN; PAM sequence: CTT
tgtagctcttttgtacttct

SEQ ID NO: 220971 - DNA, 20 bp, Artificial Sequence
  Description of Artificial Sequence: Synthetic oligonucleotide
  Target: ATXN1; (-) strand; PAM type: YTN; PAM sequence: TTG
agactttgtagctcttttgt

SEQ ID NO: 220972 - DNA, 20 bp, Artificial Sequence
  Description of Artificial Sequence: Synthetic oligonucleotide
  Target: ATXN1; (-) strand; PAM type: YTN; PAM sequence: TTT
gagactttgtagctcttttg

SEQ ID NO: 220973 - DNA, 20 bp, Artificial Sequence
  Description of Artificial Sequence: Synthetic oligonucleotide
  Target: ATXN1; (-) strand; PAM type: YTN; PAM sequence: TTT
tgagactttgtagctctttt

SEQ ID NO: 220974 - DNA, 20 bp, Artificial Sequence
  Description of Artificial Sequence: Synthetic oligonucleotide
  Target: ATXN1; (-) strand; PAM type: YTN; PAM sequence: CTT
ttgagactttgtagctcttt

SEQ ID NO: 220975 - DNA, 20 bp, Artificial Sequence
  Description of Artificial Sequence: Synthetic oligonucleotide
  Target: ATXN1; (-) strand; PAM type: YTN; PAM sequence: CTC
ttttgagactttgtagctct

SEQ ID NO: 220976 - DNA, 20 bp, Artificial Sequence
  Description of Artificial Sequence: Synthetic oligonucleotide
  Target: ATXN1; (-) strand; PAM type: YTN; PAM sequence: TTC
ctcttttgagactttgtagc

SEQ ID NO: 220977 - DNA, 20 bp, Artificial Sequence
  Description of Artificial Sequence: Synthetic oligonucleotide
  Target: ATXN1; (-) strand; PAM type: YTN; PAM sequence: CTG
cataaaatggttcctctttt

SEQ ID NO: 220978 - DNA, 20 bp, Artificial Sequence
  Description of Artificial Sequence: Synthetic oligonucleotide
  Target: ATXN1; (-) strand; PAM type: YTN; PAM sequence: CTC
ctgcataaaatggttcctct

SEQ ID NO: 220979 - DNA, 20 bp, Artificial Sequence
  Description of Artificial Sequence: Synthetic oligonucleotide
  Target: ATXN1; (-) strand; PAM type: YTN; PAM sequence: CTC
tcctgcataaaatggttcct

SEQ ID NO: 220980 - DNA, 20 bp, Artificial Sequence
  Description of Artificial Sequence: Synthetic oligonucleotide
  Target: ATXN1; (-) strand; PAM type: YTN; PAM sequence: CTG
ataccctctcctgcataaaa

SEQ ID NO: 220981 - DNA, 20 bp, Artificial Sequence
  Description of Artificial Sequence: Synthetic oligonucleotide
  Target: ATXN1; (-) strand; PAM type: YTN; PAM sequence: TTC
ctgataccctctcctgcata

SEQ ID NO: 220982 - DNA, 20 bp, Artificial Sequence
  Description of Artificial Sequence: Synthetic oligonucleotide
  Target: ATXN1; (-) strand; PAM type: YTN; PAM sequence: TTT
cctgataccctctcctgcat

SEQ ID NO: 220983 - DNA, 20 bp, Artificial Sequence
  Description of Artificial Sequence: Synthetic oligonucleotide
  Target: ATXN1; (-) strand; PAM type: YTN; PAM sequence: CTT
tcctgataccctctcctgca

SEQ ID NO: 220984 - DNA, 20 bp, Artificial Sequence
  Description of Artificial Sequence: Synthetic oligonucleotide
  Target: ATXN1; (-) strand; PAM type: YTN; PAM sequence: TTA
ccagaatctttcctgatacc

SEQ ID NO: 220985 - DNA, 20 bp, Artificial Sequence
  Description of Artificial Sequence: Synthetic oligonucleotide
  Target: ATXN1; (-) strand; PAM type: YTN; PAM sequence: CTT
accagaatctttcctgatac

SEQ ID NO: 220986 - DNA, 20 bp, Artificial Sequence
  Description of Artificial Sequence: Synthetic oligonucleotide
  Target: ATXN1; (-) strand; PAM type: YTN; PAM sequence: TTC
ttaccagaatctttcctgat

SEQ ID NO: 220987 - DNA, 20 bp, Artificial Sequence
  Description of Artificial Sequence: Synthetic oligonucleotide
  Target: ATXN1; (-) strand; PAM type: YTN; PAM sequence: TTT
cttaccagaatctttcctga

SEQ ID NO: 220988 - DNA, 20 bp, Artificial Sequence
  Description of Artificial Sequence: Synthetic oligonucleotide
  Target: ATXN1; (-) strand; PAM type: YTN; PAM sequence: CTT
tcttaccagaatctttcctg

SEQ ID NO: 220989 - DNA, 20 bp, Artificial Sequence
  Description of Artificial Sequence: Synthetic oligonucleotide
  Target: ATXN1; (-) strand; PAM type: YTN; PAM sequence: CTG
aggcccactttcttaccaga

SEQ ID NO: 220990 - DNA, 20 bp, Artificial Sequence
  Description of Artificial Sequence: Synthetic oligonucleotide
  Target: ATXN1; (-) strand; PAM type: YTN; PAM sequence: CTC
ctgaggcccactttcttacc

SEQ ID NO: 220991 - DNA, 20 bp, Artificial Sequence
  Description of Artificial Sequence: Synthetic oligonucleotide
  Target: ATXN1; (-) strand; PAM type: YTN; PAM sequence: CTA
gctcctgaggcccactttct

SEQ ID NO: 220992 - DNA, 20 bp, Artificial Sequence
  Description of Artificial Sequence: Synthetic oligonucleotide
  Target: ATXN1; (-) strand; PAM type: YTN; PAM sequence: CTG
cctagctcctgaggcccact

SEQ ID NO: 220993 - DNA, 20 bp, Artificial Sequence
  Description of Artificial Sequence: Synthetic oligonucleotide
  Target: ATXN1; (-) strand; PAM type: YTN; PAM sequence: TTC
ccatctgcctagctcctgag

SEQ ID NO: 220994 - DNA, 20 bp, Artificial Sequence
  Description of Artificial Sequence: Synthetic oligonucleotide
  Target: ATXN1; (-) strand; PAM type: YTN; PAM sequence: TTC
aaaattcccatctgcctagc

SEQ ID NO: 220995 - DNA, 20 bp, Artificial Sequence
  Description of Artificial Sequence: Synthetic oligonucleotide
  Target: ATXN1; (-) strand; PAM type: YTN; PAM sequence: TTA
gagttcaaaattcccatctg

SEQ ID NO: 220996 - DNA, 20 bp, Artificial Sequence
  Description of Artificial Sequence: Synthetic oligonucleotide
  Target: ATXN1; (-) strand; PAM type: YTN; PAM sequence: CTT
agagttcaaaattcccatct

SEQ ID NO: 220997 - DNA, 20 bp, Artificial Sequence
  Description of Artificial Sequence: Synthetic oligonucleotide
  Target: ATXN1; (-) strand; PAM type: YTN; PAM sequence: TTC
agaaatagacacttagagtt

SEQ ID NO: 220998 - DNA, 20 bp, Artificial Sequence
  Description of Artificial Sequence: Synthetic oligonucleotide
  Target: ATXN1; (-) strand; PAM type: YTN; PAM sequence: CTT
cagaaatagacacttagagt

SEQ ID NO: 220999 - DNA, 20 bp, Artificial Sequence
  Description of Artificial Sequence: Synthetic oligonucleotide
  Target: ATXN1; (-) strand; PAM type: YTN; PAM sequence: TTC
acttcagaaatagacactta

SEQ ID NO: 221000 - DNA, 20 bp, Artificial Sequence
  Description of Artificial Sequence: Synthetic oligonucleotide
  Target: ATXN1; (-) strand; PAM type: YTN; PAM sequence: TTT
cacttcagaaatagacactt

SEQ ID NO: 221001 - DNA, 20 bp, Artificial Sequence
  Description of Artificial Sequence: Synthetic oligonucleotide
  Target: ATXN1; (-) strand; PAM type: YTN; PAM sequence: TTA
gtttcacttcagaaatagac

SEQ ID NO: 221002 - DNA, 20 bp, Artificial Sequence
  Description of Artificial Sequence: Synthetic oligonucleotide
  Target: ATXN1; (-) strand; PAM type: YTN; PAM sequence: TTG
attagtttcacttcagaaat

SEQ ID NO: 221003 - DNA, 20 bp, Artificial Sequence
  Description of Artificial Sequence: Synthetic oligonucleotide
  Target: ATXN1; (-) strand; PAM type: YTN; PAM sequence: CTG
tagaaacacattgattagtt

SEQ ID NO: 221004 - DNA, 20 bp, Artificial Sequence
  Description of Artificial Sequence: Synthetic oligonucleotide
  Target: ATXN1; (-) strand; PAM type: YTN; PAM sequence: TTA
actgtagaaacacattgatt

SEQ ID NO: 221005 - DNA, 20 bp, Artificial Sequence
  Description of Artificial Sequence: Synthetic oligonucleotide
  Target: ATXN1; (-) strand; PAM type: YTN; PAM sequence: CTC
aataaatgttaactgtagaa

SEQ ID NO: 221006 - DNA, 20 bp, Artificial Sequence
  Description of Artificial Sequence: Synthetic oligonucleotide
  Target: ATXN1; (-) strand; PAM type: YTN; PAM sequence: TTG
ctcaataaatgttaactgta

SEQ ID NO: 221007 - DNA, 20 bp, Artificial Sequence
  Description of Artificial Sequence: Synthetic oligonucleotide
  Target: ATXN1; (-) strand; PAM type: YTN; PAM sequence: TTG
tgacacatagtagttgctca

SEQ ID NO: 221008 - DNA, 20 bp, Artificial Sequence
  Description of Artificial Sequence: Synthetic oligonucleotide
  Target: ATXN1; (-) strand; PAM type: YTN; PAM sequence: TTT
gtgacacatagtagttgctc

SEQ ID NO: 221009 - DNA, 20 bp, Artificial Sequence
  Description of Artificial Sequence: Synthetic oligonucleotide
  Target: ATXN1; (-) strand; PAM type: YTN; PAM sequence: CTT
tgtgacacatagtagttgct

SEQ ID NO: 221010 - DNA, 20 bp, Artificial Sequence
  Description of Artificial Sequence: Synthetic oligonucleotide
  Target: ATXN1; (-) strand; PAM type: YTN; PAM sequence: TTA
tgaactttgtgacacatagt

SEQ ID NO: 221011 - DNA, 20 bp, Artificial Sequence
  Description of Artificial Sequence: Synthetic oligonucleotide
  Target: ATXN1; (-) strand; PAM type: YTN; PAM sequence: TTT
atgaactttgtgacacatag

SEQ ID NO: 221012 - DNA, 20 bp, Artificial Sequence
  Description of Artificial Sequence: Synthetic oligonucleotide
  Target: ATXN1; (-) strand; PAM type: YTN; PAM sequence: TTA
gagataacatttatgaactt

SEQ ID NO: 221013 - DNA, 20 bp, Artificial Sequence
  Description of Artificial Sequence: Synthetic oligonucleotide
  Target: ATXN1; (-) strand; PAM type: YTN; PAM sequence: CTT
agagataacatttatgaact

SEQ ID NO: 221014 - DNA, 20 bp, Artificial Sequence
  Description of Artificial Sequence: Synthetic oligonucleotide
  Target: ATXN1; (-) strand; PAM type: YTN; PAM sequence: TTG
gaagcttagagataacattt

SEQ ID NO: 221015 - DNA, 20 bp, Artificial Sequence
  Description of Artificial Sequence: Synthetic oligonucleotide
  Target: ATXN1; (-) strand; PAM type: YTN; PAM sequence: TTT
ggaagcttagagataacatt

SEQ ID NO: 221016 - DNA, 20 bp, Artificial Sequence
  Description of Artificial Sequence: Synthetic oligonucleotide
  Target: ATXN1; (-) strand; PAM type: YTN; PAM sequence: TTG
tttggaagcttagagataac

SEQ ID NO: 221017 - DNA, 20 bp, Artificial Sequence
  Description of Artificial Sequence: Synthetic oligonucleotide
  Target: ATXN1; (-) strand; PAM type: YTN; PAM sequence: TTT
gtttggaagcttagagataa

SEQ ID NO: 221018 - DNA, 20 bp, Artificial Sequence
  Description of Artificial Sequence: Synthetic oligonucleotide
  Target: ATXN1; (-) strand; PAM type: YTN; PAM sequence: TTC
catgtttgtttggaagctta

SEQ ID NO: 221019 - DNA, 20 bp, Artificial Sequence
  Description of Artificial Sequence: Synthetic oligonucleotide
  Target: ATXN1; (-) strand; PAM type: YTN; PAM sequence: CTG
tcattccatgtttgtttgga

SEQ ID NO: 221020 - DNA, 20 bp, Artificial Sequence
  Description of Artificial Sequence: Synthetic oligonucleotide
  Target: ATXN1; (-) strand; PAM type: YTN; PAM sequence: TTG
taaccaggctgtcattccat

SEQ ID NO: 221021 - DNA, 20 bp, Artificial Sequence
  Description of Artificial Sequence: Synthetic oligonucleotide
  Target: ATXN1; (-) strand; PAM type: YTN; PAM sequence: TTT
gtaaccaggctgtcattcca

SEQ ID NO: 221022 - DNA, 20 bp, Artificial Sequence
  Description of Artificial Sequence: Synthetic oligonucleotide
  Target: ATXN1; (-) strand; PAM type: YTN; PAM sequence: TTA
atcatttgtaaccaggctgt

SEQ ID NO: 221023 - DNA, 20 bp, Artificial Sequence
  Description of Artificial Sequence: Synthetic oligonucleotide
  Target: ATXN1; (-) strand; PAM type: YTN; PAM sequence: TTT
aatcatttgtaaccaggctg

SEQ ID NO: 221024 - DNA, 20 bp, Artificial Sequence
  Description of Artificial Sequence: Synthetic oligonucleotide
  Target: ATXN1; (-) strand; PAM type: YTN; PAM sequence: TTT
taatcatttgtaaccaggct

SEQ ID NO: 221025 - DNA, 20 bp, Artificial Sequence
  Description of Artificial Sequence: Synthetic oligonucleotide
  Target: ATXN1; (-) strand; PAM type: YTN; PAM sequence: TTT
ttaatcatttgtaaccaggc

SEQ ID NO: 221026 - DNA, 20 bp, Artificial Sequence
  Description of Artificial Sequence: Synthetic oligonucleotide
  Target: ATXN1; (-) strand; PAM type: YTN; PAM sequence: CTT
tttaatcatttgtaaccagg

SEQ ID NO: 221027 - DNA, 20 bp, Artificial Sequence
  Description of Artificial Sequence: Synthetic oligonucleotide
  Target: ATXN1; (-) strand; PAM type: YTN; PAM sequence: CTG
tgagtccctttttaatcatt

SEQ ID NO: 221028 - DNA, 20 bp, Artificial Sequence
  Description of Artificial Sequence: Synthetic oligonucleotide
  Target: ATXN1; (-) strand; PAM type: YTN; PAM sequence: CTC
tgtgagtccctttttaatca

SEQ ID NO: 221029 - DNA, 20 bp, Artificial Sequence
  Description of Artificial Sequence: Synthetic oligonucleotide
  Target: ATXN1; (-) strand; PAM type: YTN; PAM sequence: TTA
atagactctgtgagtccctt

SEQ ID NO: 221030 - DNA, 20 bp, Artificial Sequence
  Description of Artificial Sequence: Synthetic oligonucleotide
  Target: ATXN1; (-) strand; PAM type: YTN; PAM sequence: TTG
ggaatgttaatagactctgt

SEQ ID NO: 221031 - DNA, 20 bp, Artificial Sequence
  Description of Artificial Sequence: Synthetic oligonucleotide
  Target: ATXN1; (-) strand; PAM type: YTN; PAM sequence: CTT
gggaatgttaatagactctg

SEQ ID NO: 221032 - DNA, 20 bp, Artificial Sequence
  Description of Artificial Sequence: Synthetic oligonucleotide
  Target: ATXN1; (-) strand; PAM type: YTN; PAM sequence: CTC
ttgggaatgttaatagactc

SEQ ID NO: 221033 - DNA, 20 bp, Artificial Sequence
  Description of Artificial Sequence: Synthetic oligonucleotide
  Target: ATXN1; (-) strand; PAM type: YTN; PAM sequence: CTA
atgactcttgggaatgttaa

SEQ ID NO: 221034 - DNA, 20 bp, Artificial Sequence
  Description of Artificial Sequence: Synthetic oligonucleotide
  Target: ATXN1; (-) strand; PAM type: YTN; PAM sequence: TTC
agtaagaactaatgactctt

SEQ ID NO: 221035 - DNA, 20 bp, Artificial Sequence
  Description of Artificial Sequence: Synthetic oligonucleotide
  Target: ATXN1; (-) strand; PAM type: YTN; PAM sequence: CTA
atgttcagtaagaactaatg

SEQ ID NO: 221036 - DNA, 20 bp, Artificial Sequence
  Description of Artificial Sequence: Synthetic oligonucleotide
  Target: ATXN1; (-) strand; PAM type: YTN; PAM sequence: TTA
ctaatgttcagtaagaacta

SEQ ID NO: 221037 - DNA, 20 bp, Artificial Sequence
  Description of Artificial Sequence: Synthetic oligonucleotide
  Target: ATXN1; (-) strand; PAM type: YTN; PAM sequence: CTT
actaatgttcagtaagaact

SEQ ID NO: 221038 - DNA, 20 bp, Artificial Sequence
  Description of Artificial Sequence: Synthetic oligonucleotide
  Target: ATXN1; (-) strand; PAM type: YTN; PAM sequence: TTG
gcttactaatgttcagtaag

SEQ ID NO: 221039 - DNA, 20 bp, Artificial Sequence
  Description of Artificial Sequence: Synthetic oligonucleotide
  Target: ATXN1; (-) strand; PAM type: YTN; PAM sequence: TTT
ggcttactaatgttcagtaa

SEQ ID NO: 221040 - DNA, 20 bp, Artificial Sequence
  Description of Artificial Sequence: Synthetic oligonucleotide
  Target: ATXN1; (-) strand; PAM type: YTN; PAM sequence: CTT
tggcttactaatgttcagta

SEQ ID NO: 221041 - DNA, 20 bp, Artificial Sequence
  Description of Artificial Sequence: Synthetic oligonucleotide
  Target: ATXN1; (-) strand; PAM type: YTN; PAM sequence: TTG
atataaatatgcctttggct

SEQ ID NO: 221042 - DNA, 20 bp, Artificial Sequence
  Description of Artificial Sequence: Synthetic oligonucleotide
  Target: ATXN1; (-) strand; PAM type: YTN; PAM sequence: TTG
tgttgatataaatatgcctt

SEQ ID NO: 221043 - DNA, 20 bp, Artificial Sequence
  Description of Artificial Sequence: Synthetic oligonucleotide
  Target: ATXN1; (-) strand; PAM type: YTN; PAM sequence: CTT
gtgttgatataaatatgcct

SEQ ID NO: 221044 - DNA, 20 bp, Artificial Sequence
  Description of Artificial Sequence: Synthetic oligonucleotide
  Target: ATXN1; (-) strand; PAM type: YTN; PAM sequence: CTC
ttgtgttgatataaatatgc

SEQ ID NO: 221045 - DNA, 20 bp, Artificial Sequence
  Description of Artificial Sequence: Synthetic oligonucleotide
  Target: ATXN1; (-) strand; PAM type: YTN; PAM sequence: TTA
actcttgtgttgatataaat

SEQ ID NO: 221046 - DNA, 20 bp, Artificial Sequence
  Description of Artificial Sequence: Synthetic oligonucleotide
  Target: ATXN1; (-) strand; PAM type: YTN; PAM sequence: CTG
tgtgattaactcttgtgttg

SEQ ID NO: 221047 - DNA, 20 bp, Artificial Sequence
  Description of Artificial Sequence: Synthetic oligonucleotide
  Target: ATXN1; (-) strand; PAM type: YTN; PAM sequence: TTC
tgtgtgattaactcttgtgt

SEQ ID NO: 221048 - DNA, 20 bp, Artificial Sequence
  Description of Artificial Sequence: Synthetic oligonucleotide
  Target: ATXN1; (-) strand; PAM type: YTN; PAM sequence: TTT
ctgtgtgattaactcttgtg

SEQ ID NO: 221049 - DNA, 20 bp, Artificial Sequence
  Description of Artificial Sequence: Synthetic oligonucleotide
  Target: ATXN1; (-) strand; PAM type: YTN; PAM sequence: TTT
tctgtgtgattaactcttgt

SEQ ID NO: 221050 - DNA, 20 bp, Artificial Sequence
  Description of Artificial Sequence: Synthetic oligonucleotide
  Target: ATXN1; (-) strand; PAM type: YTN; PAM sequence: CTT
ttctgtgtgattaactcttg

SEQ ID NO: 221051 - DNA, 20 bp, Artificial Sequence
  Description of Artificial Sequence: Synthetic oligonucleotide
  Target: ATXN1; (-) strand; PAM type: YTN; PAM sequence: CTG
tcatcttttctgtgtgatta

SEQ ID NO: 221052 - DNA, 20 bp, Artificial Sequence
  Description of Artificial Sequence: Synthetic oligonucleotide
  Target: ATXN1; (-) strand; PAM type: YTN; PAM sequence: TTA
agactgtcatcttttctgtg

SEQ ID NO: 221053 - DNA, 20 bp, Artificial Sequence
  Description of Artificial Sequence: Synthetic oligonucleotide
  Target: ATXN1; (-) strand; PAM type: YTN; PAM sequence: TTC
gaattaagactgtcatcttt

SEQ ID NO: 221054 - DNA, 20 bp, Artificial Sequence
  Description of Artificial Sequence: Synthetic oligonucleotide
  Target: ATXN1; (-) strand; PAM type: YTN; PAM sequence: TTG
ttcgaattaagactgtcatc

SEQ ID NO: 221055 - DNA, 20 bp, Artificial Sequence
  Description of Artificial Sequence: Synthetic oligonucleotide
  Target: ATXN1; (-) strand; PAM type: YTN; PAM sequence: TTG
attgttcgaattaagactgt

SEQ ID NO: 221056 - DNA, 20 bp, Artificial Sequence
  Description of Artificial Sequence: Synthetic oligonucleotide
  Target: ATXN1; (-) strand; PAM type: YTN; PAM sequence: CTT
gattgttcgaattaagactg

SEQ ID NO: 221057 - DNA, 20 bp, Artificial Sequence
  Description of Artificial Sequence: Synthetic oligonucleotide
  Target: ATXN1; (-) strand; PAM type: YTN; PAM sequence: TTG
acccttgattgttcgaatta

SEQ ID NO: 221058 - DNA, 20 bp, Artificial Sequence
  Description of Artificial Sequence: Synthetic oligonucleotide
  Target: ATXN1; (-) strand; PAM type: YTN; PAM sequence: TTT
gacccttgattgttcgaatt

SEQ ID NO: 221059 - DNA, 20 bp, Artificial Sequence
  Description of Artificial Sequence: Synthetic oligonucleotide
  Target: ATXN1; (-) strand; PAM type: YTN; PAM sequence: TTT
tgacccttgattgttcgaat

SEQ ID NO: 221060 - DNA, 20 bp, Artificial Sequence
  Description of Artificial Sequence: Synthetic oligonucleotide
  Target: ATXN1; (-) strand; PAM type: YTN; PAM sequence: TTC
aaaatatataatgattttga

SEQ ID NO: 221061 - DNA, 20 bp, Artificial Sequence
  Description of Artificial Sequence: Synthetic oligonucleotide
  Target: ATXN1; (-) strand; PAM type: YTN; PAM sequence: TTC
gtattcaaaatatataatga

SEQ ID NO: 221062 - DNA, 20 bp, Artificial Sequence
  Description of Artificial Sequence: Synthetic oligonucleotide
  Target: ATXN1; (-) strand; PAM type: YTN; PAM sequence: TTC
aaccatattcgtattcaaaa

SEQ ID NO: 221063 - DNA, 20 bp, Artificial Sequence
  Description of Artificial Sequence: Synthetic oligonucleotide
  Target: ATXN1; (-) strand; PAM type: YTN; PAM sequence: TTG
tcatattcaaccatattcgt

SEQ ID NO: 221064 - DNA, 20 bp, Artificial Sequence
  Description of Artificial Sequence: Synthetic oligonucleotide
  Target: ATXN1; (-) strand; PAM type: YTN; PAM sequence: CTT
gtcatattcaaccatattcg

SEQ ID NO: 221065 - DNA, 20 bp, Artificial Sequence
  Description of Artificial Sequence: Synthetic oligonucleotide
  Target: ATXN1; (-) strand; PAM type: YTN; PAM sequence: TTC
aaatccttgtcatattcaac

SEQ ID NO: 221066 - DNA, 20 bp, Artificial Sequence
  Description of Artificial Sequence: Synthetic oligonucleotide
  Target: ATXN1; (-) strand; PAM type: YTN; PAM sequence: TTG
acgtattcaaatccttgtca

SEQ ID NO: 221067 - DNA, 20 bp, Artificial Sequence
  Description of Artificial Sequence: Synthetic oligonucleotide
  Target: ATXN1; (-) strand; PAM type: YTN; PAM sequence: TTT
gacgtattcaaatccttgtc

SEQ ID NO: 221068 - DNA, 20 bp, Artificial Sequence
  Description of Artificial Sequence: Synthetic oligonucleotide
  Target: ATXN1; (-) strand; PAM type: YTN; PAM sequence: TTT
tgacgtattcaaatccttgt

SEQ ID NO: 221069 - DNA, 20 bp, Artificial Sequence
  Description of Artificial Sequence: Synthetic oligonucleotide
  Target: ATXN1; (-) strand; PAM type: YTN; PAM sequence: TTG
tgttttgacgtattcaaatc

SEQ ID NO: 221070 - DNA, 20 bp, Artificial Sequence
  Description of Artificial Sequence: Synthetic oligonucleotide
  Target: ATXN1; (-) strand; PAM type: YTN; PAM sequence: TTT
gtgttttgacgtattcaaat

SEQ ID NO: 221071 - DNA, 20 bp, Artificial Sequence
  Description of Artificial Sequence: Synthetic oligonucleotide
  Target: ATXN1; (-) strand; PAM type: YTN; PAM sequence: TTA
catgtcagggaatgtgattt

SEQ ID NO: 221072 - DNA, 20 bp, Artificial Sequence
  Description of Artificial Sequence: Synthetic oligonucleotide
  Target: ATXN1; (-) strand; PAM type: YTN; PAM sequence: TTC
agttacatgtcagggaatgt

SEQ ID NO: 221073 - DNA, 20 bp, Artificial Sequence
  Description of Artificial Sequence: Synthetic oligonucleotide
  Target: ATXN1; (-) strand; PAM type: YTN; PAM sequence: TTT
cagttacatgtcagggaatg

SEQ ID NO: 221074 - DNA, 20 bp, Artificial Sequence
  Description of Artificial Sequence: Synthetic oligonucleotide
  Target: ATXN1; (-) strand; PAM type: YTN; PAM sequence: TTG
tcatttcagttacatgtcag

SEQ ID NO: 221075 - DNA, 20 bp, Artificial Sequence
  Description of Artificial Sequence: Synthetic oligonucleotide
  Target: ATXN1; (-) strand; PAM type: YTN; PAM sequence: CTT
gtcatttcagttacatgtca

SEQ ID NO: 221076 - DNA, 20 bp, Artificial Sequence
  Description of Artificial Sequence: Synthetic oligonucleotide
  Target: ATXN1; (-) strand; PAM type: YTN; PAM sequence: TTC
ttgtcatttcagttacatgt

SEQ ID NO: 221077 - DNA, 20 bp, Artificial Sequence
  Description of Artificial Sequence: Synthetic oligonucleotide
  Target: ATXN1; (-) strand; PAM type: YTN; PAM sequence: TTG
atattcttgtcatttcagtt

SEQ ID NO: 221078 - DNA, 20 bp, Artificial Sequence
  Description of Artificial Sequence: Synthetic oligonucleotide
  Target: ATXN1; (-) strand; PAM type: YTN; PAM sequence: CTT
gatattcttgtcatttcagt

SEQ ID NO: 221079 - DNA, 20 bp, Artificial Sequence
  Description of Artificial Sequence: Synthetic oligonucleotide
  Target: ATXN1; (-) strand; PAM type: YTN; PAM sequence: TTC
ttgatattcttgtcatttca

SEQ ID NO: 221080 - DNA, 20 bp, Artificial Sequence
  Description of Artificial Sequence: Synthetic oligonucleotide
  Target: ATXN1; (-) strand; PAM type: YTN; PAM sequence: TTA
agttcttgatattcttgtca

SEQ ID NO: 221081 - DNA, 20 bp, Artificial Sequence
  Description of Artificial Sequence: Synthetic oligonucleotide
  Target: ATXN1; (-) strand; PAM type: YTN; PAM sequence: CTT
aagttcttgatattcttgtc

SEQ ID NO: 221082 - DNA, 20 bp, Artificial Sequence
  Description of Artificial Sequence: Synthetic oligonucleotide
  Target: ATXN1; (-) strand; PAM type: YTN; PAM sequence: TTA
gaataaacatgtacttaagt

SEQ ID NO: 221083 - DNA, 20 bp, Artificial Sequence
  Description of Artificial Sequence: Synthetic oligonucleotide
  Target: ATXN1; (-) strand; PAM type: YTN; PAM sequence: TTA
gaggttagaataaacatgta

SEQ ID NO: 221084 - DNA, 20 bp, Artificial Sequence
  Description of Artificial Sequence: Synthetic oligonucleotide
  Target: ATXN1; (-) strand; PAM type: YTN; PAM sequence: CTG
atgttagaggttagaataaa

SEQ ID NO: 221085 - DNA, 20 bp, Artificial Sequence
  Description of Artificial Sequence: Synthetic oligonucleotide
  Target: ATXN1; (-) strand; PAM type: YTN; PAM sequence: TTG
cataatactgatgttagagg

SEQ ID NO: 221086 - DNA, 20 bp, Artificial Sequence
  Description of Artificial Sequence: Synthetic oligonucleotide
  Target: ATXN1; (-) strand; PAM type: YTN; PAM sequence: TTA
aaatgaaatcattgcataat

SEQ ID NO: 221087 - DNA, 20 bp, Artificial Sequence
  Description of Artificial Sequence: Synthetic oligonucleotide
  Target: ATXN1; (-) strand; PAM type: YTN; PAM sequence: TTT
aaaatgaaatcattgcataa

SEQ ID NO: 221088 - DNA, 20 bp, Artificial Sequence
  Description of Artificial Sequence: Synthetic oligonucleotide
  Target: ATXN1; (-) strand; PAM type: YTN; PAM sequence: TTA
gtttaaaatgaaatcattgc

SEQ ID NO: 221089 - DNA, 20 bp, Artificial Sequence
  Description of Artificial Sequence: Synthetic oligonucleotide
  Target: ATXN1; (-) strand; PAM type: YTN; PAM sequence: TTT
agtttaaaatgaaatcattg

SEQ ID NO: 221090 - DNA, 20 bp, Artificial Sequence
  Description of Artificial Sequence: Synthetic oligonucleotide
  Target: ATXN1; (-) strand; PAM type: YTN; PAM sequence: TTA
atcatttagtttaaaatgaa

SEQ ID NO: 221091 - DNA, 20 bp, Artificial Sequence
  Description of Artificial Sequence: Synthetic oligonucleotide
  Target: ATXN1; (-) strand; PAM type: YTN; PAM sequence: TTT
aatcatttagtttaaaatga

SEQ ID NO: 221092 - DNA, 20 bp, Artificial Sequence
  Description of Artificial Sequence: Synthetic oligonucleotide
  Target: ATXN1; (-) strand; PAM type: YTN; PAM sequence: TTT
taatcatttagtttaaaatg

SEQ ID NO: 221093 - DNA, 20 bp, Artificial Sequence
  Description of Artificial Sequence: Synthetic oligonucleotide
  Target: ATXN1; (-) strand; PAM type: YTN; PAM sequence: TTA
aaacaaaggtacattttaat

SEQ ID NO: 221094 - DNA, 20 bp, Artificial Sequence
  Description of Artificial Sequence: Synthetic oligonucleotide
  Target: ATXN1; (-) strand; PAM type: YTN; PAM sequence: TTT
aaaacaaaggtacattttaa

SEQ ID NO: 221095 - DNA, 20 bp, Artificial Sequence
  Description of Artificial Sequence: Synthetic oligonucleotide
  Target: ATXN1; (-) strand; PAM type: YTN; PAM sequence: TTT
taaaacaaaggtacatttta

SEQ ID NO: 221096 - DNA, 20 bp, Artificial Sequence
  Description of Artificial Sequence: Synthetic oligonucleotide
  Target: ATXN1; (-) strand; PAM type: YTN; PAM sequence: CTA
ttttaaaacaaaggtacatt

SEQ ID NO: 221097 - DNA, 20 bp, Artificial Sequence
  Description of Artificial Sequence: Synthetic oligonucleotide
  Target: ATXN1; (-) strand; PAM type: YTN; PAM sequence: CTC
aaatacctattttaaaacaa

SEQ ID NO: 221098 - DNA, 20 bp, Artificial Sequence
  Description of Artificial Sequence: Synthetic oligonucleotide
  Target: ATXN1; (-) strand; PAM type: YTN; PAM sequence: CTG
tagaaactcaaatacctatt

SEQ ID NO: 221099 - DNA, 20 bp, Artificial Sequence
  Description of Artificial Sequence: Synthetic oligonucleotide
  Target: ATXN1; (-) strand; PAM type: YTN; PAM sequence: CTG
ctgtagaaactcaaatacct

SEQ ID NO: 221100 - DNA, 20 bp, Artificial Sequence
  Description of Artificial Sequence: Synthetic oligonucleotide
  Target: ATXN1; (-) strand; PAM type: YTN; PAM sequence: TTG
gagaaacactgctgtagaaa

SEQ ID NO: 221101 - DNA, 20 bp, Artificial Sequence
  Description of Artificial Sequence: Synthetic oligonucleotide
  Target: ATXN1; (-) strand; PAM type: YTN; PAM sequence: CTT
ggagaaacactgctgtagaa

SEQ ID NO: 221102 - DNA, 20 bp, Artificial Sequence
  Description of Artificial Sequence: Synthetic oligonucleotide
  Target: ATXN1; (-) strand; PAM type: YTN; PAM sequence: CTC
acacttggagaaacactgct

SEQ ID NO: 221103 - DNA, 20 bp, Artificial Sequence
  Description of Artificial Sequence: Synthetic oligonucleotide
  Target: ATXN1; (-) strand; PAM type: YTN; PAM sequence: TTG
gctcacacttggagaaacac

SEQ ID NO: 221104 - DNA, 20 bp, Artificial Sequence
  Description of Artificial Sequence: Synthetic oligonucleotide
  Target: ATXN1; (-) strand; PAM type: YTN; PAM sequence: CTT
ggctcacacttggagaaaca

SEQ ID NO: 221105 - DNA, 20 bp, Artificial Sequence
  Description of Artificial Sequence: Synthetic oligonucleotide
  Target: ATXN1; (-) strand; PAM type: YTN; PAM sequence: TTA
acataaaaggtccttggctc

SEQ ID NO: 221106 - DNA, 20 bp, Artificial Sequence
  Description of Artificial Sequence: Synthetic oligonucleotide
  Target: ATXN1; (-) strand; PAM type: YTN; PAM sequence: TTT
aacataaaaggtccttggct

SEQ ID NO: 221107 - DNA, 20 bp, Artificial Sequence
  Description of Artificial Sequence: Synthetic oligonucleotide
  Target: ATXN1; (-) strand; PAM type: YTN; PAM sequence: TTC
atttaacataaaaggtcctt

SEQ ID NO: 221108 - DNA, 20 bp, Artificial Sequence
  Description of Artificial Sequence: Synthetic oligonucleotide
  Target: ATXN1; (-) strand; PAM type: YTN; PAM sequence: CTG
tgattcatttaacataaaag

SEQ ID NO: 221109 - DNA, 20 bp, Artificial Sequence
  Description of Artificial Sequence: Synthetic oligonucleotide
  Target: ATXN1; (-) strand; PAM type: YTN; PAM sequence: CTC
ctgtgattcatttaacataa

SEQ ID NO: 221110 - DNA, 20 bp, Artificial Sequence
  Description of Artificial Sequence: Synthetic oligonucleotide
  Target: ATXN1; (-) strand; PAM type: YTN; PAM sequence: TTA
acgagcaccctcctgtgatt

SEQ ID NO: 221111 - DNA, 20 bp, Artificial Sequence
  Description of Artificial Sequence: Synthetic oligonucleotide
  Target: ATXN1; (-) strand; PAM type: YTN; PAM sequence: TTT
aacgagcaccctcctgtgat

SEQ ID NO: 221112 - DNA, 20 bp, Artificial Sequence
  Description of Artificial Sequence: Synthetic oligonucleotide
  Target: ATXN1; (-) strand; PAM type: YTN; PAM sequence: TTT
taacgagcaccctcctgtga

SEQ ID NO: 221113 - DNA, 20 bp, Artificial Sequence
  Description of Artificial Sequence: Synthetic oligonucleotide
  Target: ATXN1; (-) strand; PAM type: YTN; PAM sequence: CTT
ttaacgagcaccctcctgtg

SEQ ID NO: 221114 - DNA, 20 bp, Artificial Sequence
  Description of Artificial Sequence: Synthetic oligonucleotide
  Target: ATXN1; (-) strand; PAM type: YTN; PAM sequence: TTG
tacttttaacgagcaccctc

SEQ ID NO: 221115 - DNA, 20 bp, Artificial Sequence
  Description of Artificial Sequence: Synthetic oligonucleotide
  Target: ATXN1; (-) strand; PAM type: YTN; PAM sequence: TTA
aataggtcaggggtggggcc

SEQ ID NO: 221116 - DNA, 20 bp, Artificial Sequence
  Description of Artificial Sequence: Synthetic oligonucleotide
  Target: ATXN1; (-) strand; PAM type: YTN; PAM sequence: TTA
aagtatgttaaataggtcag

SEQ ID NO: 221117 - DNA, 20 bp, Artificial Sequence
  Description of Artificial Sequence: Synthetic oligonucleotide
  Target: ATXN1; (-) strand; PAM type: YTN; PAM sequence: CTT
aaagtatgttaaataggtca

SEQ ID NO: 221118 - DNA, 20 bp, Artificial Sequence
  Description of Artificial Sequence: Synthetic oligonucleotide
  Target: ATXN1; (-) strand; PAM type: YTN; PAM sequence: CTG
ggccttaaagtatgttaaat

SEQ ID NO: 221119 - DNA, 20 bp, Artificial Sequence
  Description of Artificial Sequence: Synthetic oligonucleotide
  Target: ATXN1; (-) strand; PAM type: YTN; PAM sequence: TTC
ctgggccttaaagtatgtta

SEQ ID NO: 221120 - DNA, 20 bp, Artificial Sequence
  Description of Artificial Sequence: Synthetic oligonucleotide
  Target: ATXN1; (-) strand; PAM type: YTN; PAM sequence: TTC
agattcctgggccttaaagt

SEQ ID NO: 221121 - DNA, 20 bp, Artificial Sequence
  Description of Artificial Sequence: Synthetic oligonucleotide
  Target: ATXN1; (-) strand; PAM type: YTN; PAM sequence: TTG
aaaattcagattcctgggcc

SEQ ID NO: 221122 - DNA, 20 bp, Artificial Sequence
  Description of Artificial Sequence: Synthetic oligonucleotide
  Target: ATXN1; (-) strand; PAM type: YTN; PAM sequence: CTG
ttgaaaattcagattcctgg

SEQ ID NO: 221123 - DNA, 20 bp, Artificial Sequence
  Description of Artificial Sequence: Synthetic oligonucleotide
  Target: ATXN1; (-) strand; PAM type: YTN; PAM sequence: TTA
gtcctgttgaaaattcagat

SEQ ID NO: 221124 - DNA, 20 bp, Artificial Sequence
  Description of Artificial Sequence: Synthetic oligonucleotide
  Target: ATXN1; (-) strand; PAM type: YTN; PAM sequence: CTT
agtcctgttgaaaattcaga

SEQ ID NO: 221125 - DNA, 20 bp, Artificial Sequence
  Description of Artificial Sequence: Synthetic oligonucleotide
  Target: ATXN1; (-) strand; PAM type: YTN; PAM sequence: TTG
aatatacaacttagtcctgt

SEQ ID NO: 221126 - DNA, 20 bp, Artificial Sequence
  Description of Artificial Sequence: Synthetic oligonucleotide
  Target: ATXN1; (-) strand; PAM type: YTN; PAM sequence: CTT
gaatatacaacttagtcctg

SEQ ID NO: 221127 - DNA, 20 bp, Artificial Sequence
  Description of Artificial Sequence: Synthetic oligonucleotide
  Target: ATXN1; (-) strand; PAM type: YTN; PAM sequence: CTA
ggacttgaatatacaactta

SEQ ID NO: 221128 - DNA, 20 bp, Artificial Sequence
  Description of Artificial Sequence: Synthetic oligonucleotide
  Target: ATXN1; (-) strand; PAM type: YTN; PAM sequence: CTA
gaccagaggccctaggactt

SEQ ID NO: 221129 - DNA, 20 bp, Artificial Sequence
  Description of Artificial Sequence: Synthetic oligonucleotide
  Target: ATXN1; (-) strand; PAM type: YTN; PAM sequence: CTC
tagaccagaggccctaggac

SEQ ID NO: 221130 - DNA, 20 bp, Artificial Sequence
  Description of Artificial Sequence: Synthetic oligonucleotide
  Target: ATXN1; (-) strand; PAM type: YTN; PAM sequence: TTG
gggggaaaggtgtggggagg

SEQ ID NO: 221131 - DNA, 20 bp, Artificial Sequence
  Description of Artificial Sequence: Synthetic oligonucleotide
  Target: ATXN1; (-) strand; PAM type: YTN; PAM sequence: TTC
agtaagggagtaaacaagag

SEQ ID NO: 221132 - DNA, 20 bp, Artificial Sequence
  Description of Artificial Sequence: Synthetic oligonucleotide
  Target: ATXN1; (-) strand; PAM type: YTN; PAM sequence: TTT
cagtaagggagtaaacaaga

SEQ ID NO: 221133 - DNA, 20 bp, Artificial Sequence
  Description of Artificial Sequence: Synthetic oligonucleotide
  Target: ATXN1; (-) strand; PAM type: YTN; PAM sequence: TTG
gcaaagacacatttcagtaa

SEQ ID NO: 221134 - DNA, 20 bp, Artificial Sequence
  Description of Artificial Sequence: Synthetic oligonucleotide
  Target: ATXN1; (-) strand; PAM type: YTN; PAM sequence: TTA
aattggcaaagacacatttc

SEQ ID NO: 221135 - DNA, 20 bp, Artificial Sequence
  Description of Artificial Sequence: Synthetic oligonucleotide
  Target: ATXN1; (-) strand; PAM type: YTN; PAM sequence: TTT
aaattggcaaagacacattt

SEQ ID NO: 221136 - DNA, 20 bp, Artificial Sequence
  Description of Artificial Sequence: Synthetic oligonucleotide
  Target: ATXN1; (-) strand; PAM type: YTN; PAM sequence: TTG
tttaaattggcaaagacaca

SEQ ID NO: 221137 - DNA, 20 bp, Artificial Sequence
  Description of Artificial Sequence: Synthetic oligonucleotide
  Target: ATXN1; (-) strand; PAM type: YTN; PAM sequence: TTG
aaaagtaattgtttaaattg

SEQ ID NO: 221138 - DNA, 20 bp, Artificial Sequence
  Description of Artificial Sequence: Synthetic oligonucleotide
  Target: ATXN1; (-) strand; PAM type: YTN; PAM sequence: TTG
gaggatgttgaaaagtaatt

SEQ ID NO: 221139 - DNA, 20 bp, Artificial Sequence
  Description of Artificial Sequence: Synthetic oligonucleotide
  Target: ATXN1; (-) strand; PAM type: YTN; PAM sequence: TTT
ggaggatgttgaaaagtaat

SEQ ID NO: 221140 - DNA, 20 bp, Artificial Sequence
  Description of Artificial Sequence: Synthetic oligonucleotide
  Target: ATXN1; (-) strand; PAM type: YTN; PAM sequence: TTA
atgcagtatgacacagaaaa

SEQ ID NO: 221141 - DNA, 20 bp, Artificial Sequence
  Description of Artificial Sequence: Synthetic oligonucleotide
  Target: ATXN1; (-) strand; PAM type: YTN; PAM sequence: TTT
aatgcagtatgacacagaaa

SEQ ID NO: 221142 - DNA, 20 bp, Artificial Sequence
  Description of Artificial Sequence: Synthetic oligonucleotide
  Target: ATXN1; (-) strand; PAM type: YTN; PAM sequence: TTT
taatgcagtatgacacagaa

SEQ ID NO: 221143 - DNA, 20 bp, Artificial Sequence
  Description of Artificial Sequence: Synthetic oligonucleotide
  Target: ATXN1; (-) strand; PAM type: YTN; PAM sequence: CTT
ttaatgcagtatgacacaga

SEQ ID NO: 221144 - DNA, 20 bp, Artificial Sequence
  Description of Artificial Sequence: Synthetic oligonucleotide
  Target: ATXN1; (-) strand; PAM type: YTN; PAM sequence: TTC
ttttaatgcagtatgacaca

SEQ ID NO: 221145 - DNA, 20 bp, Artificial Sequence
  Description of Artificial Sequence: Synthetic oligonucleotide
  Target: ATXN1; (-) strand; PAM type: YTN; PAM sequence: TTT
cttttaatgcagtatgacac

SEQ ID NO: 221146 - DNA, 20 bp, Artificial Sequence
  Description of Artificial Sequence: Synthetic oligonucleotide
  Target: ATXN1; (-) strand; PAM type: YTN; PAM sequence: TTT
tcttttaatgcagtatgaca

SEQ ID NO: 221147 - DNA, 20 bp, Artificial Sequence
  Description of Artificial Sequence: Synthetic oligonucleotide
  Target: ATXN1; (-) strand; PAM type: YTN; PAM sequence: TTT
ttcttttaatgcagtatgac

SEQ ID NO: 221148 - DNA, 20 bp, Artificial Sequence
  Description of Artificial Sequence: Synthetic oligonucleotide
  Target: ATXN1; (-) strand; PAM type: YTN; PAM sequence: TTA
gaagtaatttttcttttaat

SEQ ID NO: 221149 - DNA, 20 bp, Artificial Sequence
  Description of Artificial Sequence: Synthetic oligonucleotide
  Target: ATXN1; (-) strand; PAM type: YTN; PAM sequence: TTT
agaagtaatttttcttttaa

SEQ ID NO: 221150 - DNA, 20 bp, Artificial Sequence
  Description of Artificial Sequence: Synthetic oligonucleotide
  Target: ATXN1; (-) strand; PAM type: YTN; PAM sequence: TTA
gtgtttagaagtaatttttc

SEQ ID NO: 221151 - DNA, 20 bp, Artificial Sequence
  Description of Artificial Sequence: Synthetic oligonucleotide
  Target: ATXN1; (-) strand; PAM type: YTN; PAM sequence: TTT
agtgtttagaagtaattttt

SEQ ID NO: 221152 - DNA, 20 bp, Artificial Sequence
  Description of Artificial Sequence: Synthetic oligonucleotide
  Target: ATXN1; (-) strand; PAM type: YTN; PAM sequence: TTT
tagtgtttagaagtaatttt

SEQ ID NO: 221153 - DNA, 20 bp, Artificial Sequence
  Description of Artificial Sequence: Synthetic oligonucleotide
  Target: ATXN1; (-) strand; PAM type: YTN; PAM sequence: CTG
tggtataattttagtgttta

SEQ ID NO: 221154 - DNA, 20 bp, Artificial Sequence
  Description of Artificial Sequence: Synthetic oligonucleotide
  Target: ATXN1; (-) strand; PAM type: YTN; PAM sequence: TTC
ctgtggtataattttagtgt

SEQ ID NO: 221155 - DNA, 20 bp, Artificial Sequence
  Description of Artificial Sequence: Synthetic oligonucleotide
  Target: ATXN1; (-) strand; PAM type: YTN; PAM sequence: TTT
cctgtggtataattttagtg

SEQ ID NO: 221156 - DNA, 20 bp, Artificial Sequence
  Description of Artificial Sequence: Synthetic oligonucleotide
  Target: ATXN1; (-) strand; PAM type: YTN; PAM sequence: TTT
tcctgtggtataattttagt

SEQ ID NO: 221157 - DNA, 20 bp, Artificial Sequence
  Description of Artificial Sequence: Synthetic oligonucleotide
  Target: ATXN1; (-) strand; PAM type: YTN; PAM sequence: TTT
ttcctgtggtataattttag

SEQ ID NO: 221158 - DNA, 20 bp, Artificial Sequence
  Description of Artificial Sequence: Synthetic oligonucleotide
  Target: ATXN1; (-) strand; PAM type: YTN; PAM sequence: TTT
tttcctgtggtataatttta

SEQ ID NO: 221159 - DNA, 20 bp, Artificial Sequence
  Description of Artificial Sequence: Synthetic oligonucleotide
  Target: ATXN1; (-) strand; PAM type: YTN; PAM sequence: TTT
ttttcctgtggtataatttt

SEQ ID NO: 221160 - DNA, 20 bp, Artificial Sequence
  Description of Artificial Sequence: Synthetic oligonucleotide
  Target: ATXN1; (-) strand; PAM type: YTN; PAM sequence: TTT
tttttcctgtggtataattt

SEQ ID NO: 221161 - DNA, 20 bp, Artificial Sequence
  Description of Artificial Sequence: Synthetic oligonucleotide
  Target: ATXN1; (-) strand; PAM type: YTN; PAM sequence: TTT
ttttttcctgtggtataatt

SEQ ID NO: 221162 - DNA, 20 bp, Artificial Sequence
  Description of Artificial Sequence: Synthetic oligonucleotide
  Target: ATXN1; (-) strand; PAM type: YTN; PAM sequence: CTT
tttttttcctgtggtataat

SEQ ID NO: 221163 - DNA, 20 bp, Artificial Sequence
  Description of Artificial Sequence: Synthetic oligonucleotide
  Target: ATXN1; (-) strand; PAM type: YTN; PAM sequence: TTA
aaaaagcctttttttttcct

SEQ ID NO: 221164 - DNA, 20 bp, Artificial Sequence
  Description of Artificial Sequence: Synthetic oligonucleotide
  Target: ATXN1; (-) strand; PAM type: YTN; PAM sequence: TTT
aaaaaagcctttttttttcc

SEQ ID NO: 221165 - DNA, 20 bp, Artificial Sequence
  Description of Artificial Sequence: Synthetic oligonucleotide
  Target: ATXN1; (-) strand; PAM type: YTN; PAM sequence: TTT
taaaaaagcctttttttttc

SEQ ID NO: 221166 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaagccttttttttt

SEQ ID NO: 221167 - DNA, 20 bp, Artificial Sequence
  Description of Artificial Sequence: Synthetic oligonucleotide
  Target: ATXN1; (-) strand; PAM type: YTN; PAM sequence: TTA
taaaaatgggtttttaaaaa

SEQ ID NO: 221168 - DNA, 20 bp, Artificial Sequence
  Description of Artificial Sequence: Synthetic oligonucleotide
  Target: ATXN1; (-) strand; PAM type: YTN; PAM sequence: CTA
gatgtagcaaaagaagtgtt

SEQ ID NO: 221169 - DNA, 20 bp, Artificial Sequence
  Description of Artificial Sequence: Synthetic oligonucleotide
  Target: ATXN1; (-) strand; PAM type: YTN; PAM sequence: TTG
agctagatgtagcaaaagaa

SEQ ID NO: 221170 - DNA, 20 bp, Artificial Sequence
  Description of Artificial Sequence: Synthetic oligonucleotide
  Target: ATXN1; (-) strand; PAM type: YTN; PAM sequence: CTT
gagctagatgtagcaaaaga

SEQ ID NO: 221171 - DNA, 20 bp, Artificial Sequence
  Description of Artificial Sequence: Synthetic oligonucleotide
  Target: ATXN1; (-) strand; PAM type: YTN; PAM sequence: CTG
acttgagctagatgtagcaa

SEQ ID NO: 221172 - DNA, 20 bp, Artificial Sequence
  Description of Artificial Sequence: Synthetic oligonucleotide
  Target: ATXN1; (-) strand; PAM type: YTN; PAM sequence: TTG
ctgacttgagctagatgtag

SEQ ID NO: 221173 - DNA, 20 bp, Artificial Sequence
  Description of Artificial Sequence: Synthetic oligonucleotide
  Target: ATXN1; (-) strand; PAM type: YTN; PAM sequence: TTT
gctgacttgagctagatgta

SEQ ID NO: 221174 - DNA, 20 bp, Artificial Sequence
  Description of Artificial Sequence: Synthetic oligonucleotide
  Target: ATXN1; (-) strand; PAM type: YTN; PAM sequence: TTT
tgctgacttgagctagatgt

SEQ ID NO: 221175 - DNA, 20 bp, Artificial Sequence
  Description of Artificial Sequence: Synthetic oligonucleotide
  Target: ATXN1; (-) strand; PAM type: YTN; PAM sequence: CTA
gagccacattttgctgactt

SEQ ID NO: 221176 - DNA, 20 bp, Artificial Sequence
  Description of Artificial Sequence: Synthetic oligonucleotide
  Target: ATXN1; (-) strand; PAM type: YTN; PAM sequence: TTA
ctagagccacattttgctga

SEQ ID NO: 221177 - DNA, 20 bp, Artificial Sequence
  Description of Artificial Sequence: Synthetic oligonucleotide
  Target: ATXN1; (-) strand; PAM type: YTN; PAM sequence: TTT
actagagccacattttgctg

SEQ ID NO: 221178 - DNA, 20 bp, Artificial Sequence
  Description of Artificial Sequence: Synthetic oligonucleotide
  Target: ATXN1; (-) strand; PAM type: YTN; PAM sequence: CTC
caaggcatttactagagcca

SEQ ID NO: 221179 - DNA, 20 bp, Artificial Sequence
  Description of Artificial Sequence: Synthetic oligonucleotide
  Target: ATXN1; (-) strand; PAM type: YTN; PAM sequence: CTA
ccacagactccaaggcattt

SEQ ID NO: 221180 - DNA, 20 bp, Artificial Sequence
  Description of Artificial Sequence: Synthetic oligonucleotide
  Target: ATXN1; (-) strand; PAM type: YTN; PAM sequence: TTG
tgcctaccacagactccaag

SEQ ID NO: 221181 - DNA, 20 bp, Artificial Sequence
  Description of Artificial Sequence: Synthetic oligonucleotide
  Target: ATXN1; (-) strand; PAM type: YTN; PAM sequence: TTG
ttgtgcctaccacagactcc

SEQ ID NO: 221182 - DNA, 20 bp, Artificial Sequence
  Description of Artificial Sequence: Synthetic oligonucleotide
  Target: ATXN1; (-) strand; PAM type: YTN; PAM sequence: CTT
gttgtgcctaccacagactc

SEQ ID NO: 221183 - DNA, 20 bp, Artificial Sequence
  Description of Artificial Sequence: Synthetic oligonucleotide
  Target: ATXN1; (-) strand; PAM type: YTN; PAM sequence: TTG
aaggtcccttgttgtgccta

SEQ ID NO: 221184 - DNA, 20 bp, Artificial Sequence
  Description of Artificial Sequence: Synthetic oligonucleotide
  Target: ATXN1; (-) strand; PAM type: YTN; PAM sequence: TTT
gaaggtcccttgttgtgcct

SEQ ID NO: 221185 - DNA, 20 bp, Artificial Sequence
  Description of Artificial Sequence: Synthetic oligonucleotide
  Target: ATXN1; (-) strand; PAM type: YTN; PAM sequence: TTA
ggacgtgggtatgtttgaag

SEQ ID NO: 221186 - DNA, 20 bp, Artificial Sequence
  Description of Artificial Sequence: Synthetic oligonucleotide
  Target: ATXN1; (-) strand; PAM type: YTN; PAM sequence: CTG
gggattaggacgtgggtatg

SEQ ID NO: 221187 - DNA, 20 bp, Artificial Sequence
  Description of Artificial Sequence: Synthetic oligonucleotide
  Target: ATXN1; (-) strand; PAM type: YTN; PAM sequence: TTC
tggggattaggacgtgggta

SEQ ID NO: 221188 - DNA, 20 bp, Artificial Sequence
  Description of Artificial Sequence: Synthetic oligonucleotide
  Target: ATXN1; (-) strand; PAM type: YTN; PAM sequence: CTG
attctggggattaggacgtg

SEQ ID NO: 221189 - DNA, 20 bp, Artificial Sequence
  Description of Artificial Sequence: Synthetic oligonucleotide
  Target: ATXN1; (-) strand; PAM type: YTN; PAM sequence: TTC
acagactgattctggggatt

SEQ ID NO: 221190 - DNA, 20 bp, Artificial Sequence
  Description of Artificial Sequence: Synthetic oligonucleotide
  Target: ATXN1; (-) strand; PAM type: YTN; PAM sequence: TTA
ccacgaattcacagactgat

SEQ ID NO: 221191 - DNA, 20 bp, Artificial Sequence
  Description of Artificial Sequence: Synthetic oligonucleotide
  Target: ATXN1; (-) strand; PAM type: YTN; PAM sequence: TTT
accacgaattcacagactga

SEQ ID NO: 221192 - DNA, 20 bp, Artificial Sequence
  Description of Artificial Sequence: Synthetic oligonucleotide
  Target: ATXN1; (-) strand; PAM type: YTN; PAM sequence: TTT
taccacgaattcacagactg

SEQ ID NO: 221193 - DNA, 20 bp, Artificial Sequence
  Description of Artificial Sequence: Synthetic oligonucleotide
  Target: ATXN1; (-) strand; PAM type: YTN; PAM sequence: CTT
ttaccacgaattcacagact

SEQ ID NO: 221194 - DNA, 20 bp, Artificial Sequence
  Description of Artificial Sequence: Synthetic oligonucleotide
  Target: ATXN1; (-) strand; PAM type: YTN; PAM sequence: CTG
tgaaatcgcttttaccacga

SEQ ID NO: 221195 - DNA, 20 bp, Artificial Sequence
  Description of Artificial Sequence: Synthetic oligonucleotide
  Target: ATXN1; (-) strand; PAM type: YTN; PAM sequence: TTA
atgtcatcacatctgtgaaa

SEQ ID NO: 221196 - DNA, 20 bp, Artificial Sequence
  Description of Artificial Sequence: Synthetic oligonucleotide
  Target: ATXN1; (-) strand; PAM type: YTN; PAM sequence: CTT
aatgtcatcacatctgtgaa

SEQ ID NO: 221197 - DNA, 20 bp, Artificial Sequence
  Description of Artificial Sequence: Synthetic oligonucleotide
  Target: ATXN1; (-) strand; PAM type: YTN; PAM sequence: CTC
cagatccttaatgtcatcac

SEQ ID NO: 221198 - DNA, 20 bp, Artificial Sequence
  Description of Artificial Sequence: Synthetic oligonucleotide
  Target: ATXN1; (-) strand; PAM type: YTN; PAM sequence: CTC
cccatctccagatccttaat

SEQ ID NO: 221199 - DNA, 20 bp, Artificial Sequence
  Description of Artificial Sequence: Synthetic oligonucleotide
  Target: ATXN1; (-) strand; PAM type: YTN; PAM sequence: CTG
tatcatctccccatctccag

SEQ ID NO: 221200 - DNA, 20 bp, Artificial Sequence
  Description of Artificial Sequence: Synthetic oligonucleotide
  Target: ATXN1; (-) strand; PAM type: YTN; PAM sequence: TTG
gacccacctgtatcatctcc

SEQ ID NO: 221201 - DNA, 20 bp, Artificial Sequence
  Description of Artificial Sequence: Synthetic oligonucleotide
  Target: ATXN1; (-) strand; PAM type: YTN; PAM sequence: TTA
cattggacccacctgtatca

SEQ ID NO: 221202 - DNA, 20 bp, Artificial Sequence
  Description of Artificial Sequence: Synthetic oligonucleotide
  Target: ATXN1; (-) strand; PAM type: YTN; PAM sequence: TTG
cgattacattggacccacct

SEQ ID NO: 221203 - DNA, 20 bp, Artificial Sequence
  Description of Artificial Sequence: Synthetic oligonucleotide
  Target: ATXN1; (-) strand; PAM type: YTN; PAM sequence: CTT
gcgattacattggacccacc

SEQ ID NO: 221204 - DNA, 20 bp, Artificial Sequence
  Description of Artificial Sequence: Synthetic oligonucleotide
  Target: ATXN1; (-) strand; PAM type: YTN; PAM sequence: TTC
cttgcgattacattggaccc

SEQ ID NO: 221205 - DNA, 20 bp, Artificial Sequence
  Description of Artificial Sequence: Synthetic oligonucleotide
  Target: ATXN1; (-) strand; PAM type: YTN; PAM sequence: CTT
ccttgcgattacattggacc

SEQ ID NO: 221206 - DNA, 20 bp, Artificial Sequence
  Description of Artificial Sequence: Synthetic oligonucleotide
  Target: ATXN1; (-) strand; PAM type: YTN; PAM sequence: TTA
aacttccttgcgattacatt

SEQ ID NO: 221207 - DNA, 20 bp, Artificial Sequence
  Description of Artificial Sequence: Synthetic oligonucleotide
  Target: ATXN1; (-) strand; PAM type: YTN; PAM sequence: TTT
aaacttccttgcgattacat

SEQ ID NO: 221208 - DNA, 20 bp, Artificial Sequence
  Description of Artificial Sequence: Synthetic oligonucleotide
  Target: ATXN1; (-) strand; PAM type: YTN; PAM sequence: TTT
taaacttccttgcgattaca

SEQ ID NO: 221209 - DNA, 20 bp, Artificial Sequence
  Description of Artificial Sequence: Synthetic oligonucleotide
  Target: ATXN1; (-) strand; PAM type: YTN; PAM sequence: CTT
ttaaacttccttgcgattac

SEQ ID NO: 221210 - DNA, 20 bp, Artificial Sequence
  Description of Artificial Sequence: Synthetic oligonucleotide
  Target: ATXN1; (-) strand; PAM type: YTN; PAM sequence: CTC
agacttttaaacttccttgc

SEQ ID NO: 221211 - DNA, 20 bp, Artificial Sequence
  Description of Artificial Sequence: Synthetic oligonucleotide
  Target: ATXN1; (-) strand; PAM type: YTN; PAM sequence: TTC
tcagacttttaaacttcctt

SEQ ID NO: 221212 - DNA, 20 bp, Artificial Sequence
  Description of Artificial Sequence: Synthetic oligonucleotide
  Target: ATXN1; (-) strand; PAM type: YTN; PAM sequence: CTT
ctcagacttttaaacttcct

SEQ ID NO: 221213 - DNA, 20 bp, Artificial Sequence
  Description of Artificial Sequence: Synthetic oligonucleotide
  Target: ATXN1; (-) strand; PAM type: YTN; PAM sequence: CTC
cttctcagacttttaaactt

SEQ ID NO: 221214 - DNA, 20 bp, Artificial Sequence
  Description of Artificial Sequence: Synthetic oligonucleotide
  Target: ATXN1; (-) strand; PAM type: YTN; PAM sequence: TTC
ctccttctcagacttttaaa

SEQ ID NO: 221215 - DNA, 20 bp, Artificial Sequence
  Description of Artificial Sequence: Synthetic oligonucleotide
  Target: ATXN1; (-) strand; PAM type: YTN; PAM sequence: CTT
cctccttctcagacttttaa

SEQ ID NO: 221216 - DNA, 20 bp, Artificial Sequence
  Description of Artificial Sequence: Synthetic oligonucleotide
  Target: ATXN1; (-) strand; PAM type: YTN; PAM sequence: TTC
ttcctccttctcagactttt

SEQ ID NO: 221217 - DNA, 20 bp, Artificial Sequence
  Description of Artificial Sequence: Synthetic oligonucleotide
  Target: ATXN1; (-) strand; PAM type: YTN; PAM sequence: CTT
cttcctccttctcagacttt

SEQ ID NO: 221218 - DNA, 20 bp, Artificial Sequence
  Description of Artificial Sequence: Synthetic oligonucleotide
  Target: ATXN1; (-) strand; PAM type: YTN; PAM sequence: CTG
acacttcttcctccttctca

SEQ ID NO: 221219 - DNA, 20 bp, Artificial Sequence
  Description of Artificial Sequence: Synthetic oligonucleotide
  Target: ATXN1; (-) strand; PAM type: YTN; PAM sequence: CTC
tgacacttcttcctccttct

SEQ ID NO: 221220 - DNA, 20 bp, Artificial Sequence
  Description of Artificial Sequence: Synthetic oligonucleotide
  Target: ATXN1; (-) strand; PAM type: YTN; PAM sequence: TTC
ctctgacacttcttcctcct

SEQ ID NO: 221221 - DNA, 20 bp, Artificial Sequence
  Description of Artificial Sequence: Synthetic oligonucleotide
  Target: ATXN1; (-) strand; PAM type: YTN; PAM sequence: CTT
cctctgacacttcttcctcc

SEQ ID NO: 221222 - DNA, 20 bp, Artificial Sequence
  Description of Artificial Sequence: Synthetic oligonucleotide
  Target: ATXN1; (-) strand; PAM type: YTN; PAM sequence: TTG
aatcttcctctgacacttct

SEQ ID NO: 221223 - DNA, 20 bp, Artificial Sequence
  Description of Artificial Sequence: Synthetic oligonucleotide
  Target: ATXN1; (-) strand; PAM type: YTN; PAM sequence: TTC
catagttgaatcttcctctg

SEQ ID NO: 221224 - DNA, 20 bp, Artificial Sequence
  Description of Artificial Sequence: Synthetic oligonucleotide
  Target: ATXN1; (-) strand; PAM type: YTN; PAM sequence: TTT
ccatagttgaatcttcctct

SEQ ID NO: 221225 - DNA, 20 bp, Artificial Sequence
  Description of Artificial Sequence: Synthetic oligonucleotide
  Target: ATXN1; (-) strand; PAM type: YTN; PAM sequence: CTG
tgtttccatagttgaatctt

SEQ ID NO: 221226 - DNA, 20 bp, Artificial Sequence
  Description of Artificial Sequence: Synthetic oligonucleotide
  Target: ATXN1; (-) strand; PAM type: YTN; PAM sequence: CTG
tgctgtgtttccatagttga

SEQ ID NO: 221227 - DNA, 20 bp, Artificial Sequence
  Description of Artificial Sequence: Synthetic oligonucleotide
  Target: ATXN1; (-) strand; PAM type: YTN; PAM sequence: CTC
tgtgctgtgtttccatagtt

SEQ ID NO: 221228 - DNA, 20 bp, Artificial Sequence
  Description of Artificial Sequence: Synthetic oligonucleotide
  Target: ATXN1; (-) strand; PAM type: YTN; PAM sequence: CTC
tctgtgctgtgtttccatag

SEQ ID NO: 221229 - DNA, 20 bp, Artificial Sequence
  Description of Artificial Sequence: Synthetic oligonucleotide
  Target: ATXN1; (-) strand; PAM type: YTN; PAM sequence: TTG
catctctctgtgctgtgttt

SEQ ID NO: 221230 - DNA, 20 bp, Artificial Sequence
  Description of Artificial Sequence: Synthetic oligonucleotide
  Target: ATXN1; (-) strand; PAM type: YTN; PAM sequence: TTC
aaagccatcaatgttgcatc

SEQ ID NO: 221231 - DNA, 20 bp, Artificial Sequence
  Description of Artificial Sequence: Synthetic oligonucleotide
  Target: ATXN1; (-) strand; PAM type: YTN; PAM sequence: CTT
caaagccatcaatgttgcat

SEQ ID NO: 221232 - DNA, 20 bp, Artificial Sequence
  Description of Artificial Sequence: Synthetic oligonucleotide
  Target: ATXN1; (-) strand; PAM type: YTN; PAM sequence: CTA
tcttcaaagccatcaatgtt

SEQ ID NO: 221233 - DNA, 20 bp, Artificial Sequence
  Description of Artificial Sequence: Synthetic oligonucleotide
  Target: ATXN1; (-) strand; PAM type: YTN; PAM sequence: TTC
ccctatcttcaaagccatca

SEQ ID NO: 221234 - DNA, 20 bp, Artificial Sequence
  Description of Artificial Sequence: Synthetic oligonucleotide
  Target: ATXN1; (-) strand; PAM type: YTN; PAM sequence: CTT
cccctatcttcaaagccatc

SEQ ID NO: 221235 - DNA, 20 bp, Artificial Sequence
  Description of Artificial Sequence: Synthetic oligonucleotide
  Target: ATXN1; (-) strand; PAM type: YTN; PAM sequence: CTG
gccccttcccctatcttcaa

SEQ ID NO: 221236 - DNA, 20 bp, Artificial Sequence
  Description of Artificial Sequence: Synthetic oligonucleotide
  Target: ATXN1; (-) strand; PAM type: YTN; PAM sequence: CTC
ctggccccttcccctatctt

SEQ ID NO: 221237 - DNA, 20 bp, Artificial Sequence
  Description of Artificial Sequence: Synthetic oligonucleotide
  Target: ATXN1; (-) strand; PAM type: YTN; PAM sequence: TTG
gctcctggccccttccccta

SEQ ID NO: 221238 - DNA, 20 bp, Artificial Sequence
  Description of Artificial Sequence: Synthetic oligonucleotide
  Target: ATXN1; (-) strand; PAM type: YTN; PAM sequence: CTT
ggctcctggccccttcccct

SEQ ID NO: 221239 - DNA, 20 bp, Artificial Sequence
  Description of Artificial Sequence: Synthetic oligonucleotide
  Target: ATXN1; (-) strand; PAM type: YTN; PAM sequence: TTC
ttggctcctggccccttccc

SEQ ID NO: 221240 - DNA, 20 bp, Artificial Sequence
  Description of Artificial Sequence: Synthetic oligonucleotide
  Target: ATXN1; (-) strand; PAM type: YTN; PAM sequence: TTT
cttggctcctggccccttcc

SEQ ID NO: 221241 - DNA, 20 bp, Artificial Sequence
  Description of Artificial Sequence: Synthetic oligonucleotide
  Target: ATXN1; (-) strand; PAM type: YTN; PAM sequence: TTG
tatttcttggctcctggccc

SEQ ID NO: 221242 - DNA, 20 bp, Artificial Sequence
  Description of Artificial Sequence: Synthetic oligonucleotide
  Target: ATXN1; (-) strand; PAM type: YTN; PAM sequence: CTA
gatgccattgtatttcttgg

SEQ ID NO: 221243 - DNA, 20 bp, Artificial Sequence
  Description of Artificial Sequence: Synthetic oligonucleotide
  Target: ATXN1; (-) strand; PAM type: YTN; PAM sequence: TTG
tctagatgccattgtatttc

SEQ ID NO: 221244 - DNA, 20 bp, Artificial Sequence
  Description of Artificial Sequence: Synthetic oligonucleotide
  Target: ATXN1; (-) strand; PAM type: YTN; PAM sequence: TTC
cattgtctagatgccattgt

SEQ ID NO: 221245 - DNA, 20 bp, Artificial Sequence
  Description of Artificial Sequence: Synthetic oligonucleotide
  Target: ATXN1; (-) strand; PAM type: YTN; PAM sequence: TTT
ccattgtctagatgccattg

SEQ ID NO: 221246 - DNA, 20 bp, Artificial Sequence
  Description of Artificial Sequence: Synthetic oligonucleotide
  Target: ATXN1; (-) strand; PAM type: YTN; PAM sequence: TTT
tccattgtctagatgccatt

SEQ ID NO: 221247 - DNA, 20 bp, Artificial Sequence
  Description of Artificial Sequence: Synthetic oligonucleotide
  Target: ATXN1; (-) strand; PAM type: YTN; PAM sequence: TTT
ttccattgtctagatgccat

SEQ ID NO: 221248 - DNA, 20 bp, Artificial Sequence
  Description of Artificial Sequence: Synthetic oligonucleotide
  Target: ATXN1; (-) strand; PAM type: YTN; PAM sequence: CTT
tttccattgtctagatgcca

SEQ ID NO: 221249 - DNA, 20 bp, Artificial Sequence
  Description of Artificial Sequence: Synthetic oligonucleotide
  Target: ATXN1; (-) strand; PAM type: YTN; PAM sequence: CTG
gcccacctttttccattgtc

SEQ ID NO: 221250 - DNA, 20 bp, Artificial Sequence
  Description of Artificial Sequence: Synthetic oligonucleotide
  Target: ATXN1; (-) strand; PAM type: YTN; PAM sequence: CTG
ggatcacaggcatgaaccat

SEQ ID NO: 221251 - DNA, 20 bp, Artificial Sequence
  Description of Artificial Sequence: Synthetic oligonucleotide
  Target: ATXN1; (-) strand; PAM type: YTN; PAM sequence: CTC
ccagagtgctgggatcacag

SEQ ID NO: 221252 - DNA, 20 bp, Artificial Sequence
  Description of Artificial Sequence: Synthetic oligonucleotide
  Target: ATXN1; (-) strand; PAM type: YTN; PAM sequence: CTC
ggcctcccagagtgctggga

SEQ ID NO: 221253 - DNA, 20 bp, Artificial Sequence
  Description of Artificial Sequence: Synthetic oligonucleotide
  Target: ATXN1; (-) strand; PAM type: YTN; PAM sequence: CTC
aggcgatccacccgcctcgg

SEQ ID NO: 221254 - DNA, 20 bp, Artificial Sequence
  Description of Artificial Sequence: Synthetic oligonucleotide
  Target: ATXN1; (-) strand; PAM type: YTN; PAM sequence: CTC
gacctcaggcgatccacccg

SEQ ID NO: 221255 - DNA, 20 bp, Artificial Sequence
  Description of Artificial Sequence: Synthetic oligonucleotide
  Target: ATXN1; (-) strand; PAM type: YTN; PAM sequence: CTC
tcgacctcaggcgatccacc

SEQ ID NO: 221256 - DNA, 20 bp, Artificial Sequence
  Description of Artificial Sequence: Synthetic oligonucleotide
  Target: ATXN1; (-) strand; PAM type: YTN; PAM sequence: CTC
gaactctcgacctcaggcga

SEQ ID NO: 221257 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactctcgacctca

SEQ ID NO: 221258 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtctcgaactc

SEQ ID NO: 221259 - DNA, 20 bp, Artificial Sequence
  Description of Artificial Sequence: Synthetic oligonucleotide
  Target: ATXN1; (-) strand; PAM type: YTN; PAM sequence: CTC
catgttggccaggctggtct

SEQ ID NO: 221260 - DNA, 20 bp, Artificial Sequence
  Description of Artificial Sequence: Synthetic oligonucleotide
  Target: ATXN1; (-) strand; PAM type: YTN; PAM sequence: TTC
tccatgttggccaggctggt

SEQ ID NO: 221261 - DNA, 20 bp, Artificial Sequence
  Description of Artificial Sequence: Synthetic oligonucleotide
  Target: ATXN1; (-) strand; PAM type: YTN; PAM sequence: TTT
ctccatgttggccaggctgg

SEQ ID NO: 221262 - DNA, 20 bp, Artificial Sequence
  Description of Artificial Sequence: Synthetic oligonucleotide
  Target: ATXN1; (-) strand; PAM type: YTN; PAM sequence: CTA
gagtggggtttctccatgtt

SEQ ID NO: 221263 - DNA, 20 bp, Artificial Sequence
  Description of Artificial Sequence: Synthetic oligonucleotide
  Target: ATXN1; (-) strand; PAM type: YTN; PAM sequence: TTA
ctagagtggggtttctccat

SEQ ID NO: 221264 - DNA, 20 bp, Artificial Sequence
  Description of Artificial Sequence: Synthetic oligonucleotide
  Target: ATXN1; (-) strand; PAM type: YTN; PAM sequence: TTT
actagagtggggtttctcca

SEQ ID NO: 221265 - DNA, 20 bp, Artificial Sequence
  Description of Artificial Sequence: Synthetic oligonucleotide
  Target: ATXN1; (-) strand; PAM type: YTN; PAM sequence: TTT
tactagagtggggtttctcc

SEQ ID NO: 221266 - DNA, 20 bp, Artificial Sequence
  Description of Artificial Sequence: Synthetic oligonucleotide
  Target: ATXN1; (-) strand; PAM type: YTN; PAM sequence: TTT
ttactagagtggggtttctc

SEQ ID NO: 221267 - DNA, 20 bp, Artificial Sequence
  Description of Artificial Sequence: Synthetic oligonucleotide
  Target: ATXN1; (-) strand; PAM type: YTN; PAM sequence: TTA
tatttttactagagtggggt

SEQ ID NO: 221268 - DNA, 20 bp, Artificial Sequence
  Description of Artificial Sequence: Synthetic oligonucleotide
  Target: ATXN1; (-) strand; PAM type: YTN; PAM sequence: TTT
atatttttactagagtgggg

SEQ ID NO: 221269 - DNA, 20 bp, Artificial Sequence
  Description of Artificial Sequence: Synthetic oligonucleotide
  Target: ATXN1; (-) strand; PAM type: YTN; PAM sequence: TTT
tatatttttactagagtggg

SEQ ID NO: 221270 - DNA, 20 bp, Artificial Sequence
  Description of Artificial Sequence: Synthetic oligonucleotide
  Target: ATXN1; (-) strand; PAM type: YTN; PAM sequence: CTA
aattttatatttttactaga

SEQ ID NO: 221271 - DNA, 20 bp, Artificial Sequence
  Description of Artificial Sequence: Synthetic oligonucleotide
  Target: ATXN1; (-) strand; PAM type: YTN; PAM sequence: CTG
ggagtagcccagcaccatac

SEQ ID NO: 221272 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggagtagcc

SEQ ID NO: 221273 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 221274 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 221275 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccaagta

SEQ ID NO: 221276 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccaag

SEQ ID NO: 221277 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcctgcctcag

SEQ ID NO: 221278 - DNA, 20 bp, Artificial Sequence
  Description of Artificial Sequence: Synthetic oligonucleotide
  Target: ATXN1; (-) strand; PAM type: YTN; PAM sequence: CTC
caaggttcaagcaattctcc

SEQ ID NO: 221279 - DNA, 20 bp, Artificial Sequence
  Description of Artificial Sequence: Synthetic oligonucleotide
  Target: ATXN1; (-) strand; PAM type: YTN; PAM sequence: CTC
cgtctccaaggttcaagcaa

SEQ ID NO: 221280 - DNA, 20 bp, Artificial Sequence
  Description of Artificial Sequence: Synthetic oligonucleotide
  Target: ATXN1; (-) strand; PAM type: YTN; PAM sequence: CTC
agtgccacctccgtctccaa

SEQ ID NO: 221281 - DNA, 20 bp, Artificial Sequence
  Description of Artificial Sequence: Synthetic oligonucleotide
  Target: ATXN1; (-) strand; PAM type: YTN; PAM sequence: TTG
gctcagtgccacctccgtct

SEQ ID NO: 221282 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcacatattg

SEQ ID NO: 221283 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctggagtgcag

SEQ ID NO: 221284 - DNA, 20 bp, Artificial Sequence
  Description of Artificial Sequence: Synthetic oligonucleotide
  Target: ATXN1; (-) strand; PAM type: YTN; PAM sequence: TTC
tgtcgcccaggctggagtgc

SEQ ID NO: 221285 - DNA, 20 bp, Artificial Sequence
  Description of Artificial Sequence: Synthetic oligonucleotide
  Target: ATXN1; (-) strand; PAM type: YTN; PAM sequence: CTC
attctgtcgcccaggctgga

SEQ ID NO: 221286 - DNA, 20 bp, Artificial Sequence
  Description of Artificial Sequence: Synthetic oligonucleotide
  Target: ATXN1; (-) strand; PAM type: YTN; PAM sequence: TTG
gcgggggggaacggagtctc

SEQ ID NO: 221287 - DNA, 20 bp, Artificial Sequence
  Description of Artificial Sequence: Synthetic oligonucleotide
  Target: ATXN1; (-) strand; PAM type: YTN; PAM sequence: TTT
ggcgggggggaacggagtct

SEQ ID NO: 221288 - DNA, 20 bp, Artificial Sequence
  Description of Artificial Sequence: Synthetic oligonucleotide
  Target: ATXN1; (-) strand; PAM type: YTN; PAM sequence: TTT
tggcgggggggaacggagtc

SEQ ID NO: 221289 - DNA, 20 bp, Artificial Sequence
  Description of Artificial Sequence: Synthetic oligonucleotide
  Target: ATXN1; (-) strand; PAM type: YTN; PAM sequence: TTT
ttggcgggggggaacggagt

SEQ ID NO: 221290 - DNA, 20 bp, Artificial Sequence
  Description of Artificial Sequence: Synthetic oligonucleotide
  Target: ATXN1; (-) strand; PAM type: YTN; PAM sequence: TTT
tttggcgggggggaacggag

SEQ ID NO: 221291 - DNA, 20 bp, Artificial Sequence
  Description of Artificial Sequence: Synthetic oligonucleotide
  Target: ATXN1; (-) strand; PAM type: YTN; PAM sequence: TTT
ttttggcgggggggaacgga

SEQ ID NO: 221292 - DNA, 20 bp, Artificial Sequence
  Description of Artificial Sequence: Synthetic oligonucleotide
  Target: ATXN1; (-) strand; PAM type: YTN; PAM sequence: TTT
tttttggcgggggggaacgg

SEQ ID NO: 221293 - DNA, 20 bp, Artificial Sequence
  Description of Artificial Sequence: Synthetic oligonucleotide
  Target: ATXN1; (-) strand; PAM type: YTN; PAM sequence: TTT
ttttttggcgggggggaacg

SEQ ID NO: 221294 - DNA, 20 bp, Artificial Sequence
  Description of Artificial Sequence: Synthetic oligonucleotide
  Target: ATXN1; (-) strand; PAM type: YTN; PAM sequence: TTT
tttttttggcgggggggaac

SEQ ID NO: 221295 - DNA, 20 bp, Artificial Sequence
  Description of Artificial Sequence: Synthetic oligonucleotide
  Target: ATXN1; (-) strand; PAM type: YTN; PAM sequence: TTT
ttttttttggcgggggggaa

SEQ ID NO: 221296 - DNA, 20 bp, Artificial Sequence
  Description of Artificial Sequence: Synthetic oligonucleotide
  Target: ATXN1; (-) strand; PAM type: YTN; PAM sequence: TTT
tttttttttggcggggggga

SEQ ID NO: 221297 - DNA, 20 bp, Artificial Sequence
  Description of Artificial Sequence: Synthetic oligonucleotide
  Target: ATXN1; (-) strand; PAM type: YTN; PAM sequence: TTT
ttttttttttggcggggggg

SEQ ID NO: 221298 - DNA, 20 bp, Artificial Sequence
  Description of Artificial Sequence: Synthetic oligonucleotide
  Target: ATXN1; (-) strand; PAM type: YTN; PAM sequence: TTT
tttttttttttggcgggggg

SEQ ID NO: 221299 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttggcggggg

SEQ ID NO: 221300 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttggcgggg

SEQ ID NO: 221301 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttggcggg

SEQ ID NO: 221302 - DNA, 20 bp, Artificial Sequence
  Description of Artificial Sequence: Synthetic oligonucleotide
  Target: ATXN1; (-) strand; PAM type: YTN; PAM sequence: TTC
ttttttttttttttttggcg

SEQ ID NO: 221303 - DNA, 20 bp, Artificial Sequence
  Description of Artificial Sequence: Synthetic oligonucleotide
  Target: ATXN1; (-) strand; PAM type: YTN; PAM sequence: TTT
cttttttttttttttttggc

SEQ ID NO: 221304 - DNA, 20 bp, Artificial Sequence
  Description of Artificial Sequence: Synthetic oligonucleotide
  Target: ATXN1; (-) strand; PAM type: YTN; PAM sequence: TTT
tcttttttttttttttttgg

SEQ ID NO: 221305 - DNA, 20 bp, Artificial Sequence
  Description of Artificial Sequence: Synthetic oligonucleotide
  Target: ATXN1; (-) strand; PAM type: YTN; PAM sequence: CTT
ttcttttttttttttttttg

SEQ ID NO: 221306 - DNA, 20 bp, Artificial Sequence
  Description of Artificial Sequence: Synthetic oligonucleotide
  Target: ATXN1; (-) strand; PAM type: YTN; PAM sequence: TTC
ttttcttttttttttttttt

SEQ ID NO: 221307 - DNA, 20 bp, Artificial Sequence
  Description of Artificial Sequence: Synthetic oligonucleotide
  Target: ATXN1; (-) strand; PAM type: YTN; PAM sequence: TTT
cttttctttttttttttttt

SEQ ID NO: 221308 - DNA, 20 bp, Artificial Sequence
  Description of Artificial Sequence: Synthetic oligonucleotide
  Target: ATXN1; (-) strand; PAM type: YTN; PAM sequence: TTT
tcttttcttttttttttttt

SEQ ID NO: 221309 - DNA, 20 bp, Artificial Sequence
  Description of Artificial Sequence: Synthetic oligonucleotide
  Target: ATXN1; (-) strand; PAM type: YTN; PAM sequence: CTT
ttcttttctttttttttttt

SEQ ID NO: 221310 - DNA, 20 bp, Artificial Sequence
  Description of Artificial Sequence: Synthetic oligonucleotide
  Target: ATXN1; (-) strand; PAM type: YTN; PAM sequence: TTC
ttttcttttctttttttttt

SEQ ID NO: 221311 - DNA, 20 bp, Artificial Sequence
  Description of Artificial Sequence: Synthetic oligonucleotide
  Target: ATXN1; (-) strand; PAM type: YTN; PAM sequence: TTT
cttttcttttcttttttttt

SEQ ID NO: 221312 - DNA, 20 bp, Artificial Sequence
  Description of Artificial Sequence: Synthetic oligonucleotide
  Target: ATXN1; (-) strand; PAM type: YTN; PAM sequence: CTT
tcttttcttttctttttttt

SEQ ID NO: 221313 - DNA, 20 bp, Artificial Sequence
  Description of Artificial Sequence: Synthetic oligonucleotide
  Target: ATXN1; (-) strand; PAM type: YTN; PAM sequence: TTC
tttcttttcttttctttttt

SEQ ID NO: 221314 - DNA, 20 bp, Artificial Sequence
  Description of Artificial Sequence: Synthetic oligonucleotide
  Target: ATXN1; (-) strand; PAM type: YTN; PAM sequence: TTT
ctttcttttcttttcttttt

SEQ ID NO: 221315 - DNA, 20 bp, Artificial Sequence
  Description of Artificial Sequence: Synthetic oligonucleotide
  Target: ATXN1; (-) strand; PAM type: YTN; PAM sequence: TTT
tctttcttttcttttctttt

SEQ ID NO: 221316 - DNA, 20 bp, Artificial Sequence
  Description of Artificial Sequence: Synthetic oligonucleotide
  Target: ATXN1; (-) strand; PAM type: YTN; PAM sequence: TTC
cgttttctttcttttctttt

SEQ ID NO: 221317 - DNA, 20 bp, Artificial Sequence
  Description of Artificial Sequence: Synthetic oligonucleotide
  Target: ATXN1; (-) strand; PAM type: YTN; PAM sequence: TTT
ccgttttctttcttttcttt

SEQ ID NO: 221318 - DNA, 20 bp, Artificial Sequence
  Description of Artificial Sequence: Synthetic oligonucleotide
  Target: ATXN1; (-) strand; PAM type: YTN; PAM sequence: TTT
tccgttttctttcttttctt

SEQ ID NO: 221319 - DNA, 20 bp, Artificial Sequence
  Description of Artificial Sequence: Synthetic oligonucleotide
  Target: ATXN1; (-) strand; PAM type: YTN; PAM sequence: CTT
ttccgttttctttcttttct

SEQ ID NO: 221320 - DNA, 20 bp, Artificial Sequence
  Description of Artificial Sequence: Synthetic oligonucleotide
  Target: ATXN1; (-) strand; PAM type: YTN; PAM sequence: TTG
ccttttccgttttctttctt

SEQ ID NO: 221321 - DNA, 20 bp, Artificial Sequence
  Description of Artificial Sequence: Synthetic oligonucleotide
  Target: ATXN1; (-) strand; PAM type: YTN; PAM sequence: CTT
gccttttccgttttctttct

SEQ ID NO: 221322 - DNA, 20 bp, Artificial Sequence
  Description of Artificial Sequence: Synthetic oligonucleotide
  Target: ATXN1; (-) strand; PAM type: YTN; PAM sequence: TTC
atatccttgccttttccgtt

SEQ ID NO: 221323 - DNA, 20 bp, Artificial Sequence
  Description of Artificial Sequence: Synthetic oligonucleotide
  Target: ATXN1; (-) strand; PAM type: YTN; PAM sequence: CTA
gagaataattcatatccttg

SEQ ID NO: 221324 - DNA, 20 bp, Artificial Sequence
  Description of Artificial Sequence: Synthetic oligonucleotide
  Target: ATXN1; (-) strand; PAM type: YTN; PAM sequence: CTC
tagagaataattcatatcct

SEQ ID NO: 221325 - DNA, 20 bp, Artificial Sequence
  Description of Artificial Sequence: Synthetic oligonucleotide
  Target: ATXN1; (-) strand; PAM type: YTN; PAM sequence: CTG
tagggactctagagaataat

SEQ ID NO: 221326 - DNA, 20 bp, Artificial Sequence
  Description of Artificial Sequence: Synthetic oligonucleotide
  Target: ATXN1; (-) strand; PAM type: YTN; PAM sequence: CTC
tgtagggactctagagaata

SEQ ID NO: 221327 - DNA, 20 bp, Artificial Sequence
  Description of Artificial Sequence: Synthetic oligonucleotide
  Target: ATXN1; (-) strand; PAM type: YTN; PAM sequence: TTC
tctgtagggactctagagaa

SEQ ID NO: 221328 - DNA, 20 bp, Artificial Sequence
  Description of Artificial Sequence: Synthetic oligonucleotide
  Target: ATXN1; (-) strand; PAM type: YTN; PAM sequence: CTC
attctctgtagggactctag

SEQ ID NO: 221329 - DNA, 20 bp, Artificial Sequence
  Description of Artificial Sequence: Synthetic oligonucleotide
  Target: ATXN1; (-) strand; PAM type: YTN; PAM sequence: CTG
aaatcaaagtgtcagccagg

SEQ ID NO: 221330 - DNA, 20 bp, Artificial Sequence
  Description of Artificial Sequence: Synthetic oligonucleotide
  Target: ATXN1; (-) strand; PAM type: YTN; PAM sequence: CTC
accaggctgaaatcaaagtg

SEQ ID NO: 221331 - DNA, 20 bp, Artificial Sequence
  Description of Artificial Sequence: Synthetic oligonucleotide
  Target: ATXN1; (-) strand; PAM type: YTN; PAM sequence: CTG
caggtcagaaatccaataca

SEQ ID NO: 221332 - DNA, 20 bp, Artificial Sequence
  Description of Artificial Sequence: Synthetic oligonucleotide
  Target: ATXN1; (-) strand; PAM type: YTN; PAM sequence: TTC
tgcaggtcagaaatccaata

SEQ ID NO: 221333 - DNA, 20 bp, Artificial Sequence
  Description of Artificial Sequence: Synthetic oligonucleotide
  Target: ATXN1; (-) strand; PAM type: YTN; PAM sequence: CTG
acagttctgcaggtcagaaa

SEQ ID NO: 221334 - DNA, 20 bp, Artificial Sequence
  Description of Artificial Sequence: Synthetic oligonucleotide
  Target: ATXN1; (-) strand; PAM type: YTN; PAM sequence: TTA
tctgacagttctgcaggtca

SEQ ID NO: 221335 - DNA, 20 bp, Artificial Sequence
  Description of Artificial Sequence: Synthetic oligonucleotide
  Target: ATXN1; (-) strand; PAM type: YTN; PAM sequence: TTT
atctgacagttctgcaggtc

SEQ ID NO: 221336 - DNA, 20 bp, Artificial Sequence
  Description of Artificial Sequence: Synthetic oligonucleotide
  Target: ATXN1; (-) strand; PAM type: YTN; PAM sequence: TTT
tatctgacagttctgcaggt

SEQ ID NO: 221337 - DNA, 20 bp, Artificial Sequence
  Description of Artificial Sequence: Synthetic oligonucleotide
  Target: ATXN1; (-) strand; PAM type: YTN; PAM sequence: TTT
ttatctgacagttctgcagg

SEQ ID NO: 221338 - DNA, 20 bp, Artificial Sequence
  Description of Artificial Sequence: Synthetic oligonucleotide
  Target: ATXN1; (-) strand; PAM type: YTN; PAM sequence: CTG
tttttatctgacagttctgc

SEQ ID NO: 221339 - DNA, 20 bp, Artificial Sequence
  Description of Artificial Sequence: Synthetic oligonucleotide
  Target: ATXN1; (-) strand; PAM type: YTN; PAM sequence: TTA
aagcaactgtttttatctga

SEQ ID NO: 221340 - DNA, 20 bp, Artificial Sequence
  Description of Artificial Sequence: Synthetic oligonucleotide
  Target: ATXN1; (-) strand; PAM type: YTN; PAM sequence: CTT
aaagcaactgtttttatctg

SEQ ID NO: 221341 - DNA, 20 bp, Artificial Sequence
  Description of Artificial Sequence: Synthetic oligonucleotide
  Target: ATXN1; (-) strand; PAM type: YTN; PAM sequence: TTG
tggcttaaagcaactgtttt

SEQ ID NO: 221342 - DNA, 20 bp, Artificial Sequence
  Description of Artificial Sequence: Synthetic oligonucleotide
  Target: ATXN1; (-) strand; PAM type: YTN; PAM sequence: TTT
gtggcttaaagcaactgttt

SEQ ID NO: 221343 - DNA, 20 bp, Artificial Sequence
  Description of Artificial Sequence: Synthetic oligonucleotide
  Target: ATXN1; (-) strand; PAM type: YTN; PAM sequence: CTT
tgtggcttaaagcaactgtt

SEQ ID NO: 221344 - DNA, 20 bp, Artificial Sequence
  Description of Artificial Sequence: Synthetic oligonucleotide
  Target: ATXN1; (-) strand; PAM type: YTN; PAM sequence: TTA
tcaggaactttgtggcttaa

SEQ ID NO: 221345 - DNA, 20 bp, Artificial Sequence
  Description of Artificial Sequence: Synthetic oligonucleotide
  Target: ATXN1; (-) strand; PAM type: YTN; PAM sequence: CTT
atcaggaactttgtggctta

SEQ ID NO: 221346 - DNA, 20 bp, Artificial Sequence
  Description of Artificial Sequence: Synthetic oligonucleotide
  Target: ATXN1; (-) strand; PAM type: YTN; PAM sequence: CTG
taacaacttatcaggaactt

SEQ ID NO: 221347 - DNA, 20 bp, Artificial Sequence
  Description of Artificial Sequence: Synthetic oligonucleotide
  Target: ATXN1; (-) strand; PAM type: YTN; PAM sequence: CTG
ctgtaacaacttatcaggaa

SEQ ID NO: 221348 - DNA, 20 bp, Artificial Sequence
  Description of Artificial Sequence: Synthetic oligonucleotide
  Target: ATXN1; (-) strand; PAM type: YTN; PAM sequence: TTG
ctgctgtaacaacttatcag

SEQ ID NO: 221349 - DNA, 20 bp, Artificial Sequence
  Description of Artificial Sequence: Synthetic oligonucleotide
  Target: ATXN1; (-) strand; PAM type: YTN; PAM sequence: TTC
attgctgctgtaacaactta

SEQ ID NO: 221350 - DNA, 20 bp, Artificial Sequence
  Description of Artificial Sequence: Synthetic oligonucleotide
  Target: ATXN1; (-) strand; PAM type: YTN; PAM sequence: TTT
cattgctgctgtaacaactt

SEQ ID NO: 221351 - DNA, 20 bp, Artificial Sequence
  Description of Artificial Sequence: Synthetic oligonucleotide
  Target: ATXN1; (-) strand; PAM type: YTN; PAM sequence: TTT
tcattgctgctgtaacaact

SEQ ID NO: 221352 - DNA, 20 bp, Artificial Sequence
  Description of Artificial Sequence: Synthetic oligonucleotide
  Target: ATXN1; (-) strand; PAM type: YTN; PAM sequence: TTT
ttcattgctgctgtaacaac

SEQ ID NO: 221353 - DNA, 20 bp, Artificial Sequence
  Description of Artificial Sequence: Synthetic oligonucleotide
  Target: ATXN1; (-) strand; PAM type: YTN; PAM sequence: TTA
gtttttcattgctgctgtaa

SEQ ID NO: 221354 - DNA, 20 bp, Artificial Sequence
  Description of Artificial Sequence: Synthetic oligonucleotide
  Target: ATXN1; (-) strand; PAM type: YTN; PAM sequence: CTG
tgttagtttttcattgctgc

SEQ ID NO: 221355 - DNA, 20 bp, Artificial Sequence
  Description of Artificial Sequence: Synthetic oligonucleotide
  Target: ATXN1; (-) strand; PAM type: YTN; PAM sequence: TTC
aaagcacctgtgttagtttt

SEQ ID NO: 221356 - DNA, 20 bp, Artificial Sequence
  Description of Artificial Sequence: Synthetic oligonucleotide
  Target: ATXN1; (-) strand; PAM type: YTN; PAM sequence: CTT
caaagcacctgtgttagttt

SEQ ID NO: 221357 - DNA, 20 bp, Artificial Sequence
  Description of Artificial Sequence: Synthetic oligonucleotide
  Target: ATXN1; (-) strand; PAM type: YTN; PAM sequence: TTC
ttcaaagcacctgtgttagt

SEQ ID NO: 221358 - DNA, 20 bp, Artificial Sequence
  Description of Artificial Sequence: Synthetic oligonucleotide
  Target: ATXN1; (-) strand; PAM type: YTN; PAM sequence: TTT
cttcaaagcacctgtgttag

SEQ ID NO: 221359 - DNA, 20 bp, Artificial Sequence
  Description of Artificial Sequence: Synthetic oligonucleotide
  Target: ATXN1; (-) strand; PAM type: YTN; PAM sequence: CTG
agtttcttcaaagcacctgt

SEQ ID NO: 221360 - DNA, 20 bp, Artificial Sequence
  Description of Artificial Sequence: Synthetic oligonucleotide
  Target: ATXN1; (-) strand; PAM type: YTN; PAM sequence: TTA
gaggtgacctgagtttcttc

SEQ ID NO: 221361 - DNA, 20 bp, Artificial Sequence
  Description of Artificial Sequence: Synthetic oligonucleotide
  Target: ATXN1; (-) strand; PAM type: YTN; PAM sequence: TTG
tgttagaggtgacctgagtt

SEQ ID NO: 221362 - DNA, 20 bp, Artificial Sequence
  Description of Artificial Sequence: Synthetic oligonucleotide
  Target: ATXN1; (-) strand; PAM type: YTN; PAM sequence: TTT
gtgttagaggtgacctgagt

SEQ ID NO: 221363 - DNA, 20 bp, Artificial Sequence
  Description of Artificial Sequence: Synthetic oligonucleotide
  Target: ATXN1; (-) strand; PAM type: YTN; PAM sequence: CTT
tgtgttagaggtgacctgag

SEQ ID NO: 221364 - DNA, 20 bp, Artificial Sequence
  Description of Artificial Sequence: Synthetic oligonucleotide
  Target: ATXN1; (-) strand; PAM type: YTN; PAM sequence: CTG
ggccatggcctttgtgttag

SEQ ID NO: 221365 - DNA, 20 bp, Artificial Sequence
  Description of Artificial Sequence: Synthetic oligonucleotide
  Target: ATXN1; (-) strand; PAM type: YTN; PAM sequence: CTG
gctgggccatggcctttgtg

SEQ ID NO: 221366 - DNA, 20 bp, Artificial Sequence
  Description of Artificial Sequence: Synthetic oligonucleotide
  Target: ATXN1; (-) strand; PAM type: YTN; PAM sequence: TTG
gtaaagccggaaagtatgtg

SEQ ID NO: 221367 - DNA, 20 bp, Artificial Sequence
  Description of Artificial Sequence: Synthetic oligonucleotide
  Target: ATXN1; (-) strand; PAM type: YTN; PAM sequence: TTT
ggtaaagccggaaagtatgt

SEQ ID NO: 221368 - DNA, 20 bp, Artificial Sequence
  Description of Artificial Sequence: Synthetic oligonucleotide
  Target: ATXN1; (-) strand; PAM type: YTN; PAM sequence: TTA
tgtgtttggtaaagccggaa

SEQ ID NO: 221369 - DNA, 20 bp, Artificial Sequence
  Description of Artificial Sequence: Synthetic oligonucleotide
  Target: ATXN1; (-) strand; PAM type: YTN; PAM sequence: TTT
atgtgtttggtaaagccgga

SEQ ID NO: 221370 - DNA, 20 bp, Artificial Sequence
  Description of Artificial Sequence: Synthetic oligonucleotide
  Target: ATXN1; (-) strand; PAM type: YTN; PAM sequence: CTT
tatgtgtttggtaaagccgg

SEQ ID NO: 221371 - DNA, 20 bp, Artificial Sequence
  Description of Artificial Sequence: Synthetic oligonucleotide
  Target: ATXN1; (-) strand; PAM type: YTN; PAM sequence: CTG
tctttatgtgtttggtaaag

SEQ ID NO: 221372 - DNA, 20 bp, Artificial Sequence
  Description of Artificial Sequence: Synthetic oligonucleotide
  Target: ATXN1; (-) strand; PAM type: YTN; PAM sequence: TTC
tgtctttatgtgtttggtaa

SEQ ID NO: 221373 - DNA, 20 bp, Artificial Sequence
  Description of Artificial Sequence: Synthetic oligonucleotide
  Target: ATXN1; (-) strand; PAM type: YTN; PAM sequence: TTG
ggattctgtctttatgtgtt

SEQ ID NO: 221374 - DNA, 20 bp, Artificial Sequence
  Description of Artificial Sequence: Synthetic oligonucleotide
  Target: ATXN1; (-) strand; PAM type: YTN; PAM sequence: TTT
gggattctgtctttatgtgt

SEQ ID NO: 221375 - DNA, 20 bp, Artificial Sequence
  Description of Artificial Sequence: Synthetic oligonucleotide
  Target: ATXN1; (-) strand; PAM type: YTN; PAM sequence: TTA
atatttgggattctgtcttt

SEQ ID NO: 221376 - DNA, 20 bp, Artificial Sequence
  Description of Artificial Sequence: Synthetic oligonucleotide
  Target: ATXN1; (-) strand; PAM type: YTN; PAM sequence: TTG
tgccaaattaatatttggga

SEQ ID NO: 221377 - DNA, 20 bp, Artificial Sequence
  Description of Artificial Sequence: Synthetic oligonucleotide
  Target: ATXN1; (-) strand; PAM type: YTN; PAM sequence: TTT
gtgccaaattaatatttggg

SEQ ID NO: 221378 - DNA, 20 bp, Artificial Sequence
  Description of Artificial Sequence: Synthetic oligonucleotide
  Target: ATXN1; (-) strand; PAM type: YTN; PAM sequence: CTA
cccgggccatatcccatttg

SEQ ID NO: 221379 - DNA, 20 bp, Artificial Sequence
  Description of Artificial Sequence: Synthetic oligonucleotide
  Target: ATXN1; (-) strand; PAM type: YTN; PAM sequence: TTG
catgaaaataaactacccgg

SEQ ID NO: 221380 - DNA, 20 bp, Artificial Sequence
  Description of Artificial Sequence: Synthetic oligonucleotide
  Target: ATXN1; (-) strand; PAM type: YTN; PAM sequence: CTG
caggcgtgagtgggaagagc

SEQ ID NO: 221381 - DNA, 20 bp, Artificial Sequence
  Description of Artificial Sequence: Synthetic oligonucleotide
  Target: ATXN1; (-) strand; PAM type: YTN; PAM sequence: TTG
acaaaggtgaggaggtaagc

SEQ ID NO: 221382 - DNA, 20 bp, Artificial Sequence
  Description of Artificial Sequence: Synthetic oligonucleotide
  Target: ATXN1; (-) strand; PAM type: YTN; PAM sequence: CTT
gacaaaggtgaggaggtaag

SEQ ID NO: 221383 - DNA, 20 bp, Artificial Sequence
  Description of Artificial Sequence: Synthetic oligonucleotide
  Target: ATXN1; (-) strand; PAM type: YTN; PAM sequence: CTG
ccttgacaaaggtgaggagg

SEQ ID NO: 221384 - DNA, 20 bp, Artificial Sequence
  Description of Artificial Sequence: Synthetic oligonucleotide
  Target: ATXN1; (-) strand; PAM type: YTN; PAM sequence: CTG
ataaatcagcctgccttgac

SEQ ID NO: 221385 - DNA, 20 bp, Artificial Sequence
  Description of Artificial Sequence: Synthetic oligonucleotide
  Target: ATXN1; (-) strand; PAM type: YTN; PAM sequence: TTC
caagctgataaatcagcctg

SEQ ID NO: 221386 - DNA, 20 bp, Artificial Sequence
  Description of Artificial Sequence: Synthetic oligonucleotide
  Target: ATXN1; (-) strand; PAM type: YTN; PAM sequence: TTT
ccaagctgataaatcagcct

SEQ ID NO: 221387 - DNA, 20 bp, Artificial Sequence
  Description of Artificial Sequence: Synthetic oligonucleotide
  Target: ATXN1; (-) strand; PAM type: YTN; PAM sequence: CTC
atagtttccaagctgataaa

SEQ ID NO: 221388 - DNA, 20 bp, Artificial Sequence
  Description of Artificial Sequence: Synthetic oligonucleotide
  Target: ATXN1; (-) strand; PAM type: YTN; PAM sequence: TTC
tcatagtttccaagctgata

SEQ ID NO: 221389 - DNA, 20 bp, Artificial Sequence
  Description of Artificial Sequence: Synthetic oligonucleotide
  Target: ATXN1; (-) strand; PAM type: YTN; PAM sequence: CTT
ctcatagtttccaagctgat

SEQ ID NO: 221390 - DNA, 20 bp, Artificial Sequence
  Description of Artificial Sequence: Synthetic oligonucleotide
  Target: ATXN1; (-) strand; PAM type: YTN; PAM sequence: TTC
cttctcatagtttccaagct

SEQ ID NO: 221391 - DNA, 20 bp, Artificial Sequence
  Description of Artificial Sequence: Synthetic oligonucleotide
  Target: ATXN1; (-) strand; PAM type: YTN; PAM sequence: TTT
ccttctcatagtttccaagc

SEQ ID NO: 221392 - DNA, 20 bp, Artificial Sequence
  Description of Artificial Sequence: Synthetic oligonucleotide
  Target: ATXN1; (-) strand; PAM type: YTN; PAM sequence: CTT
tccttctcatagtttccaag

SEQ ID NO: 221393 - DNA, 20 bp, Artificial Sequence
  Description of Artificial Sequence: Synthetic oligonucleotide
  Target: ATXN1; (-) strand; PAM type: YTN; PAM sequence: TTA
gaccctttccttctcatagt

SEQ ID NO: 221394 - DNA, 20 bp, Artificial Sequence
  Description of Artificial Sequence: Synthetic oligonucleotide
  Target: ATXN1; (-) strand; PAM type: YTN; PAM sequence: CTT
agaccctttccttctcatag

SEQ ID NO: 221395 - DNA, 20 bp, Artificial Sequence
  Description of Artificial Sequence: Synthetic oligonucleotide
  Target: ATXN1; (-) strand; PAM type: YTN; PAM sequence: CTG
ccttagaccctttccttctc

SEQ ID NO: 221396 - DNA, 20 bp, Artificial Sequence
  Description of Artificial Sequence: Synthetic oligonucleotide
  Target: ATXN1; (-) strand; PAM type: YTN; PAM sequence: TTG
agaaaccctgccttagaccc

SEQ ID NO: 221397 - DNA, 20 bp, Artificial Sequence
  Description of Artificial Sequence: Synthetic oligonucleotide
  Target: ATXN1; (-) strand; PAM type: YTN; PAM sequence: CTG
gagttgagaaaccctgcctt

SEQ ID NO: 221398 - DNA, 20 bp, Artificial Sequence
  Description of Artificial Sequence: Synthetic oligonucleotide
  Target: ATXN1; (-) strand; PAM type: YTN; PAM sequence: TTA
atagtgctggagttgagaaa

SEQ ID NO: 221399 - DNA, 20 bp, Artificial Sequence
  Description of Artificial Sequence: Synthetic oligonucleotide
  Target: ATXN1; (-) strand; PAM type: YTN; PAM sequence: CTG
gcccaaaatgttaatagtgc

SEQ ID NO: 221400 - DNA, 20 bp, Artificial Sequence
  Description of Artificial Sequence: Synthetic oligonucleotide
  Target: ATXN1; (-) strand; PAM type: YTN; PAM sequence: CTC
aaccaaggatcatctggccc

SEQ ID NO: 221401 - DNA, 20 bp, Artificial Sequence
  Description of Artificial Sequence: Synthetic oligonucleotide
  Target: ATXN1; (-) strand; PAM type: YTN; PAM sequence: CTG
cctcaaccaaggatcatctg

SEQ ID NO: 221402 - DNA, 20 bp, Artificial Sequence
  Description of Artificial Sequence: Synthetic oligonucleotide
  Target: ATXN1; (-) strand; PAM type: YTN; PAM sequence: CTC
tgcctcaaccaaggatcatc

SEQ ID NO: 221403 - DNA, 20 bp, Artificial Sequence
  Description of Artificial Sequence: Synthetic oligonucleotide
  Target: ATXN1; (-) strand; PAM type: YTN; PAM sequence: CTA
caatgcaccaaacagtcctc

SEQ ID NO: 221404 - DNA, 20 bp, Artificial Sequence
  Description of Artificial Sequence: Synthetic oligonucleotide
  Target: ATXN1; (-) strand; PAM type: YTN; PAM sequence: TTA
aaaatcaatcaatcaatcaa

SEQ ID NO: 221405 - DNA, 20 bp, Artificial Sequence
  Description of Artificial Sequence: Synthetic oligonucleotide
  Target: ATXN1; (-) strand; PAM type: YTN; PAM sequence: TTT
aaaaatcaatcaatcaatca

SEQ ID NO: 221406 - DNA, 20 bp, Artificial Sequence
  Description of Artificial Sequence: Synthetic oligonucleotide
  Target: ATXN1; (-) strand; PAM type: YTN; PAM sequence: TTT
taaaaatcaatcaatcaatc

SEQ ID NO: 221407 - DNA, 20 bp, Artificial Sequence
  Description of Artificial Sequence: Synthetic oligonucleotide
  Target: ATXN1; (-) strand; PAM type: YTN; PAM sequence: TTT
ttaaaaatcaatcaatcaat

SEQ ID NO: 221408 - DNA, 20 bp, Artificial Sequence
  Description of Artificial Sequence: Synthetic oligonucleotide
  Target: ATXN1; (-) strand; PAM type: YTN; PAM sequence: TTG
aatgaatgaatgaatgaatg

SEQ ID NO: 221409 - DNA, 20 bp, Artificial Sequence
  Description of Artificial Sequence: Synthetic oligonucleotide
  Target: ATXN1; (-) strand; PAM type: YTN; PAM sequence: CTT
gaatgaatgaatgaatgaat

SEQ ID NO: 221410 - DNA, 20 bp, Artificial Sequence
  Description of Artificial Sequence: Synthetic oligonucleotide
  Target: ATXN1; (-) strand; PAM type: YTN; PAM sequence: CTC
ttgaatgaatgaatgaatga

SEQ ID NO: 221411 - DNA, 20 bp, Artificial Sequence
  Description of Artificial Sequence: Synthetic oligonucleotide
  Target: ATXN1; (-) strand; PAM type: YTN; PAM sequence: CTG
ggcagcagagtcaggggtct

SEQ ID NO: 221412 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcagcagagtca

SEQ ID NO: 221413 - DNA, 20 bp, Artificial Sequence
  Description of Artificial Sequence: Synthetic oligonucleotide
  Target: ATXN1; (-) strand; PAM type: YTN; PAM sequence: CTA
cactccagcctgggcagcag

SEQ ID NO: 221414 - DNA, 20 bp, Artificial Sequence
  Description of Artificial Sequence: Synthetic oligonucleotide
  Target: ATXN1; (-) strand; PAM type: YTN; PAM sequence: CTG
tgatggcgtcactacactcc

SEQ ID NO: 221415 - DNA, 20 bp, Artificial Sequence
  Description of Artificial Sequence: Synthetic oligonucleotide
  Target: ATXN1; (-) strand; PAM type: YTN; PAM sequence: CTG
cagtgagctgtgatggcgtc

SEQ ID NO: 221416 - DNA, 20 bp, Artificial Sequence
  Description of Artificial Sequence: Synthetic oligonucleotide
  Target: ATXN1; (-) strand; PAM type: YTN; PAM sequence: TTG
aggctgcagtgagctgtgat

SEQ ID NO: 221417 - DNA, 20 bp, Artificial Sequence
  Description of Artificial Sequence: Synthetic oligonucleotide
  Target: ATXN1; (-) strand; PAM type: YTN; PAM sequence: TTT
gaggctgcagtgagctgtga

SEQ ID NO: 221418 - DNA, 20 bp, Artificial Sequence
  Description of Artificial Sequence: Synthetic oligonucleotide
  Target: ATXN1; (-) strand; PAM type: YTN; PAM sequence: CTC
aggagtttgaggctgcagtg

SEQ ID NO: 221419 - DNA, 20 bp, Artificial Sequence
  Description of Artificial Sequence: Synthetic oligonucleotide
  Target: ATXN1; (-) strand; PAM type: YTN; PAM sequence: CTG
agctcaggagtttgaggctg

SEQ ID NO: 221420 - DNA, 20 bp, Artificial Sequence
  Description of Artificial Sequence: Synthetic oligonucleotide
  Target: ATXN1; (-) strand; PAM type: YTN; PAM sequence: TTA
ggaggtcgaggcaggaggat

SEQ ID NO: 221421 - DNA, 20 bp, Artificial Sequence
  Description of Artificial Sequence: Synthetic oligonucleotide
  Target: ATXN1; (-) strand; PAM type: YTN; PAM sequence: TTT
aggaggtcgaggcaggagga

SEQ ID NO: 221422 - DNA, 20 bp, Artificial Sequence
  Description of Artificial Sequence: Synthetic oligonucleotide
  Target: ATXN1; (-) strand; PAM type: YTN; PAM sequence: CTT
taggaggtcgaggcaggagg

SEQ ID NO: 221423 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttaggag

SEQ ID NO: 221424 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccagcact

SEQ ID NO: 221425 - DNA, 20 bp, Artificial Sequence
  Description of Artificial Sequence: Synthetic oligonucleotide
  Target: ATXN1; (-) strand; PAM type: YTN; PAM sequence: TTG
gctcacacctgtaatcccag

SEQ ID NO: 221426 - DNA, 20 bp, Artificial Sequence
  Description of Artificial Sequence: Synthetic oligonucleotide
  Target: ATXN1; (-) strand; PAM type: YTN; PAM sequence: CTG
ggggcattggctcacacctg

SEQ ID NO: 221427 - DNA, 20 bp, Artificial Sequence
  Description of Artificial Sequence: Synthetic oligonucleotide
  Target: ATXN1; (-) strand; PAM type: YTN; PAM sequence: CTG
caatggggctgggggcattg

SEQ ID NO: 221428 - DNA, 20 bp, Artificial Sequence
  Description of Artificial Sequence: Synthetic oligonucleotide
  Target: ATXN1; (-) strand; PAM type: YTN; PAM sequence: CTG
aacatcctgcaatggggctg

SEQ ID NO: 221429 - DNA, 20 bp, Artificial Sequence
  Description of Artificial Sequence: Synthetic oligonucleotide
  Target: ATXN1; (-) strand; PAM type: YTN; PAM sequence: CTG
ctgaacatcctgcaatgggg

SEQ ID NO: 221430 - DNA, 20 bp, Artificial Sequence
  Description of Artificial Sequence: Synthetic oligonucleotide
  Target: ATXN1; (-) strand; PAM type: YTN; PAM sequence: CTA
gtgagtagaggccagaaatg

SEQ ID NO: 221431 - DNA, 20 bp, Artificial Sequence
  Description of Artificial Sequence: Synthetic oligonucleotide
  Target: ATXN1; (-) strand; PAM type: YTN; PAM sequence: CTG
gcatctagtgagtagaggcc

SEQ ID NO: 221432 - DNA, 20 bp, Artificial Sequence
  Description of Artificial Sequence: Synthetic oligonucleotide
  Target: ATXN1; (-) strand; PAM type: YTN; PAM sequence: TTG
atcgtcccaaatgggaaaac

SEQ ID NO: 221433 - DNA, 20 bp, Artificial Sequence
  Description of Artificial Sequence: Synthetic oligonucleotide
  Target: ATXN1; (-) strand; PAM type: YTN; PAM sequence: TTT
gatcgtcccaaatgggaaaa

SEQ ID NO: 221434 - DNA, 20 bp, Artificial Sequence
  Description of Artificial Sequence: Synthetic oligonucleotide
  Target: ATXN1; (-) strand; PAM type: YTN; PAM sequence: TTT
tgatcgtcccaaatgggaaa

SEQ ID NO: 221435 - DNA, 20 bp, Artificial Sequence
  Description of Artificial Sequence: Synthetic oligonucleotide
  Target: ATXN1; (-) strand; PAM type: YTN; PAM sequence: TTT
ttgatcgtcccaaatgggaa

SEQ ID NO: 221436 - DNA, 20 bp, Artificial Sequence
  Description of Artificial Sequence: Synthetic oligonucleotide
  Target: ATXN1; (-) strand; PAM type: YTN; PAM sequence: CTT
tttgatcgtcccaaatggga

SEQ ID NO: 221437 - DNA, 20 bp, Artificial Sequence
  Description of Artificial Sequence: Synthetic oligonucleotide
  Target: ATXN1; (-) strand; PAM type: YTN; PAM sequence: TTG
gagacactttttgatcgtcc

SEQ ID NO: 221438 - DNA, 20 bp, Artificial Sequence
  Description of Artificial Sequence: Synthetic oligonucleotide
  Target: ATXN1; (-) strand; PAM type: YTN; PAM sequence: TTT
ggagacactttttgatcgtc

SEQ ID NO: 221439 - DNA, 20 bp, Artificial Sequence
  Description of Artificial Sequence: Synthetic oligonucleotide
  Target: ATXN1; (-) strand; PAM type: YTN; PAM sequence: TTG
gcaatgtttggagacacttt

SEQ ID NO: 221440 - DNA, 20 bp, Artificial Sequence
  Description of Artificial Sequence: Synthetic oligonucleotide
  Target: ATXN1; (-) strand; PAM type: YTN; PAM sequence: TTT
ggcaatgtttggagacactt

SEQ ID NO: 221441 - DNA, 20 bp, Artificial Sequence
  Description of Artificial Sequence: Synthetic oligonucleotide
  Target: ATXN1; (-) strand; PAM type: YTN; PAM sequence: CTC
aggacatttggcaatgtttg

SEQ ID NO: 221442 - DNA, 20 bp, Artificial Sequence
  Description of Artificial Sequence: Synthetic oligonucleotide
  Target: ATXN1; (-) strand; PAM type: YTN; PAM sequence: CTC
tcaggacatttggcaatgtt

SEQ ID NO: 221443 - DNA, 20 bp, Artificial Sequence
  Description of Artificial Sequence: Synthetic oligonucleotide
  Target: ATXN1; (-) strand; PAM type: YTN; PAM sequence: TTG
ccctctcaggacatttggca

SEQ ID NO: 221444 - DNA, 20 bp, Artificial Sequence
  Description of Artificial Sequence: Synthetic oligonucleotide
  Target: ATXN1; (-) strand; PAM type: YTN; PAM sequence: TTT
gccctctcaggacatttggc

SEQ ID NO: 221445 - DNA, 20 bp, Artificial Sequence
  Description of Artificial Sequence: Synthetic oligonucleotide
  Target: ATXN1; (-) strand; PAM type: YTN; PAM sequence: TTT
tgccctctcaggacatttgg

SEQ ID NO: 221446 - DNA, 20 bp, Artificial Sequence
  Description of Artificial Sequence: Synthetic oligonucleotide
  Target: ATXN1; (-) strand; PAM type: YTN; PAM sequence: CTG
gggaccattttgccctctca

SEQ ID NO: 221447 - DNA, 20 bp, Artificial Sequence
  Description of Artificial Sequence: Synthetic oligonucleotide
  Target: ATXN1; (-) strand; PAM type: YTN; PAM sequence: CTC
aactggggaccattttgccc

SEQ ID NO: 221448 - DNA, 20 bp, Artificial Sequence
  Description of Artificial Sequence: Synthetic oligonucleotide
  Target: ATXN1; (-) strand; PAM type: YTN; PAM sequence: CTG
tcaaccagtggatctcaact

SEQ ID NO: 221449 - DNA, 20 bp, Artificial Sequence
  Description of Artificial Sequence: Synthetic oligonucleotide
  Target: ATXN1; (-) strand; PAM type: YTN; PAM sequence: CTG
ccacatgctgtcaaccagtg

SEQ ID NO: 221450 - DNA, 20 bp, Artificial Sequence
  Description of Artificial Sequence: Synthetic oligonucleotide
  Target: ATXN1; (-) strand; PAM type: YTN; PAM sequence: TTA
actgccacatgctgtcaacc

SEQ ID NO: 221451 - DNA, 20 bp, Artificial Sequence
  Description of Artificial Sequence: Synthetic oligonucleotide
  Target: ATXN1; (-) strand; PAM type: YTN; PAM sequence: CTG
atggagagaacacagaccac

SEQ ID NO: 221452 - DNA, 20 bp, Artificial Sequence
  Description of Artificial Sequence: Synthetic oligonucleotide
  Target: ATXN1; (-) strand; PAM type: YTN; PAM sequence: TTC
catgtatgggagggaactga

SEQ ID NO: 221453 - DNA, 20 bp, Artificial Sequence
  Description of Artificial Sequence: Synthetic oligonucleotide
  Target: ATXN1; (-) strand; PAM type: YTN; PAM sequence: TTT
ccatgtatgggagggaactg

SEQ ID NO: 221454 - DNA, 20 bp, Artificial Sequence
  Description of Artificial Sequence: Synthetic oligonucleotide
  Target: ATXN1; (-) strand; PAM type: YTN; PAM sequence: TTA
gagcatttccatgtatggga

SEQ ID NO: 221455 - DNA, 20 bp, Artificial Sequence
  Description of Artificial Sequence: Synthetic oligonucleotide
  Target: ATXN1; (-) strand; PAM type: YTN; PAM sequence: TTG
aatgagaccagcagcaatgt

SEQ ID NO: 221456 - DNA, 20 bp, Artificial Sequence
  Description of Artificial Sequence: Synthetic oligonucleotide
  Target: ATXN1; (-) strand; PAM type: YTN; PAM sequence: TTT
gaatgagaccagcagcaatg

SEQ ID NO: 221457 - DNA, 20 bp, Artificial Sequence
  Description of Artificial Sequence: Synthetic oligonucleotide
  Target: ATXN1; (-) strand; PAM type: YTN; PAM sequence: CTC
atttgaatgagaccagcagc

SEQ ID NO: 221458 - DNA, 20 bp, Artificial Sequence
  Description of Artificial Sequence: Synthetic oligonucleotide
  Target: ATXN1; (-) strand; PAM type: YTN; PAM sequence: TTG
ggagactcatttgaatgaga

SEQ ID NO: 221459 - DNA, 20 bp, Artificial Sequence
  Description of Artificial Sequence: Synthetic oligonucleotide
  Target: ATXN1; (-) strand; PAM type: YTN; PAM sequence: CTT
gggagactcatttgaatgag

SEQ ID NO: 221460 - DNA, 20 bp, Artificial Sequence
  Description of Artificial Sequence: Synthetic oligonucleotide
  Target: ATXN1; (-) strand; PAM type: YTN; PAM sequence: CTG
aatccttgggagactcattt

SEQ ID NO: 221461 - DNA, 20 bp, Artificial Sequence
  Description of Artificial Sequence: Synthetic oligonucleotide
  Target: ATXN1; (-) strand; PAM type: YTN; PAM sequence: TTA
aaatgtcaaacagactgaat

SEQ ID NO: 221462 - DNA, 20 bp, Artificial Sequence
  Description of Artificial Sequence: Synthetic oligonucleotide
  Target: ATXN1; (-) strand; PAM type: YTN; PAM sequence: TTT
aaaatgtcaaacagactgaa

SEQ ID NO: 221463 - DNA, 20 bp, Artificial Sequence
  Description of Artificial Sequence: Synthetic oligonucleotide
  Target: ATXN1; (-) strand; PAM type: YTN; PAM sequence: TTT
taaaatgtcaaacagactga

SEQ ID NO: 221464 - DNA, 20 bp, Artificial Sequence
  Description of Artificial Sequence: Synthetic oligonucleotide
  Target: ATXN1; (-) strand; PAM type: YTN; PAM sequence: CTG
ttttaaaatgtcaaacagac

SEQ ID NO: 221465 - DNA, 20 bp, Artificial Sequence
  Description of Artificial Sequence: Synthetic oligonucleotide
  Target: ATXN1; (-) strand; PAM type: YTN; PAM sequence: TTG
agctgttttaaaatgtcaaa

SEQ ID NO: 221466 - DNA, 20 bp, Artificial Sequence
  Description of Artificial Sequence: Synthetic oligonucleotide
  Target: ATXN1; (-) strand; PAM type: YTN; PAM sequence: TTT
gagctgttttaaaatgtcaa

SEQ ID NO: 221467 - DNA, 20 bp, Artificial Sequence
  Description of Artificial Sequence: Synthetic oligonucleotide
  Target: ATXN1; (-) strand; PAM type: YTN; PAM sequence: CTG
agtttgagctgttttaaaat

SEQ ID NO: 221468 - DNA, 20 bp, Artificial Sequence
  Description of Artificial Sequence: Synthetic oligonucleotide
  Target: ATXN1; (-) strand; PAM type: YTN; PAM sequence: TTC
tgagtttgagctgttttaaa

SEQ ID NO: 221469 - DNA, 20 bp, Artificial Sequence
  Description of Artificial Sequence: Synthetic oligonucleotide
  Target: ATXN1; (-) strand; PAM type: YTN; PAM sequence: TTG
aattctgagtttgagctgtt

SEQ ID NO: 221470 - DNA, 20 bp, Artificial Sequence
  Description of Artificial Sequence: Synthetic oligonucleotide
  Target: ATXN1; (-) strand; PAM type: YTN; PAM sequence: CTG
tggttgaattctgagtttga

SEQ ID NO: 221471 - DNA, 20 bp, Artificial Sequence
  Description of Artificial Sequence: Synthetic oligonucleotide
  Target: ATXN1; (-) strand; PAM type: YTN; PAM sequence: TTA
aaaaaaagtcctgtggttga

SEQ ID NO: 221472 - DNA, 20 bp, Artificial Sequence
  Description of Artificial Sequence: Synthetic oligonucleotide
  Target: ATXN1; (-) strand; PAM type: YTN; PAM sequence: TTT
aaaaaaaagtcctgtggttg

SEQ ID NO: 221473 - DNA, 20 bp, Artificial Sequence
  Description of Artificial Sequence: Synthetic oligonucleotide
  Target: ATXN1; (-) strand; PAM type: YTN; PAM sequence: TTT
taaaaaaaagtcctgtggtt

SEQ ID NO: 221474 - DNA, 20 bp, Artificial Sequence
  Description of Artificial Sequence: Synthetic oligonucleotide
  Target: ATXN1; (-) strand; PAM type: YTN; PAM sequence: CTG
ggaataagtatagtggggcc

SEQ ID NO: 221475 - DNA, 20 bp, Artificial Sequence
  Description of Artificial Sequence: Synthetic oligonucleotide
  Target: ATXN1; (-) strand; PAM type: YTN; PAM sequence: CTG
tggctgggaataagtatagt

SEQ ID NO: 221476 - DNA, 20 bp, Artificial Sequence
  Description of Artificial Sequence: Synthetic oligonucleotide
  Target: ATXN1; (-) strand; PAM type: YTN; PAM sequence: TTG
cctgtggctgggaataagta

SEQ ID NO: 221477 - DNA, 20 bp, Artificial Sequence
  Description of Artificial Sequence: Synthetic oligonucleotide
  Target: ATXN1; (-) strand; PAM type: YTN; PAM sequence: CTT
gcctgtggctgggaataagt

SEQ ID NO: 221478 - DNA, 20 bp, Artificial Sequence
  Description of Artificial Sequence: Synthetic oligonucleotide
  Target: ATXN1; (-) strand; PAM type: YTN; PAM sequence: TTC
ccttgcctgtggctgggaat

SEQ ID NO: 221479 - DNA, 20 bp, Artificial Sequence
  Description of Artificial Sequence: Synthetic oligonucleotide
  Target: ATXN1; (-) strand; PAM type: YTN; PAM sequence: TTT
cccttgcctgtggctgggaa

SEQ ID NO: 221480 - DNA, 20 bp, Artificial Sequence
  Description of Artificial Sequence: Synthetic oligonucleotide
  Target: ATXN1; (-) strand; PAM type: YTN; PAM sequence: TTG
tggaaaagccatgtttccct

SEQ ID NO: 221481 - DNA, 20 bp, Artificial Sequence
  Description of Artificial Sequence: Synthetic oligonucleotide
  Target: ATXN1; (-) strand; PAM type: YTN; PAM sequence: CTG
cgggtcattgtggaaaagcc

SEQ ID NO: 221482 - DNA, 20 bp, Artificial Sequence
  Description of Artificial Sequence: Synthetic oligonucleotide
  Target: ATXN1; (-) strand; PAM type: YTN; PAM sequence: TTG
ggctgcgggtcattgtggaa

SEQ ID NO: 221483 - DNA, 20 bp, Artificial Sequence
  Description of Artificial Sequence: Synthetic oligonucleotide
  Target: ATXN1; (-) strand; PAM type: YTN; PAM sequence: CTA
ggttgggctgcgggtcattg

SEQ ID NO: 221484 - DNA, 20 bp, Artificial Sequence
  Description of Artificial Sequence: Synthetic oligonucleotide
  Target: ATXN1; (-) strand; PAM type: YTN; PAM sequence: TTG
gctaggttgggctgcgggtc

SEQ ID NO: 221485 - DNA, 20 bp, Artificial Sequence
  Description of Artificial Sequence: Synthetic oligonucleotide
  Target: ATXN1; (-) strand; PAM type: YTN; PAM sequence: TTG
ttggctaggttgggctgcgg

SEQ ID NO: 221486 - DNA, 20 bp, Artificial Sequence
  Description of Artificial Sequence: Synthetic oligonucleotide
  Target: ATXN1; (-) strand; PAM type: YTN; PAM sequence: CTT
gttggctaggttgggctgcg

SEQ ID NO: 221487 - DNA, 20 bp, Artificial Sequence
  Description of Artificial Sequence: Synthetic oligonucleotide
  Target: ATXN1; (-) strand; PAM type: YTN; PAM sequence: TTG
tgagcttgttggctaggttg

SEQ ID NO: 221488 - DNA, 20 bp, Artificial Sequence
  Description of Artificial Sequence: Synthetic oligonucleotide
  Target: ATXN1; (-) strand; PAM type: YTN; PAM sequence: CTG
tagcagcagtatggatgaat

SEQ ID NO: 221489 - DNA, 20 bp, Artificial Sequence
  Description of Artificial Sequence: Synthetic oligonucleotide
  Target: ATXN1; (-) strand; PAM type: YTN; PAM sequence: CTC
tgtagcagcagtatggatga

SEQ ID NO: 221490 - DNA, 20 bp, Artificial Sequence
  Description of Artificial Sequence: Synthetic oligonucleotide
  Target: ATXN1; (-) strand; PAM type: YTN; PAM sequence: CTG
tcgcctctgtagcagcagta

SEQ ID NO: 221491 - DNA, 20 bp, Artificial Sequence
  Description of Artificial Sequence: Synthetic oligonucleotide
  Target: ATXN1; (-) strand; PAM type: YTN; PAM sequence: CTC
tgtcgcctctgtagcagcag

SEQ ID NO: 221492 - DNA, 20 bp, Artificial Sequence
  Description of Artificial Sequence: Synthetic oligonucleotide
  Target: ATXN1; (-) strand; PAM type: YTN; PAM sequence: CTG
acctctgtcgcctctgtagc

SEQ ID NO: 221493 - DNA, 20 bp, Artificial Sequence
  Description of Artificial Sequence: Synthetic oligonucleotide
  Target: ATXN1; (-) strand; PAM type: YTN; PAM sequence: CTG
taacagtcaaatagcaagtg

SEQ ID NO: 221494 - DNA, 20 bp, Artificial Sequence
  Description of Artificial Sequence: Synthetic oligonucleotide
  Target: ATXN1; (-) strand; PAM type: YTN; PAM sequence: CTC
tgtaacagtcaaatagcaag

SEQ ID NO: 221495 - DNA, 20 bp, Artificial Sequence
  Description of Artificial Sequence: Synthetic oligonucleotide
  Target: ATXN1; (-) strand; PAM type: YTN; PAM sequence: TTC
tctgtaacagtcaaatagca

SEQ ID NO: 221496 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaaaaaa

SEQ ID NO: 221497 - DNA, 20 bp, Artificial Sequence
  Description of Artificial Sequence: Synthetic oligonucleotide
  Target: ATXN1; (-) strand; PAM type: YTN; PAM sequence: CTC
cgtctcaaaaaaaaaaaaaa

SEQ ID NO: 221498 - DNA, 20 bp, Artificial Sequence
  Description of Artificial Sequence: Synthetic oligonucleotide
  Target: ATXN1; (-) strand; PAM type: YTN; PAM sequence: CTG
gcaacagagcgagactccgt

SEQ ID NO: 221499 - DNA, 20 bp, Artificial Sequence
  Description of Artificial Sequence: Synthetic oligonucleotide
  Target: ATXN1; (-) strand; PAM type: YTN; PAM sequence: CTC
cagcctggcaacagagcgag

SEQ ID NO: 221500 - DNA, 20 bp, Artificial Sequence
  Description of Artificial Sequence: Synthetic oligonucleotide
  Target: ATXN1; (-) strand; PAM type: YTN; PAM sequence: CTG
cactccagcctggcaacaga

SEQ ID NO: 221501 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatcacacc

SEQ ID NO: 221502 - DNA, 20 bp, Artificial Sequence
  Description of Artificial Sequence: Synthetic oligonucleotide
  Target: ATXN1; (-) strand; PAM type: YTN; PAM sequence: TTG
cagtgttgcagtgagccgag

SEQ ID NO: 221503 - DNA, 20 bp, Artificial Sequence
  Description of Artificial Sequence: Synthetic oligonucleotide
  Target: ATXN1; (-) strand; PAM type: YTN; PAM sequence: CTT
gcagtgttgcagtgagccga

SEQ ID NO: 221504 - DNA, 20 bp, Artificial Sequence
  Description of Artificial Sequence: Synthetic oligonucleotide
  Target: ATXN1; (-) strand; PAM type: YTN; PAM sequence: TTG
aacccatgaggcggagcttg

SEQ ID NO: 221505 - DNA, 20 bp, Artificial Sequence
  Description of Artificial Sequence: Synthetic oligonucleotide
  Target: ATXN1; (-) strand; PAM type: YTN; PAM sequence: CTT
gaacccatgaggcggagctt

SEQ ID NO: 221506 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgcttgaa

SEQ ID NO: 221507 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagaat

SEQ ID NO: 221508 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagaa

SEQ ID NO: 221509 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcagga

SEQ ID NO: 221510 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacttgggag

SEQ ID NO: 221511 - DNA, 20 bp, Artificial Sequence
  Description of Artificial Sequence: Synthetic oligonucleotide
  Target: ATXN1; (-) strand; PAM type: YTN; PAM sequence: CTG
ggcgtggtggtgggcgcctg

SEQ ID NO: 221512 - DNA, 20 bp, Artificial Sequence
  Description of Artificial Sequence: Synthetic oligonucleotide
  Target: ATXN1; (-) strand; PAM type: YTN; PAM sequence: TTA
gctgggcgtggtggtgggcg

SEQ ID NO: 221513 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaaaaaaaaa

SEQ ID NO: 221514 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaaaaaa

SEQ ID NO: 221515 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaaaaa

SEQ ID NO: 221516 - DNA, 20 bp, Artificial Sequence
  Description of Artificial Sequence: Synthetic oligonucleotide
  Target: ATXN1; (-) strand; PAM type: YTN; PAM sequence: CTA
atacagtgaaaccccgtctc

SEQ ID NO: 221517 - DNA, 20 bp, Artificial Sequence
  Description of Artificial Sequence: Synthetic oligonucleotide
  Target: ATXN1; (-) strand; PAM type: YTN; PAM sequence: CTA
gctaatacagtgaaaccccg

SEQ ID NO: 221518 - DNA, 20 bp, Artificial Sequence
  Description of Artificial Sequence: Synthetic oligonucleotide
  Target: ATXN1; (-) strand; PAM type: YTN; PAM sequence: TTG
agaccagcctagctaataca

SEQ ID NO: 221519 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctagctaatac

SEQ ID NO: 221520 - DNA, 20 bp, Artificial Sequence
  Description of Artificial Sequence: Synthetic oligonucleotide
  Target: ATXN1; (-) strand; PAM type: YTN; PAM sequence: TTC
ggaggccaaggtgggcagat

SEQ ID NO: 221521 - DNA, 20 bp, Artificial Sequence
  Description of Artificial Sequence: Synthetic oligonucleotide
  Target: ATXN1; (-) strand; PAM type: YTN; PAM sequence: TTT
cggaggccaaggtgggcaga

SEQ ID NO: 221522 - DNA, 20 bp, Artificial Sequence
  Description of Artificial Sequence: Synthetic oligonucleotide
  Target: ATXN1; (-) strand; PAM type: YTN; PAM sequence: TTT
tcggaggccaaggtgggcag

SEQ ID NO: 221523 - DNA, 20 bp, Artificial Sequence
  Description of Artificial Sequence: Synthetic oligonucleotide
  Target: ATXN1; (-) strand; PAM type: YTN; PAM sequence: CTA
taatcccagcattttcggag

SEQ ID NO: 221524 - DNA, 20 bp, Artificial Sequence
  Description of Artificial Sequence: Synthetic oligonucleotide
  Target: ATXN1; (-) strand; PAM type: YTN; PAM sequence: CTC
aagcctataatcccagcatt

SEQ ID NO: 221525 - DNA, 20 bp, Artificial Sequence
  Description of Artificial Sequence: Synthetic oligonucleotide
  Target: ATXN1; (-) strand; PAM type: YTN; PAM sequence: CTG
taggcagggcgtggtggctc

SEQ ID NO: 221526 - DNA, 20 bp, Artificial Sequence
  Description of Artificial Sequence: Synthetic oligonucleotide
  Target: ATXN1; (-) strand; PAM type: YTN; PAM sequence: CTC
tgtaggcagggcgtggtggc

SEQ ID NO: 221527 - DNA, 20 bp, Artificial Sequence
  Description of Artificial Sequence: Synthetic oligonucleotide
  Target: ATXN1; (-) strand; PAM type: YTN; PAM sequence: TTC
tctgtaggcagggcgtggtg

SEQ ID NO: 221528 - DNA, 20 bp, Artificial Sequence
  Description of Artificial Sequence: Synthetic oligonucleotide
  Target: ATXN1; (-) strand; PAM type: YTN; PAM sequence: TTA
ggaagttctctgtaggcagg

SEQ ID NO: 221529 - DNA, 20 bp, Artificial Sequence
  Description of Artificial Sequence: Synthetic oligonucleotide
  Target: ATXN1; (-) strand; PAM type: YTN; PAM sequence: TTT
aggaagttctctgtaggcag

SEQ ID NO: 221530 - DNA, 20 bp, Artificial Sequence
  Description of Artificial Sequence: Synthetic oligonucleotide
  Target: ATXN1; (-) strand; PAM type: YTN; PAM sequence: CTT
taggaagttctctgtaggca

SEQ ID NO: 221531 - DNA, 20 bp, Artificial Sequence
  Description of Artificial Sequence: Synthetic oligonucleotide
  Target: ATXN1; (-) strand; PAM type: YTN; PAM sequence: TTG
cagtgaactttaggaagttc

SEQ ID NO: 221532 - DNA, 20 bp, Artificial Sequence
  Description of Artificial Sequence: Synthetic oligonucleotide
  Target: ATXN1; (-) strand; PAM type: YTN; PAM sequence: CTA
ggtaataaagttgcagtgaa

SEQ ID NO: 221533 - DNA, 20 bp, Artificial Sequence
  Description of Artificial Sequence: Synthetic oligonucleotide
  Target: ATXN1; (-) strand; PAM type: YTN; PAM sequence: TTA
atgaaatctaggtaataaag

SEQ ID NO: 221534 - DNA, 20 bp, Artificial Sequence
  Description of Artificial Sequence: Synthetic oligonucleotide
  Target: ATXN1; (-) strand; PAM type: YTN; PAM sequence: TTA
ttaatgaaatctaggtaata

SEQ ID NO: 221535 - DNA, 20 bp, Artificial Sequence
  Description of Artificial Sequence: Synthetic oligonucleotide
  Target: ATXN1; (-) strand; PAM type: YTN; PAM sequence: TTT
attaatgaaatctaggtaat

SEQ ID NO: 221536 - DNA, 20 bp, Artificial Sequence
  Description of Artificial Sequence: Synthetic oligonucleotide
  Target: ATXN1; (-) strand; PAM type: YTN; PAM sequence: TTT
tattaatgaaatctaggtaa

SEQ ID NO: 221537 - DNA, 20 bp, Artificial Sequence
  Description of Artificial Sequence: Synthetic oligonucleotide
  Target: ATXN1; (-) strand; PAM type: YTN; PAM sequence: TTT
ttattaatgaaatctaggta

SEQ ID NO: 221538 - DNA, 20 bp, Artificial Sequence
  Description of Artificial Sequence: Synthetic oligonucleotide
  Target: ATXN1; (-) strand; PAM type: YTN; PAM sequence: TTG
aaaggatttttattaatgaa

SEQ ID NO: 221539 - DNA, 20 bp, Artificial Sequence
  Description of Artificial Sequence: Synthetic oligonucleotide
  Target: ATXN1; (-) strand; PAM type: YTN; PAM sequence: CTG
attgaaaggatttttattaa

SEQ ID NO: 221540 - DNA, 20 bp, Artificial Sequence
  Description of Artificial Sequence: Synthetic oligonucleotide
  Target: ATXN1; (-) strand; PAM type: YTN; PAM sequence: TTC
tgattgaaaggatttttatt

SEQ ID NO: 221541 - DNA, 20 bp, Artificial Sequence
  Description of Artificial Sequence: Synthetic oligonucleotide
  Target: ATXN1; (-) strand; PAM type: YTN; PAM sequence: CTT
ctgattgaaaggatttttat

SEQ ID NO: 221542 - DNA, 20 bp, Artificial Sequence
  Description of Artificial Sequence: Synthetic oligonucleotide
  Target: ATXN1; (-) strand; PAM type: YTN; PAM sequence: CTA
aaccttctgattgaaaggat

SEQ ID NO: 221543 - DNA, 20 bp, Artificial Sequence
  Description of Artificial Sequence: Synthetic oligonucleotide
  Target: ATXN1; (-) strand; PAM type: YTN; PAM sequence: CTG
tgctaaaccttctgattgaa

SEQ ID NO: 221544 - DNA, 20 bp, Artificial Sequence
  Description of Artificial Sequence: Synthetic oligonucleotide
  Target: ATXN1; (-) strand; PAM type: YTN; PAM sequence: CTA
cactgtgctaaaccttctga

SEQ ID NO: 221545 - DNA, 20 bp, Artificial Sequence
  Description of Artificial Sequence: Synthetic oligonucleotide
  Target: ATXN1; (-) strand; PAM type: YTN; PAM sequence: TTG
gtctacactgtgctaaacct

SEQ ID NO: 221546 - DNA, 20 bp, Artificial Sequence
  Description of Artificial Sequence: Synthetic oligonucleotide
  Target: ATXN1; (-) strand; PAM type: YTN; PAM sequence: TTT
ggtctacactgtgctaaacc

SEQ ID NO: 221547 - DNA, 20 bp, Artificial Sequence
  Description of Artificial Sequence: Synthetic oligonucleotide
  Target: ATXN1; (-) strand; PAM type: YTN; PAM sequence: CTT
tggtctacactgtgctaaac

SEQ ID NO: 221548 - DNA, 20 bp, Artificial Sequence
  Description of Artificial Sequence: Synthetic oligonucleotide
  Target: ATXN1; (-) strand; PAM type: YTN; PAM sequence: CTC
tttggtctacactgtgctaa

SEQ ID NO: 221549 - DNA, 20 bp, Artificial Sequence
  Description of Artificial Sequence: Synthetic oligonucleotide
  Target: ATXN1; (-) strand; PAM type: YTN; PAM sequence: TTC
agtgaatgatctctttggtc

SEQ ID NO: 221550 - DNA, 20 bp, Artificial Sequence
  Description of Artificial Sequence: Synthetic oligonucleotide
  Target: ATXN1; (-) strand; PAM type: YTN; PAM sequence: TTT
cagtgaatgatctctttggt

SEQ ID NO: 221551 - DNA, 20 bp, Artificial Sequence
  Description of Artificial Sequence: Synthetic oligonucleotide
  Target: ATXN1; (-) strand; PAM type: YTN; PAM sequence: CTT
tcagtgaatgatctctttgg

SEQ ID NO: 221552 - DNA, 20 bp, Artificial Sequence
  Description of Artificial Sequence: Synthetic oligonucleotide
  Target: ATXN1; (-) strand; PAM type: YTN; PAM sequence: TTG
ccatcagagccagcctttca

SEQ ID NO: 221553 - DNA, 20 bp, Artificial Sequence
  Description of Artificial Sequence: Synthetic oligonucleotide
  Target: ATXN1; (-) strand; PAM type: YTN; PAM sequence: TTT
gccatcagagccagcctttc

SEQ ID NO: 221554 - DNA, 20 bp, Artificial Sequence
  Description of Artificial Sequence: Synthetic oligonucleotide
  Target: ATXN1; (-) strand; PAM type: YTN; PAM sequence: TTT
tgccatcagagccagccttt

SEQ ID NO: 221555 - DNA, 20 bp, Artificial Sequence
  Description of Artificial Sequence: Synthetic oligonucleotide
  Target: ATXN1; (-) strand; PAM type: YTN; PAM sequence: CTG
ttttgccatcagagccagcc

SEQ ID NO: 221556 - DNA, 20 bp, Artificial Sequence
  Description of Artificial Sequence: Synthetic oligonucleotide
  Target: ATXN1; (-) strand; PAM type: YTN; PAM sequence: TTC
caaaccatctgttttgccat

SEQ ID NO: 221557 - DNA, 20 bp, Artificial Sequence
  Description of Artificial Sequence: Synthetic oligonucleotide
  Target: ATXN1; (-) strand; PAM type: YTN; PAM sequence: CTC
attccaaaccatctgttttg

SEQ ID NO: 221558 - DNA, 20 bp, Artificial Sequence
  Description of Artificial Sequence: Synthetic oligonucleotide
  Target: ATXN1; (-) strand; PAM type: YTN; PAM sequence: TTC
ccaggatctcattccaaacc

SEQ ID NO: 221559 - DNA, 20 bp, Artificial Sequence
  Description of Artificial Sequence: Synthetic oligonucleotide
  Target: ATXN1; (-) strand; PAM type: YTN; PAM sequence: TTT
cccaggatctcattccaaac

SEQ ID NO: 221560 - DNA, 20 bp, Artificial Sequence
  Description of Artificial Sequence: Synthetic oligonucleotide
  Target: ATXN1; (-) strand; PAM type: YTN; PAM sequence: CTC
cagtacagtggccatttccc

SEQ ID NO: 221561 - DNA, 20 bp, Artificial Sequence
  Description of Artificial Sequence: Synthetic oligonucleotide
  Target: ATXN1; (-) strand; PAM type: YTN; PAM sequence: TTA
ctccagtacagtggccattt

SEQ ID NO: 221562 - DNA, 20 bp, Artificial Sequence
  Description of Artificial Sequence: Synthetic oligonucleotide
  Target: ATXN1; (-) strand; PAM type: YTN; PAM sequence: CTT
actccagtacagtggccatt

SEQ ID NO: 221563 - DNA, 20 bp, Artificial Sequence
  Description of Artificial Sequence: Synthetic oligonucleotide
  Target: ATXN1; (-) strand; PAM type: YTN; PAM sequence: TTC
ttactccagtacagtggcca

SEQ ID NO: 221564 - DNA, 20 bp, Artificial Sequence
  Description of Artificial Sequence: Synthetic oligonucleotide
  Target: ATXN1; (-) strand; PAM type: YTN; PAM sequence: TTT
cttactccagtacagtggcc

SEQ ID NO: 221565 - DNA, 20 bp, Artificial Sequence
  Description of Artificial Sequence: Synthetic oligonucleotide
  Target: ATXN1; (-) strand; PAM type: YTN; PAM sequence: TTG
atttcttactccagtacagt

SEQ ID NO: 221566 - DNA, 20 bp, Artificial Sequence
  Description of Artificial Sequence: Synthetic oligonucleotide
  Target: ATXN1; (-) strand; PAM type: YTN; PAM sequence: CTA
ggagcattgatttcttactc

SEQ ID NO: 221567 - DNA, 20 bp, Artificial Sequence
  Description of Artificial Sequence: Synthetic oligonucleotide
  Target: ATXN1; (-) strand; PAM type: YTN; PAM sequence: CTC
taggagcattgatttcttac

SEQ ID NO: 221568 - DNA, 20 bp, Artificial Sequence
  Description of Artificial Sequence: Synthetic oligonucleotide
  Target: ATXN1; (-) strand; PAM type: YTN; PAM sequence: TTC
tctaggagcattgatttctt

SEQ ID NO: 221569 - DNA, 20 bp, Artificial Sequence
  Description of Artificial Sequence: Synthetic oligonucleotide
  Target: ATXN1; (-) strand; PAM type: YTN; PAM sequence: TTT
ctctaggagcattgatttct

SEQ ID NO: 221570 - DNA, 20 bp, Artificial Sequence
  Description of Artificial Sequence: Synthetic oligonucleotide
  Target: ATXN1; (-) strand; PAM type: YTN; PAM sequence: CTG
tttctctaggagcattgatt

SEQ ID NO: 221571 - DNA, 20 bp, Artificial Sequence
  Description of Artificial Sequence: Synthetic oligonucleotide
  Target: ATXN1; (-) strand; PAM type: YTN; PAM sequence: CTG
aggaaatgatctgtttctct

SEQ ID NO: 221572 - DNA, 20 bp, Artificial Sequence
  Description of Artificial Sequence: Synthetic oligonucleotide
  Target: ATXN1; (-) strand; PAM type: YTN; PAM sequence: TTG
ctgaggaaatgatctgtttc

SEQ ID NO: 221573 - DNA, 20 bp, Artificial Sequence
  Description of Artificial Sequence: Synthetic oligonucleotide
  Target: ATXN1; (-) strand; PAM type: YTN; PAM sequence: CTT
gctgaggaaatgatctgttt

SEQ ID NO: 221574 - DNA, 20 bp, Artificial Sequence
  Description of Artificial Sequence: Synthetic oligonucleotide
  Target: ATXN1; (-) strand; PAM type: YTN; PAM sequence: TTG
gcaaaaacttgctgaggaaa

SEQ ID NO: 221575 - DNA, 20 bp, Artificial Sequence
  Description of Artificial Sequence: Synthetic oligonucleotide
  Target: ATXN1; (-) strand; PAM type: YTN; PAM sequence: CTT
ggcaaaaacttgctgaggaa

SEQ ID NO: 221576 - DNA, 20 bp, Artificial Sequence
  Description of Artificial Sequence: Synthetic oligonucleotide
  Target: ATXN1; (-) strand; PAM type: YTN; PAM sequence: TTC
ttggcaaaaacttgctgagg

SEQ ID NO: 221577 - DNA, 20 bp, Artificial Sequence
  Description of Artificial Sequence: Synthetic oligonucleotide
  Target: ATXN1; (-) strand; PAM type: YTN; PAM sequence: TTA
agtcatgttcttggcaaaaa

SEQ ID NO: 221578 - DNA, 20 bp, Artificial Sequence
  Description of Artificial Sequence: Synthetic oligonucleotide
  Target: ATXN1; (-) strand; PAM type: YTN; PAM sequence: TTT
aagtcatgttcttggcaaaa

SEQ ID NO: 221579 - DNA, 20 bp, Artificial Sequence
  Description of Artificial Sequence: Synthetic oligonucleotide
  Target: ATXN1; (-) strand; PAM type: YTN; PAM sequence: TTG
tttaagtcatgttcttggca

SEQ ID NO: 221580 - DNA, 20 bp, Artificial Sequence
  Description of Artificial Sequence: Synthetic oligonucleotide
  Target: ATXN1; (-) strand; PAM type: YTN; PAM sequence: TTT
gtttaagtcatgttcttggc

SEQ ID NO: 221581 - DNA, 20 bp, Artificial Sequence
  Description of Artificial Sequence: Synthetic oligonucleotide
  Target: ATXN1; (-) strand; PAM type: YTN; PAM sequence: TTC
acatgtttgtttaagtcatg

SEQ ID NO: 221582 - DNA, 20 bp, Artificial Sequence
  Description of Artificial Sequence: Synthetic oligonucleotide
  Target: ATXN1; (-) strand; PAM type: YTN; PAM sequence: TTT
cacatgtttgtttaagtcat

SEQ ID NO: 221583 - DNA, 20 bp, Artificial Sequence
  Description of Artificial Sequence: Synthetic oligonucleotide
  Target: ATXN1; (-) strand; PAM type: YTN; PAM sequence: TTT
tcacatgtttgtttaagtca

SEQ ID NO: 221584 - DNA, 20 bp, Artificial Sequence
  Description of Artificial Sequence: Synthetic oligonucleotide
  Target: ATXN1; (-) strand; PAM type: YTN; PAM sequence: CTT
ttcacatgtttgtttaagtc

SEQ ID NO: 221585 - DNA, 20 bp, Artificial Sequence
  Description of Artificial Sequence: Synthetic oligonucleotide
  Target: ATXN1; (-) strand; PAM type: YTN; PAM sequence: CTA
cacaaaacaggatcttttca

SEQ ID NO: 221586 - DNA, 20 bp, Artificial Sequence
  Description of Artificial Sequence: Synthetic oligonucleotide
  Target: ATXN1; (-) strand; PAM type: YTN; PAM sequence: TTC
agaactacacaaaacaggat

SEQ ID NO: 221587 - DNA, 20 bp, Artificial Sequence
  Description of Artificial Sequence: Synthetic oligonucleotide
  Target: ATXN1; (-) strand; PAM type: YTN; PAM sequence: CTG
agcagaattcagaactacac

SEQ ID NO: 221588 - DNA, 20 bp, Artificial Sequence
  Description of Artificial Sequence: Synthetic oligonucleotide
  Target: ATXN1; (-) strand; PAM type: YTN; PAM sequence: TTG
aaagtctgagcagaattcag

SEQ ID NO: 221589 - DNA, 20 bp, Artificial Sequence
  Description of Artificial Sequence: Synthetic oligonucleotide
  Target: ATXN1; (-) strand; PAM type: YTN; PAM sequence: TTG
aaattgaaagtctgagcaga

SEQ ID NO: 221590 - DNA, 20 bp, Artificial Sequence
  Description of Artificial Sequence: Synthetic oligonucleotide
  Target: ATXN1; (-) strand; PAM type: YTN; PAM sequence: TTT
gaaattgaaagtctgagcag

SEQ ID NO: 221591 - DNA, 20 bp, Artificial Sequence
  Description of Artificial Sequence: Synthetic oligonucleotide
  Target: ATXN1; (-) strand; PAM type: YTN; PAM sequence: TTT
tgaaattgaaagtctgagca

SEQ ID NO: 221592 - DNA, 20 bp, Artificial Sequence
  Description of Artificial Sequence: Synthetic oligonucleotide
  Target: ATXN1; (-) strand; PAM type: YTN; PAM sequence: TTA
ttttgaaattgaaagtctga

SEQ ID NO: 221593 - DNA, 20 bp, Artificial Sequence
  Description of Artificial Sequence: Synthetic oligonucleotide
  Target: ATXN1; (-) strand; PAM type: YTN; PAM sequence: TTG
ttattttgaaattgaaagtc

SEQ ID NO: 221594 - DNA, 20 bp, Artificial Sequence
  Description of Artificial Sequence: Synthetic oligonucleotide
  Target: ATXN1; (-) strand; PAM type: YTN; PAM sequence: TTT
gttattttgaaattgaaagt

SEQ ID NO: 221595 - DNA, 20 bp, Artificial Sequence
  Description of Artificial Sequence: Synthetic oligonucleotide
  Target: ATXN1; (-) strand; PAM type: YTN; PAM sequence: CTT
tgttattttgaaattgaaag

SEQ ID NO: 221596 - DNA, 20 bp, Artificial Sequence
  Description of Artificial Sequence: Synthetic oligonucleotide
  Target: ATXN1; (-) strand; PAM type: YTN; PAM sequence: CTG
ctttgttattttgaaattga

SEQ ID NO: 221597 - DNA, 20 bp, Artificial Sequence
  Description of Artificial Sequence: Synthetic oligonucleotide
  Target: ATXN1; (-) strand; PAM type: YTN; PAM sequence: TTA
ctgctttgttattttgaaat

SEQ ID NO: 221598 - DNA, 20 bp, Artificial Sequence
  Description of Artificial Sequence: Synthetic oligonucleotide
  Target: ATXN1; (-) strand; PAM type: YTN; PAM sequence: TTT
actgctttgttattttgaaa

SEQ ID NO: 221599 - DNA, 20 bp, Artificial Sequence
  Description of Artificial Sequence: Synthetic oligonucleotide
  Target: ATXN1; (-) strand; PAM type: YTN; PAM sequence: TTC
cagtttactgctttgttatt

SEQ ID NO: 221600 - DNA, 20 bp, Artificial Sequence
  Description of Artificial Sequence: Synthetic oligonucleotide
  Target: ATXN1; (-) strand; PAM type: YTN; PAM sequence: TTT
ccagtttactgctttgttat

SEQ ID NO: 221601 - DNA, 20 bp, Artificial Sequence
  Description of Artificial Sequence: Synthetic oligonucleotide
  Target: ATXN1; (-) strand; PAM type: YTN; PAM sequence: CTA
tgtttccagtttactgcttt

SEQ ID NO: 221602 - DNA, 20 bp, Artificial Sequence
  Description of Artificial Sequence: Synthetic oligonucleotide
  Target: ATXN1; (-) strand; PAM type: YTN; PAM sequence: TTC
agaaagaatgggggctatgt

SEQ ID NO: 221603 - DNA, 20 bp, Artificial Sequence
  Description of Artificial Sequence: Synthetic oligonucleotide
  Target: ATXN1; (-) strand; PAM type: YTN; PAM sequence: TTT
cagaaagaatgggggctatg

SEQ ID NO: 221604 - DNA, 20 bp, Artificial Sequence
  Description of Artificial Sequence: Synthetic oligonucleotide
  Target: ATXN1; (-) strand; PAM type: YTN; PAM sequence: TTA
agatttcagaaagaatgggg

SEQ ID NO: 221605 - DNA, 20 bp, Artificial Sequence
  Description of Artificial Sequence: Synthetic oligonucleotide
  Target: ATXN1; (-) strand; PAM type: YTN; PAM sequence: TTT
aagatttcagaaagaatggg

SEQ ID NO: 221606 - DNA, 20 bp, Artificial Sequence
  Description of Artificial Sequence: Synthetic oligonucleotide
  Target: ATXN1; (-) strand; PAM type: YTN; PAM sequence: CTG
tttaagatttcagaaagaat

SEQ ID NO: 221607 - DNA, 20 bp, Artificial Sequence
  Description of Artificial Sequence: Synthetic oligonucleotide
  Target: ATXN1; (-) strand; PAM type: YTN; PAM sequence: CTG
cagtctgtttaagatttcag

SEQ ID NO: 221608 - DNA, 20 bp, Artificial Sequence
  Description of Artificial Sequence: Synthetic oligonucleotide
  Target: ATXN1; (-) strand; PAM type: YTN; PAM sequence: TTG
gaagctgcagtctgtttaag

SEQ ID NO: 221609 - DNA, 20 bp, Artificial Sequence
  Description of Artificial Sequence: Synthetic oligonucleotide
  Target: ATXN1; (-) strand; PAM type: YTN; PAM sequence: CTT
ggaagctgcagtctgtttaa

SEQ ID NO: 221610 - DNA, 20 bp, Artificial Sequence
  Description of Artificial Sequence: Synthetic oligonucleotide
  Target: ATXN1; (-) strand; PAM type: YTN; PAM sequence: TTC
acatccaaccttggaagctg

SEQ ID NO: 221611 - DNA, 20 bp, Artificial Sequence
  Description of Artificial Sequence: Synthetic oligonucleotide
  Target: ATXN1; (-) strand; PAM type: YTN; PAM sequence: TTT
cacatccaaccttggaagct

SEQ ID NO: 221612 - DNA, 20 bp, Artificial Sequence
  Description of Artificial Sequence: Synthetic oligonucleotide
  Target: ATXN1; (-) strand; PAM type: YTN; PAM sequence: CTG
aatttcacatccaaccttgg

SEQ ID NO: 221613 - DNA, 20 bp, Artificial Sequence
  Description of Artificial Sequence: Synthetic oligonucleotide
  Target: ATXN1; (-) strand; PAM type: YTN; PAM sequence: CTC
tgaatttcacatccaacctt

SEQ ID NO: 221614 - DNA, 20 bp, Artificial Sequence
  Description of Artificial Sequence: Synthetic oligonucleotide
  Target: ATXN1; (-) strand; PAM type: YTN; PAM sequence: TTG
tgtgcctctgaatttcacat

SEQ ID NO: 221615 - DNA, 20 bp, Artificial Sequence
  Description of Artificial Sequence: Synthetic oligonucleotide
  Target: ATXN1; (-) strand; PAM type: YTN; PAM sequence: CTA
ccaaaagagttgtgtgcctc

SEQ ID NO: 221616 - DNA, 20 bp, Artificial Sequence
  Description of Artificial Sequence: Synthetic oligonucleotide
  Target: ATXN1; (-) strand; PAM type: YTN; PAM sequence: TTC
taccaaaagagttgtgtgcc

SEQ ID NO: 221617 - DNA, 20 bp, Artificial Sequence
  Description of Artificial Sequence: Synthetic oligonucleotide
  Target: ATXN1; (-) strand; PAM type: YTN; PAM sequence: TTT
ctaccaaaagagttgtgtgc

SEQ ID NO: 221618 - DNA, 20 bp, Artificial Sequence
  Description of Artificial Sequence: Synthetic oligonucleotide
  Target: ATXN1; (-) strand; PAM type: YTN; PAM sequence: CTT
tctaccaaaagagttgtgtg

SEQ ID NO: 221619 - DNA, 20 bp, Artificial Sequence
  Description of Artificial Sequence: Synthetic oligonucleotide
  Target: ATXN1; (-) strand; PAM type: YTN; PAM sequence: CTG
cagctttctaccaaaagagt

SEQ ID NO: 221620 - DNA, 20 bp, Artificial Sequence
  Description of Artificial Sequence: Synthetic oligonucleotide
  Target: ATXN1; (-) strand; PAM type: YTN; PAM sequence: CTG
ggctgcagctttctaccaaa

SEQ ID NO: 221621 - DNA, 20 bp, Artificial Sequence
  Description of Artificial Sequence: Synthetic oligonucleotide
  Target: ATXN1; (-) strand; PAM type: YTN; PAM sequence: CTG
ctgggctgcagctttctacc

SEQ ID NO: 221622 - DNA, 20 bp, Artificial Sequence
  Description of Artificial Sequence: Synthetic oligonucleotide
  Target: ATXN1; (-) strand; PAM type: YTN; PAM sequence: CTC
tgctgggctgcagctttcta

SEQ ID NO: 221623 - DNA, 20 bp, Artificial Sequence
  Description of Artificial Sequence: Synthetic oligonucleotide
  Target: ATXN1; (-) strand; PAM type: YTN; PAM sequence: TTC
agagagctctgctgggctgc

SEQ ID NO: 221624 - DNA, 20 bp, Artificial Sequence
  Description of Artificial Sequence: Synthetic oligonucleotide
  Target: ATXN1; (-) strand; PAM type: YTN; PAM sequence: CTT
cagagagctctgctgggctg

SEQ ID NO: 221625 - DNA, 20 bp, Artificial Sequence
  Description of Artificial Sequence: Synthetic oligonucleotide
  Target: ATXN1; (-) strand; PAM type: YTN; PAM sequence: CTA
gacttcagagagctctgctg

SEQ ID NO: 221626 - DNA, 20 bp, Artificial Sequence
  Description of Artificial Sequence: Synthetic oligonucleotide
  Target: ATXN1; (-) strand; PAM type: YTN; PAM sequence: CTC
cccctagacttcagagagct

SEQ ID NO: 221627 - DNA, 20 bp, Artificial Sequence
  Description of Artificial Sequence: Synthetic oligonucleotide
  Target: ATXN1; (-) strand; PAM type: YTN; PAM sequence: CTA
caacacagacacccacctcc

SEQ ID NO: 221628 - DNA, 20 bp, Artificial Sequence
  Description of Artificial Sequence: Synthetic oligonucleotide
  Target: ATXN1; (-) strand; PAM type: YTN; PAM sequence: CTA
taaagtcaccaatctacaac

SEQ ID NO: 221629 - DNA, 20 bp, Artificial Sequence
  Description of Artificial Sequence: Synthetic oligonucleotide
  Target: ATXN1; (-) strand; PAM type: YTN; PAM sequence: TTC
tataaagtcaccaatctaca

SEQ ID NO: 221630 - DNA, 20 bp, Artificial Sequence
  Description of Artificial Sequence: Synthetic oligonucleotide
  Target: ATXN1; (-) strand; PAM type: YTN; PAM sequence: CTG
gaagcacattctataaagtc

SEQ ID NO: 221631 - DNA, 20 bp, Artificial Sequence
  Description of Artificial Sequence: Synthetic oligonucleotide
  Target: ATXN1; (-) strand; PAM type: YTN; PAM sequence: TTC
ctggaagcacattctataaa

SEQ ID NO: 221632 - DNA, 20 bp, Artificial Sequence
  Description of Artificial Sequence: Synthetic oligonucleotide
  Target: ATXN1; (-) strand; PAM type: YTN; PAM sequence: CTC
acattcctggaagcacattc

SEQ ID NO: 221633 - DNA, 20 bp, Artificial Sequence
  Description of Artificial Sequence: Synthetic oligonucleotide
  Target: ATXN1; (-) strand; PAM type: YTN; PAM sequence: TTG
ccaggggtgtgtatgctcac

SEQ ID NO: 221634 - DNA, 20 bp, Artificial Sequence
  Description of Artificial Sequence: Synthetic oligonucleotide
  Target: ATXN1; (-) strand; PAM type: YTN; PAM sequence: TTC
agttgccaggggtgtgtatg

SEQ ID NO: 221635 - DNA, 20 bp, Artificial Sequence
  Description of Artificial Sequence: Synthetic oligonucleotide
  Target: ATXN1; (-) strand; PAM type: YTN; PAM sequence: TTT
cagttgccaggggtgtgtat

SEQ ID NO: 221636 - DNA, 20 bp, Artificial Sequence
  Description of Artificial Sequence: Synthetic oligonucleotide
  Target: ATXN1; (-) strand; PAM type: YTN; PAM sequence: CTT
tcagttgccaggggtgtgta

SEQ ID NO: 221637 - DNA, 20 bp, Artificial Sequence
  Description of Artificial Sequence: Synthetic oligonucleotide
  Target: ATXN1; (-) strand; PAM type: YTN; PAM sequence: TTA
ctttcagttgccaggggtgt

SEQ ID NO: 221638 - DNA, 20 bp, Artificial Sequence
  Description of Artificial Sequence: Synthetic oligonucleotide
  Target: ATXN1; (-) strand; PAM type: YTN; PAM sequence: TTG
gttactttcagttgccaggg

SEQ ID NO: 221639 - DNA, 20 bp, Artificial Sequence
  Description of Artificial Sequence: Synthetic oligonucleotide
  Target: ATXN1; (-) strand; PAM type: YTN; PAM sequence: TTA
aaaagccattggttactttc

SEQ ID NO: 221640 - DNA, 20 bp, Artificial Sequence
  Description of Artificial Sequence: Synthetic oligonucleotide
  Target: ATXN1; (-) strand; PAM type: YTN; PAM sequence: CTG
ttaaaaagccattggttact

SEQ ID NO: 221641 - DNA, 20 bp, Artificial Sequence
  Description of Artificial Sequence: Synthetic oligonucleotide
  Target: ATXN1; (-) strand; PAM type: YTN; PAM sequence: TTG
aaataaagtggatctgttaa

SEQ ID NO: 221642 - DNA, 20 bp, Artificial Sequence
  Description of Artificial Sequence: Synthetic oligonucleotide
  Target: ATXN1; (-) strand; PAM type: YTN; PAM sequence: CTC
caaacgttgaaataaagtgg

SEQ ID NO: 221643 - DNA, 20 bp, Artificial Sequence
  Description of Artificial Sequence: Synthetic oligonucleotide
  Target: ATXN1; (-) strand; PAM type: YTN; PAM sequence: TTA
atctccaaacgttgaaataa

SEQ ID NO: 221644 - DNA, 20 bp, Artificial Sequence
  Description of Artificial Sequence: Synthetic oligonucleotide
  Target: ATXN1; (-) strand; PAM type: YTN; PAM sequence: TTG
cgggttaatctccaaacgtt

SEQ ID NO: 221645 - DNA, 20 bp, Artificial Sequence
  Description of Artificial Sequence: Synthetic oligonucleotide
  Target: ATXN1; (-) strand; PAM type: YTN; PAM sequence: TTG
attgcgggttaatctccaaa

SEQ ID NO: 221646 - DNA, 20 bp, Artificial Sequence
  Description of Artificial Sequence: Synthetic oligonucleotide
  Target: ATXN1; (-) strand; PAM type: YTN; PAM sequence: TTT
gattgcgggttaatctccaa

SEQ ID NO: 221647 - DNA, 20 bp, Artificial Sequence
  Description of Artificial Sequence: Synthetic oligonucleotide
  Target: ATXN1; (-) strand; PAM type: YTN; PAM sequence: CTC
atacggcagtatttgattgc

SEQ ID NO: 221648 - DNA, 20 bp, Artificial Sequence
  Description of Artificial Sequence: Synthetic oligonucleotide
  Target: ATXN1; (-) strand; PAM type: YTN; PAM sequence: TTA
gcacggactcatacggcagt

SEQ ID NO: 221649 - DNA, 20 bp, Artificial Sequence
  Description of Artificial Sequence: Synthetic oligonucleotide
  Target: ATXN1; (-) strand; PAM type: YTN; PAM sequence: CTT
agcacggactcatacggcag

SEQ ID NO: 221650 - DNA, 20 bp, Artificial Sequence
  Description of Artificial Sequence: Synthetic oligonucleotide
  Target: ATXN1; (-) strand; PAM type: YTN; PAM sequence: TTG
acagaaaatgtgaaatgatg

SEQ ID NO: 221651 - DNA, 20 bp, Artificial Sequence
  Description of Artificial Sequence: Synthetic oligonucleotide
  Target: ATXN1; (-) strand; PAM type: YTN; PAM sequence: TTT
gacagaaaatgtgaaatgat

SEQ ID NO: 221652 - DNA, 20 bp, Artificial Sequence
  Description of Artificial Sequence: Synthetic oligonucleotide
  Target: ATXN1; (-) strand; PAM type: YTN; PAM sequence: TTT
tgacagaaaatgtgaaatga

SEQ ID NO: 221653 - DNA, 20 bp, Artificial Sequence
  Description of Artificial Sequence: Synthetic oligonucleotide
  Target: ATXN1; (-) strand; PAM type: YTN; PAM sequence: CTT
ttgacagaaaatgtgaaatg

SEQ ID NO: 221654 - DNA, 20 bp, Artificial Sequence
  Description of Artificial Sequence: Synthetic oligonucleotide
  Target: ATXN1; (-) strand; PAM type: YTN; PAM sequence: TTG
aagaaaggcttttgacagaa

SEQ ID NO: 221655 - DNA, 20 bp, Artificial Sequence
  Description of Artificial Sequence: Synthetic oligonucleotide
  Target: ATXN1; (-) strand; PAM type: YTN; PAM sequence: CTA
tggtgcaattgaagaaaggc

SEQ ID NO: 221656 - DNA, 20 bp, Artificial Sequence
  Description of Artificial Sequence: Synthetic oligonucleotide
  Target: ATXN1; (-) strand; PAM type: YTN; PAM sequence: TTA
tgggactatggtgcaattga

SEQ ID NO: 221657 - DNA, 20 bp, Artificial Sequence
  Description of Artificial Sequence: Synthetic oligonucleotide
  Target: ATXN1; (-) strand; PAM type: YTN; PAM sequence: TTT
atgggactatggtgcaattg

SEQ ID NO: 221658 - DNA, 20 bp, Artificial Sequence
  Description of Artificial Sequence: Synthetic oligonucleotide
  Target: ATXN1; (-) strand; PAM type: YTN; PAM sequence: TTT
tatgggactatggtgcaatt

SEQ ID NO: 221659 - DNA, 20 bp, Artificial Sequence
  Description of Artificial Sequence: Synthetic oligonucleotide
  Target: ATXN1; (-) strand; PAM type: YTN; PAM sequence: TTC
agattttatgggactatggt

SEQ ID NO: 221660 - DNA, 20 bp, Artificial Sequence
  Description of Artificial Sequence: Synthetic oligonucleotide
  Target: ATXN1; (-) strand; PAM type: YTN; PAM sequence: TTT
cagattttatgggactatgg

SEQ ID NO: 221661 - DNA, 20 bp, Artificial Sequence
  Description of Artificial Sequence: Synthetic oligonucleotide
  Target: ATXN1; (-) strand; PAM type: YTN; PAM sequence: TTT
tcagattttatgggactatg

SEQ ID NO: 221662 - DNA, 20 bp, Artificial Sequence
  Description of Artificial Sequence: Synthetic oligonucleotide
  Target: ATXN1; (-) strand; PAM type: YTN; PAM sequence: CTC
agtcatgtgatattttcaga

SEQ ID NO: 221663 - DNA, 20 bp, Artificial Sequence
  Description of Artificial Sequence: Synthetic oligonucleotide
  Target: ATXN1; (-) strand; PAM type: YTN; PAM sequence: TTA
gatcctcagtcatgtgatat

SEQ ID NO: 221664 - DNA, 20 bp, Artificial Sequence
  Description of Artificial Sequence: Synthetic oligonucleotide
  Target: ATXN1; (-) strand; PAM type: YTN; PAM sequence: CTT
agatcctcagtcatgtgata

SEQ ID NO: 221665 - DNA, 20 bp, Artificial Sequence
  Description of Artificial Sequence: Synthetic oligonucleotide
  Target: ATXN1; (-) strand; PAM type: YTN; PAM sequence: CTC
ttagatcctcagtcatgtga

SEQ ID NO: 221666 - DNA, 20 bp, Artificial Sequence
  Description of Artificial Sequence: Synthetic oligonucleotide
  Target: ATXN1; (-) strand; PAM type: YTN; PAM sequence: TTG
gctcttagatcctcagtcat

SEQ ID NO: 221667 - DNA, 20 bp, Artificial Sequence
  Description of Artificial Sequence: Synthetic oligonucleotide
  Target: ATXN1; (-) strand; PAM type: YTN; PAM sequence: CTT
ggctcttagatcctcagtca

SEQ ID NO: 221668 - DNA, 20 bp, Artificial Sequence
  Description of Artificial Sequence: Synthetic oligonucleotide
  Target: ATXN1; (-) strand; PAM type: YTN; PAM sequence: TTC
aggaccttggctcttagatc

SEQ ID NO: 221669 - DNA, 20 bp, Artificial Sequence
  Description of Artificial Sequence: Synthetic oligonucleotide
  Target: ATXN1; (-) strand; PAM type: YTN; PAM sequence: TTG
tgtgattcaggaccttggct

SEQ ID NO: 221670 - DNA, 20 bp, Artificial Sequence
  Description of Artificial Sequence: Synthetic oligonucleotide
  Target: ATXN1; (-) strand; PAM type: YTN; PAM sequence: CTA
atgagtatgttgtgtgattc

SEQ ID NO: 221671 - DNA, 20 bp, Artificial Sequence
  Description of Artificial Sequence: Synthetic oligonucleotide
  Target: ATXN1; (-) strand; PAM type: YTN; PAM sequence: TTC
cctaatgagtatgttgtgtg

SEQ ID NO: 221672 - DNA, 20 bp, Artificial Sequence
  Description of Artificial Sequence: Synthetic oligonucleotide
  Target: ATXN1; (-) strand; PAM type: YTN; PAM sequence: CTG
aaagggggaaagggagaaga

SEQ ID NO: 221673 - DNA, 20 bp, Artificial Sequence
  Description of Artificial Sequence: Synthetic oligonucleotide
  Target: ATXN1; (-) strand; PAM type: YTN; PAM sequence: TTA
aaatatctgaaagggggaaa

SEQ ID NO: 221674 - DNA, 20 bp, Artificial Sequence
  Description of Artificial Sequence: Synthetic oligonucleotide
  Target: ATXN1; (-) strand; PAM type: YTN; PAM sequence: TTT
aaaatatctgaaagggggaa

SEQ ID NO: 221675 - DNA, 20 bp, Artificial Sequence
  Description of Artificial Sequence: Synthetic oligonucleotide
  Target: ATXN1; (-) strand; PAM type: YTN; PAM sequence: TTT
taaaatatctgaaaggggga

SEQ ID NO: 221676 - DNA, 20 bp, Artificial Sequence
  Description of Artificial Sequence: Synthetic oligonucleotide
  Target: ATXN1; (-) strand; PAM type: YTN; PAM sequence: TTA
attttaaaatatctgaaagg

SEQ ID NO: 221677 - DNA, 20 bp, Artificial Sequence
  Description of Artificial Sequence: Synthetic oligonucleotide
  Target: ATXN1; (-) strand; PAM type: YTN; PAM sequence: TTT
aattttaaaatatctgaaag

SEQ ID NO: 221678 - DNA, 20 bp, Artificial Sequence
  Description of Artificial Sequence: Synthetic oligonucleotide
  Target: ATXN1; (-) strand; PAM type: YTN; PAM sequence: TTT
taattttaaaatatctgaaa

SEQ ID NO: 221679 - DNA, 20 bp, Artificial Sequence
  Description of Artificial Sequence: Synthetic oligonucleotide
  Target: ATXN1; (-) strand; PAM type: YTN; PAM sequence: TTC
gttttaattttaaaatatct

SEQ ID NO: 221680 - DNA, 20 bp, Artificial Sequence
  Description of Artificial Sequence: Synthetic oligonucleotide
  Target: ATXN1; (-) strand; PAM type: YTN; PAM sequence: CTT
cgttttaattttaaaatatc

SEQ ID NO: 221681 - DNA, 20 bp, Artificial Sequence
  Description of Artificial Sequence: Synthetic oligonucleotide
  Target: ATXN1; (-) strand; PAM type: YTN; PAM sequence: CTC
cacccttcgttttaatttta

SEQ ID NO: 221682 - DNA, 20 bp, Artificial Sequence
  Description of Artificial Sequence: Synthetic oligonucleotide
  Target: ATXN1; (-) strand; PAM type: YTN; PAM sequence: TTC
cctccacccttcgttttaat

SEQ ID NO: 221683 - DNA, 20 bp, Artificial Sequence
  Description of Artificial Sequence: Synthetic oligonucleotide
  Target: ATXN1; (-) strand; PAM type: YTN; PAM sequence: TTA
catataaattccctccaccc

SEQ ID NO: 221684 - DNA, 20 bp, Artificial Sequence
  Description of Artificial Sequence: Synthetic oligonucleotide
  Target: ATXN1; (-) strand; PAM type: YTN; PAM sequence: CTG
ccatcaggccaatatcatta

SEQ ID NO: 221685 - DNA, 20 bp, Artificial Sequence
  Description of Artificial Sequence: Synthetic oligonucleotide
  Target: ATXN1; (-) strand; PAM type: YTN; PAM sequence: TTG
actgccatcaggccaatatc

SEQ ID NO: 221686 - DNA, 20 bp, Artificial Sequence
  Description of Artificial Sequence: Synthetic oligonucleotide
  Target: ATXN1; (-) strand; PAM type: YTN; PAM sequence: TTC
atgtgtgccataagttgact

SEQ ID NO: 221687 - DNA, 20 bp, Artificial Sequence
  Description of Artificial Sequence: Synthetic oligonucleotide
  Target: ATXN1; (-) strand; PAM type: YTN; PAM sequence: CTT
catgtgtgccataagttgac

SEQ ID NO: 221688 - DNA, 20 bp, Artificial Sequence
  Description of Artificial Sequence: Synthetic oligonucleotide
  Target: ATXN1; (-) strand; PAM type: YTN; PAM sequence: TTC
gccttcatgtgtgccataag

SEQ ID NO: 221689 - DNA, 20 bp, Artificial Sequence
  Description of Artificial Sequence: Synthetic oligonucleotide
  Target: ATXN1; (-) strand; PAM type: YTN; PAM sequence: TTT
cgccttcatgtgtgccataa

SEQ ID NO: 221690 - DNA, 20 bp, Artificial Sequence
  Description of Artificial Sequence: Synthetic oligonucleotide
  Target: ATXN1; (-) strand; PAM type: YTN; PAM sequence: CTT
tcgccttcatgtgtgccata

SEQ ID NO: 221691 - DNA, 20 bp, Artificial Sequence
  Description of Artificial Sequence: Synthetic oligonucleotide
  Target: ATXN1; (-) strand; PAM type: YTN; PAM sequence: CTC
ctttcgccttcatgtgtgcc

SEQ ID NO: 221692 - DNA, 20 bp, Artificial Sequence
  Description of Artificial Sequence: Synthetic oligonucleotide
  Target: ATXN1; (-) strand; PAM type: YTN; PAM sequence: CTG
ctcctttcgccttcatgtgt

SEQ ID NO: 221693 - DNA, 20 bp, Artificial Sequence
  Description of Artificial Sequence: Synthetic oligonucleotide
  Target: ATXN1; (-) strand; PAM type: YTN; PAM sequence: TTC
cctgctcctttcgccttcat

SEQ ID NO: 221694 - DNA, 20 bp, Artificial Sequence
  Description of Artificial Sequence: Synthetic oligonucleotide
  Target: ATXN1; (-) strand; PAM type: YTN; PAM sequence: TTT
ccctgctcctttcgccttca

SEQ ID NO: 221695 - DNA, 20 bp, Artificial Sequence
  Description of Artificial Sequence: Synthetic oligonucleotide
  Target: ATXN1; (-) strand; PAM type: YTN; PAM sequence: CTT
tccctgctcctttcgccttc

SEQ ID NO: 221696 - DNA, 20 bp, Artificial Sequence
  Description of Artificial Sequence: Synthetic oligonucleotide
  Target: ATXN1; (-) strand; PAM type: YTN; PAM sequence: CTG
aaaaaactttccctgctcct

SEQ ID NO: 221697 - DNA, 20 bp, Artificial Sequence
  Description of Artificial Sequence: Synthetic oligonucleotide
  Target: ATXN1; (-) strand; PAM type: YTN; PAM sequence: CTC
cctgaaaaaactttccctgc

SEQ ID NO: 221698 - DNA, 20 bp, Artificial Sequence
  Description of Artificial Sequence: Synthetic oligonucleotide
  Target: ATXN1; (-) strand; PAM type: YTN; PAM sequence: CTC
tccctgaaaaaactttccct

SEQ ID NO: 221699 - DNA, 20 bp, Artificial Sequence
  Description of Artificial Sequence: Synthetic oligonucleotide
  Target: ATXN1; (-) strand; PAM type: YTN; PAM sequence: CTC
cacctctccctgaaaaaact

SEQ ID NO: 221700 - DNA, 20 bp, Artificial Sequence
  Description of Artificial Sequence: Synthetic oligonucleotide
  Target: ATXN1; (-) strand; PAM type: YTN; PAM sequence: CTC
catctccacctctccctgaa

SEQ ID NO: 221701 - DNA, 20 bp, Artificial Sequence
  Description of Artificial Sequence: Synthetic oligonucleotide
  Target: ATXN1; (-) strand; PAM type: YTN; PAM sequence: TTA
aatatatgtaggctccatct

SEQ ID NO: 221702 - DNA, 20 bp, Artificial Sequence
  Description of Artificial Sequence: Synthetic oligonucleotide
  Target: ATXN1; (-) strand; PAM type: YTN; PAM sequence: TTT
aaatatatgtaggctccatc

SEQ ID NO: 221703 - DNA, 20 bp, Artificial Sequence
  Description of Artificial Sequence: Synthetic oligonucleotide
  Target: ATXN1; (-) strand; PAM type: YTN; PAM sequence: TTT
taaatatatgtaggctccat

SEQ ID NO: 221704 - DNA, 20 bp, Artificial Sequence
  Description of Artificial Sequence: Synthetic oligonucleotide
  Target: ATXN1; (-) strand; PAM type: YTN; PAM sequence: CTC
caattttaaatatatgtagg

SEQ ID NO: 221705 - DNA, 20 bp, Artificial Sequence
  Description of Artificial Sequence: Synthetic oligonucleotide
  Target: ATXN1; (-) strand; PAM type: YTN; PAM sequence: CTG
gcctccaattttaaatatat

SEQ ID NO: 221706 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccgcacc

SEQ ID NO: 221707 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 221708 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 221709 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 221710 - DNA, 20 bp, Artificial Sequence
  Description of Artificial Sequence: Synthetic oligonucleotide
  Target: ATXN1; (-) strand; PAM type: YTN; PAM sequence: CTC
aaatgatccgccagcctcag

SEQ ID NO: 221711 - DNA, 20 bp, Artificial Sequence
  Description of Artificial Sequence: Synthetic oligonucleotide
  Target: ATXN1; (-) strand; PAM type: YTN; PAM sequence: CTG
acctcaaatgatccgccagc

SEQ ID NO: 221712 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaaatgatccgcc

SEQ ID NO: 221713 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcaaatgat

SEQ ID NO: 221714 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcaaatga

SEQ ID NO: 221715 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgacctca

SEQ ID NO: 221716 - DNA, 20 bp, Artificial Sequence
  Description of Artificial Sequence: Synthetic oligonucleotide
  Target: ATXN1; (-) strand; PAM type: YTN; PAM sequence: TTC
accatgtcagtcagactggt

SEQ ID NO: 221717 - DNA, 20 bp, Artificial Sequence
  Description of Artificial Sequence: Synthetic oligonucleotide
  Target: ATXN1; (-) strand; PAM type: YTN; PAM sequence: CTT
caccatgtcagtcagactgg

SEQ ID NO: 221718 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggcttcacca

SEQ ID NO: 221719 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggcttcacc

SEQ ID NO: 221720 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggcttcac

SEQ ID NO: 221721 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggcttca

SEQ ID NO: 221722 - DNA, 20 bp, Artificial Sequence
  Description of Artificial Sequence: Synthetic oligonucleotide
  Target: ATXN1; (-) strand; PAM type: YTN; PAM sequence: TTT
tttagtagagatggggcttc

SEQ ID NO: 221723 - DNA, 20 bp, Artificial Sequence
  Description of Artificial Sequence: Synthetic oligonucleotide
  Target: ATXN1; (-) strand; PAM type: YTN; PAM sequence: TTT
ttttagtagagatggggctt

SEQ ID NO: 221724 - DNA, 20 bp, Artificial Sequence
  Description of Artificial Sequence: Synthetic oligonucleotide
  Target: ATXN1; (-) strand; PAM type: YTN; PAM sequence: TTT
tttttagtagagatggggct

SEQ ID NO: 221725 - DNA, 20 bp, Artificial Sequence
  Description of Artificial Sequence: Synthetic oligonucleotide
  Target: ATXN1; (-) strand; PAM type: YTN; PAM sequence: TTA
tatattttttttagtagaga

SEQ ID NO: 221726 - DNA, 20 bp, Artificial Sequence
  Description of Artificial Sequence: Synthetic oligonucleotide
  Target: ATXN1; (-) strand; PAM type: YTN; PAM sequence: TTT
atatattttttttagtagag

SEQ ID NO: 221727 - DNA, 20 bp, Artificial Sequence
  Description of Artificial Sequence: Synthetic oligonucleotide
  Target: ATXN1; (-) strand; PAM type: YTN; PAM sequence: TTT
tatatattttttttagtaga

SEQ ID NO: 221728 - DNA, 20 bp, Artificial Sequence
  Description of Artificial Sequence: Synthetic oligonucleotide
  Target: ATXN1; (-) strand; PAM type: YTN; PAM sequence: TTT
ttatatattttttttagtag

SEQ ID NO: 221729 - DNA, 20 bp, Artificial Sequence
  Description of Artificial Sequence: Synthetic oligonucleotide
  Target: ATXN1; (-) strand; PAM type: YTN; PAM sequence: TTT
tttatatattttttttagta

SEQ ID NO: 221730 - DNA, 20 bp, Artificial Sequence
  Description of Artificial Sequence: Synthetic oligonucleotide
  Target: ATXN1; (-) strand; PAM type: YTN; PAM sequence: TTT
ttttatatattttttttagt

SEQ ID NO: 221731 - DNA, 20 bp, Artificial Sequence
  Description of Artificial Sequence: Synthetic oligonucleotide
  Target: ATXN1; (-) strand; PAM type: YTN; PAM sequence: TTT
tttttatatattttttttag

SEQ ID NO: 221732 - DNA, 20 bp, Artificial Sequence
  Description of Artificial Sequence: Synthetic oligonucleotide
  Target: ATXN1; (-) strand; PAM type: YTN; PAM sequence: CTA
attttttttatatatttttt

SEQ ID NO: 221733 - DNA, 20 bp, Artificial Sequence
  Description of Artificial Sequence: Synthetic oligonucleotide
  Target: ATXN1; (-) strand; PAM type: YTN; PAM sequence: CTG
gctaattttttttatatatt

SEQ ID NO: 221734 - DNA, 20 bp, Artificial Sequence
  Description of Artificial Sequence: Synthetic oligonucleotide
  Target: ATXN1; (-) strand; PAM type: YTN; PAM sequence: CTA
caggtatgcaccacaatgcc

SEQ ID NO: 221735 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtatgcaccac

SEQ ID NO: 221736 - DNA, 20 bp, Artificial Sequence
  Description of Artificial Sequence: Synthetic oligonucleotide
  Target: ATXN1; (-) strand; PAM type: YTN; PAM sequence: CTC
ccgagtcgctgggactacag

SEQ ID NO: 221737 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtcgctggga

SEQ ID NO: 221738 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtcgct

SEQ ID NO: 221739 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagtc

SEQ ID NO: 221740 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgag

SEQ ID NO: 221741 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcctgcctcag

SEQ ID NO: 221742 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagtgattctcc

SEQ ID NO: 221743 - DNA, 20 bp, Artificial Sequence
  Description of Artificial Sequence: Synthetic oligonucleotide
  Target: ATXN1; (-) strand; PAM type: YTN; PAM sequence: CTC
cacctcccaggttcaagtga

SEQ ID NO: 221744 - DNA, 20 bp, Artificial Sequence
  Description of Artificial Sequence: Synthetic oligonucleotide
  Target: ATXN1; (-) strand; PAM type: YTN; PAM sequence: CTG
cagcctccacctcccaggtt

SEQ ID NO: 221745 - DNA, 20 bp, Artificial Sequence
  Description of Artificial Sequence: Synthetic oligonucleotide
  Target: ATXN1; (-) strand; PAM type: YTN; PAM sequence: CTC
actgcagcctccacctccca

SEQ ID NO: 221746 - DNA, 20 bp, Artificial Sequence
  Description of Artificial Sequence: Synthetic oligonucleotide
  Target: ATXN1; (-) strand; PAM type: YTN; PAM sequence: TTG
gctcactgcagcctccacct

SEQ ID NO: 221747 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcagcctccacc

SEQ ID NO: 221748 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcaatctt

SEQ ID NO: 221749 - DNA, 20 bp, Artificial Sequence
  Description of Artificial Sequence: Synthetic oligonucleotide
  Target: ATXN1; (-) strand; PAM type: YTN; PAM sequence: CTC
cgtcacccaggctggagtgc

SEQ ID NO: 221750 - DNA, 20 bp, Artificial Sequence
  Description of Artificial Sequence: Synthetic oligonucleotide
  Target: ATXN1; (-) strand; PAM type: YTN; PAM sequence: CTC
actccgtcacccaggctgga

SEQ ID NO: 221751 - DNA, 20 bp, Artificial Sequence
  Description of Artificial Sequence: Synthetic oligonucleotide
  Target: ATXN1; (-) strand; PAM type: YTN; PAM sequence: TTG
agaaagagtctcactccgtc

SEQ ID NO: 221752 - DNA, 20 bp, Artificial Sequence
  Description of Artificial Sequence: Synthetic oligonucleotide
  Target: ATXN1; (-) strand; PAM type: YTN; PAM sequence: TTT
gagaaagagtctcactccgt

SEQ ID NO: 221753 - DNA, 20 bp, Artificial Sequence
  Description of Artificial Sequence: Synthetic oligonucleotide
  Target: ATXN1; (-) strand; PAM type: YTN; PAM sequence: TTT
tgagaaagagtctcactccg

SEQ ID NO: 221754 - DNA, 20 bp, Artificial Sequence
  Description of Artificial Sequence: Synthetic oligonucleotide
  Target: ATXN1; (-) strand; PAM type: YTN; PAM sequence: TTT
ttgagaaagagtctcactcc

SEQ ID NO: 221755 - DNA, 20 bp, Artificial Sequence
  Description of Artificial Sequence: Synthetic oligonucleotide
  Target: ATXN1; (-) strand; PAM type: YTN; PAM sequence: TTT
tttgagaaagagtctcactc

SEQ ID NO: 221756 - DNA, 20 bp, Artificial Sequence
  Description of Artificial Sequence: Synthetic oligonucleotide
  Target: ATXN1; (-) strand; PAM type: YTN; PAM sequence: TTA
ttttttgagaaagagtctca

SEQ ID NO: 221757 - DNA, 20 bp, Artificial Sequence
  Description of Artificial Sequence: Synthetic oligonucleotide
  Target: ATXN1; (-) strand; PAM type: YTN; PAM sequence: TTT
attttttgagaaagagtctc

SEQ ID NO: 221758 - DNA, 20 bp, Artificial Sequence
  Description of Artificial Sequence: Synthetic oligonucleotide
  Target: ATXN1; (-) strand; PAM type: YTN; PAM sequence: TTA
tttattttttgagaaagagt

SEQ ID NO: 221759 - DNA, 20 bp, Artificial Sequence
  Description of Artificial Sequence: Synthetic oligonucleotide
  Target: ATXN1; (-) strand; PAM type: YTN; PAM sequence: TTT
atttattttttgagaaagag

SEQ ID NO: 221760 - DNA, 20 bp, Artificial Sequence
  Description of Artificial Sequence: Synthetic oligonucleotide
  Target: ATXN1; (-) strand; PAM type: YTN; PAM sequence: TTA
tttatttattttttgagaaa

SEQ ID NO: 221761 - DNA, 20 bp, Artificial Sequence
  Description of Artificial Sequence: Synthetic oligonucleotide
  Target: ATXN1; (-) strand; PAM type: YTN; PAM sequence: TTT
atttatttattttttgagaa

SEQ ID NO: 221762 - DNA, 20 bp, Artificial Sequence
  Description of Artificial Sequence: Synthetic oligonucleotide
  Target: ATXN1; (-) strand; PAM type: YTN; PAM sequence: TTA
tttatttatttattttttga

SEQ ID NO: 221763 - DNA, 20 bp, Artificial Sequence
  Description of Artificial Sequence: Synthetic oligonucleotide
  Target: ATXN1; (-) strand; PAM type: YTN; PAM sequence: TTT
atttatttatttattttttg

SEQ ID NO: 221764 - DNA, 20 bp, Artificial Sequence
  Description of Artificial Sequence: Synthetic oligonucleotide
  Target: ATXN1; (-) strand; PAM type: YTN; PAM sequence: TTT
tatttatttatttatttttt

SEQ ID NO: 221765 - DNA, 20 bp, Artificial Sequence
  Description of Artificial Sequence: Synthetic oligonucleotide
  Target: ATXN1; (-) strand; PAM type: YTN; PAM sequence: TTT
ttatttatttatttattttt

SEQ ID NO: 221766 - DNA, 20 bp, Artificial Sequence
  Description of Artificial Sequence: Synthetic oligonucleotide
  Target: ATXN1; (-) strand; PAM type: YTN; PAM sequence: TTA
tttttatttatttatttatt

SEQ ID NO: 221767 - DNA, 20 bp, Artificial Sequence
  Description of Artificial Sequence: Synthetic oligonucleotide
  Target: ATXN1; (-) strand; PAM type: YTN; PAM sequence: TTT
atttttatttatttatttat

SEQ ID NO: 221768 - DNA, 20 bp, Artificial Sequence
  Description of Artificial Sequence: Synthetic oligonucleotide
  Target: ATXN1; (-) strand; PAM type: YTN; PAM sequence: TTT
tatttttatttatttattta

SEQ ID NO: 221769 - DNA, 20 bp, Artificial Sequence
  Description of Artificial Sequence: Synthetic oligonucleotide
  Target: ATXN1; (-) strand; PAM type: YTN; PAM sequence: TTA
ttttatttttatttatttat

SEQ ID NO: 221770 - DNA, 20 bp, Artificial Sequence
  Description of Artificial Sequence: Synthetic oligonucleotide
  Target: ATXN1; (-) strand; PAM type: YTN; PAM sequence: TTT
attttatttttatttattta

SEQ ID NO: 221771 - DNA, 20 bp, Artificial Sequence
  Description of Artificial Sequence: Synthetic oligonucleotide
  Target: ATXN1; (-) strand; PAM type: YTN; PAM sequence: TTT
tattttatttttatttattt

SEQ ID NO: 221772 - DNA, 20 bp, Artificial Sequence
  Description of Artificial Sequence: Synthetic oligonucleotide
  Target: ATXN1; (-) strand; PAM type: YTN; PAM sequence: TTG
catcacaattttattttatt

SEQ ID NO: 221773 - DNA, 20 bp, Artificial Sequence
  Description of Artificial Sequence: Synthetic oligonucleotide
  Target: ATXN1; (-) strand; PAM type: YTN; PAM sequence: CTT
gcatcacaattttattttat

SEQ ID NO: 221774 - DNA, 20 bp, Artificial Sequence
  Description of Artificial Sequence: Synthetic oligonucleotide
  Target: ATXN1; (-) strand; PAM type: YTN; PAM sequence: TTG
gcagtgtcttgcatcacaat

SEQ ID NO: 221775 - DNA, 20 bp, Artificial Sequence
  Description of Artificial Sequence: Synthetic oligonucleotide
  Target: ATXN1; (-) strand; PAM type: YTN; PAM sequence: TTT
ggcagtgtcttgcatcacaa

SEQ ID NO: 221776 - DNA, 20 bp, Artificial Sequence
  Description of Artificial Sequence: Synthetic oligonucleotide
  Target: ATXN1; (-) strand; PAM type: YTN; PAM sequence: CTT
tggcagtgtcttgcatcaca

SEQ ID NO: 221777 - DNA, 20 bp, Artificial Sequence
  Description of Artificial Sequence: Synthetic oligonucleotide
  Target: ATXN1; (-) strand; PAM type: YTN; PAM sequence: CTC
ctttggcagtgtcttgcatc

SEQ ID NO: 221778 - DNA, 20 bp, Artificial Sequence
  Description of Artificial Sequence: Synthetic oligonucleotide
  Target: ATXN1; (-) strand; PAM type: YTN; PAM sequence: TTC
tcctttggcagtgtcttgca

SEQ ID NO: 221779 - DNA, 20 bp, Artificial Sequence
  Description of Artificial Sequence: Synthetic oligonucleotide
  Target: ATXN1; (-) strand; PAM type: YTN; PAM sequence: CTT
ctcctttggcagtgtcttgc

SEQ ID NO: 221780 - DNA, 20 bp, Artificial Sequence
  Description of Artificial Sequence: Synthetic oligonucleotide
  Target: ATXN1; (-) strand; PAM type: YTN; PAM sequence: CTG
tccgcttctcctttggcagt

SEQ ID NO: 221781 - DNA, 20 bp, Artificial Sequence
  Description of Artificial Sequence: Synthetic oligonucleotide
  Target: ATXN1; (-) strand; PAM type: YTN; PAM sequence: TTC
cccataaccctgtccgcttc

SEQ ID NO: 221782 - DNA, 20 bp, Artificial Sequence
  Description of Artificial Sequence: Synthetic oligonucleotide
  Target: ATXN1; (-) strand; PAM type: YTN; PAM sequence: CTT
ccccataaccctgtccgctt

SEQ ID NO: 221783 - DNA, 20 bp, Artificial Sequence
  Description of Artificial Sequence: Synthetic oligonucleotide
  Target: ATXN1; (-) strand; PAM type: YTN; PAM sequence: TTC
cttccccataaccctgtccg

SEQ ID NO: 221784 - DNA, 20 bp, Artificial Sequence
  Description of Artificial Sequence: Synthetic oligonucleotide
  Target: ATXN1; (-) strand; PAM type: YTN; PAM sequence: TTG
gagacatgtatgatgatgtg

SEQ ID NO: 221785 - DNA, 20 bp, Artificial Sequence
  Description of Artificial Sequence: Synthetic oligonucleotide
  Target: ATXN1; (-) strand; PAM type: YTN; PAM sequence: CTA
tattggagacatgtatgatg

SEQ ID NO: 221786 - DNA, 20 bp, Artificial Sequence
  Description of Artificial Sequence: Synthetic oligonucleotide
  Target: ATXN1; (-) strand; PAM type: YTN; PAM sequence: TTC
tatattggagacatgtatga

SEQ ID NO: 221787 - DNA, 20 bp, Artificial Sequence
  Description of Artificial Sequence: Synthetic oligonucleotide
  Target: ATXN1; (-) strand; PAM type: YTN; PAM sequence: TTT
ctatattggagacatgtatg

SEQ ID NO: 221788 - DNA, 20 bp, Artificial Sequence
  Description of Artificial Sequence: Synthetic oligonucleotide
  Target: ATXN1; (-) strand; PAM type: YTN; PAM sequence: TTT
tctatattggagacatgtat

SEQ ID NO: 221789 - DNA, 20 bp, Artificial Sequence
  Description of Artificial Sequence: Synthetic oligonucleotide
  Target: ATXN1; (-) strand; PAM type: YTN; PAM sequence: TTT
ttctatattggagacatgta

SEQ ID NO: 221790 - DNA, 20 bp, Artificial Sequence
  Description of Artificial Sequence: Synthetic oligonucleotide
  Target: ATXN1; (-) strand; PAM type: YTN; PAM sequence: TTG
ggaatgcagcatttttctat

SEQ ID NO: 221791 - DNA, 20 bp, Artificial Sequence
  Description of Artificial Sequence: Synthetic oligonucleotide
  Target: ATXN1; (-) strand; PAM type: YTN; PAM sequence: TTT
gggaatgcagcatttttcta

SEQ ID NO: 221792 - DNA, 20 bp, Artificial Sequence
  Description of Artificial Sequence: Synthetic oligonucleotide
  Target: ATXN1; (-) strand; PAM type: YTN; PAM sequence: TTC
ataatgcagcatttgggaat

SEQ ID NO: 221793 - DNA, 20 bp, Artificial Sequence
  Description of Artificial Sequence: Synthetic oligonucleotide
  Target: ATXN1; (-) strand; PAM type: YTN; PAM sequence: TTC
attcataatgcagcatttgg

SEQ ID NO: 221794 - DNA, 20 bp, Artificial Sequence
  Description of Artificial Sequence: Synthetic oligonucleotide
  Target: ATXN1; (-) strand; PAM type: YTN; PAM sequence: TTT
cattcataatgcagcatttg

SEQ ID NO: 221795 - DNA, 20 bp, Artificial Sequence
  Description of Artificial Sequence: Synthetic oligonucleotide
  Target: ATXN1; (-) strand; PAM type: YTN; PAM sequence: TTT
tcattcataatgcagcattt

SEQ ID NO: 221796 - DNA, 20 bp, Artificial Sequence
  Description of Artificial Sequence: Synthetic oligonucleotide
  Target: ATXN1; (-) strand; PAM type: YTN; PAM sequence: TTG
atgttttcattcataatgca

SEQ ID NO: 221797 - DNA, 20 bp, Artificial Sequence
  Description of Artificial Sequence: Synthetic oligonucleotide
  Target: ATXN1; (-) strand; PAM type: YTN; PAM sequence: CTT
gatgttttcattcataatgc

SEQ ID NO: 221798 - DNA, 20 bp, Artificial Sequence
  Description of Artificial Sequence: Synthetic oligonucleotide
  Target: ATXN1; (-) strand; PAM type: YTN; PAM sequence: CTG
ccttgatgttttcattcata

SEQ ID NO: 221799 - DNA, 20 bp, Artificial Sequence
  Description of Artificial Sequence: Synthetic oligonucleotide
  Target: ATXN1; (-) strand; PAM type: YTN; PAM sequence: TTA
cctgccttgatgttttcatt

SEQ ID NO: 221800 - DNA, 20 bp, Artificial Sequence
  Description of Artificial Sequence: Synthetic oligonucleotide
  Target: ATXN1; (-) strand; PAM type: YTN; PAM sequence: TTC
atggtgttacctgccttgat

SEQ ID NO: 221801 - DNA, 20 bp, Artificial Sequence
  Description of Artificial Sequence: Synthetic oligonucleotide
  Target: ATXN1; (-) strand; PAM type: YTN; PAM sequence: CTT
catggtgttacctgccttga

SEQ ID NO: 221802 - DNA, 20 bp, Artificial Sequence
  Description of Artificial Sequence: Synthetic oligonucleotide
  Target: ATXN1; (-) strand; PAM type: YTN; PAM sequence: TTA
gagacacaggcttcatggtg

SEQ ID NO: 221803 - DNA, 20 bp, Artificial Sequence
  Description of Artificial Sequence: Synthetic oligonucleotide
  Target: ATXN1; (-) strand; PAM type: YTN; PAM sequence: TTG
ggtagccagattagagacac

SEQ ID NO: 221804 - DNA, 20 bp, Artificial Sequence
  Description of Artificial Sequence: Synthetic oligonucleotide
  Target: ATXN1; (-) strand; PAM type: YTN; PAM sequence: TTT
gggtagccagattagagaca

SEQ ID NO: 221805 - DNA, 20 bp, Artificial Sequence
  Description of Artificial Sequence: Synthetic oligonucleotide
  Target: ATXN1; (-) strand; PAM type: YTN; PAM sequence: TTA
tttgggtagccagattagag

SEQ ID NO: 221806 - DNA, 20 bp, Artificial Sequence
  Description of Artificial Sequence: Synthetic oligonucleotide
  Target: ATXN1; (-) strand; PAM type: YTN; PAM sequence: CTT
atttgggtagccagattaga

SEQ ID NO: 221807 - DNA, 20 bp, Artificial Sequence
  Description of Artificial Sequence: Synthetic oligonucleotide
  Target: ATXN1; (-) strand; PAM type: YTN; PAM sequence: TTA
gtagccttatttgggtagcc

SEQ ID NO: 221808 - DNA, 20 bp, Artificial Sequence
  Description of Artificial Sequence: Synthetic oligonucleotide
  Target: ATXN1; (-) strand; PAM type: YTN; PAM sequence: TTG
atgagcattagtagccttat

SEQ ID NO: 221809 - DNA, 20 bp, Artificial Sequence
  Description of Artificial Sequence: Synthetic oligonucleotide
  Target: ATXN1; (-) strand; PAM type: YTN; PAM sequence: CTG
ttgatgagcattagtagcct

SEQ ID NO: 221810 - DNA, 20 bp, Artificial Sequence
  Description of Artificial Sequence: Synthetic oligonucleotide
  Target: ATXN1; (-) strand; PAM type: YTN; PAM sequence: CTA
ccctgttgatgagcattagt

SEQ ID NO: 221811 - DNA, 20 bp, Artificial Sequence
  Description of Artificial Sequence: Synthetic oligonucleotide
  Target: ATXN1; (-) strand; PAM type: YTN; PAM sequence: TTA
ccaatgtaatactaccctgt

SEQ ID NO: 221812 - DNA, 20 bp, Artificial Sequence
  Description of Artificial Sequence: Synthetic oligonucleotide
  Target: ATXN1; (-) strand; PAM type: YTN; PAM sequence: CTT
accaatgtaatactaccctg

SEQ ID NO: 221813 - DNA, 20 bp, Artificial Sequence
  Description of Artificial Sequence: Synthetic oligonucleotide
  Target: ATXN1; (-) strand; PAM type: YTN; PAM sequence: CTC
acacttaccaatgtaatact

SEQ ID NO: 221814 - DNA, 20 bp, Artificial Sequence
  Description of Artificial Sequence: Synthetic oligonucleotide
  Target: ATXN1; (-) strand; PAM type: YTN; PAM sequence: CTC
actcacacttaccaatgtaa

SEQ ID NO: 221815 - DNA, 20 bp, Artificial Sequence
  Description of Artificial Sequence: Synthetic oligonucleotide
  Target: ATXN1; (-) strand; PAM type: YTN; PAM sequence: TTG
caaactcactcacacttacc

SEQ ID NO: 221816 - DNA, 20 bp, Artificial Sequence
  Description of Artificial Sequence: Synthetic oligonucleotide
  Target: ATXN1; (-) strand; PAM type: YTN; PAM sequence: TTC
atcgaattgcaaactcactc

SEQ ID NO: 221817 - DNA, 20 bp, Artificial Sequence
  Description of Artificial Sequence: Synthetic oligonucleotide
  Target: ATXN1; (-) strand; PAM type: YTN; PAM sequence: TTT
catcgaattgcaaactcact

SEQ ID NO: 221818 - DNA, 20 bp, Artificial Sequence
  Description of Artificial Sequence: Synthetic oligonucleotide
  Target: ATXN1; (-) strand; PAM type: YTN; PAM sequence: TTT
tcatcgaattgcaaactcac

SEQ ID NO: 221819 - DNA, 20 bp, Artificial Sequence
  Description of Artificial Sequence: Synthetic oligonucleotide
  Target: ATXN1; (-) strand; PAM type: YTN; PAM sequence: TTT
ttcatcgaattgcaaactca

SEQ ID NO: 221820 - DNA, 20 bp, Artificial Sequence
  Description of Artificial Sequence: Synthetic oligonucleotide
  Target: ATXN1; (-) strand; PAM type: YTN; PAM sequence: TTT
tttcatcgaattgcaaactc

SEQ ID NO: 221821 - DNA, 20 bp, Artificial Sequence
  Description of Artificial Sequence: Synthetic oligonucleotide
  Target: ATXN1; (-) strand; PAM type: YTN; PAM sequence: TTT
ttttcatcgaattgcaaact

SEQ ID NO: 221822 - DNA, 20 bp, Artificial Sequence
  Description of Artificial Sequence: Synthetic oligonucleotide
  Target: ATXN1; (-) strand; PAM type: YTN; PAM sequence: TTG
tatatatatttttttcatcg

SEQ ID NO: 221823 - DNA, 20 bp, Artificial Sequence
  Description of Artificial Sequence: Synthetic oligonucleotide
  Target: ATXN1; (-) strand; PAM type: YTN; PAM sequence: TTC
agttgtatatatattttttt

SEQ ID NO: 221824 - DNA, 20 bp, Artificial Sequence
  Description of Artificial Sequence: Synthetic oligonucleotide
  Target: ATXN1; (-) strand; PAM type: YTN; PAM sequence: CTT
cagttgtatatatatttttt

SEQ ID NO: 221825 - DNA, 20 bp, Artificial Sequence
  Description of Artificial Sequence: Synthetic oligonucleotide
  Target: ATXN1; (-) strand; PAM type: YTN; PAM sequence: TTA
gaaatcttcagttgtatata

SEQ ID NO: 221826 - DNA, 20 bp, Artificial Sequence
  Description of Artificial Sequence: Synthetic oligonucleotide
  Target: ATXN1; (-) strand; PAM type: YTN; PAM sequence: TTT
agaaatcttcagttgtatat

SEQ ID NO: 221827 - DNA, 20 bp, Artificial Sequence
  Description of Artificial Sequence: Synthetic oligonucleotide
  Target: ATXN1; (-) strand; PAM type: YTN; PAM sequence: TTT
tagaaatcttcagttgtata

SEQ ID NO: 221828 - DNA, 20 bp, Artificial Sequence
  Description of Artificial Sequence: Synthetic oligonucleotide
  Target: ATXN1; (-) strand; PAM type: YTN; PAM sequence: CTT
ttagaaatcttcagttgtat

SEQ ID NO: 221829 - DNA, 20 bp, Artificial Sequence
  Description of Artificial Sequence: Synthetic oligonucleotide
  Target: ATXN1; (-) strand; PAM type: YTN; PAM sequence: TTA
tcttttagaaatcttcagtt

SEQ ID NO: 221830 - DNA, 20 bp, Artificial Sequence
  Description of Artificial Sequence: Synthetic oligonucleotide
  Target: ATXN1; (-) strand; PAM type: YTN; PAM sequence: TTA
gtgaattatcttttagaaat

SEQ ID NO: 221831 - DNA, 20 bp, Artificial Sequence
  Description of Artificial Sequence: Synthetic oligonucleotide
  Target: ATXN1; (-) strand; PAM type: YTN; PAM sequence: CTA
gccatgtaaaagggtgaatg

SEQ ID NO: 221832 - DNA, 20 bp, Artificial Sequence
  Description of Artificial Sequence: Synthetic oligonucleotide
  Target: ATXN1; (-) strand; PAM type: YTN; PAM sequence: TTG
actagccatgtaaaagggtg

SEQ ID NO: 221833 - DNA, 20 bp, Artificial Sequence
  Description of Artificial Sequence: Synthetic oligonucleotide
  Target: ATXN1; (-) strand; PAM type: YTN; PAM sequence: CTT
gactagccatgtaaaagggt

SEQ ID NO: 221834 - DNA, 20 bp, Artificial Sequence
  Description of Artificial Sequence: Synthetic oligonucleotide
  Target: ATXN1; (-) strand; PAM type: YTN; PAM sequence: TTC
ttgactagccatgtaaaagg

SEQ ID NO: 221835 - DNA, 20 bp, Artificial Sequence
  Description of Artificial Sequence: Synthetic oligonucleotide
  Target: ATXN1; (-) strand; PAM type: YTN; PAM sequence: CTT
cttgactagccatgtaaaag

SEQ ID NO: 221836 - DNA, 20 bp, Artificial Sequence
  Description of Artificial Sequence: Synthetic oligonucleotide
  Target: ATXN1; (-) strand; PAM type: YTN; PAM sequence: CTC
ttcttgactagccatgtaaa

SEQ ID NO: 221837 - DNA, 20 bp, Artificial Sequence
  Description of Artificial Sequence: Synthetic oligonucleotide
  Target: ATXN1; (-) strand; PAM type: YTN; PAM sequence: TTG
ctcttcttgactagccatgt

SEQ ID NO: 221838 - DNA, 20 bp, Artificial Sequence
  Description of Artificial Sequence: Synthetic oligonucleotide
  Target: ATXN1; (-) strand; PAM type: YTN; PAM sequence: TTT
gctcttcttgactagccatg

SEQ ID NO: 221839 - DNA, 20 bp, Artificial Sequence
  Description of Artificial Sequence: Synthetic oligonucleotide
  Target: ATXN1; (-) strand; PAM type: YTN; PAM sequence: TTT
tgctcttcttgactagccat

SEQ ID NO: 221840 - DNA, 20 bp, Artificial Sequence
  Description of Artificial Sequence: Synthetic oligonucleotide
  Target: ATXN1; (-) strand; PAM type: YTN; PAM sequence: CTT
ttgctcttcttgactagcca

SEQ ID NO: 221841 - DNA, 20 bp, Artificial Sequence
  Description of Artificial Sequence: Synthetic oligonucleotide
  Target: ATXN1; (-) strand; PAM type: YTN; PAM sequence: TTC
ttttgctcttcttgactagc

SEQ ID NO: 221842 - DNA, 20 bp, Artificial Sequence
  Description of Artificial Sequence: Synthetic oligonucleotide
  Target: ATXN1; (-) strand; PAM type: YTN; PAM sequence: CTC
agtccatgtaagagcattct

SEQ ID NO: 221843 - DNA, 20 bp, Artificial Sequence
  Description of Artificial Sequence: Synthetic oligonucleotide
  Target: ATXN1; (-) strand; PAM type: YTN; PAM sequence: CTG
agtctcagtccatgtaagag

SEQ ID NO: 221844 - DNA, 20 bp, Artificial Sequence
  Description of Artificial Sequence: Synthetic oligonucleotide
  Target: ATXN1; (-) strand; PAM type: YTN; PAM sequence: TTA
aaacctgagtctcagtccat

SEQ ID NO: 221845 - DNA, 20 bp, Artificial Sequence
  Description of Artificial Sequence: Synthetic oligonucleotide
  Target: ATXN1; (-) strand; PAM type: YTN; PAM sequence: CTT
aaaacctgagtctcagtcca

SEQ ID NO: 221846 - DNA, 20 bp, Artificial Sequence
  Description of Artificial Sequence: Synthetic oligonucleotide
  Target: ATXN1; (-) strand; PAM type: YTN; PAM sequence: CTG
gcagggtcttaaaacctgag

SEQ ID NO: 221847 - DNA, 20 bp, Artificial Sequence
  Description of Artificial Sequence: Synthetic oligonucleotide
  Target: ATXN1; (-) strand; PAM type: YTN; PAM sequence: TTA
aatctggcagggtcttaaaa

SEQ ID NO: 221848 - DNA, 20 bp, Artificial Sequence
  Description of Artificial Sequence: Synthetic oligonucleotide
  Target: ATXN1; (-) strand; PAM type: YTN; PAM sequence: TTA
ttaaatctggcagggtctta

SEQ ID NO: 221849 - DNA, 20 bp, Artificial Sequence
  Description of Artificial Sequence: Synthetic oligonucleotide
  Target: ATXN1; (-) strand; PAM type: YTN; PAM sequence: TTA
gaggttattaaatctggcag

SEQ ID NO: 221850 - DNA, 20 bp, Artificial Sequence
  Description of Artificial Sequence: Synthetic oligonucleotide
  Target: ATXN1; (-) strand; PAM type: YTN; PAM sequence: TTC
aaggtaaaaagttagaggtt

SEQ ID NO: 221851 - DNA, 20 bp, Artificial Sequence
  Description of Artificial Sequence: Synthetic oligonucleotide
  Target: ATXN1; (-) strand; PAM type: YTN; PAM sequence: TTT
caaggtaaaaagttagaggt

SEQ ID NO: 221852 - DNA, 20 bp, Artificial Sequence
  Description of Artificial Sequence: Synthetic oligonucleotide
  Target: ATXN1; (-) strand; PAM type: YTN; PAM sequence: CTT
tcaaggtaaaaagttagagg

SEQ ID NO: 221853 - DNA, 20 bp, Artificial Sequence
  Description of Artificial Sequence: Synthetic oligonucleotide
  Target: ATXN1; (-) strand; PAM type: YTN; PAM sequence: TTC
agtaactttcaaggtaaaaa

SEQ ID NO: 221854 - DNA, 20 bp, Artificial Sequence
  Description of Artificial Sequence: Synthetic oligonucleotide
  Target: ATXN1; (-) strand; PAM type: YTN; PAM sequence: CTT
cagtaactttcaaggtaaaa

SEQ ID NO: 221855 - DNA, 20 bp, Artificial Sequence
  Description of Artificial Sequence: Synthetic oligonucleotide
  Target: ATXN1; (-) strand; PAM type: YTN; PAM sequence: TTA
tatacttcagtaactttcaa

SEQ ID NO: 221856 - DNA, 20 bp, Artificial Sequence
  Description of Artificial Sequence: Synthetic oligonucleotide
  Target: ATXN1; (-) strand; PAM type: YTN; PAM sequence: CTG
tgttatatacttcagtaact

SEQ ID NO: 221857 - DNA, 20 bp, Artificial Sequence
  Description of Artificial Sequence: Synthetic oligonucleotide
  Target: ATXN1; (-) strand; PAM type: YTN; PAM sequence: TTA
tacaactgtgttatatactt

SEQ ID NO: 221858 - DNA, 20 bp, Artificial Sequence
  Description of Artificial Sequence: Synthetic oligonucleotide
  Target: ATXN1; (-) strand; PAM type: YTN; PAM sequence: TTT
atacaactgtgttatatact

SEQ ID NO: 221859 - DNA, 20 bp, Artificial Sequence
  Description of Artificial Sequence: Synthetic oligonucleotide
  Target: ATXN1; (-) strand; PAM type: YTN; PAM sequence: TTT
tatacaactgtgttatatac

SEQ ID NO: 221860 - DNA, 20 bp, Artificial Sequence
  Description of Artificial Sequence: Synthetic oligonucleotide
  Target: ATXN1; (-) strand; PAM type: YTN; PAM sequence: TTG
attttatacaactgtgttat

SEQ ID NO: 221861 - DNA, 20 bp, Artificial Sequence
  Description of Artificial Sequence: Synthetic oligonucleotide
  Target: ATXN1; (-) strand; PAM type: YTN; PAM sequence: TTG
tacattgattttatacaact

SEQ ID NO: 221862 - DNA, 20 bp, Artificial Sequence
  Description of Artificial Sequence: Synthetic oligonucleotide
  Target: ATXN1; (-) strand; PAM type: YTN; PAM sequence: TTT
gtacattgattttatacaac

SEQ ID NO: 221863 - DNA, 20 bp, Artificial Sequence
  Description of Artificial Sequence: Synthetic oligonucleotide
  Target: ATXN1; (-) strand; PAM type: YTN; PAM sequence: CTT
tgtacattgattttatacaa

SEQ ID NO: 221864 - DNA, 20 bp, Artificial Sequence
  Description of Artificial Sequence: Synthetic oligonucleotide
  Target: ATXN1; (-) strand; PAM type: YTN; PAM sequence: CTA
ctttgtacattgattttata

SEQ ID NO: 221865 - DNA, 20 bp, Artificial Sequence
  Description of Artificial Sequence: Synthetic oligonucleotide
  Target: ATXN1; (-) strand; PAM type: YTN; PAM sequence: TTG
aaataatgtactactttgta

SEQ ID NO: 221866 - DNA, 20 bp, Artificial Sequence
  Description of Artificial Sequence: Synthetic oligonucleotide
  Target: ATXN1; (-) strand; PAM type: YTN; PAM sequence: TTT
gaaataatgtactactttgt

SEQ ID NO: 221867 - DNA, 20 bp, Artificial Sequence
  Description of Artificial Sequence: Synthetic oligonucleotide
  Target: ATXN1; (-) strand; PAM type: YTN; PAM sequence: TTT
tgaaataatgtactactttg

SEQ ID NO: 221868 - DNA, 20 bp, Artificial Sequence
  Description of Artificial Sequence: Synthetic oligonucleotide
  Target: ATXN1; (-) strand; PAM type: YTN; PAM sequence: TTG
tgggttttgaaataatgtac

SEQ ID NO: 221869 - DNA, 20 bp, Artificial Sequence
  Description of Artificial Sequence: Synthetic oligonucleotide
  Target: ATXN1; (-) strand; PAM type: YTN; PAM sequence: TTA
attgtgggttttgaaataat

SEQ ID NO: 221870 - DNA, 20 bp, Artificial Sequence
  Description of Artificial Sequence: Synthetic oligonucleotide
  Target: ATXN1; (-) strand; PAM type: YTN; PAM sequence: CTG
ttaattgtgggttttgaaat

SEQ ID NO: 221871 - DNA, 20 bp, Artificial Sequence
  Description of Artificial Sequence: Synthetic oligonucleotide
  Target: ATXN1; (-) strand; PAM type: YTN; PAM sequence: TTC
ataggctgttaattgtgggt

SEQ ID NO: 221872 - DNA, 20 bp, Artificial Sequence
  Description of Artificial Sequence: Synthetic oligonucleotide
  Target: ATXN1; (-) strand; PAM type: YTN; PAM sequence: TTT
cataggctgttaattgtggg

SEQ ID NO: 221873 - DNA, 20 bp, Artificial Sequence
  Description of Artificial Sequence: Synthetic oligonucleotide
  Target: ATXN1; (-) strand; PAM type: YTN; PAM sequence: TTT
tcataggctgttaattgtgg

SEQ ID NO: 221874 - DNA, 20 bp, Artificial Sequence
  Description of Artificial Sequence: Synthetic oligonucleotide
  Target: ATXN1; (-) strand; PAM type: YTN; PAM sequence: TTG
gttttcataggctgttaatt

SEQ ID NO: 221875 - DNA, 20 bp, Artificial Sequence
  Description of Artificial Sequence: Synthetic oligonucleotide
  Target: ATXN1; (-) strand; PAM type: YTN; PAM sequence: CTA
ataccagaaagagttggttt

SEQ ID NO: 221876 - DNA, 20 bp, Artificial Sequence
  Description of Artificial Sequence: Synthetic oligonucleotide
  Target: ATXN1; (-) strand; PAM type: YTN; PAM sequence: CTA
gtgctaataccagaaagagt

SEQ ID NO: 221877 - DNA, 20 bp, Artificial Sequence
  Description of Artificial Sequence: Synthetic oligonucleotide
  Target: ATXN1; (-) strand; PAM type: YTN; PAM sequence: TTA
aaaggatgtatgaaactagt

SEQ ID NO: 221878 - DNA, 20 bp, Artificial Sequence
  Description of Artificial Sequence: Synthetic oligonucleotide
  Target: ATXN1; (-) strand; PAM type: YTN; PAM sequence: TTT
aaaaggatgtatgaaactag

SEQ ID NO: 221879 - DNA, 20 bp, Artificial Sequence
  Description of Artificial Sequence: Synthetic oligonucleotide
  Target: ATXN1; (-) strand; PAM type: YTN; PAM sequence: CTA
acatttaaaaggatgtatga

SEQ ID NO: 221880 - DNA, 20 bp, Artificial Sequence
  Description of Artificial Sequence: Synthetic oligonucleotide
  Target: ATXN1; (-) strand; PAM type: YTN; PAM sequence: TTC
aatgtccctaacatttaaaa

SEQ ID NO: 221881 - DNA, 20 bp, Artificial Sequence
  Description of Artificial Sequence: Synthetic oligonucleotide
  Target: ATXN1; (-) strand; PAM type: YTN; PAM sequence: TTT
caatgtccctaacatttaaa

SEQ ID NO: 221882 - DNA, 20 bp, Artificial Sequence
  Description of Artificial Sequence: Synthetic oligonucleotide
  Target: ATXN1; (-) strand; PAM type: YTN; PAM sequence: CTC
agtaatgaagaagtaagatg

SEQ ID NO: 221883 - DNA, 20 bp, Artificial Sequence
  Description of Artificial Sequence: Synthetic oligonucleotide
  Target: ATXN1; (-) strand; PAM type: YTN; PAM sequence: CTA
gcacaaagtaggcactcagt

SEQ ID NO: 221884 - DNA, 20 bp, Artificial Sequence
  Description of Artificial Sequence: Synthetic oligonucleotide
  Target: ATXN1; (-) strand; PAM type: YTN; PAM sequence: CTC
agggcctagcacaaagtagg

SEQ ID NO: 221885 - DNA, 20 bp, Artificial Sequence
  Description of Artificial Sequence: Synthetic oligonucleotide
  Target: ATXN1; (-) strand; PAM type: YTN; PAM sequence: CTC
atgtgtatcctcagggccta

SEQ ID NO: 221886 - DNA, 20 bp, Artificial Sequence
  Description of Artificial Sequence: Synthetic oligonucleotide
  Target: ATXN1; (-) strand; PAM type: YTN; PAM sequence: TTA
ctcatgtgtatcctcagggc

SEQ ID NO: 221887 - DNA, 20 bp, Artificial Sequence
  Description of Artificial Sequence: Synthetic oligonucleotide
  Target: ATXN1; (-) strand; PAM type: YTN; PAM sequence: TTT
actcatgtgtatcctcaggg

SEQ ID NO: 221888 - DNA, 20 bp, Artificial Sequence
  Description of Artificial Sequence: Synthetic oligonucleotide
  Target: ATXN1; (-) strand; PAM type: YTN; PAM sequence: TTT
tactcatgtgtatcctcagg

SEQ ID NO: 221889 - DNA, 20 bp, Artificial Sequence
  Description of Artificial Sequence: Synthetic oligonucleotide
  Target: ATXN1; (-) strand; PAM type: YTN; PAM sequence: CTA
gatggagagtgcaaggacca

SEQ ID NO: 221890 - DNA, 20 bp, Artificial Sequence
  Description of Artificial Sequence: Synthetic oligonucleotide
  Target: ATXN1; (-) strand; PAM type: YTN; PAM sequence: TTC
cccacaactagatggagagt

SEQ ID NO: 221891 - DNA, 20 bp, Artificial Sequence
  Description of Artificial Sequence: Synthetic oligonucleotide
  Target: ATXN1; (-) strand; PAM type: YTN; PAM sequence: TTT
ccccacaactagatggagag

SEQ ID NO: 221892 - DNA, 20 bp, Artificial Sequence
  Description of Artificial Sequence: Synthetic oligonucleotide
  Target: ATXN1; (-) strand; PAM type: YTN; PAM sequence: TTT
tccccacaactagatggaga

SEQ ID NO: 221893 - DNA, 20 bp, Artificial Sequence
  Description of Artificial Sequence: Synthetic oligonucleotide
  Target: ATXN1; (-) strand; PAM type: YTN; PAM sequence: TTA
ttttccccacaactagatgg

SEQ ID NO: 221894 - DNA, 20 bp, Artificial Sequence
  Description of Artificial Sequence: Synthetic oligonucleotide
  Target: ATXN1; (-) strand; PAM type: YTN; PAM sequence: TTT
attttccccacaactagatg

SEQ ID NO: 221895 - DNA, 20 bp, Artificial Sequence
  Description of Artificial Sequence: Synthetic oligonucleotide
  Target: ATXN1; (-) strand; PAM type: YTN; PAM sequence: TTG
tttattttccccacaactag

SEQ ID NO: 221896 - DNA, 20 bp, Artificial Sequence
  Description of Artificial Sequence: Synthetic oligonucleotide
  Target: ATXN1; (-) strand; PAM type: YTN; PAM sequence: TTT
gtttattttccccacaacta

SEQ ID NO: 221897 - DNA, 20 bp, Artificial Sequence
  Description of Artificial Sequence: Synthetic oligonucleotide
  Target: ATXN1; (-) strand; PAM type: YTN; PAM sequence: TTG
tttgtttattttccccacaa

SEQ ID NO: 221898 - DNA, 20 bp, Artificial Sequence
  Description of Artificial Sequence: Synthetic oligonucleotide
  Target: ATXN1; (-) strand; PAM type: YTN; PAM sequence: CTG
ccattgtttgtttattttcc

SEQ ID NO: 221899 - DNA, 20 bp, Artificial Sequence
  Description of Artificial Sequence: Synthetic oligonucleotide
  Target: ATXN1; (-) strand; PAM type: YTN; PAM sequence: CTC
tgccattgtttgtttatttt

SEQ ID NO: 221900 - DNA, 20 bp, Artificial Sequence
  Description of Artificial Sequence: Synthetic oligonucleotide
  Target: ATXN1; (-) strand; PAM type: YTN; PAM sequence: TTC
ataatcgtggcatactctgc

SEQ ID NO: 221901 - DNA, 20 bp, Artificial Sequence
  Description of Artificial Sequence: Synthetic oligonucleotide
  Target: ATXN1; (-) strand; PAM type: YTN; PAM sequence: TTT
cataatcgtggcatactctg

SEQ ID NO: 221902 - DNA, 20 bp, Artificial Sequence
  Description of Artificial Sequence: Synthetic oligonucleotide
  Target: ATXN1; (-) strand; PAM type: YTN; PAM sequence: CTT
tcataatcgtggcatactct

SEQ ID NO: 221903 - DNA, 20 bp, Artificial Sequence
  Description of Artificial Sequence: Synthetic oligonucleotide
  Target: ATXN1; (-) strand; PAM type: YTN; PAM sequence: CTC
tttcataatcgtggcatact

SEQ ID NO: 221904 - DNA, 20 bp, Artificial Sequence
  Description of Artificial Sequence: Synthetic oligonucleotide
  Target: ATXN1; (-) strand; PAM type: YTN; PAM sequence: TTC
ctctttcataatcgtggcat

SEQ ID NO: 221905 - DNA, 20 bp, Artificial Sequence
  Description of Artificial Sequence: Synthetic oligonucleotide
  Target: ATXN1; (-) strand; PAM type: YTN; PAM sequence: TTT
cctctttcataatcgtggca

SEQ ID NO: 221906 - DNA, 20 bp, Artificial Sequence
  Description of Artificial Sequence: Synthetic oligonucleotide
  Target: ATXN1; (-) strand; PAM type: YTN; PAM sequence: CTT
tcctctttcataatcgtggc

SEQ ID NO: 221907 - DNA, 20 bp, Artificial Sequence
  Description of Artificial Sequence: Synthetic oligonucleotide
  Target: ATXN1; (-) strand; PAM type: YTN; PAM sequence: CTG
ctttcctctttcataatcgt

SEQ ID NO: 221908 - DNA, 20 bp, Artificial Sequence
  Description of Artificial Sequence: Synthetic oligonucleotide
  Target: ATXN1; (-) strand; PAM type: YTN; PAM sequence: CTC
agactgctttcctctttcat

SEQ ID NO: 221909 - DNA, 20 bp, Artificial Sequence
  Description of Artificial Sequence: Synthetic oligonucleotide
  Target: ATXN1; (-) strand; PAM type: YTN; PAM sequence: TTC
caccactcagactgctttcc

SEQ ID NO: 221910 - DNA, 20 bp, Artificial Sequence
  Description of Artificial Sequence: Synthetic oligonucleotide
  Target: ATXN1; (-) strand; PAM type: YTN; PAM sequence: TTA
taggaagaagaatccattcc

SEQ ID NO: 221911 - DNA, 20 bp, Artificial Sequence
  Description of Artificial Sequence: Synthetic oligonucleotide
  Target: ATXN1; (-) strand; PAM type: YTN; PAM sequence: TTT
ataggaagaagaatccattc

SEQ ID NO: 221912 - DNA, 20 bp, Artificial Sequence
  Description of Artificial Sequence: Synthetic oligonucleotide
  Target: ATXN1; (-) strand; PAM type: YTN; PAM sequence: TTT
tataggaagaagaatccatt

SEQ ID NO: 221913 - DNA, 20 bp, Artificial Sequence
  Description of Artificial Sequence: Synthetic oligonucleotide
  Target: ATXN1; (-) strand; PAM type: YTN; PAM sequence: TTT
ttataggaagaagaatccat

SEQ ID NO: 221914 - DNA, 20 bp, Artificial Sequence
  Description of Artificial Sequence: Synthetic oligonucleotide
  Target: ATXN1; (-) strand; PAM type: YTN; PAM sequence: CTT
tttataggaagaagaatcca

SEQ ID NO: 221915 - DNA, 20 bp, Artificial Sequence
  Description of Artificial Sequence: Synthetic oligonucleotide
  Target: ATXN1; (-) strand; PAM type: YTN; PAM sequence: TTC
tttttataggaagaagaatc

SEQ ID NO: 221916 - DNA, 20 bp, Artificial Sequence
  Description of Artificial Sequence: Synthetic oligonucleotide
  Target: ATXN1; (-) strand; PAM type: YTN; PAM sequence: TTA
tattctttttataggaagaa

SEQ ID NO: 221917 - DNA, 20 bp, Artificial Sequence
  Description of Artificial Sequence: Synthetic oligonucleotide
  Target: ATXN1; (-) strand; PAM type: YTN; PAM sequence: TTT
atattctttttataggaaga

SEQ ID NO: 221918 - DNA, 20 bp, Artificial Sequence
  Description of Artificial Sequence: Synthetic oligonucleotide
  Target: ATXN1; (-) strand; PAM type: YTN; PAM sequence: TTT
tatattctttttataggaag

SEQ ID NO: 221919 - DNA, 20 bp, Artificial Sequence
  Description of Artificial Sequence: Synthetic oligonucleotide
  Target: ATXN1; (-) strand; PAM type: YTN; PAM sequence: TTG
ggaatcaggataggaaaccc

SEQ ID NO: 221920 - DNA, 20 bp, Artificial Sequence
  Description of Artificial Sequence: Synthetic oligonucleotide
  Target: ATXN1; (-) strand; PAM type: YTN; PAM sequence: TTG
tgagttgggaatcaggatag

SEQ ID NO: 221921 - DNA, 20 bp, Artificial Sequence
  Description of Artificial Sequence: Synthetic oligonucleotide
  Target: ATXN1; (-) strand; PAM type: YTN; PAM sequence: TTT
gtgagttgggaatcaggata

SEQ ID NO: 221922 - DNA, 20 bp, Artificial Sequence
  Description of Artificial Sequence: Synthetic oligonucleotide
  Target: ATXN1; (-) strand; PAM type: YTN; PAM sequence: TTA
atttgtgagttgggaatcag

SEQ ID NO: 221923 - DNA, 20 bp, Artificial Sequence
  Description of Artificial Sequence: Synthetic oligonucleotide
  Target: ATXN1; (-) strand; PAM type: YTN; PAM sequence: TTT
aatttgtgagttgggaatca

SEQ ID NO: 221924 - DNA, 20 bp, Artificial Sequence
  Description of Artificial Sequence: Synthetic oligonucleotide
  Target: ATXN1; (-) strand; PAM type: YTN; PAM sequence: CTT
taatttgtgagttgggaatc

SEQ ID NO: 221925 - DNA, 20 bp, Artificial Sequence
  Description of Artificial Sequence: Synthetic oligonucleotide
  Target: ATXN1; (-) strand; PAM type: YTN; PAM sequence: TTA
tcacaacaagcagtccataa

SEQ ID NO: 221926 - DNA, 20 bp, Artificial Sequence
  Description of Artificial Sequence: Synthetic oligonucleotide
  Target: ATXN1; (-) strand; PAM type: YTN; PAM sequence: TTT
atcacaacaagcagtccata

SEQ ID NO: 221927 - DNA, 20 bp, Artificial Sequence
  Description of Artificial Sequence: Synthetic oligonucleotide
  Target: ATXN1; (-) strand; PAM type: YTN; PAM sequence: TTT
tatcacaacaagcagtccat

SEQ ID NO: 221928 - DNA, 20 bp, Artificial Sequence
  Description of Artificial Sequence: Synthetic oligonucleotide
  Target: ATXN1; (-) strand; PAM type: YTN; PAM sequence: TTA
ttttatcacaacaagcagtc

SEQ ID NO: 221929 - DNA, 20 bp, Artificial Sequence
  Description of Artificial Sequence: Synthetic oligonucleotide
  Target: ATXN1; (-) strand; PAM type: YTN; PAM sequence: CTA
aaattattttatcacaacaa

SEQ ID NO: 221930 - DNA, 20 bp, Artificial Sequence
  Description of Artificial Sequence: Synthetic oligonucleotide
  Target: ATXN1; (-) strand; PAM type: YTN; PAM sequence: TTC
caaccagaaggaatcatact

SEQ ID NO: 221931 - DNA, 20 bp, Artificial Sequence
  Description of Artificial Sequence: Synthetic oligonucleotide
  Target: ATXN1; (-) strand; PAM type: YTN; PAM sequence: TTT
ccaaccagaaggaatcatac

SEQ ID NO: 221932 - DNA, 20 bp, Artificial Sequence
  Description of Artificial Sequence: Synthetic oligonucleotide
  Target: ATXN1; (-) strand; PAM type: YTN; PAM sequence: CTG
gtaggaagatgtttccaacc

SEQ ID NO: 221933 - DNA, 20 bp, Artificial Sequence
  Description of Artificial Sequence: Synthetic oligonucleotide
  Target: ATXN1; (-) strand; PAM type: YTN; PAM sequence: TTA
aatctggtaggaagatgttt

SEQ ID NO: 221934 - DNA, 20 bp, Artificial Sequence
  Description of Artificial Sequence: Synthetic oligonucleotide
  Target: ATXN1; (-) strand; PAM type: YTN; PAM sequence: TTG
tagttaaatctggtaggaag

SEQ ID NO: 221935 - DNA, 20 bp, Artificial Sequence
  Description of Artificial Sequence: Synthetic oligonucleotide
  Target: ATXN1; (-) strand; PAM type: YTN; PAM sequence: TTT
gtagttaaatctggtaggaa

SEQ ID NO: 221936 - DNA, 20 bp, Artificial Sequence
  Description of Artificial Sequence: Synthetic oligonucleotide
  Target: ATXN1; (-) strand; PAM type: YTN; PAM sequence: TTT
tgtagttaaatctggtagga

SEQ ID NO: 221937 - DNA, 20 bp, Artificial Sequence
  Description of Artificial Sequence: Synthetic oligonucleotide
  Target: ATXN1; (-) strand; PAM type: YTN; PAM sequence: TTC
cagagtagaggtcagttttg

SEQ ID NO: 221938 - DNA, 20 bp, Artificial Sequence
  Description of Artificial Sequence: Synthetic oligonucleotide
  Target: ATXN1; (-) strand; PAM type: YTN; PAM sequence: TTG
aacattccagagtagaggtc

SEQ ID NO: 221939 - DNA, 20 bp, Artificial Sequence
  Description of Artificial Sequence: Synthetic oligonucleotide
  Target: ATXN1; (-) strand; PAM type: YTN; PAM sequence: TTG
gccagttgaacattccagag

SEQ ID NO: 221940 - DNA, 20 bp, Artificial Sequence
  Description of Artificial Sequence: Synthetic oligonucleotide
  Target: ATXN1; (-) strand; PAM type: YTN; PAM sequence: CTT
ggccagttgaacattccaga

SEQ ID NO: 221941 - DNA, 20 bp, Artificial Sequence
  Description of Artificial Sequence: Synthetic oligonucleotide
  Target: ATXN1; (-) strand; PAM type: YTN; PAM sequence: TTC
ttggccagttgaacattcca

SEQ ID NO: 221942 - DNA, 20 bp, Artificial Sequence
  Description of Artificial Sequence: Synthetic oligonucleotide
  Target: ATXN1; (-) strand; PAM type: YTN; PAM sequence: TTT
cttggccagttgaacattcc

SEQ ID NO: 221943 - DNA, 20 bp, Artificial Sequence
  Description of Artificial Sequence: Synthetic oligonucleotide
  Target: ATXN1; (-) strand; PAM type: YTN; PAM sequence: TTT
tcttggccagttgaacattc

SEQ ID NO: 221944 - DNA, 20 bp, Artificial Sequence
  Description of Artificial Sequence: Synthetic oligonucleotide
  Target: ATXN1; (-) strand; PAM type: YTN; PAM sequence: CTT
ttcttggccagttgaacatt

SEQ ID NO: 221945 - DNA, 20 bp, Artificial Sequence
  Description of Artificial Sequence: Synthetic oligonucleotide
  Target: ATXN1; (-) strand; PAM type: YTN; PAM sequence: TTG
atgtaacacttttcttggcc

SEQ ID NO: 221946 - DNA, 20 bp, Artificial Sequence
  Description of Artificial Sequence: Synthetic oligonucleotide
  Target: ATXN1; (-) strand; PAM type: YTN; PAM sequence: TTG
gtgttgatgtaacacttttc

SEQ ID NO: 221947 - DNA, 20 bp, Artificial Sequence
  Description of Artificial Sequence: Synthetic oligonucleotide
  Target: ATXN1; (-) strand; PAM type: YTN; PAM sequence: TTG
tgatggaatagaaaaaaaaa

SEQ ID NO: 221948 - DNA, 20 bp, Artificial Sequence
  Description of Artificial Sequence: Synthetic oligonucleotide
  Target: ATXN1; (-) strand; PAM type: YTN; PAM sequence: CTT
gtgatggaatagaaaaaaaa

SEQ ID NO: 221949 - DNA, 20 bp, Artificial Sequence
  Description of Artificial Sequence: Synthetic oligonucleotide
  Target: ATXN1; (-) strand; PAM type: YTN; PAM sequence: TTC
agtggacataagaggaaagg

SEQ ID NO: 221950 - DNA, 20 bp, Artificial Sequence
  Description of Artificial Sequence: Synthetic oligonucleotide
  Target: ATXN1; (-) strand; PAM type: YTN; PAM sequence: CTA
caaaatacagcagagggttc

SEQ ID NO: 221951 - DNA, 20 bp, Artificial Sequence
  Description of Artificial Sequence: Synthetic oligonucleotide
  Target: ATXN1; (-) strand; PAM type: YTN; PAM sequence: CTG
aaaggctacaaaatacagca

SEQ ID NO: 221952 - DNA, 20 bp, Artificial Sequence
  Description of Artificial Sequence: Synthetic oligonucleotide
  Target: ATXN1; (-) strand; PAM type: YTN; PAM sequence: CTA
gatctgaaaggctacaaaat

SEQ ID NO: 221953 - DNA, 20 bp, Artificial Sequence
  Description of Artificial Sequence: Synthetic oligonucleotide
  Target: ATXN1; (-) strand; PAM type: YTN; PAM sequence: TTA
agtgaaaataaaatgaaaca

SEQ ID NO: 221954 - DNA, 20 bp, Artificial Sequence
  Description of Artificial Sequence: Synthetic oligonucleotide
  Target: ATXN1; (-) strand; PAM type: YTN; PAM sequence: CTA
gttaagtgaaaataaaatga

SEQ ID NO: 221955 - DNA, 20 bp, Artificial Sequence
  Description of Artificial Sequence: Synthetic oligonucleotide
  Target: ATXN1; (-) strand; PAM type: YTN; PAM sequence: TTA
actagttaagtgaaaataaa

SEQ ID NO: 221956 - DNA, 20 bp, Artificial Sequence
  Description of Artificial Sequence: Synthetic oligonucleotide
  Target: ATXN1; (-) strand; PAM type: YTN; PAM sequence: TTA
aaaaaagtgttaactagtta

SEQ ID NO: 221957 - DNA, 20 bp, Artificial Sequence
  Description of Artificial Sequence: Synthetic oligonucleotide
  Target: ATXN1; (-) strand; PAM type: YTN; PAM sequence: TTT
aaaaaaagtgttaactagtt

SEQ ID NO: 221958 - DNA, 20 bp, Artificial Sequence
  Description of Artificial Sequence: Synthetic oligonucleotide
  Target: ATXN1; (-) strand; PAM type: YTN; PAM sequence: TTT
taaaaaaagtgttaactagt

SEQ ID NO: 221959 - DNA, 20 bp, Artificial Sequence
  Description of Artificial Sequence: Synthetic oligonucleotide
  Target: ATXN1; (-) strand; PAM type: YTN; PAM sequence: TTG
ttttaaaaaaagtgttaact

SEQ ID NO: 221960 - DNA, 20 bp, Artificial Sequence
  Description of Artificial Sequence: Synthetic oligonucleotide
  Target: ATXN1; (-) strand; PAM type: YTN; PAM sequence: TTC
attgttttaaaaaaagtgtt

SEQ ID NO: 221961 - DNA, 20 bp, Artificial Sequence
  Description of Artificial Sequence: Synthetic oligonucleotide
  Target: ATXN1; (-) strand; PAM type: YTN; PAM sequence: TTC
attcattgttttaaaaaaag

SEQ ID NO: 221962 - DNA, 20 bp, Artificial Sequence
  Description of Artificial Sequence: Synthetic oligonucleotide
  Target: ATXN1; (-) strand; PAM type: YTN; PAM sequence: CTA
cagacatgattcattcattg

SEQ ID NO: 221963 - DNA, 20 bp, Artificial Sequence
  Description of Artificial Sequence: Synthetic oligonucleotide
  Target: ATXN1; (-) strand; PAM type: YTN; PAM sequence: CTC
gcagtggccactacagacat

SEQ ID NO: 221964 - DNA, 20 bp, Artificial Sequence
  Description of Artificial Sequence: Synthetic oligonucleotide
  Target: ATXN1; (-) strand; PAM type: YTN; PAM sequence: TTG
ctcgcagtggccactacaga

SEQ ID NO: 221965 - DNA, 20 bp, Artificial Sequence
  Description of Artificial Sequence: Synthetic oligonucleotide
  Target: ATXN1; (-) strand; PAM type: YTN; PAM sequence: TTT
gctcgcagtggccactacag

SEQ ID NO: 221966 - DNA, 20 bp, Artificial Sequence
  Description of Artificial Sequence: Synthetic oligonucleotide
  Target: ATXN1; (-) strand; PAM type: YTN; PAM sequence: CTT
tgctcgcagtggccactaca

SEQ ID NO: 221967 - DNA, 20 bp, Artificial Sequence
  Description of Artificial Sequence: Synthetic oligonucleotide
  Target: ATXN1; (-) strand; PAM type: YTN; PAM sequence: TTC
ccatggtgctttgctcgcag

SEQ ID NO: 221968 - DNA, 20 bp, Artificial Sequence
  Description of Artificial Sequence: Synthetic oligonucleotide
  Target: ATXN1; (-) strand; PAM type: YTN; PAM sequence: TTT
cccatggtgctttgctcgca

SEQ ID NO: 221969 - DNA, 20 bp, Artificial Sequence
  Description of Artificial Sequence: Synthetic oligonucleotide
  Target: ATXN1; (-) strand; PAM type: YTN; PAM sequence: TTA
catttcccatggtgctttgc

SEQ ID NO: 221970 - DNA, 20 bp, Artificial Sequence
  Description of Artificial Sequence: Synthetic oligonucleotide
  Target: ATXN1; (-) strand; PAM type: YTN; PAM sequence: TTT
acatttcccatggtgctttg

SEQ ID NO: 221971 - DNA, 20 bp, Artificial Sequence
  Description of Artificial Sequence: Synthetic oligonucleotide
  Target: ATXN1; (-) strand; PAM type: YTN; PAM sequence: TTT
tacatttcccatggtgcttt

SEQ ID NO: 221972 - DNA, 20 bp, Artificial Sequence
  Description of Artificial Sequence: Synthetic oligonucleotide
  Target: ATXN1; (-) strand; PAM type: YTN; PAM sequence: TTT
ttacatttcccatggtgctt

SEQ ID NO: 221973 - DNA, 20 bp, Artificial Sequence
  Description of Artificial Sequence: Synthetic oligonucleotide
  Target: ATXN1; (-) strand; PAM type: YTN; PAM sequence: CTT
tttacatttcccatggtgct

SEQ ID NO: 221974 - DNA, 20 bp, Artificial Sequence
  Description of Artificial Sequence: Synthetic oligonucleotide
  Target: ATXN1; (-) strand; PAM type: YTN; PAM sequence: TTC
ctttttacatttcccatggt

SEQ ID NO: 221975 - DNA, 20 bp, Artificial Sequence
  Description of Artificial Sequence: Synthetic oligonucleotide
  Target: ATXN1; (-) strand; PAM type: YTN; PAM sequence: TTG
ttcctttttacatttcccat

SEQ ID NO: 221976 - DNA, 20 bp, Artificial Sequence
  Description of Artificial Sequence: Synthetic oligonucleotide
  Target: ATXN1; (-) strand; PAM type: YTN; PAM sequence: CTT
gttcctttttacatttccca

SEQ ID NO: 221977 - DNA, 20 bp, Artificial Sequence
  Description of Artificial Sequence: Synthetic oligonucleotide
  Target: ATXN1; (-) strand; PAM type: YTN; PAM sequence: CTC
ttgttcctttttacatttcc

SEQ ID NO: 221978 - DNA, 20 bp, Artificial Sequence
  Description of Artificial Sequence: Synthetic oligonucleotide
  Target: ATXN1; (-) strand; PAM type: YTN; PAM sequence: TTA
aggacaaggacaacctcttg

SEQ ID NO: 221979 - DNA, 20 bp, Artificial Sequence
  Description of Artificial Sequence: Synthetic oligonucleotide
  Target: ATXN1; (-) strand; PAM type: YTN; PAM sequence: TTT
aaggacaaggacaacctctt

SEQ ID NO: 221980 - DNA, 20 bp, Artificial Sequence
  Description of Artificial Sequence: Synthetic oligonucleotide
  Target: ATXN1; (-) strand; PAM type: YTN; PAM sequence: CTT
taaggacaaggacaacctct

SEQ ID NO: 221981 - DNA, 20 bp, Artificial Sequence
  Description of Artificial Sequence: Synthetic oligonucleotide
  Target: ATXN1; (-) strand; PAM type: YTN; PAM sequence: TTG
gaaatctttaaggacaagga

SEQ ID NO: 221982 - DNA, 20 bp, Artificial Sequence
  Description of Artificial Sequence: Synthetic oligonucleotide
  Target: ATXN1; (-) strand; PAM type: YTN; PAM sequence: CTC
aggttggaaatctttaagga

SEQ ID NO: 221983 - DNA, 20 bp, Artificial Sequence
  Description of Artificial Sequence: Synthetic oligonucleotide
  Target: ATXN1; (-) strand; PAM type: YTN; PAM sequence: CTG
actcaggttggaaatcttta

SEQ ID NO: 221984 - DNA, 20 bp, Artificial Sequence
  Description of Artificial Sequence: Synthetic oligonucleotide
  Target: ATXN1; (-) strand; PAM type: YTN; PAM sequence: CTC
cctgactcaggttggaaatc

SEQ ID NO: 221985 - DNA, 20 bp, Artificial Sequence
  Description of Artificial Sequence: Synthetic oligonucleotide
  Target: ATXN1; (-) strand; PAM type: YTN; PAM sequence: TTG
tctccctgactcaggttgga

SEQ ID NO: 221986 - DNA, 20 bp, Artificial Sequence
  Description of Artificial Sequence: Synthetic oligonucleotide
  Target: ATXN1; (-) strand; PAM type: YTN; PAM sequence: TTT
gtctccctgactcaggttgg

SEQ ID NO: 221987 - DNA, 20 bp, Artificial Sequence
  Description of Artificial Sequence: Synthetic oligonucleotide
  Target: ATXN1; (-) strand; PAM type: YTN; PAM sequence: TTA
catgtttgtctccctgactc

SEQ ID NO: 221988 - DNA, 20 bp, Artificial Sequence
  Description of Artificial Sequence: Synthetic oligonucleotide
  Target: ATXN1; (-) strand; PAM type: YTN; PAM sequence: TTT
acatgtttgtctccctgact

SEQ ID NO: 221989 - DNA, 20 bp, Artificial Sequence
  Description of Artificial Sequence: Synthetic oligonucleotide
  Target: ATXN1; (-) strand; PAM type: YTN; PAM sequence: TTG
tttacatgtttgtctccctg

SEQ ID NO: 221990 - DNA, 20 bp, Artificial Sequence
  Description of Artificial Sequence: Synthetic oligonucleotide
  Target: ATXN1; (-) strand; PAM type: YTN; PAM sequence: TTT
gtttacatgtttgtctccct

SEQ ID NO: 221991 - DNA, 20 bp, Artificial Sequence
  Description of Artificial Sequence: Synthetic oligonucleotide
  Target: ATXN1; (-) strand; PAM type: YTN; PAM sequence: TTG
tttgtttacatgtttgtctc

SEQ ID NO: 221992 - DNA, 20 bp, Artificial Sequence
  Description of Artificial Sequence: Synthetic oligonucleotide
  Target: ATXN1; (-) strand; PAM type: YTN; PAM sequence: TTC
acaccgtattgtttgtttac

SEQ ID NO: 221993 - DNA, 20 bp, Artificial Sequence
  Description of Artificial Sequence: Synthetic oligonucleotide
  Target: ATXN1; (-) strand; PAM type: YTN; PAM sequence: TTG
attcacaccgtattgtttgt

SEQ ID NO: 221994 - DNA, 20 bp, Artificial Sequence
  Description of Artificial Sequence: Synthetic oligonucleotide
  Target: ATXN1; (-) strand; PAM type: YTN; PAM sequence: CTT
gattcacaccgtattgtttg

SEQ ID NO: 221995 - DNA, 20 bp, Artificial Sequence
  Description of Artificial Sequence: Synthetic oligonucleotide
  Target: ATXN1; (-) strand; PAM type: YTN; PAM sequence: TTC
cccttgattcacaccgtatt

SEQ ID NO: 221996 - DNA, 20 bp, Artificial Sequence
  Description of Artificial Sequence: Synthetic oligonucleotide
  Target: ATXN1; (-) strand; PAM type: YTN; PAM sequence: CTC
acccacattccccttgattc

SEQ ID NO: 221997 - DNA, 20 bp, Artificial Sequence
  Description of Artificial Sequence: Synthetic oligonucleotide
  Target: ATXN1; (-) strand; PAM type: YTN; PAM sequence: CTC
agcgctcacccacattcccc

SEQ ID NO: 221998 - DNA, 20 bp, Artificial Sequence
  Description of Artificial Sequence: Synthetic oligonucleotide
  Target: ATXN1; (-) strand; PAM type: YTN; PAM sequence: CTC
tcagcgctcacccacattcc

SEQ ID NO: 221999 - DNA, 20 bp, Artificial Sequence
  Description of Artificial Sequence: Synthetic oligonucleotide
  Target: ATXN1; (-) strand; PAM type: YTN; PAM sequence: CTC
gtcatctctcagcgctcacc

SEQ ID NO: 222000 - DNA, 20 bp, Artificial Sequence
  Description of Artificial Sequence: Synthetic oligonucleotide
  Target: ATXN1; (-) strand; PAM type: YTN; PAM sequence: TTG
ctcgtcatctctcagcgctc

SEQ ID NO: 222001 - DNA, 20 bp, Artificial Sequence
  Description of Artificial Sequence: Synthetic oligonucleotide
  Target: ATXN1; (-) strand; PAM type: YTN; PAM sequence: TTT
gctcgtcatctctcagcgct

SEQ ID NO: 222002 - DNA, 20 bp, Artificial Sequence
  Description of Artificial Sequence: Synthetic oligonucleotide
  Target: ATXN1; (-) strand; PAM type: YTN; PAM sequence: CTT
tgctcgtcatctctcagcgc

SEQ ID NO: 222003 - DNA, 20 bp, Artificial Sequence
  Description of Artificial Sequence: Synthetic oligonucleotide
  Target: ATXN1; (-) strand; PAM type: YTN; PAM sequence: TTC
tttgctcgtcatctctcagc

SEQ ID NO: 222004 - DNA, 20 bp, Artificial Sequence
  Description of Artificial Sequence: Synthetic oligonucleotide
  Target: ATXN1; (-) strand; PAM type: YTN; PAM sequence: CTG
ccagcagagttctttgctcg

SEQ ID NO: 222005 - DNA, 20 bp, Artificial Sequence
  Description of Artificial Sequence: Synthetic oligonucleotide
  Target: ATXN1; (-) strand; PAM type: YTN; PAM sequence: CTC
tgccagcagagttctttgct

SEQ ID NO: 222006 - DNA, 20 bp, Artificial Sequence
  Description of Artificial Sequence: Synthetic oligonucleotide
  Target: ATXN1; (-) strand; PAM type: YTN; PAM sequence: CTC
tctgccagcagagttctttg

SEQ ID NO: 222007 - DNA, 20 bp, Artificial Sequence
  Description of Artificial Sequence: Synthetic oligonucleotide
  Target: ATXN1; (-) strand; PAM type: YTN; PAM sequence: CTG
ggagctctctgccagcagag

SEQ ID NO: 222008 - DNA, 20 bp, Artificial Sequence
  Description of Artificial Sequence: Synthetic oligonucleotide
  Target: ATXN1; (-) strand; PAM type: YTN; PAM sequence: TTG
cagctgggagctctctgcca

SEQ ID NO: 222009 - DNA, 20 bp, Artificial Sequence
  Description of Artificial Sequence: Synthetic oligonucleotide
  Target: ATXN1; (-) strand; PAM type: YTN; PAM sequence: CTG
tgttgcagctgggagctctc

SEQ ID NO: 222010 - DNA, 20 bp, Artificial Sequence
  Description of Artificial Sequence: Synthetic oligonucleotide
  Target: ATXN1; (-) strand; PAM type: YTN; PAM sequence: TTA
atgcctgtgttgcagctggg

SEQ ID NO: 222011 - DNA, 20 bp, Artificial Sequence
  Description of Artificial Sequence: Synthetic oligonucleotide
  Target: ATXN1; (-) strand; PAM type: YTN; PAM sequence: CTC
ccagagcacacgtaattaat

SEQ ID NO: 222012 - DNA, 20 bp, Artificial Sequence
  Description of Artificial Sequence: Synthetic oligonucleotide
  Target: ATXN1; (-) strand; PAM type: YTN; PAM sequence: CTC
tcccagagcacacgtaatta

SEQ ID NO: 222013 - DNA, 20 bp, Artificial Sequence
  Description of Artificial Sequence: Synthetic oligonucleotide
  Target: ATXN1; (-) strand; PAM type: YTN; PAM sequence: CTC
ccctctcccagagcacacgt

SEQ ID NO: 222014 - DNA, 20 bp, Artificial Sequence
  Description of Artificial Sequence: Synthetic oligonucleotide
  Target: ATXN1; (-) strand; PAM type: YTN; PAM sequence: CTG
gggaggggaatcaaaaaata

SEQ ID NO: 222015 - DNA, 20 bp, Artificial Sequence
  Description of Artificial Sequence: Synthetic oligonucleotide
  Target: ATXN1; (-) strand; PAM type: YTN; PAM sequence: TTC
tggggaggggaatcaaaaaa

SEQ ID NO: 222016 - DNA, 20 bp, Artificial Sequence
  Description of Artificial Sequence: Synthetic oligonucleotide
  Target: ATXN1; (-) strand; PAM type: YTN; PAM sequence: CTG
attctggggaggggaatcaa

SEQ ID NO: 222017 - DNA, 20 bp, Artificial Sequence
  Description of Artificial Sequence: Synthetic oligonucleotide
  Target: ATXN1; (-) strand; PAM type: YTN; PAM sequence: TTC
aaatagcactgattctgggg

SEQ ID NO: 222018 - DNA, 20 bp, Artificial Sequence
  Description of Artificial Sequence: Synthetic oligonucleotide
  Target: ATXN1; (-) strand; PAM type: YTN; PAM sequence: TTT
caaatagcactgattctggg

SEQ ID NO: 222019 - DNA, 20 bp, Artificial Sequence
  Description of Artificial Sequence: Synthetic oligonucleotide
  Target: ATXN1; (-) strand; PAM type: YTN; PAM sequence: TTT
tcaaatagcactgattctgg

SEQ ID NO: 222020 - DNA, 20 bp, Artificial Sequence
  Description of Artificial Sequence: Synthetic oligonucleotide
  Target: ATXN1; (-) strand; PAM type: YTN; PAM sequence: CTA
cgtgggattttcaaatagca

SEQ ID NO: 222021 - DNA, 20 bp, Artificial Sequence
  Description of Artificial Sequence: Synthetic oligonucleotide
  Target: ATXN1; (-) strand; PAM type: YTN; PAM sequence: TTA
cctacgtgggattttcaaat

SEQ ID NO: 222022 - DNA, 20 bp, Artificial Sequence
  Description of Artificial Sequence: Synthetic oligonucleotide
  Target: ATXN1; (-) strand; PAM type: YTN; PAM sequence: CTT
acctacgtgggattttcaaa

SEQ ID NO: 222023 - DNA, 20 bp, Artificial Sequence
  Description of Artificial Sequence: Synthetic oligonucleotide
  Target: ATXN1; (-) strand; PAM type: YTN; PAM sequence: CTC
ttacctacgtgggattttca

SEQ ID NO: 222024 - DNA, 20 bp, Artificial Sequence
  Description of Artificial Sequence: Synthetic oligonucleotide
  Target: ATXN1; (-) strand; PAM type: YTN; PAM sequence: CTG
tcctcttacctacgtgggat

SEQ ID NO: 222025 - DNA, 20 bp, Artificial Sequence
  Description of Artificial Sequence: Synthetic oligonucleotide
  Target: ATXN1; (-) strand; PAM type: YTN; PAM sequence: CTC
cctgtcctcttacctacgtg

SEQ ID NO: 222026 - DNA, 20 bp, Artificial Sequence
  Description of Artificial Sequence: Synthetic oligonucleotide
  Target: ATXN1; (-) strand; PAM type: YTN; PAM sequence: TTG
tatgcctccctgtcctctta

SEQ ID NO: 222027 - DNA, 20 bp, Artificial Sequence
  Description of Artificial Sequence: Synthetic oligonucleotide
  Target: ATXN1; (-) strand; PAM type: YTN; PAM sequence: TTT
gtatgcctccctgtcctctt

SEQ ID NO: 222028 - DNA, 20 bp, Artificial Sequence
  Description of Artificial Sequence: Synthetic oligonucleotide
  Target: ATXN1; (-) strand; PAM type: YTN; PAM sequence: CTT
tgtatgcctccctgtcctct

SEQ ID NO: 222029 - DNA, 20 bp, Artificial Sequence
  Description of Artificial Sequence: Synthetic oligonucleotide
  Target: ATXN1; (-) strand; PAM type: YTN; PAM sequence: CTA
ggctttgtatgcctccctgt

SEQ ID NO: 222030 - DNA, 20 bp, Artificial Sequence
  Description of Artificial Sequence: Synthetic oligonucleotide
  Target: ATXN1; (-) strand; PAM type: YTN; PAM sequence: TTG
taaaaataacatggctaggc

SEQ ID NO: 222031 - DNA, 20 bp, Artificial Sequence
  Description of Artificial Sequence: Synthetic oligonucleotide
  Target: ATXN1; (-) strand; PAM type: YTN; PAM sequence: CTT
gtaaaaataacatggctagg

SEQ ID NO: 222032 - DNA, 20 bp, Artificial Sequence
  Description of Artificial Sequence: Synthetic oligonucleotide
  Target: ATXN1; (-) strand; PAM type: YTN; PAM sequence: TTG
acttgtaaaaataacatggc

SEQ ID NO: 222033 - DNA, 20 bp, Artificial Sequence
  Description of Artificial Sequence: Synthetic oligonucleotide
  Target: ATXN1; (-) strand; PAM type: YTN; PAM sequence: TTT
gacttgtaaaaataacatgg

SEQ ID NO: 222034 - DNA, 20 bp, Artificial Sequence
  Description of Artificial Sequence: Synthetic oligonucleotide
  Target: ATXN1; (-) strand; PAM type: YTN; PAM sequence: TTA
gataaacgcagtagcatatt

SEQ ID NO: 222035 - DNA, 20 bp, Artificial Sequence
  Description of Artificial Sequence: Synthetic oligonucleotide
  Target: ATXN1; (-) strand; PAM type: YTN; PAM sequence: CTA
agtattagataaacgcagta

SEQ ID NO: 222036 - DNA, 20 bp, Artificial Sequence
  Description of Artificial Sequence: Synthetic oligonucleotide
  Target: ATXN1; (-) strand; PAM type: YTN; PAM sequence: TTA
tctaagtattagataaacgc

SEQ ID NO: 222037 - DNA, 20 bp, Artificial Sequence
  Description of Artificial Sequence: Synthetic oligonucleotide
  Target: ATXN1; (-) strand; PAM type: YTN; PAM sequence: TTT
atctaagtattagataaacg

SEQ ID NO: 222038 - DNA, 20 bp, Artificial Sequence
  Description of Artificial Sequence: Synthetic oligonucleotide
  Target: ATXN1; (-) strand; PAM type: YTN; PAM sequence: TTT
tatctaagtattagataaac

SEQ ID NO: 222039 - DNA, 20 bp, Artificial Sequence
  Description of Artificial Sequence: Synthetic oligonucleotide
  Target: ATXN1; (-) strand; PAM type: YTN; PAM sequence: TTT
ttatctaagtattagataaa

SEQ ID NO: 222040 - DNA, 20 bp, Artificial Sequence
  Description of Artificial Sequence: Synthetic oligonucleotide
  Target: ATXN1; (-) strand; PAM type: YTN; PAM sequence: CTG
aaaaataatttttatctaag

SEQ ID NO: 222041 - DNA, 20 bp, Artificial Sequence
  Description of Artificial Sequence: Synthetic oligonucleotide
  Target: ATXN1; (-) strand; PAM type: YTN; PAM sequence: TTC
aataagcaatggcctgaaaa

SEQ ID NO: 222042 - DNA, 20 bp, Artificial Sequence
  Description of Artificial Sequence: Synthetic oligonucleotide
  Target: ATXN1; (-) strand; PAM type: YTN; PAM sequence: CTA
atgatgaggacacagagaga

SEQ ID NO: 222043 - DNA, 20 bp, Artificial Sequence
  Description of Artificial Sequence: Synthetic oligonucleotide
  Target: ATXN1; (-) strand; PAM type: YTN; PAM sequence: CTG
acctaatgatgaggacacag

SEQ ID NO: 222044 - DNA, 20 bp, Artificial Sequence
  Description of Artificial Sequence: Synthetic oligonucleotide
  Target: ATXN1; (-) strand; PAM type: YTN; PAM sequence: CTC
ctgacctaatgatgaggaca

SEQ ID NO: 222045 - DNA, 20 bp, Artificial Sequence
  Description of Artificial Sequence: Synthetic oligonucleotide
  Target: ATXN1; (-) strand; PAM type: YTN; PAM sequence: CTG
gaaaccactcctgacctaat

SEQ ID NO: 222046 - DNA, 20 bp, Artificial Sequence
  Description of Artificial Sequence: Synthetic oligonucleotide
  Target: ATXN1; (-) strand; PAM type: YTN; PAM sequence: CTA
ctggaaaccactcctgacct

SEQ ID NO: 222047 - DNA, 20 bp, Artificial Sequence
  Description of Artificial Sequence: Synthetic oligonucleotide
  Target: ATXN1; (-) strand; PAM type: YTN; PAM sequence: TTG
tggagcacctactggaaacc

SEQ ID NO: 222048 - DNA, 20 bp, Artificial Sequence
  Description of Artificial Sequence: Synthetic oligonucleotide
  Target: ATXN1; (-) strand; PAM type: YTN; PAM sequence: TTT
gtggagcacctactggaaac

SEQ ID NO: 222049 - DNA, 20 bp, Artificial Sequence
  Description of Artificial Sequence: Synthetic oligonucleotide
  Target: ATXN1; (-) strand; PAM type: YTN; PAM sequence: CTT
tgtggagcacctactggaaa

SEQ ID NO: 222050 - DNA, 20 bp, Artificial Sequence
  Description of Artificial Sequence: Synthetic oligonucleotide
  Target: ATXN1; (-) strand; PAM type: YTN; PAM sequence: CTC
tttgtggagcacctactgga

SEQ ID NO: 222051 - DNA, 20 bp, Artificial Sequence
  Description of Artificial Sequence: Synthetic oligonucleotide
  Target: ATXN1; (-) strand; PAM type: YTN; PAM sequence: TTG
ctctttgtggagcacctact

SEQ ID NO: 222052 - DNA, 20 bp, Artificial Sequence
  Description of Artificial Sequence: Synthetic oligonucleotide
  Target: ATXN1; (-) strand; PAM type: YTN; PAM sequence: TTT
gctctttgtggagcacctac

SEQ ID NO: 222053 - DNA, 20 bp, Artificial Sequence
  Description of Artificial Sequence: Synthetic oligonucleotide
  Target: ATXN1; (-) strand; PAM type: YTN; PAM sequence: TTT
tgctctttgtggagcaccta

SEQ ID NO: 222054 - DNA, 20 bp, Artificial Sequence
  Description of Artificial Sequence: Synthetic oligonucleotide
  Target: ATXN1; (-) strand; PAM type: YTN; PAM sequence: TTT
ttgctctttgtggagcacct

SEQ ID NO: 222055 - DNA, 20 bp, Artificial Sequence
  Description of Artificial Sequence: Synthetic oligonucleotide
  Target: ATXN1; (-) strand; PAM type: YTN; PAM sequence: CTT
tttgctctttgtggagcacc

SEQ ID NO: 222056 - DNA, 20 bp, Artificial Sequence
  Description of Artificial Sequence: Synthetic oligonucleotide
  Target: ATXN1; (-) strand; PAM type: YTN; PAM sequence: TTG
tatccccatctttttgctct

SEQ ID NO: 222057 - DNA, 20 bp, Artificial Sequence
  Description of Artificial Sequence: Synthetic oligonucleotide
  Target: ATXN1; (-) strand; PAM type: YTN; PAM sequence: TTT
gtatccccatctttttgctc

SEQ ID NO: 222058 - DNA, 20 bp, Artificial Sequence
  Description of Artificial Sequence: Synthetic oligonucleotide
  Target: ATXN1; (-) strand; PAM type: YTN; PAM sequence: TTT
tgtatccccatctttttgct

SEQ ID NO: 222059 - DNA, 20 bp, Artificial Sequence
  Description of Artificial Sequence: Synthetic oligonucleotide
  Target: ATXN1; (-) strand; PAM type: YTN; PAM sequence: CTA
tacaagttttgtatccccat

SEQ ID NO: 222060 - DNA, 20 bp, Artificial Sequence
  Description of Artificial Sequence: Synthetic oligonucleotide
  Target: ATXN1; (-) strand; PAM type: YTN; PAM sequence: CTA
ctatacaagttttgtatccc

SEQ ID NO: 222061 - DNA, 20 bp, Artificial Sequence
  Description of Artificial Sequence: Synthetic oligonucleotide
  Target: ATXN1; (-) strand; PAM type: YTN; PAM sequence: TTC
tactatacaagttttgtatc

SEQ ID NO: 222062 - DNA, 20 bp, Artificial Sequence
  Description of Artificial Sequence: Synthetic oligonucleotide
  Target: ATXN1; (-) strand; PAM type: YTN; PAM sequence: TTG
gaaaaaaaattctactatac

SEQ ID NO: 222063 - DNA, 20 bp, Artificial Sequence
  Description of Artificial Sequence: Synthetic oligonucleotide
  Target: ATXN1; (-) strand; PAM type: YTN; PAM sequence: CTT
ggaaaaaaaattctactata

SEQ ID NO: 222064 - DNA, 20 bp, Artificial Sequence
  Description of Artificial Sequence: Synthetic oligonucleotide
  Target: ATXN1; (-) strand; PAM type: YTN; PAM sequence: CTG
gtgtgaatgaagcaagatac

SEQ ID NO: 222065 - DNA, 20 bp, Artificial Sequence
  Description of Artificial Sequence: Synthetic oligonucleotide
  Target: ATXN1; (-) strand; PAM type: YTN; PAM sequence: TTC
tggtgtgaatgaagcaagat

SEQ ID NO: 222066 - DNA, 20 bp, Artificial Sequence
  Description of Artificial Sequence: Synthetic oligonucleotide
  Target: ATXN1; (-) strand; PAM type: YTN; PAM sequence: TTT
ctggtgtgaatgaagcaaga

SEQ ID NO: 222067 - DNA, 20 bp, Artificial Sequence
  Description of Artificial Sequence: Synthetic oligonucleotide
  Target: ATXN1; (-) strand; PAM type: YTN; PAM sequence: TTT
tctggtgtgaatgaagcaag

SEQ ID NO: 222068 - DNA, 20 bp, Artificial Sequence
  Description of Artificial Sequence: Synthetic oligonucleotide
  Target: ATXN1; (-) strand; PAM type: YTN; PAM sequence: TTT
ttctggtgtgaatgaagcaa

SEQ ID NO: 222069 - DNA, 20 bp, Artificial Sequence
  Description of Artificial Sequence: Synthetic oligonucleotide
  Target: ATXN1; (-) strand; PAM type: YTN; PAM sequence: CTT
tttctggtgtgaatgaagca

SEQ ID NO: 222070 - DNA, 20 bp, Artificial Sequence
  Description of Artificial Sequence: Synthetic oligonucleotide
  Target: ATXN1; (-) strand; PAM type: YTN; PAM sequence: TTC
agcagacaacggcacaaatg

SEQ ID NO: 222071 - DNA, 20 bp, Artificial Sequence
  Description of Artificial Sequence: Synthetic oligonucleotide
  Target: ATXN1; (-) strand; PAM type: YTN; PAM sequence: CTT
cagcagacaacggcacaaat

SEQ ID NO: 222072 - DNA, 20 bp, Artificial Sequence
  Description of Artificial Sequence: Synthetic oligonucleotide
  Target: ATXN1; (-) strand; PAM type: YTN; PAM sequence: CTA
accttcagcagacaacggca

SEQ ID NO: 222073 - DNA, 20 bp, Artificial Sequence
  Description of Artificial Sequence: Synthetic oligonucleotide
  Target: ATXN1; (-) strand; PAM type: YTN; PAM sequence: TTC
atgaagactaaccttcagca

SEQ ID NO: 222074 - DNA, 20 bp, Artificial Sequence
  Description of Artificial Sequence: Synthetic oligonucleotide
  Target: ATXN1; (-) strand; PAM type: YTN; PAM sequence: TTT
catgaagactaaccttcagc

SEQ ID NO: 222075 - DNA, 20 bp, Artificial Sequence
  Description of Artificial Sequence: Synthetic oligonucleotide
  Target: ATXN1; (-) strand; PAM type: YTN; PAM sequence: TTA
aatttcatgaagactaacct

SEQ ID NO: 222076 - DNA, 20 bp, Artificial Sequence
  Description of Artificial Sequence: Synthetic oligonucleotide
  Target: ATXN1; (-) strand; PAM type: YTN; PAM sequence: TTC
atgttaaatttcatgaagac

SEQ ID NO: 222077 - DNA, 20 bp, Artificial Sequence
  Description of Artificial Sequence: Synthetic oligonucleotide
  Target: ATXN1; (-) strand; PAM type: YTN; PAM sequence: TTG
aaaggacaaatgttcatgtt

SEQ ID NO: 222078 - DNA, 20 bp, Artificial Sequence
  Description of Artificial Sequence: Synthetic oligonucleotide
  Target: ATXN1; (-) strand; PAM type: YTN; PAM sequence: CTT
gaaaggacaaatgttcatgt

SEQ ID NO: 222079 - DNA, 20 bp, Artificial Sequence
  Description of Artificial Sequence: Synthetic oligonucleotide
  Target: ATXN1; (-) strand; PAM type: YTN; PAM sequence: CTG
cttgaaaggacaaatgttca

SEQ ID NO: 222080 - DNA, 20 bp, Artificial Sequence
  Description of Artificial Sequence: Synthetic oligonucleotide
  Target: ATXN1; (-) strand; PAM type: YTN; PAM sequence: TTA
gctgcttgaaaggacaaatg

SEQ ID NO: 222081 - DNA, 20 bp, Artificial Sequence
  Description of Artificial Sequence: Synthetic oligonucleotide
  Target: ATXN1; (-) strand; PAM type: YTN; PAM sequence: TTA
aaaaggaattagctgcttga

SEQ ID NO: 222082 - DNA, 20 bp, Artificial Sequence
  Description of Artificial Sequence: Synthetic oligonucleotide
  Target: ATXN1; (-) strand; PAM type: YTN; PAM sequence: CTT
aaaaaggaattagctgcttg

SEQ ID NO: 222083 - DNA, 20 bp, Artificial Sequence
  Description of Artificial Sequence: Synthetic oligonucleotide
  Target: ATXN1; (-) strand; PAM type: YTN; PAM sequence: CTG
cttaaaaaggaattagctgc

SEQ ID NO: 222084 - DNA, 20 bp, Artificial Sequence
  Description of Artificial Sequence: Synthetic oligonucleotide
  Target: ATXN1; (-) strand; PAM type: YTN; PAM sequence: TTA
gctgcttaaaaaggaattag

SEQ ID NO: 222085 - DNA, 20 bp, Artificial Sequence
  Description of Artificial Sequence: Synthetic oligonucleotide
  Target: ATXN1; (-) strand; PAM type: YTN; PAM sequence: TTT
agctgcttaaaaaggaatta

SEQ ID NO: 222086 - DNA, 20 bp, Artificial Sequence
  Description of Artificial Sequence: Synthetic oligonucleotide
  Target: ATXN1; (-) strand; PAM type: YTN; PAM sequence: TTA
gtcatcccgtgaaagacata

SEQ ID NO: 222087 - DNA, 20 bp, Artificial Sequence
  Description of Artificial Sequence: Synthetic oligonucleotide
  Target: ATXN1; (-) strand; PAM type: YTN; PAM sequence: TTC
acaattagtcatcccgtgaa

SEQ ID NO: 222088 - DNA, 20 bp, Artificial Sequence
  Description of Artificial Sequence: Synthetic oligonucleotide
  Target: ATXN1; (-) strand; PAM type: YTN; PAM sequence: TTA
cattcacaattagtcatccc

SEQ ID NO: 222089 - DNA, 20 bp, Artificial Sequence
  Description of Artificial Sequence: Synthetic oligonucleotide
  Target: ATXN1; (-) strand; PAM type: YTN; PAM sequence: CTT
acattcacaattagtcatcc

SEQ ID NO: 222090 - DNA, 20 bp, Artificial Sequence
  Description of Artificial Sequence: Synthetic oligonucleotide
  Target: ATXN1; (-) strand; PAM type: YTN; PAM sequence: TTG
cttacattcacaattagtca

SEQ ID NO: 222091 - DNA, 20 bp, Artificial Sequence
  Description of Artificial Sequence: Synthetic oligonucleotide
  Target: ATXN1; (-) strand; PAM type: YTN; PAM sequence: CTT
gcttacattcacaattagtc

SEQ ID NO: 222092 - DNA, 20 bp, Artificial Sequence
  Description of Artificial Sequence: Synthetic oligonucleotide
  Target: ATXN1; (-) strand; PAM type: YTN; PAM sequence: TTG
tcttgcttacattcacaatt

SEQ ID NO: 222093 - DNA, 20 bp, Artificial Sequence
  Description of Artificial Sequence: Synthetic oligonucleotide
  Target: ATXN1; (-) strand; PAM type: YTN; PAM sequence: TTC
atcagttgtcttgcttacat

SEQ ID NO: 222094 - DNA, 20 bp, Artificial Sequence
  Description of Artificial Sequence: Synthetic oligonucleotide
  Target: ATXN1; (-) strand; PAM type: YTN; PAM sequence: TTT
catcagttgtcttgcttaca

SEQ ID NO: 222095 - DNA, 20 bp, Artificial Sequence
  Description of Artificial Sequence: Synthetic oligonucleotide
  Target: ATXN1; (-) strand; PAM type: YTN; PAM sequence: CTG
aatttcatcagttgtcttgc

SEQ ID NO: 222096 - DNA, 20 bp, Artificial Sequence
  Description of Artificial Sequence: Synthetic oligonucleotide
  Target: ATXN1; (-) strand; PAM type: YTN; PAM sequence: TTA
tatctgaatttcatcagttg

SEQ ID NO: 222097 - DNA, 20 bp, Artificial Sequence
  Description of Artificial Sequence: Synthetic oligonucleotide
  Target: ATXN1; (-) strand; PAM type: YTN; PAM sequence: TTG
taaacaattatatctgaatt

SEQ ID NO: 222098 - DNA, 20 bp, Artificial Sequence
  Description of Artificial Sequence: Synthetic oligonucleotide
  Target: ATXN1; (-) strand; PAM type: YTN; PAM sequence: TTA
agagcagtaatagaaaattg

SEQ ID NO: 222099 - DNA, 20 bp, Artificial Sequence
  Description of Artificial Sequence: Synthetic oligonucleotide
  Target: ATXN1; (-) strand; PAM type: YTN; PAM sequence: TTG
acagaaacagaatgaattaa

SEQ ID NO: 222100 - DNA, 20 bp, Artificial Sequence
  Description of Artificial Sequence: Synthetic oligonucleotide
  Target: ATXN1; (-) strand; PAM type: YTN; PAM sequence: CTG
taaatatagaaaatagggta

SEQ ID NO: 222101 - DNA, 20 bp, Artificial Sequence
  Description of Artificial Sequence: Synthetic oligonucleotide
  Target: ATXN1; (-) strand; PAM type: YTN; PAM sequence: TTC
aagtgcactgtaaatataga

SEQ ID NO: 222102 - DNA, 20 bp, Artificial Sequence
  Description of Artificial Sequence: Synthetic oligonucleotide
  Target: ATXN1; (-) strand; PAM type: YTN; PAM sequence: TTT
caagtgcactgtaaatatag

SEQ ID NO: 222103 - DNA, 20 bp, Artificial Sequence
  Description of Artificial Sequence: Synthetic oligonucleotide
  Target: ATXN1; (-) strand; PAM type: YTN; PAM sequence: TTG
cataaacaatttcaagtgca

SEQ ID NO: 222104 - DNA, 20 bp, Artificial Sequence
  Description of Artificial Sequence: Synthetic oligonucleotide
  Target: ATXN1; (-) strand; PAM type: YTN; PAM sequence: TTA
agttgcataaacaatttcaa

SEQ ID NO: 222105 - DNA, 20 bp, Artificial Sequence
  Description of Artificial Sequence: Synthetic oligonucleotide
  Target: ATXN1; (-) strand; PAM type: YTN; PAM sequence: TTT
aagttgcataaacaatttca

SEQ ID NO: 222106 - DNA, 20 bp, Artificial Sequence
  Description of Artificial Sequence: Synthetic oligonucleotide
  Target: ATXN1; (-) strand; PAM type: YTN; PAM sequence: TTT
taagttgcataaacaatttc

SEQ ID NO: 222107 - DNA, 20 bp, Artificial Sequence
  Description of Artificial Sequence: Synthetic oligonucleotide
  Target: ATXN1; (-) strand; PAM type: YTN; PAM sequence: TTT
ttaagttgcataaacaattt

SEQ ID NO: 222108 - DNA, 20 bp, Artificial Sequence
  Description of Artificial Sequence: Synthetic oligonucleotide
  Target: ATXN1; (-) strand; PAM type: YTN; PAM sequence: TTT
tttaagttgcataaacaatt

SEQ ID NO: 222109 - DNA, 20 bp, Artificial Sequence
  Description of Artificial Sequence: Synthetic oligonucleotide
  Target: ATXN1; (-) strand; PAM type: YTN; PAM sequence: TTT
ttttaagttgcataaacaat

SEQ ID NO: 222110 - DNA, 20 bp, Artificial Sequence
  Description of Artificial Sequence: Synthetic oligonucleotide
  Target: ATXN1; (-) strand; PAM type: YTN; PAM sequence: TTA
atttttttaagttgcataaa

SEQ ID NO: 222111 - DNA, 20 bp, Artificial Sequence
  Description of Artificial Sequence: Synthetic oligonucleotide
  Target: ATXN1; (-) strand; PAM type: YTN; PAM sequence: TTT
aatttttttaagttgcataa

SEQ ID NO: 222112 - DNA, 20 bp, Artificial Sequence
  Description of Artificial Sequence: Synthetic oligonucleotide
  Target: ATXN1; (-) strand; PAM type: YTN; PAM sequence: TTC
agatgaccatttaatttttt

SEQ ID NO: 222113 - DNA, 20 bp, Artificial Sequence
  Description of Artificial Sequence: Synthetic oligonucleotide
  Target: ATXN1; (-) strand; PAM type: YTN; PAM sequence: TTT
cagatgaccatttaattttt

SEQ ID NO: 222114 - DNA, 20 bp, Artificial Sequence
  Description of Artificial Sequence: Synthetic oligonucleotide
  Target: ATXN1; (-) strand; PAM type: YTN; PAM sequence: TTT
tcagatgaccatttaatttt

SEQ ID NO: 222115 - DNA, 20 bp, Artificial Sequence
  Description of Artificial Sequence: Synthetic oligonucleotide
  Target: ATXN1; (-) strand; PAM type: YTN; PAM sequence: CTT
ttcagatgaccatttaattt

SEQ ID NO: 222116 - DNA, 20 bp, Artificial Sequence
  Description of Artificial Sequence: Synthetic oligonucleotide
  Target: ATXN1; (-) strand; PAM type: YTN; PAM sequence: TTC
gagtgcaccaaacacttttc

SEQ ID NO: 222117 - DNA, 20 bp, Artificial Sequence
  Description of Artificial Sequence: Synthetic oligonucleotide
  Target: ATXN1; (-) strand; PAM type: YTN; PAM sequence: CTC
attcgagtgcaccaaacact

SEQ ID NO: 222118 - DNA, 20 bp, Artificial Sequence
  Description of Artificial Sequence: Synthetic oligonucleotide
  Target: ATXN1; (-) strand; PAM type: YTN; PAM sequence: TTG
caagaaaaaaatctcattcg

SEQ ID NO: 222119 - DNA, 20 bp, Artificial Sequence
  Description of Artificial Sequence: Synthetic oligonucleotide
  Target: ATXN1; (-) strand; PAM type: YTN; PAM sequence: CTG
ataaaagttgcaagaaaaaa

SEQ ID NO: 222120 - DNA, 20 bp, Artificial Sequence
  Description of Artificial Sequence: Synthetic oligonucleotide
  Target: ATXN1; (-) strand; PAM type: YTN; PAM sequence: TTA
ggcaaacagcccctgataaa

SEQ ID NO: 222121 - DNA, 20 bp, Artificial Sequence
  Description of Artificial Sequence: Synthetic oligonucleotide
  Target: ATXN1; (-) strand; PAM type: YTN; PAM sequence: TTT
aggcaaacagcccctgataa

SEQ ID NO: 222122 - DNA, 20 bp, Artificial Sequence
  Description of Artificial Sequence: Synthetic oligonucleotide
  Target: ATXN1; (-) strand; PAM type: YTN; PAM sequence: TTT
taggcaaacagcccctgata

SEQ ID NO: 222123 - DNA, 20 bp, Artificial Sequence
  Description of Artificial Sequence: Synthetic oligonucleotide
  Target: ATXN1; (-) strand; PAM type: YTN; PAM sequence: TTT
ttaggcaaacagcccctgat

SEQ ID NO: 222124 - DNA, 20 bp, Artificial Sequence
  Description of Artificial Sequence: Synthetic oligonucleotide
  Target: ATXN1; (-) strand; PAM type: YTN; PAM sequence: CTA
gagcagcaagtttttaggca

SEQ ID NO: 222125 - DNA, 20 bp, Artificial Sequence
  Description of Artificial Sequence: Synthetic oligonucleotide
  Target: ATXN1; (-) strand; PAM type: YTN; PAM sequence: TTG
gctagagcagcaagttttta

SEQ ID NO: 222126 - DNA, 20 bp, Artificial Sequence
  Description of Artificial Sequence: Synthetic oligonucleotide
  Target: ATXN1; (-) strand; PAM type: YTN; PAM sequence: TTT
ggctagagcagcaagttttt

SEQ ID NO: 222127 - DNA, 20 bp, Artificial Sequence
  Description of Artificial Sequence: Synthetic oligonucleotide
  Target: ATXN1; (-) strand; PAM type: YTN; PAM sequence: TTT
tggctagagcagcaagtttt

SEQ ID NO: 222128 - DNA, 20 bp, Artificial Sequence
  Description of Artificial Sequence: Synthetic oligonucleotide
  Target: ATXN1; (-) strand; PAM type: YTN; PAM sequence: CTA
aaaacattttggctagagca

SEQ ID NO: 222129 - DNA, 20 bp, Artificial Sequence
  Description of Artificial Sequence: Synthetic oligonucleotide
  Target: ATXN1; (-) strand; PAM type: YTN; PAM sequence: TTG
tgctaaaaacattttggcta

SEQ ID NO: 222130 - DNA, 20 bp, Artificial Sequence
  Description of Artificial Sequence: Synthetic oligonucleotide
  Target: ATXN1; (-) strand; PAM type: YTN; PAM sequence: TTT
gtgctaaaaacattttggct

SEQ ID NO: 222131 - DNA, 20 bp, Artificial Sequence
  Description of Artificial Sequence: Synthetic oligonucleotide
  Target: ATXN1; (-) strand; PAM type: YTN; PAM sequence: TTT
tgtgctaaaaacattttggc

SEQ ID NO: 222132 - DNA, 20 bp, Artificial Sequence
  Description of Artificial Sequence: Synthetic oligonucleotide
  Target: ATXN1; (-) strand; PAM type: YTN; PAM sequence: CTA
gaattttgtgctaaaaacat

SEQ ID NO: 222133 - DNA, 20 bp, Artificial Sequence
  Description of Artificial Sequence: Synthetic oligonucleotide
  Target: ATXN1; (-) strand; PAM type: YTN; PAM sequence: TTG
ctagaattttgtgctaaaaa

SEQ ID NO: 222134 - DNA, 20 bp, Artificial Sequence
  Description of Artificial Sequence: Synthetic oligonucleotide
  Target: ATXN1; (-) strand; PAM type: YTN; PAM sequence: TTA
ttgctagaattttgtgctaa

SEQ ID NO: 222135 - DNA, 20 bp, Artificial Sequence
  Description of Artificial Sequence: Synthetic oligonucleotide
  Target: ATXN1; (-) strand; PAM type: YTN; PAM sequence: CTG
aggttattgctagaattttg

SEQ ID NO: 222136 - DNA, 20 bp, Artificial Sequence
  Description of Artificial Sequence: Synthetic oligonucleotide
  Target: ATXN1; (-) strand; PAM type: YTN; PAM sequence: CTC
tgaggttattgctagaattt

SEQ ID NO: 222137 - DNA, 20 bp, Artificial Sequence
  Description of Artificial Sequence: Synthetic oligonucleotide
  Target: ATXN1; (-) strand; PAM type: YTN; PAM sequence: TTA
agtggcaaagaaaagatagc

SEQ ID NO: 222138 - DNA, 20 bp, Artificial Sequence
  Description of Artificial Sequence: Synthetic oligonucleotide
  Target: ATXN1; (-) strand; PAM type: YTN; PAM sequence: TTG
gtaaaattaagtggcaaaga

SEQ ID NO: 222139 - DNA, 20 bp, Artificial Sequence
  Description of Artificial Sequence: Synthetic oligonucleotide
  Target: ATXN1; (-) strand; PAM type: YTN; PAM sequence: CTT
ggtaaaattaagtggcaaag

SEQ ID NO: 222140 - DNA, 20 bp, Artificial Sequence
  Description of Artificial Sequence: Synthetic oligonucleotide
  Target: ATXN1; (-) strand; PAM type: YTN; PAM sequence: CTC
ttggtaaaattaagtggcaa

SEQ ID NO: 222141 - DNA, 20 bp, Artificial Sequence
  Description of Artificial Sequence: Synthetic oligonucleotide
  Target: ATXN1; (-) strand; PAM type: YTN; PAM sequence: TTG
ctcttggtaaaattaagtgg

SEQ ID NO: 222142 - DNA, 20 bp, Artificial Sequence
  Description of Artificial Sequence: Synthetic oligonucleotide
  Target: ATXN1; (-) strand; PAM type: YTN; PAM sequence: TTT
gctcttggtaaaattaagtg

SEQ ID NO: 222143 - DNA, 20 bp, Artificial Sequence
  Description of Artificial Sequence: Synthetic oligonucleotide
  Target: ATXN1; (-) strand; PAM type: YTN; PAM sequence: TTT
tgctcttggtaaaattaagt

SEQ ID NO: 222144 - DNA, 20 bp, Artificial Sequence
  Description of Artificial Sequence: Synthetic oligonucleotide
  Target: ATXN1; (-) strand; PAM type: YTN; PAM sequence: TTT
ttgctcttggtaaaattaag

SEQ ID NO: 222145 - DNA, 20 bp, Artificial Sequence
  Description of Artificial Sequence: Synthetic oligonucleotide
  Target: ATXN1; (-) strand; PAM type: YTN; PAM sequence: CTT
tttgctcttggtaaaattaa

SEQ ID NO: 222146 - DNA, 20 bp, Artificial Sequence
  Description of Artificial Sequence: Synthetic oligonucleotide
  Target: ATXN1; (-) strand; PAM type: YTN; PAM sequence: TTC
tttttgctcttggtaaaatt

SEQ ID NO: 222147 - DNA, 20 bp, Artificial Sequence
  Description of Artificial Sequence: Synthetic oligonucleotide
  Target: ATXN1; (-) strand; PAM type: YTN; PAM sequence: CTT
ctttttgctcttggtaaaat

SEQ ID NO: 222148 - DNA, 20 bp, Artificial Sequence
  Description of Artificial Sequence: Synthetic oligonucleotide
  Target: ATXN1; (-) strand; PAM type: YTN; PAM sequence: TTC
ccttctttttgctcttggta

SEQ ID NO: 222149 - DNA, 20 bp, Artificial Sequence
  Description of Artificial Sequence: Synthetic oligonucleotide
  Target: ATXN1; (-) strand; PAM type: YTN; PAM sequence: TTT
cccttctttttgctcttggt

SEQ ID NO: 222150 - DNA, 20 bp, Artificial Sequence
  Description of Artificial Sequence: Synthetic oligonucleotide
  Target: ATXN1; (-) strand; PAM type: YTN; PAM sequence: TTT
tcccttctttttgctcttgg

SEQ ID NO: 222151 - DNA, 20 bp, Artificial Sequence
  Description of Artificial Sequence: Synthetic oligonucleotide
  Target: ATXN1; (-) strand; PAM type: YTN; PAM sequence: TTT
ttcccttctttttgctcttg

SEQ ID NO: 222152 - DNA, 20 bp, Artificial Sequence
  Description of Artificial Sequence: Synthetic oligonucleotide
  Target: ATXN1; (-) strand; PAM type: YTN; PAM sequence: TTT
tttcccttctttttgctctt

SEQ ID NO: 222153 - DNA, 20 bp, Artificial Sequence
  Description of Artificial Sequence: Synthetic oligonucleotide
  Target: ATXN1; (-) strand; PAM type: YTN; PAM sequence: TTT
ttttcccttctttttgctct

SEQ ID NO: 222154 - DNA, 20 bp, Artificial Sequence
  Description of Artificial Sequence: Synthetic oligonucleotide
  Target: ATXN1; (-) strand; PAM type: YTN; PAM sequence: TTT
tttttcccttctttttgctc

SEQ ID NO: 222155 - DNA, 20 bp, Artificial Sequence
  Description of Artificial Sequence: Synthetic oligonucleotide
  Target: ATXN1; (-) strand; PAM type: YTN; PAM sequence: CTT
ttttttcccttctttttgct

SEQ ID NO: 222156 - DNA, 20 bp, Artificial Sequence
  Description of Artificial Sequence: Synthetic oligonucleotide
  Target: ATXN1; (-) strand; PAM type: YTN; PAM sequence: TTG
ccatgcaatggcaaaatgaa

SEQ ID NO: 222157 - DNA, 20 bp, Artificial Sequence
  Description of Artificial Sequence: Synthetic oligonucleotide
  Target: ATXN1; (-) strand; PAM type: YTN; PAM sequence: TTT
gccatgcaatggcaaaatga

SEQ ID NO: 222158 - DNA, 20 bp, Artificial Sequence
  Description of Artificial Sequence: Synthetic oligonucleotide
  Target: ATXN1; (-) strand; PAM type: YTN; PAM sequence: TTT
tgccatgcaatggcaaaatg

SEQ ID NO: 222159 - DNA, 20 bp, Artificial Sequence
  Description of Artificial Sequence: Synthetic oligonucleotide
  Target: ATXN1; (-) strand; PAM type: YTN; PAM sequence: TTT
ttgccatgcaatggcaaaat

SEQ ID NO: 222160 - DNA, 20 bp, Artificial Sequence
  Description of Artificial Sequence: Synthetic oligonucleotide
  Target: ATXN1; (-) strand; PAM type: YTN; PAM sequence: TTA
atgtgcatttttgccatgca

SEQ ID NO: 222161 - DNA, 20 bp, Artificial Sequence
  Description of Artificial Sequence: Synthetic oligonucleotide
  Target: ATXN1; (-) strand; PAM type: YTN; PAM sequence: TTA
agttaatgtgcatttttgcc

SEQ ID NO: 222162 - DNA, 20 bp, Artificial Sequence
  Description of Artificial Sequence: Synthetic oligonucleotide
  Target: ATXN1; (-) strand; PAM type: YTN; PAM sequence: CTG
ccatagaagagttaagttaa

SEQ ID NO: 222163 - DNA, 20 bp, Artificial Sequence
  Description of Artificial Sequence: Synthetic oligonucleotide
  Target: ATXN1; (-) strand; PAM type: YTN; PAM sequence: TTC
tgccatagaagagttaagtt

SEQ ID NO: 222164 - DNA, 20 bp, Artificial Sequence
  Description of Artificial Sequence: Synthetic oligonucleotide
  Target: ATXN1; (-) strand; PAM type: YTN; PAM sequence: TTT
ctgccatagaagagttaagt

SEQ ID NO: 222165 - DNA, 20 bp, Artificial Sequence
  Description of Artificial Sequence: Synthetic oligonucleotide
  Target: ATXN1; (-) strand; PAM type: YTN; PAM sequence: TTG
tatttctgccatagaagagt

SEQ ID NO: 222166 - DNA, 20 bp, Artificial Sequence
  Description of Artificial Sequence: Synthetic oligonucleotide
  Target: ATXN1; (-) strand; PAM type: YTN; PAM sequence: TTT
gtatttctgccatagaagag

SEQ ID NO: 222167 - DNA, 20 bp, Artificial Sequence
  Description of Artificial Sequence: Synthetic oligonucleotide
  Target: ATXN1; (-) strand; PAM type: YTN; PAM sequence: TTC
atttgtatttctgccataga

SEQ ID NO: 222168 - DNA, 20 bp, Artificial Sequence
  Description of Artificial Sequence: Synthetic oligonucleotide
  Target: ATXN1; (-) strand; PAM type: YTN; PAM sequence: TTT
catttgtatttctgccatag

SEQ ID NO: 222169 - DNA, 20 bp, Artificial Sequence
  Description of Artificial Sequence: Synthetic oligonucleotide
  Target: ATXN1; (-) strand; PAM type: YTN; PAM sequence: TTG
gacatatttcatttgtattt

SEQ ID NO: 222170 - DNA, 20 bp, Artificial Sequence
  Description of Artificial Sequence: Synthetic oligonucleotide
  Target: ATXN1; (-) strand; PAM type: YTN; PAM sequence: TTG
gcattggacatatttcattt

SEQ ID NO: 222171 - DNA, 20 bp, Artificial Sequence
  Description of Artificial Sequence: Synthetic oligonucleotide
  Target: ATXN1; (-) strand; PAM type: YTN; PAM sequence: TTA
aacattggcattggacatat

SEQ ID NO: 222172 - DNA, 20 bp, Artificial Sequence
  Description of Artificial Sequence: Synthetic oligonucleotide
  Target: ATXN1; (-) strand; PAM type: YTN; PAM sequence: CTT
aaacattggcattggacata

SEQ ID NO: 222173 - DNA, 20 bp, Artificial Sequence
  Description of Artificial Sequence: Synthetic oligonucleotide
  Target: ATXN1; (-) strand; PAM type: YTN; PAM sequence: CTA
aaagtaacttaaacattggc

SEQ ID NO: 222174 - DNA, 20 bp, Artificial Sequence
  Description of Artificial Sequence: Synthetic oligonucleotide
  Target: ATXN1; (-) strand; PAM type: YTN; PAM sequence: TTA
tgaaaaaataagatagtcaa

SEQ ID NO: 222175 - DNA, 20 bp, Artificial Sequence
  Description of Artificial Sequence: Synthetic oligonucleotide
  Target: ATXN1; (-) strand; PAM type: YTN; PAM sequence: TTA
aaatagatatccaagaagtc

SEQ ID NO: 222176 - DNA, 20 bp, Artificial Sequence
  Description of Artificial Sequence: Synthetic oligonucleotide
  Target: ATXN1; (-) strand; PAM type: YTN; PAM sequence: CTC
aaaatcaaaagaattaaaat

SEQ ID NO: 222177 - DNA, 20 bp, Artificial Sequence
  Description of Artificial Sequence: Synthetic oligonucleotide
  Target: ATXN1; (-) strand; PAM type: YTN; PAM sequence: TTC
tcaaaatcaaaagaattaaa

SEQ ID NO: 222178 - DNA, 20 bp, Artificial Sequence
  Description of Artificial Sequence: Synthetic oligonucleotide
  Target: ATXN1; (-) strand; PAM type: YTN; PAM sequence: TTT
ctcaaaatcaaaagaattaa

SEQ ID NO: 222179 - DNA, 20 bp, Artificial Sequence
  Description of Artificial Sequence: Synthetic oligonucleotide
  Target: ATXN1; (-) strand; PAM type: YTN; PAM sequence: TTT
tctcaaaatcaaaagaatta

SEQ ID NO: 222180 - DNA, 20 bp, Artificial Sequence
  Description of Artificial Sequence: Synthetic oligonucleotide
  Target: ATXN1; (-) strand; PAM type: YTN; PAM sequence: TTG
gtacaaacatgtacattttc

SEQ ID NO: 222181 - DNA, 20 bp, Artificial Sequence
  Description of Artificial Sequence: Synthetic oligonucleotide
  Target: ATXN1; (-) strand; PAM type: YTN; PAM sequence: TTA
gaattggtacaaacatgtac

SEQ ID NO: 222182 - DNA, 20 bp, Artificial Sequence
  Description of Artificial Sequence: Synthetic oligonucleotide
  Target: ATXN1; (-) strand; PAM type: YTN; PAM sequence: TTT
agaattggtacaaacatgta

SEQ ID NO: 222183 - DNA, 20 bp, Artificial Sequence
  Description of Artificial Sequence: Synthetic oligonucleotide
  Target: ATXN1; (-) strand; PAM type: YTN; PAM sequence: CTT
tagaattggtacaaacatgt

SEQ ID NO: 222184 - DNA, 20 bp, Artificial Sequence
  Description of Artificial Sequence: Synthetic oligonucleotide
  Target: ATXN1; (-) strand; PAM type: YTN; PAM sequence: CTG
agactttagaattggtacaa

SEQ ID NO: 222185 - DNA, 20 bp, Artificial Sequence
  Description of Artificial Sequence: Synthetic oligonucleotide
  Target: ATXN1; (-) strand; PAM type: YTN; PAM sequence: TTG
gctgagactttagaattggt

SEQ ID NO: 222186 - DNA, 20 bp, Artificial Sequence
  Description of Artificial Sequence: Synthetic oligonucleotide
  Target: ATXN1; (-) strand; PAM type: YTN; PAM sequence: TTG
aatagttggctgagacttta

SEQ ID NO: 222187 - DNA, 20 bp, Artificial Sequence
  Description of Artificial Sequence: Synthetic oligonucleotide
  Target: ATXN1; (-) strand; PAM type: YTN; PAM sequence: CTG
aaaatattgaatagttggct

SEQ ID NO: 222188 - DNA, 20 bp, Artificial Sequence
  Description of Artificial Sequence: Synthetic oligonucleotide
  Target: ATXN1; (-) strand; PAM type: YTN; PAM sequence: CTA
aatcgctgaaaatattgaat

SEQ ID NO: 222189 - DNA, 20 bp, Artificial Sequence
  Description of Artificial Sequence: Synthetic oligonucleotide
  Target: ATXN1; (-) strand; PAM type: YTN; PAM sequence: TTA
cctaaatcgctgaaaatatt

SEQ ID NO: 222190 - DNA, 20 bp, Artificial Sequence
  Description of Artificial Sequence: Synthetic oligonucleotide
  Target: ATXN1; (-) strand; PAM type: YTN; PAM sequence: TTT
acctaaatcgctgaaaatat

SEQ ID NO: 222191 - DNA, 20 bp, Artificial Sequence
  Description of Artificial Sequence: Synthetic oligonucleotide
  Target: ATXN1; (-) strand; PAM type: YTN; PAM sequence: TTG
aagtaagatttacctaaatc

SEQ ID NO: 222192 - DNA, 20 bp, Artificial Sequence
  Description of Artificial Sequence: Synthetic oligonucleotide
  Target: ATXN1; (-) strand; PAM type: YTN; PAM sequence: TTT
gaagtaagatttacctaaat

SEQ ID NO: 222193 - DNA, 20 bp, Artificial Sequence
  Description of Artificial Sequence: Synthetic oligonucleotide
  Target: ATXN1; (-) strand; PAM type: YTN; PAM sequence: TTA
gtaagaatttgaagtaagat

SEQ ID NO: 222194 - DNA, 20 bp, Artificial Sequence
  Description of Artificial Sequence: Synthetic oligonucleotide
  Target: ATXN1; (-) strand; PAM type: YTN; PAM sequence: TTG
ttagtaagaatttgaagtaa

SEQ ID NO: 222195 - DNA, 20 bp, Artificial Sequence
  Description of Artificial Sequence: Synthetic oligonucleotide
  Target: ATXN1; (-) strand; PAM type: YTN; PAM sequence: CTA
tgtggcattgttagtaagaa

SEQ ID NO: 222196 - DNA, 20 bp, Artificial Sequence
  Description of Artificial Sequence: Synthetic oligonucleotide
  Target: ATXN1; (-) strand; PAM type: YTN; PAM sequence: TTG
gtatactatgtggcattgtt

SEQ ID NO: 222197 - DNA, 20 bp, Artificial Sequence
  Description of Artificial Sequence: Synthetic oligonucleotide
  Target: ATXN1; (-) strand; PAM type: YTN; PAM sequence: CTA
atataagatagaataaaaat

SEQ ID NO: 222198 - DNA, 20 bp, Artificial Sequence
  Description of Artificial Sequence: Synthetic oligonucleotide
  Target: ATXN1; (-) strand; PAM type: YTN; PAM sequence: TTC
taatataagatagaataaaa

SEQ ID NO: 222199 - DNA, 20 bp, Artificial Sequence
  Description of Artificial Sequence: Synthetic oligonucleotide
  Target: ATXN1; (-) strand; PAM type: YTN; PAM sequence: CTT
ctaatataagatagaataaa

SEQ ID NO: 222200 - DNA, 20 bp, Artificial Sequence
  Description of Artificial Sequence: Synthetic oligonucleotide
  Target: ATXN1; (-) strand; PAM type: YTN; PAM sequence: TTA
aaagccatcttctaatataa

SEQ ID NO: 222201 - DNA, 20 bp, Artificial Sequence
  Description of Artificial Sequence: Synthetic oligonucleotide
  Target: ATXN1; (-) strand; PAM type: YTN; PAM sequence: CTT
aaaagccatcttctaatata

SEQ ID NO: 222202 - DNA, 20 bp, Artificial Sequence
  Description of Artificial Sequence: Synthetic oligonucleotide
  Target: ATXN1; (-) strand; PAM type: YTN; PAM sequence: TTG
gcttaaaagccatcttctaa

SEQ ID NO: 222203 - DNA, 20 bp, Artificial Sequence
  Description of Artificial Sequence: Synthetic oligonucleotide
  Target: ATXN1; (-) strand; PAM type: YTN; PAM sequence: TTT
ggcttaaaagccatcttcta

SEQ ID NO: 222204 - DNA, 20 bp, Artificial Sequence
  Description of Artificial Sequence: Synthetic oligonucleotide
  Target: ATXN1; (-) strand; PAM type: YTN; PAM sequence: TTT
tggcttaaaagccatcttct

SEQ ID NO: 222205 - DNA, 20 bp, Artificial Sequence
  Description of Artificial Sequence: Synthetic oligonucleotide
  Target: ATXN1; (-) strand; PAM type: YTN; PAM sequence: CTG
taagaaaataacattttggc

SEQ ID NO: 222206 - DNA, 20 bp, Artificial Sequence
  Description of Artificial Sequence: Synthetic oligonucleotide
  Target: ATXN1; (-) strand; PAM type: YTN; PAM sequence: CTA
actgtaagaaaataacattt

SEQ ID NO: 222207 - DNA, 20 bp, Artificial Sequence
  Description of Artificial Sequence: Synthetic oligonucleotide
  Target: ATXN1; (-) strand; PAM type: YTN; PAM sequence: CTG
tgagcatagcatatcaaact

SEQ ID NO: 222208 - DNA, 20 bp, Artificial Sequence
  Description of Artificial Sequence: Synthetic oligonucleotide
  Target: ATXN1; (-) strand; PAM type: YTN; PAM sequence: CTC
tgtgagcatagcatatcaaa

SEQ ID NO: 222209 - DNA, 20 bp, Artificial Sequence
  Description of Artificial Sequence: Synthetic oligonucleotide
  Target: ATXN1; (-) strand; PAM type: YTN; PAM sequence: TTC
tctgtgagcatagcatatca

SEQ ID NO: 222210 - DNA, 20 bp, Artificial Sequence
  Description of Artificial Sequence: Synthetic oligonucleotide
  Target: ATXN1; (-) strand; PAM type: YTN; PAM sequence: CTG
ggaacatcccagccaaaaga

SEQ ID NO: 222211 - DNA, 20 bp, Artificial Sequence
  Description of Artificial Sequence: Synthetic oligonucleotide
  Target: ATXN1; (-) strand; PAM type: YTN; PAM sequence: TTA
gctgggaacatcccagccaa

SEQ ID NO: 222212 - DNA, 20 bp, Artificial Sequence
  Description of Artificial Sequence: Synthetic oligonucleotide
  Target: ATXN1; (-) strand; PAM type: YTN; PAM sequence: TTT
agctgggaacatcccagcca

SEQ ID NO: 222213 - DNA, 20 bp, Artificial Sequence
  Description of Artificial Sequence: Synthetic oligonucleotide
  Target: ATXN1; (-) strand; PAM type: YTN; PAM sequence: TTT
tagctgggaacatcccagcc

SEQ ID NO: 222214 - DNA, 20 bp, Artificial Sequence
  Description of Artificial Sequence: Synthetic oligonucleotide
  Target: ATXN1; (-) strand; PAM type: YTN; PAM sequence: TTT
ttagctgggaacatcccagc

SEQ ID NO: 222215 - DNA, 20 bp, Artificial Sequence
  Description of Artificial Sequence: Synthetic oligonucleotide
  Target: ATXN1; (-) strand; PAM type: YTN; PAM sequence: CTC
atttttagctgggaacatcc

SEQ ID NO: 222216 - DNA, 20 bp, Artificial Sequence
  Description of Artificial Sequence: Synthetic oligonucleotide
  Target: ATXN1; (-) strand; PAM type: YTN; PAM sequence: TTC
tcatttttagctgggaacat

SEQ ID NO: 222217 - DNA, 20 bp, Artificial Sequence
  Description of Artificial Sequence: Synthetic oligonucleotide
  Target: ATXN1; (-) strand; PAM type: YTN; PAM sequence: TTT
ctcatttttagctgggaaca

SEQ ID NO: 222218 - DNA, 20 bp, Artificial Sequence
  Description of Artificial Sequence: Synthetic oligonucleotide
  Target: ATXN1; (-) strand; PAM type: YTN; PAM sequence: CTG
atttctcatttttagctggg

SEQ ID NO: 222219 - DNA, 20 bp, Artificial Sequence
  Description of Artificial Sequence: Synthetic oligonucleotide
  Target: ATXN1; (-) strand; PAM type: YTN; PAM sequence: CTC
tgatttctcatttttagctg

SEQ ID NO: 222220 - DNA, 20 bp, Artificial Sequence
  Description of Artificial Sequence: Synthetic oligonucleotide
  Target: ATXN1; (-) strand; PAM type: YTN; PAM sequence: CTG
tctctgatttctcattttta

SEQ ID NO: 222221 - DNA, 20 bp, Artificial Sequence
  Description of Artificial Sequence: Synthetic oligonucleotide
  Target: ATXN1; (-) strand; PAM type: YTN; PAM sequence: TTC
tgtctctgatttctcatttt

SEQ ID NO: 222222 - DNA, 20 bp, Artificial Sequence
  Description of Artificial Sequence: Synthetic oligonucleotide
  Target: ATXN1; (-) strand; PAM type: YTN; PAM sequence: TTT
ctgtctctgatttctcattt

SEQ ID NO: 222223 - DNA, 20 bp, Artificial Sequence
  Description of Artificial Sequence: Synthetic oligonucleotide
  Target: ATXN1; (-) strand; PAM type: YTN; PAM sequence: CTT
tctgtctctgatttctcatt

SEQ ID NO: 222224 - DNA, 20 bp, Artificial Sequence
  Description of Artificial Sequence: Synthetic oligonucleotide
  Target: ATXN1; (-) strand; PAM type: YTN; PAM sequence: CTC
agctttctgtctctgatttc

SEQ ID NO: 222225 - DNA, 20 bp, Artificial Sequence
  Description of Artificial Sequence: Synthetic oligonucleotide
  Target: ATXN1; (-) strand; PAM type: YTN; PAM sequence: CTA
ctcagctttctgtctctgat

SEQ ID NO: 222226 - DNA, 20 bp, Artificial Sequence
  Description of Artificial Sequence: Synthetic oligonucleotide
  Target: ATXN1; (-) strand; PAM type: YTN; PAM sequence: TTC
ctactcagctttctgtctct

SEQ ID NO: 222227 - DNA, 20 bp, Artificial Sequence
  Description of Artificial Sequence: Synthetic oligonucleotide
  Target: ATXN1; (-) strand; PAM type: YTN; PAM sequence: CTA
tgttcctactcagctttctg

SEQ ID NO: 222228 - DNA, 20 bp, Artificial Sequence
  Description of Artificial Sequence: Synthetic oligonucleotide
  Target: ATXN1; (-) strand; PAM type: YTN; PAM sequence: TTC
cacatcctatgttcctactc

SEQ ID NO: 222229 - DNA, 20 bp, Artificial Sequence
  Description of Artificial Sequence: Synthetic oligonucleotide
  Target: ATXN1; (-) strand; PAM type: YTN; PAM sequence: TTA
attccacatcctatgttcct

SEQ ID NO: 222230 - DNA, 20 bp, Artificial Sequence
  Description of Artificial Sequence: Synthetic oligonucleotide
  Target: ATXN1; (-) strand; PAM type: YTN; PAM sequence: CTT
aattccacatcctatgttcc

SEQ ID NO: 222231 - DNA, 20 bp, Artificial Sequence
  Description of Artificial Sequence: Synthetic oligonucleotide
  Target: ATXN1; (-) strand; PAM type: YTN; PAM sequence: CTA
taaaggtcaatcttaattcc

SEQ ID NO: 222232 - DNA, 20 bp, Artificial Sequence
  Description of Artificial Sequence: Synthetic oligonucleotide
  Target: ATXN1; (-) strand; PAM type: YTN; PAM sequence: TTC
tataaaggtcaatcttaatt

SEQ ID NO: 222233 - DNA, 20 bp, Artificial Sequence
  Description of Artificial Sequence: Synthetic oligonucleotide
  Target: ATXN1; (-) strand; PAM type: YTN; PAM sequence: TTA
ggaatgataaaaatattcta

SEQ ID NO: 222234 - DNA, 20 bp, Artificial Sequence
  Description of Artificial Sequence: Synthetic oligonucleotide
  Target: ATXN1; (-) strand; PAM type: YTN; PAM sequence: CTT
aggaatgataaaaatattct

SEQ ID NO: 222235 - DNA, 20 bp, Artificial Sequence
  Description of Artificial Sequence: Synthetic oligonucleotide
  Target: ATXN1; (-) strand; PAM type: YTN; PAM sequence: CTC
ttaggaatgataaaaatatt

SEQ ID NO: 222236 - DNA, 20 bp, Artificial Sequence
  Description of Artificial Sequence: Synthetic oligonucleotide
  Target: ATXN1; (-) strand; PAM type: YTN; PAM sequence: TTC
caatctcttaggaatgataa

SEQ ID NO: 222237 - DNA, 20 bp, Artificial Sequence
  Description of Artificial Sequence: Synthetic oligonucleotide
  Target: ATXN1; (-) strand; PAM type: YTN; PAM sequence: CTG
aatattccaatctcttagga

SEQ ID NO: 222238 - DNA, 20 bp, Artificial Sequence
  Description of Artificial Sequence: Synthetic oligonucleotide
  Target: ATXN1; (-) strand; PAM type: YTN; PAM sequence: TTA
gtatgctgaatattccaatc

SEQ ID NO: 222239 - DNA, 20 bp, Artificial Sequence
  Description of Artificial Sequence: Synthetic oligonucleotide
  Target: ATXN1; (-) strand; PAM type: YTN; PAM sequence: TTA
ttagtatgctgaatattcca

SEQ ID NO: 222240 - DNA, 20 bp, Artificial Sequence
  Description of Artificial Sequence: Synthetic oligonucleotide
  Target: ATXN1; (-) strand; PAM type: YTN; PAM sequence: TTA
aatcagaaaattattagtat

SEQ ID NO: 222241 - DNA, 20 bp, Artificial Sequence
  Description of Artificial Sequence: Synthetic oligonucleotide
  Target: ATXN1; (-) strand; PAM type: YTN; PAM sequence: TTT
aaatcagaaaattattagta

SEQ ID NO: 222242 - DNA, 20 bp, Artificial Sequence
  Description of Artificial Sequence: Synthetic oligonucleotide
  Target: ATXN1; (-) strand; PAM type: YTN; PAM sequence: TTA
tatttaaatcagaaaattat

SEQ ID NO: 222243 - DNA, 20 bp, Artificial Sequence
  Description of Artificial Sequence: Synthetic oligonucleotide
  Target: ATXN1; (-) strand; PAM type: YTN; PAM sequence: CTT
atatttaaatcagaaaatta

SEQ ID NO: 222244 - DNA, 20 bp, Artificial Sequence
  Description of Artificial Sequence: Synthetic oligonucleotide
  Target: ATXN1; (-) strand; PAM type: YTN; PAM sequence: CTA
cttatatttaaatcagaaaa

SEQ ID NO: 222245 - DNA, 20 bp, Artificial Sequence
  Description of Artificial Sequence: Synthetic oligonucleotide
  Target: ATXN1; (-) strand; PAM type: YTN; PAM sequence: TTA
atatggtgatgtctacttat

SEQ ID NO: 222246 - DNA, 20 bp, Artificial Sequence
  Description of Artificial Sequence: Synthetic oligonucleotide
  Target: ATXN1; (-) strand; PAM type: YTN; PAM sequence: TTG
gtgaaattaatatggtgatg

SEQ ID NO: 222247 - DNA, 20 bp, Artificial Sequence
  Description of Artificial Sequence: Synthetic oligonucleotide
  Target: ATXN1; (-) strand; PAM type: YTN; PAM sequence: TTT
ggtgaaattaatatggtgat

SEQ ID NO: 222248 - DNA, 20 bp, Artificial Sequence
  Description of Artificial Sequence: Synthetic oligonucleotide
  Target: ATXN1; (-) strand; PAM type: YTN; PAM sequence: TTT
tggtgaaattaatatggtga

SEQ ID NO: 222249 - DNA, 20 bp, Artificial Sequence
  Description of Artificial Sequence: Synthetic oligonucleotide
  Target: ATXN1; (-) strand; PAM type: YTN; PAM sequence: TTT
ttggtgaaattaatatggtg

SEQ ID NO: 222250 - DNA, 20 bp, Artificial Sequence
  Description of Artificial Sequence: Synthetic oligonucleotide
  Target: ATXN1; (-) strand; PAM type: YTN; PAM sequence: TTT
tttggtgaaattaatatggt

SEQ ID NO: 222251 - DNA, 20 bp, Artificial Sequence
  Description of Artificial Sequence: Synthetic oligonucleotide
  Target: ATXN1; (-) strand; PAM type: YTN; PAM sequence: TTT
ttttggtgaaattaatatgg

SEQ ID NO: 222252 - DNA, 20 bp, Artificial Sequence
  Description of Artificial Sequence: Synthetic oligonucleotide
  Target: ATXN1; (-) strand; PAM type: YTN; PAM sequence: TTT
tttttggtgaaattaatatg

SEQ ID NO: 222253 - DNA, 20 bp, Artificial Sequence
  Description of Artificial Sequence: Synthetic oligonucleotide
  Target: ATXN1; (-) strand; PAM type: YTN; PAM sequence: TTA
aacattttttttggtgaaat

SEQ ID NO: 222254 - DNA, 20 bp, Artificial Sequence
  Description of Artificial Sequence: Synthetic oligonucleotide
  Target: ATXN1; (-) strand; PAM type: YTN; PAM sequence: CTT
aaacattttttttggtgaaa

SEQ ID NO: 222255 - DNA, 20 bp, Artificial Sequence
  Description of Artificial Sequence: Synthetic oligonucleotide
  Target: ATXN1; (-) strand; PAM type: YTN; PAM sequence: TTA
acttaaacattttttttggt

SEQ ID NO: 222256 - DNA, 20 bp, Artificial Sequence
  Description of Artificial Sequence: Synthetic oligonucleotide
  Target: ATXN1; (-) strand; PAM type: YTN; PAM sequence: TTG
ataaattaacttaaacattt

SEQ ID NO: 222257 - DNA, 20 bp, Artificial Sequence
  Description of Artificial Sequence: Synthetic oligonucleotide
  Target: ATXN1; (-) strand; PAM type: YTN; PAM sequence: TTT
gataaattaacttaaacatt

SEQ ID NO: 222258 - DNA, 20 bp, Artificial Sequence
  Description of Artificial Sequence: Synthetic oligonucleotide
  Target: ATXN1; (-) strand; PAM type: YTN; PAM sequence: TTT
tgataaattaacttaaacat

SEQ ID NO: 222259 - DNA, 20 bp, Artificial Sequence
  Description of Artificial Sequence: Synthetic oligonucleotide
  Target: ATXN1; (-) strand; PAM type: YTN; PAM sequence: CTT
ttgataaattaacttaaaca

SEQ ID NO: 222260 - DNA, 20 bp, Artificial Sequence
  Description of Artificial Sequence: Synthetic oligonucleotide
  Target: ATXN1; (-) strand; PAM type: YTN; PAM sequence: TTC
cttttgataaattaacttaa

SEQ ID NO: 222261 - DNA, 20 bp, Artificial Sequence
  Description of Artificial Sequence: Synthetic oligonucleotide
  Target: ATXN1; (-) strand; PAM type: YTN; PAM sequence: CTT
ccttttgataaattaactta

SEQ ID NO: 222262 - DNA, 20 bp, Artificial Sequence
  Description of Artificial Sequence: Synthetic oligonucleotide
  Target: ATXN1; (-) strand; PAM type: YTN; PAM sequence: CTG
ccttccttttgataaattaa

SEQ ID NO: 222263 - DNA, 20 bp, Artificial Sequence
  Description of Artificial Sequence: Synthetic oligonucleotide
  Target: ATXN1; (-) strand; PAM type: YTN; PAM sequence: TTC
cctgccttccttttgataaa

SEQ ID NO: 222264 - DNA, 20 bp, Artificial Sequence
  Description of Artificial Sequence: Synthetic oligonucleotide
  Target: ATXN1; (-) strand; PAM type: YTN; PAM sequence: TTT
ccctgccttccttttgataa

SEQ ID NO: 222265 - DNA, 20 bp, Artificial Sequence
  Description of Artificial Sequence: Synthetic oligonucleotide
  Target: ATXN1; (-) strand; PAM type: YTN; PAM sequence: CTT
tccctgccttccttttgata

SEQ ID NO: 222266 - DNA, 20 bp, Artificial Sequence
  Description of Artificial Sequence: Synthetic oligonucleotide
  Target: ATXN1; (-) strand; PAM type: YTN; PAM sequence: CTC
tttccctgccttccttttga

SEQ ID NO: 222267 - DNA, 20 bp, Artificial Sequence
  Description of Artificial Sequence: Synthetic oligonucleotide
  Target: ATXN1; (-) strand; PAM type: YTN; PAM sequence: TTC
tctttccctgccttcctttt

SEQ ID NO: 222268 - DNA, 20 bp, Artificial Sequence
  Description of Artificial Sequence: Synthetic oligonucleotide
  Target: ATXN1; (-) strand; PAM type: YTN; PAM sequence: TTT
ctctttccctgccttccttt

SEQ ID NO: 222269 - DNA, 20 bp, Artificial Sequence
  Description of Artificial Sequence: Synthetic oligonucleotide
  Target: ATXN1; (-) strand; PAM type: YTN; PAM sequence: TTT
tctctttccctgccttcctt

SEQ ID NO: 222270 - DNA, 20 bp, Artificial Sequence
  Description of Artificial Sequence: Synthetic oligonucleotide
  Target: ATXN1; (-) strand; PAM type: YTN; PAM sequence: TTT
ttctctttccctgccttcct

SEQ ID NO: 222271 - DNA, 20 bp, Artificial Sequence
  Description of Artificial Sequence: Synthetic oligonucleotide
  Target: ATXN1; (-) strand; PAM type: YTN; PAM sequence: CTT
tttctctttccctgccttcc

SEQ ID NO: 222272 - DNA, 20 bp, Artificial Sequence
  Description of Artificial Sequence: Synthetic oligonucleotide
  Target: ATXN1; (-) strand; PAM type: YTN; PAM sequence: TTC
tttttctctttccctgcctt

SEQ ID NO: 222273 - DNA, 20 bp, Artificial Sequence
  Description of Artificial Sequence: Synthetic oligonucleotide
  Target: ATXN1; (-) strand; PAM type: YTN; PAM sequence: TTT
ctttttctctttccctgcct

SEQ ID NO: 222274 - DNA, 20 bp, Artificial Sequence
  Description of Artificial Sequence: Synthetic oligonucleotide
  Target: ATXN1; (-) strand; PAM type: YTN; PAM sequence: CTT
tctttttctctttccctgcc

SEQ ID NO: 222275 - DNA, 20 bp, Artificial Sequence
  Description of Artificial Sequence: Synthetic oligonucleotide
  Target: ATXN1; (-) strand; PAM type: YTN; PAM sequence: CTC
ctttctttttctctttccct

SEQ ID NO: 222276 - DNA, 20 bp, Artificial Sequence
  Description of Artificial Sequence: Synthetic oligonucleotide
  Target: ATXN1; (-) strand; PAM type: YTN; PAM sequence: TTC
actcctttctttttctcttt

SEQ ID NO: 222277 - DNA, 20 bp, Artificial Sequence
  Description of Artificial Sequence: Synthetic oligonucleotide
  Target: ATXN1; (-) strand; PAM type: YTN; PAM sequence: CTT
cactcctttctttttctctt

SEQ ID NO: 222278 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccgcacc

SEQ ID NO: 222279 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 222280 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 222281 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 222282 - DNA, 20 bp, Artificial Sequence
  Description of Artificial Sequence: Synthetic oligonucleotide
  Target: ATXN1; (-) strand; PAM type: YTN; PAM sequence: CTC
aggtgatccacccgcctcgg

SEQ ID NO: 222283 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatccacccgc

SEQ ID NO: 222284 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatccacc

SEQ ID NO: 222285 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcaggtga

SEQ ID NO: 222286 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacctca

SEQ ID NO: 222287 - DNA, 20 bp, Artificial Sequence
  Description of Artificial Sequence: Synthetic oligonucleotide
  Target: ATXN1; (-) strand; PAM type: YTN; PAM sequence: TTG
gtcaggctggtctcgaactc

SEQ ID NO: 222288 - DNA, 20 bp, Artificial Sequence
  Description of Artificial Sequence: Synthetic oligonucleotide
  Target: ATXN1; (-) strand; PAM type: YTN; PAM sequence: TTC
accatgttggtcaggctggt

SEQ ID NO: 222289 - DNA, 20 bp, Artificial Sequence
  Description of Artificial Sequence: Synthetic oligonucleotide
  Target: ATXN1; (-) strand; PAM type: YTN; PAM sequence: TTT
caccatgttggtcaggctgg

SEQ ID NO: 222290 - DNA, 20 bp, Artificial Sequence
  Description of Artificial Sequence: Synthetic oligonucleotide
  Target: ATXN1; (-) strand; PAM type: YTN; PAM sequence: TTG
tagagatggggtttcaccat

SEQ ID NO: 222291 - DNA, 20 bp, Artificial Sequence
  Description of Artificial Sequence: Synthetic oligonucleotide
  Target: ATXN1; (-) strand; PAM type: YTN; PAM sequence: TTT
gtagagatggggtttcacca

SEQ ID NO: 222292 - DNA, 20 bp, Artificial Sequence
  Description of Artificial Sequence: Synthetic oligonucleotide
  Target: ATXN1; (-) strand; PAM type: YTN; PAM sequence: TTT
tgtagagatggggtttcacc

SEQ ID NO: 222293 - DNA, 20 bp, Artificial Sequence
  Description of Artificial Sequence: Synthetic oligonucleotide
  Target: ATXN1; (-) strand; PAM type: YTN; PAM sequence: TTT
ttgtagagatggggtttcac

SEQ ID NO: 222294 - DNA, 20 bp, Artificial Sequence
  Description of Artificial Sequence: Synthetic oligonucleotide
  Target: ATXN1; (-) strand; PAM type: YTN; PAM sequence: TTG
tatgtttttgtagagatggg

SEQ ID NO: 222295 - DNA, 20 bp, Artificial Sequence
  Description of Artificial Sequence: Synthetic oligonucleotide
  Target: ATXN1; (-) strand; PAM type: YTN; PAM sequence: TTT
gtatgtttttgtagagatgg

SEQ ID NO: 222296 - DNA, 20 bp, Artificial Sequence
  Description of Artificial Sequence: Synthetic oligonucleotide
  Target: ATXN1; (-) strand; PAM type: YTN; PAM sequence: TTT
tgtatgtttttgtagagatg

SEQ ID NO: 222297 - DNA, 20 bp, Artificial Sequence
  Description of Artificial Sequence: Synthetic oligonucleotide
  Target: ATXN1; (-) strand; PAM type: YTN; PAM sequence: CTA
attttgtatgtttttgtaga

SEQ ID NO: 222298 - DNA, 20 bp, Artificial Sequence
  Description of Artificial Sequence: Synthetic oligonucleotide
  Target: ATXN1; (-) strand; PAM type: YTN; PAM sequence: CTC
caccacagccagctaatttt

SEQ ID NO: 222299 - DNA, 20 bp, Artificial Sequence
  Description of Artificial Sequence: Synthetic oligonucleotide
  Target: ATXN1; (-) strand; PAM type: YTN; PAM sequence: TTA
taggcatgctccaccacagc

SEQ ID NO: 222300 - DNA, 20 bp, Artificial Sequence
  Description of Artificial Sequence: Synthetic oligonucleotide
  Target: ATXN1; (-) strand; PAM type: YTN; PAM sequence: CTG
ggattataggcatgctccac

SEQ ID NO: 222301 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattatag

SEQ ID NO: 222302 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 222303 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 222304 - DNA, 20 bp, Artificial Sequence
  Description of Artificial Sequence: Synthetic oligonucleotide
  Target: ATXN1; (-) strand; PAM type: YTN; PAM sequence: CTA
ctgcctcagcctcccaagta

SEQ ID NO: 222305 - DNA, 20 bp, Artificial Sequence
  Description of Artificial Sequence: Synthetic oligonucleotide
  Target: ATXN1; (-) strand; PAM type: YTN; PAM sequence: TTC
tactgcctcagcctcccaag

SEQ ID NO: 222306 - DNA, 20 bp, Artificial Sequence
  Description of Artificial Sequence: Synthetic oligonucleotide
  Target: ATXN1; (-) strand; PAM type: YTN; PAM sequence: TTC
aagcgattctactgcctcag

SEQ ID NO: 222307 - DNA, 20 bp, Artificial Sequence
  Description of Artificial Sequence: Synthetic oligonucleotide
  Target: ATXN1; (-) strand; PAM type: YTN; PAM sequence: CTC
gagttcaagcgattctactg

SEQ ID NO: 222308 - DNA, 20 bp, Artificial Sequence
  Description of Artificial Sequence: Synthetic oligonucleotide
  Target: ATXN1; (-) strand; PAM type: YTN; PAM sequence: CTC
tcgagttcaagcgattctac

SEQ ID NO: 222309 - DNA, 20 bp, Artificial Sequence
  Description of Artificial Sequence: Synthetic oligonucleotide
  Target: ATXN1; (-) strand; PAM type: YTN; PAM sequence: CTG
tctctcgagttcaagcgatt

SEQ ID NO: 222310 - DNA, 20 bp, Artificial Sequence
  Description of Artificial Sequence: Synthetic oligonucleotide
  Target: ATXN1; (-) strand; PAM type: YTN; PAM sequence: CTC
tgtctctcgagttcaagcga

SEQ ID NO: 222311 - DNA, 20 bp, Artificial Sequence
  Description of Artificial Sequence: Synthetic oligonucleotide
  Target: ATXN1; (-) strand; PAM type: YTN; PAM sequence: TTA
ccgcaacctctgtctctcga

SEQ ID NO: 222312 - DNA, 20 bp, Artificial Sequence
  Description of Artificial Sequence: Synthetic oligonucleotide
  Target: ATXN1; (-) strand; PAM type: YTN; PAM sequence: CTT
accgcaacctctgtctctcg

SEQ ID NO: 222313 - DNA, 20 bp, Artificial Sequence
  Description of Artificial Sequence: Synthetic oligonucleotide
  Target: ATXN1; (-) strand; PAM type: YTN; PAM sequence: CTC
ggcttaccgcaacctctgtc

SEQ ID NO: 222314 - DNA, 20 bp, Artificial Sequence
  Description of Artificial Sequence: Synthetic oligonucleotide
  Target: ATXN1; (-) strand; PAM type: YTN; PAM sequence: CTG
gggtgcagtggcgtgatctc

SEQ ID NO: 222315 - DNA, 20 bp, Artificial Sequence
  Description of Artificial Sequence: Synthetic oligonucleotide
  Target: ATXN1; (-) strand; PAM type: YTN; PAM sequence: TTG
cccaggctggggtgcagtgg

SEQ ID NO: 222316 - DNA, 20 bp, Artificial Sequence
  Description of Artificial Sequence: Synthetic oligonucleotide
  Target: ATXN1; (-) strand; PAM type: YTN; PAM sequence: TTG
ttgcccaggctggggtgcag

SEQ ID NO: 222317 - DNA, 20 bp, Artificial Sequence
  Description of Artificial Sequence: Synthetic oligonucleotide
  Target: ATXN1; (-) strand; PAM type: YTN; PAM sequence: CTT
gttgcccaggctggggtgca

SEQ ID NO: 222318 - DNA, 20 bp, Artificial Sequence
  Description of Artificial Sequence: Synthetic oligonucleotide
  Target: ATXN1; (-) strand; PAM type: YTN; PAM sequence: CTC
ttgttgcccaggctggggtg

SEQ ID NO: 222319 - DNA, 20 bp, Artificial Sequence
  Description of Artificial Sequence: Synthetic oligonucleotide
  Target: ATXN1; (-) strand; PAM type: YTN; PAM sequence: TTC
actcttgttgcccaggctgg

SEQ ID NO: 222320 - DNA, 20 bp, Artificial Sequence
  Description of Artificial Sequence: Synthetic oligonucleotide
  Target: ATXN1; (-) strand; PAM type: YTN; PAM sequence: TTT
cactcttgttgcccaggctg

SEQ ID NO: 222321 - DNA, 20 bp, Artificial Sequence
  Description of Artificial Sequence: Synthetic oligonucleotide
  Target: ATXN1; (-) strand; PAM type: YTN; PAM sequence: TTG
agatggagtttcactcttgt

SEQ ID NO: 222322 - DNA, 20 bp, Artificial Sequence
  Description of Artificial Sequence: Synthetic oligonucleotide
  Target: ATXN1; (-) strand; PAM type: YTN; PAM sequence: TTT
gagatggagtttcactcttg

SEQ ID NO: 222323 - DNA, 20 bp, Artificial Sequence
  Description of Artificial Sequence: Synthetic oligonucleotide
  Target: ATXN1; (-) strand; PAM type: YTN; PAM sequence: TTT
tgagatggagtttcactctt

SEQ ID NO: 222324 - DNA, 20 bp, Artificial Sequence
  Description of Artificial Sequence: Synthetic oligonucleotide
  Target: ATXN1; (-) strand; PAM type: YTN; PAM sequence: TTT
ttgagatggagtttcactct

SEQ ID NO: 222325 - DNA, 20 bp, Artificial Sequence
  Description of Artificial Sequence: Synthetic oligonucleotide
  Target: ATXN1; (-) strand; PAM type: YTN; PAM sequence: TTT
tttgagatggagtttcactc

SEQ ID NO: 222326 - DNA, 20 bp, Artificial Sequence
  Description of Artificial Sequence: Synthetic oligonucleotide
  Target: ATXN1; (-) strand; PAM type: YTN; PAM sequence: TTT
ttttgagatggagtttcact

SEQ ID NO: 222327 - DNA, 20 bp, Artificial Sequence
  Description of Artificial Sequence: Synthetic oligonucleotide
  Target: ATXN1; (-) strand; PAM type: YTN; PAM sequence: TTT
tttttgagatggagtttcac

SEQ ID NO: 222328 - DNA, 20 bp, Artificial Sequence
  Description of Artificial Sequence: Synthetic oligonucleotide
  Target: ATXN1; (-) strand; PAM type: YTN; PAM sequence: TTT
ttttttgagatggagtttca

SEQ ID NO: 222329 - DNA, 20 bp, Artificial Sequence
  Description of Artificial Sequence: Synthetic oligonucleotide
  Target: ATXN1; (-) strand; PAM type: YTN; PAM sequence: TTT
tttttttgagatggagtttc

SEQ ID NO: 222330 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagatggagttt

SEQ ID NO: 222331 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagatggagtt

SEQ ID NO: 222332 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagatggagt

SEQ ID NO: 222333 - DNA, 20 bp, Artificial Sequence
  Description of Artificial Sequence: Synthetic oligonucleotide
  Target: ATXN1; (-) strand; PAM type: YTN; PAM sequence: CTT
tttttttttttgagatggag

SEQ ID NO: 222334 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttgagatgg

SEQ ID NO: 222335 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttttgagatg

SEQ ID NO: 222336 - DNA, 20 bp, Artificial Sequence
  Description of Artificial Sequence: Synthetic oligonucleotide
  Target: ATXN1; (-) strand; PAM type: YTN; PAM sequence: CTT
tctttttttttttttgagat

SEQ ID NO: 222337 - DNA, 20 bp, Artificial Sequence
  Description of Artificial Sequence: Synthetic oligonucleotide
  Target: ATXN1; (-) strand; PAM type: YTN; PAM sequence: CTC
ctttctttttttttttttga

SEQ ID NO: 222338 - DNA, 20 bp, Artificial Sequence
  Description of Artificial Sequence: Synthetic oligonucleotide
  Target: ATXN1; (-) strand; PAM type: YTN; PAM sequence: TTC
catcactcctttcttttttt

SEQ ID NO: 222339 - DNA, 20 bp, Artificial Sequence
  Description of Artificial Sequence: Synthetic oligonucleotide
  Target: ATXN1; (-) strand; PAM type: YTN; PAM sequence: CTT
ccatcactcctttctttttt

SEQ ID NO: 222340 - DNA, 20 bp, Artificial Sequence
  Description of Artificial Sequence: Synthetic oligonucleotide
  Target: ATXN1; (-) strand; PAM type: YTN; PAM sequence: TTC
ttccatcactcctttctttt

SEQ ID NO: 222341 - DNA, 20 bp, Artificial Sequence
  Description of Artificial Sequence: Synthetic oligonucleotide
  Target: ATXN1; (-) strand; PAM type: YTN; PAM sequence: TTT
cttccatcactcctttcttt

SEQ ID NO: 222342 - DNA, 20 bp, Artificial Sequence
  Description of Artificial Sequence: Synthetic oligonucleotide
  Target: ATXN1; (-) strand; PAM type: YTN; PAM sequence: TTT
tcttccatcactcctttctt

SEQ ID NO: 222343 - DNA, 20 bp, Artificial Sequence
  Description of Artificial Sequence: Synthetic oligonucleotide
  Target: ATXN1; (-) strand; PAM type: YTN; PAM sequence: CTT
ttcttccatcactcctttct

SEQ ID NO: 222344 - DNA, 20 bp, Artificial Sequence
  Description of Artificial Sequence: Synthetic oligonucleotide
  Target: ATXN1; (-) strand; PAM type: YTN; PAM sequence: TTC
atccatccatccatcttttc

SEQ ID NO: 222345 - DNA, 20 bp, Artificial Sequence
  Description of Artificial Sequence: Synthetic oligonucleotide
  Target: ATXN1; (-) strand; PAM type: YTN; PAM sequence: CTA
ttcatccatccatccatctt

SEQ ID NO: 222346 - DNA, 20 bp, Artificial Sequence
  Description of Artificial Sequence: Synthetic oligonucleotide
  Target: ATXN1; (-) strand; PAM type: YTN; PAM sequence: CTA
tccatccatctattcatcca

SEQ ID NO: 222347 - DNA, 20 bp, Artificial Sequence
  Description of Artificial Sequence: Synthetic oligonucleotide
  Target: ATXN1; (-) strand; PAM type: YTN; PAM sequence: CTC
ccacctatccatccatctat

SEQ ID NO: 222348 - DNA, 20 bp, Artificial Sequence
  Description of Artificial Sequence: Synthetic oligonucleotide
  Target: ATXN1; (-) strand; PAM type: YTN; PAM sequence: TTG
tccatccatccaccctccca

SEQ ID NO: 222349 - DNA, 20 bp, Artificial Sequence
  Description of Artificial Sequence: Synthetic oligonucleotide
  Target: ATXN1; (-) strand; PAM type: YTN; PAM sequence: TTT
gtccatccatccaccctccc

SEQ ID NO: 222350 - DNA, 20 bp, Artificial Sequence
  Description of Artificial Sequence: Synthetic oligonucleotide
  Target: ATXN1; (-) strand; PAM type: YTN; PAM sequence: CTA
tttgtccatccatccaccct

SEQ ID NO: 222351 - DNA, 20 bp, Artificial Sequence
  Description of Artificial Sequence: Synthetic oligonucleotide
  Target: ATXN1; (-) strand; PAM type: YTN; PAM sequence: CTA
tctatttgtccatccatcca

SEQ ID NO: 222352 - DNA, 20 bp, Artificial Sequence
  Description of Artificial Sequence: Synthetic oligonucleotide
  Target: ATXN1; (-) strand; PAM type: YTN; PAM sequence: TTC
atccatctatctatttgtcc

SEQ ID NO: 222353 - DNA, 20 bp, Artificial Sequence
  Description of Artificial Sequence: Synthetic oligonucleotide
  Target: ATXN1; (-) strand; PAM type: YTN; PAM sequence: TTC
atccatccacccatccattc

SEQ ID NO: 222354 - DNA, 20 bp, Artificial Sequence
  Description of Artificial Sequence: Synthetic oligonucleotide
  Target: ATXN1; (-) strand; PAM type: YTN; PAM sequence: CTA
ttcatccatccacccatcca

SEQ ID NO: 222355 - DNA, 20 bp, Artificial Sequence
  Description of Artificial Sequence: Synthetic oligonucleotide
  Target: ATXN1; (-) strand; PAM type: YTN; PAM sequence: TTC
catccatctattcatccatc

SEQ ID NO: 222356 - DNA, 20 bp, Artificial Sequence
  Description of Artificial Sequence: Synthetic oligonucleotide
  Target: ATXN1; (-) strand; PAM type: YTN; PAM sequence: CTT
ccatccatctattcatccat

SEQ ID NO: 222357 - DNA, 20 bp, Artificial Sequence
  Description of Artificial Sequence: Synthetic oligonucleotide
  Target: ATXN1; (-) strand; PAM type: YTN; PAM sequence: CTA
tccttccatccatctattca

SEQ ID NO: 222358 - DNA, 20 bp, Artificial Sequence
  Description of Artificial Sequence: Synthetic oligonucleotide
  Target: ATXN1; (-) strand; PAM type: YTN; PAM sequence: TTC
atctatccttccatccatct

SEQ ID NO: 222359 - DNA, 20 bp, Artificial Sequence
  Description of Artificial Sequence: Synthetic oligonucleotide
  Target: ATXN1; (-) strand; PAM type: YTN; PAM sequence: TTC
cacccatccgtccacccacc

SEQ ID NO: 222360 - DNA, 20 bp, Artificial Sequence
  Description of Artificial Sequence: Synthetic oligonucleotide
  Target: ATXN1; (-) strand; PAM type: YTN; PAM sequence: CTT
ccacccatccgtccacccac

SEQ ID NO: 222361 - DNA, 20 bp, Artificial Sequence
  Description of Artificial Sequence: Synthetic oligonucleotide
  Target: ATXN1; (-) strand; PAM type: YTN; PAM sequence: TTC
atccttccacccatccgtcc

SEQ ID NO: 222362 - DNA, 20 bp, Artificial Sequence
  Description of Artificial Sequence: Synthetic oligonucleotide
  Target: ATXN1; (-) strand; PAM type: YTN; PAM sequence: CTA
ttcatccttccacccatccg

SEQ ID NO: 222363 - DNA, 20 bp, Artificial Sequence
  Description of Artificial Sequence: Synthetic oligonucleotide
  Target: ATXN1; (-) strand; PAM type: YTN; PAM sequence: CTC
atccatccatccatccaccc

SEQ ID NO: 222364 - DNA, 20 bp, Artificial Sequence
  Description of Artificial Sequence: Synthetic oligonucleotide
  Target: ATXN1; (-) strand; PAM type: YTN; PAM sequence: CTA
actcatccatccatccatcc

SEQ ID NO: 222365 - DNA, 20 bp, Artificial Sequence
  Description of Artificial Sequence: Synthetic oligonucleotide
  Target: ATXN1; (-) strand; PAM type: YTN; PAM sequence: CTA
tccacccacccatatatcca

SEQ ID NO: 222366 - DNA, 20 bp, Artificial Sequence
  Description of Artificial Sequence: Synthetic oligonucleotide
  Target: ATXN1; (-) strand; PAM type: YTN; PAM sequence: CTC
ccatccacctatccacccac

SEQ ID NO: 222367 - DNA, 20 bp, Artificial Sequence
  Description of Artificial Sequence: Synthetic oligonucleotide
  Target: ATXN1; (-) strand; PAM type: YTN; PAM sequence: CTA
tcctcccatccacctatcca

SEQ ID NO: 222368 - DNA, 20 bp, Artificial Sequence
  Description of Artificial Sequence: Synthetic oligonucleotide
  Target: ATXN1; (-) strand; PAM type: YTN; PAM sequence: CTA
tctatcctcccatccaccta

SEQ ID NO: 222369 - DNA, 20 bp, Artificial Sequence
  Description of Artificial Sequence: Synthetic oligonucleotide
  Target: ATXN1; (-) strand; PAM type: YTN; PAM sequence: CTA
tccatctatctatcctccca

SEQ ID NO: 222370 - DNA, 20 bp, Artificial Sequence
  Description of Artificial Sequence: Synthetic oligonucleotide
  Target: ATXN1; (-) strand; PAM type: YTN; PAM sequence: TTC
catccatccatccatccatc

SEQ ID NO: 222371 - DNA, 20 bp, Artificial Sequence
  Description of Artificial Sequence: Synthetic oligonucleotide
  Target: ATXN1; (-) strand; PAM type: YTN; PAM sequence: CTT
ccatccatccatccatccat

SEQ ID NO: 222372 - DNA, 20 bp, Artificial Sequence
  Description of Artificial Sequence: Synthetic oligonucleotide
  Target: ATXN1; (-) strand; PAM type: YTN; PAM sequence: TTC
ttccatccatccatccatcc

SEQ ID NO: 222373 - DNA, 20 bp, Artificial Sequence
  Description of Artificial Sequence: Synthetic oligonucleotide
  Target: ATXN1; (-) strand; PAM type: YTN; PAM sequence: TTG
tattcttccatccatccatc

SEQ ID NO: 222374 - DNA, 20 bp, Artificial Sequence
  Description of Artificial Sequence: Synthetic oligonucleotide
  Target: ATXN1; (-) strand; PAM type: YTN; PAM sequence: CTT
gtattcttccatccatccat

SEQ ID NO: 222375 - DNA, 20 bp, Artificial Sequence
  Description of Artificial Sequence: Synthetic oligonucleotide
  Target: ATXN1; (-) strand; PAM type: YTN; PAM sequence: CTC
ccttgtattcttccatccat

SEQ ID NO: 222376 - DNA, 20 bp, Artificial Sequence
  Description of Artificial Sequence: Synthetic oligonucleotide
  Target: ATXN1; (-) strand; PAM type: YTN; PAM sequence: TTC
ctcccttgtattcttccatc

SEQ ID NO: 222377 - DNA, 20 bp, Artificial Sequence
  Description of Artificial Sequence: Synthetic oligonucleotide
  Target: ATXN1; (-) strand; PAM type: YTN; PAM sequence: CTT
cctcccttgtattcttccat

SEQ ID NO: 222378 - DNA, 20 bp, Artificial Sequence
  Description of Artificial Sequence: Synthetic oligonucleotide
  Target: ATXN1; (-) strand; PAM type: YTN; PAM sequence: TTC
cttcctcccttgtattcttc

SEQ ID NO: 222379 - DNA, 20 bp, Artificial Sequence
  Description of Artificial Sequence: Synthetic oligonucleotide
  Target: ATXN1; (-) strand; PAM type: YTN; PAM sequence: TTT
ccttcctcccttgtattctt

SEQ ID NO: 222380 - DNA, 20 bp, Artificial Sequence
  Description of Artificial Sequence: Synthetic oligonucleotide
  Target: ATXN1; (-) strand; PAM type: YTN; PAM sequence: TTT
tccttcctcccttgtattct

SEQ ID NO: 222381 - DNA, 20 bp, Artificial Sequence
  Description of Artificial Sequence: Synthetic oligonucleotide
  Target: ATXN1; (-) strand; PAM type: YTN; PAM sequence: TTT
ttccttcctcccttgtattc

SEQ ID NO: 222382 - DNA, 20 bp, Artificial Sequence
  Description of Artificial Sequence: Synthetic oligonucleotide
  Target: ATXN1; (-) strand; PAM type: YTN; PAM sequence: TTT
tttccttcctcccttgtatt

SEQ ID NO: 222383 - DNA, 20 bp, Artificial Sequence
  Description of Artificial Sequence: Synthetic oligonucleotide
  Target: ATXN1; (-) strand; PAM type: YTN; PAM sequence: CTT
ttttccttcctcccttgtat

SEQ ID NO: 222384 - DNA, 20 bp, Artificial Sequence
  Description of Artificial Sequence: Synthetic oligonucleotide
  Target: ATXN1; (-) strand; PAM type: YTN; PAM sequence: CTC
ccttttttccttcctccctt

SEQ ID NO: 222385 - DNA, 20 bp, Artificial Sequence
  Description of Artificial Sequence: Synthetic oligonucleotide
  Target: ATXN1; (-) strand; PAM type: YTN; PAM sequence: TTC
tcccttttttccttcctccc

SEQ ID NO: 222386 - DNA, 20 bp, Artificial Sequence
  Description of Artificial Sequence: Synthetic oligonucleotide
  Target: ATXN1; (-) strand; PAM type: YTN; PAM sequence: TTT
ctcccttttttccttcctcc

SEQ ID NO: 222387 - DNA, 20 bp, Artificial Sequence
  Description of Artificial Sequence: Synthetic oligonucleotide
  Target: ATXN1; (-) strand; PAM type: YTN; PAM sequence: CTT
tctcccttttttccttcctc

SEQ ID NO: 222388 - DNA, 20 bp, Artificial Sequence
  Description of Artificial Sequence: Synthetic oligonucleotide
  Target: ATXN1; (-) strand; PAM type: YTN; PAM sequence: CTG
tcccccctttctcccttttt

SEQ ID NO: 222389 - DNA, 20 bp, Artificial Sequence
  Description of Artificial Sequence: Synthetic oligonucleotide
  Target: ATXN1; (-) strand; PAM type: YTN; PAM sequence: TTC
tgtcccccctttctcccttt

SEQ ID NO: 222390 - DNA, 20 bp, Artificial Sequence
  Description of Artificial Sequence: Synthetic oligonucleotide
  Target: ATXN1; (-) strand; PAM type: YTN; PAM sequence: CTT
ctgtcccccctttctccctt

SEQ ID NO: 222391 - DNA, 20 bp, Artificial Sequence
  Description of Artificial Sequence: Synthetic oligonucleotide
  Target: ATXN1; (-) strand; PAM type: YTN; PAM sequence: CTA
cttctgtcccccctttctcc

SEQ ID NO: 222392 - DNA, 20 bp, Artificial Sequence
  Description of Artificial Sequence: Synthetic oligonucleotide
  Target: ATXN1; (-) strand; PAM type: YTN; PAM sequence: CTC
cctacttctgtccccccttt

SEQ ID NO: 222393 - DNA, 20 bp, Artificial Sequence
  Description of Artificial Sequence: Synthetic oligonucleotide
  Target: ATXN1; (-) strand; PAM type: YTN; PAM sequence: TTG
cctccctacttctgtccccc

SEQ ID NO: 222394 - DNA, 20 bp, Artificial Sequence
  Description of Artificial Sequence: Synthetic oligonucleotide
  Target: ATXN1; (-) strand; PAM type: YTN; PAM sequence: TTT
gcctccctacttctgtcccc

SEQ ID NO: 222395 - DNA, 20 bp, Artificial Sequence
  Description of Artificial Sequence: Synthetic oligonucleotide
  Target: ATXN1; (-) strand; PAM type: YTN; PAM sequence: CTT
tgcctccctacttctgtccc

SEQ ID NO: 222396 - DNA, 20 bp, Artificial Sequence
  Description of Artificial Sequence: Synthetic oligonucleotide
  Target: ATXN1; (-) strand; PAM type: YTN; PAM sequence: CTC
tttgcctccctacttctgtc

SEQ ID NO: 222397 - DNA, 20 bp, Artificial Sequence
  Description of Artificial Sequence: Synthetic oligonucleotide
  Target: ATXN1; (-) strand; PAM type: YTN; PAM sequence: TTC
tctttgcctccctacttctg

SEQ ID NO: 222398 - DNA, 20 bp, Artificial Sequence
  Description of Artificial Sequence: Synthetic oligonucleotide
  Target: ATXN1; (-) strand; PAM type: YTN; PAM sequence: CTT
ctctttgcctccctacttct

SEQ ID NO: 222399 - DNA, 20 bp, Artificial Sequence
  Description of Artificial Sequence: Synthetic oligonucleotide
  Target: ATXN1; (-) strand; PAM type: YTN; PAM sequence: TTC
ccttctctttgcctccctac

SEQ ID NO: 222400 - DNA, 20 bp, Artificial Sequence
  Description of Artificial Sequence: Synthetic oligonucleotide
  Target: ATXN1; (-) strand; PAM type: YTN; PAM sequence: TTT
cccttctctttgcctcccta

SEQ ID NO: 222401 - DNA, 20 bp, Artificial Sequence
  Description of Artificial Sequence: Synthetic oligonucleotide
  Target: ATXN1; (-) strand; PAM type: YTN; PAM sequence: CTA
tatttcccttctctttgcct

SEQ ID NO: 222402 - DNA, 20 bp, Artificial Sequence
  Description of Artificial Sequence: Synthetic oligonucleotide
  Target: ATXN1; (-) strand; PAM type: YTN; PAM sequence: CTC
cactatatttcccttctctt

SEQ ID NO: 222403 - DNA, 20 bp, Artificial Sequence
  Description of Artificial Sequence: Synthetic oligonucleotide
  Target: ATXN1; (-) strand; PAM type: YTN; PAM sequence: CTC
actccactatatttcccttc

SEQ ID NO: 222404 - DNA, 20 bp, Artificial Sequence
  Description of Artificial Sequence: Synthetic oligonucleotide
  Target: ATXN1; (-) strand; PAM type: YTN; PAM sequence: TTA
accgcccacataaaaactca

SEQ ID NO: 222405 - DNA, 20 bp, Artificial Sequence
  Description of Artificial Sequence: Synthetic oligonucleotide
  Target: ATXN1; (-) strand; PAM type: YTN; PAM sequence: CTT
aaccgcccacataaaaactc

SEQ ID NO: 222406 - DNA, 20 bp, Artificial Sequence
  Description of Artificial Sequence: Synthetic oligonucleotide
  Target: ATXN1; (-) strand; PAM type: YTN; PAM sequence: TTG
aacttaaccgcccacataaa

SEQ ID NO: 222407 - DNA, 20 bp, Artificial Sequence
  Description of Artificial Sequence: Synthetic oligonucleotide
  Target: ATXN1; (-) strand; PAM type: YTN; PAM sequence: TTT
gaacttaaccgcccacataa

SEQ ID NO: 222408 - DNA, 20 bp, Artificial Sequence
  Description of Artificial Sequence: Synthetic oligonucleotide
  Target: ATXN1; (-) strand; PAM type: YTN; PAM sequence: TTT
tgaacttaaccgcccacata

SEQ ID NO: 222409 - DNA, 20 bp, Artificial Sequence
  Description of Artificial Sequence: Synthetic oligonucleotide
  Target: ATXN1; (-) strand; PAM type: YTN; PAM sequence: CTT
ttgaacttaaccgcccacat

SEQ ID NO: 222410 - DNA, 20 bp, Artificial Sequence
  Description of Artificial Sequence: Synthetic oligonucleotide
  Target: ATXN1; (-) strand; PAM type: YTN; PAM sequence: TTA
acttttgaacttaaccgccc

SEQ ID NO: 222411 - DNA, 20 bp, Artificial Sequence
  Description of Artificial Sequence: Synthetic oligonucleotide
  Target: ATXN1; (-) strand; PAM type: YTN; PAM sequence: CTT
aacttttgaacttaaccgcc

SEQ ID NO: 222412 - DNA, 20 bp, Artificial Sequence
  Description of Artificial Sequence: Synthetic oligonucleotide
  Target: ATXN1; (-) strand; PAM type: YTN; PAM sequence: TTG
cttaacttttgaacttaacc

SEQ ID NO: 222413 - DNA, 20 bp, Artificial Sequence
  Description of Artificial Sequence: Synthetic oligonucleotide
  Target: ATXN1; (-) strand; PAM type: YTN; PAM sequence: TTT
gcttaacttttgaacttaac

SEQ ID NO: 222414 - DNA, 20 bp, Artificial Sequence
  Description of Artificial Sequence: Synthetic oligonucleotide
  Target: ATXN1; (-) strand; PAM type: YTN; PAM sequence: TTT
tgcttaacttttgaacttaa

SEQ ID NO: 222415 - DNA, 20 bp, Artificial Sequence
  Description of Artificial Sequence: Synthetic oligonucleotide
  Target: ATXN1; (-) strand; PAM type: YTN; PAM sequence: CTT
ttgcttaacttttgaactta

SEQ ID NO: 222416 - DNA, 20 bp, Artificial Sequence
  Description of Artificial Sequence: Synthetic oligonucleotide
  Target: ATXN1; (-) strand; PAM type: YTN; PAM sequence: CTA
tatatgacttttgcttaact

SEQ ID NO: 222417 - DNA, 20 bp, Artificial Sequence
  Description of Artificial Sequence: Synthetic oligonucleotide
  Target: ATXN1; (-) strand; PAM type: YTN; PAM sequence: TTG
actatatatgacttttgctt

SEQ ID NO: 222418 - DNA, 20 bp, Artificial Sequence
  Description of Artificial Sequence: Synthetic oligonucleotide
  Target: ATXN1; (-) strand; PAM type: YTN; PAM sequence: TTT
gactatatatgacttttgct

SEQ ID NO: 222419 - DNA, 20 bp, Artificial Sequence
  Description of Artificial Sequence: Synthetic oligonucleotide
  Target: ATXN1; (-) strand; PAM type: YTN; PAM sequence: TTT
tgactatatatgacttttgc

SEQ ID NO: 222420 - DNA, 20 bp, Artificial Sequence
  Description of Artificial Sequence: Synthetic oligonucleotide
  Target: ATXN1; (-) strand; PAM type: YTN; PAM sequence: TTA
attttgactatatatgactt

SEQ ID NO: 222421 - DNA, 20 bp, Artificial Sequence
  Description of Artificial Sequence: Synthetic oligonucleotide
  Target: ATXN1; (-) strand; PAM type: YTN; PAM sequence: TTC
aaagttaattttgactatat

SEQ ID NO: 222422 - DNA, 20 bp, Artificial Sequence
  Description of Artificial Sequence: Synthetic oligonucleotide
  Target: ATXN1; (-) strand; PAM type: YTN; PAM sequence: TTT
caaagttaattttgactata

SEQ ID NO: 222423 - DNA, 20 bp, Artificial Sequence
  Description of Artificial Sequence: Synthetic oligonucleotide
  Target: ATXN1; (-) strand; PAM type: YTN; PAM sequence: TTT
tcaaagttaattttgactat

SEQ ID NO: 222424 - DNA, 20 bp, Artificial Sequence
  Description of Artificial Sequence: Synthetic oligonucleotide
  Target: ATXN1; (-) strand; PAM type: YTN; PAM sequence: TTG
tgggaaagccaaaggatttt

SEQ ID NO: 222425 - DNA, 20 bp, Artificial Sequence
  Description of Artificial Sequence: Synthetic oligonucleotide
  Target: ATXN1; (-) strand; PAM type: YTN; PAM sequence: CTT
gtgggaaagccaaaggattt

SEQ ID NO: 222426 - DNA, 20 bp, Artificial Sequence
  Description of Artificial Sequence: Synthetic oligonucleotide
  Target: ATXN1; (-) strand; PAM type: YTN; PAM sequence: CTG
tgtggagtgtcttgtgggaa

SEQ ID NO: 222427 - DNA, 20 bp, Artificial Sequence
  Description of Artificial Sequence: Synthetic oligonucleotide
  Target: ATXN1; (-) strand; PAM type: YTN; PAM sequence: TTG
tgcagtatacataaaatcct

SEQ ID NO: 222428 - DNA, 20 bp, Artificial Sequence
  Description of Artificial Sequence: Synthetic oligonucleotide
  Target: ATXN1; (-) strand; PAM type: YTN; PAM sequence: TTC
agtgtacatgaaaagtgcag

SEQ ID NO: 222429 - DNA, 20 bp, Artificial Sequence
  Description of Artificial Sequence: Synthetic oligonucleotide
  Target: ATXN1; (-) strand; PAM type: YTN; PAM sequence: CTT
cagtgtacatgaaaagtgca

SEQ ID NO: 222430 - DNA, 20 bp, Artificial Sequence
  Description of Artificial Sequence: Synthetic oligonucleotide
  Target: ATXN1; (-) strand; PAM type: YTN; PAM sequence: TTA
tcacacttcagtgtacatga

SEQ ID NO: 222431 - DNA, 20 bp, Artificial Sequence
  Description of Artificial Sequence: Synthetic oligonucleotide
  Target: ATXN1; (-) strand; PAM type: YTN; PAM sequence: CTA
acccaatagttatcacactt

SEQ ID NO: 222432 - DNA, 20 bp, Artificial Sequence
  Description of Artificial Sequence: Synthetic oligonucleotide
  Target: ATXN1; (-) strand; PAM type: YTN; PAM sequence: TTG
tagtctaacccaatagttat

SEQ ID NO: 222433 - DNA, 20 bp, Artificial Sequence
  Description of Artificial Sequence: Synthetic oligonucleotide
  Target: ATXN1; (-) strand; PAM type: YTN; PAM sequence: CTT
gtagtctaacccaatagtta

SEQ ID NO: 222434 - DNA, 20 bp, Artificial Sequence
  Description of Artificial Sequence: Synthetic oligonucleotide
  Target: ATXN1; (-) strand; PAM type: YTN; PAM sequence: TTC
ttgtagtctaacccaatagt

SEQ ID NO: 222435 - DNA, 20 bp, Artificial Sequence
  Description of Artificial Sequence: Synthetic oligonucleotide
  Target: ATXN1; (-) strand; PAM type: YTN; PAM sequence: TTT
cttgtagtctaacccaatag

SEQ ID NO: 222436 - DNA, 20 bp, Artificial Sequence
  Description of Artificial Sequence: Synthetic oligonucleotide
  Target: ATXN1; (-) strand; PAM type: YTN; PAM sequence: CTT
tcttgtagtctaacccaata

SEQ ID NO: 222437 - DNA, 20 bp, Artificial Sequence
  Description of Artificial Sequence: Synthetic oligonucleotide
  Target: ATXN1; (-) strand; PAM type: YTN; PAM sequence: TTC
tttcttgtagtctaacccaa

SEQ ID NO: 222438 - DNA, 20 bp, Artificial Sequence
  Description of Artificial Sequence: Synthetic oligonucleotide
  Target: ATXN1; (-) strand; PAM type: YTN; PAM sequence: TTG
agttctttcttgtagtctaa

SEQ ID NO: 222439 - DNA, 20 bp, Artificial Sequence
  Description of Artificial Sequence: Synthetic oligonucleotide
  Target: ATXN1; (-) strand; PAM type: YTN; PAM sequence: TTC
cattgagttctttcttgtag

SEQ ID NO: 222440 - DNA, 20 bp, Artificial Sequence
  Description of Artificial Sequence: Synthetic oligonucleotide
  Target: ATXN1; (-) strand; PAM type: YTN; PAM sequence: CTT
ccattgagttctttcttgta

SEQ ID NO: 222441 - DNA, 20 bp, Artificial Sequence
  Description of Artificial Sequence: Synthetic oligonucleotide
  Target: ATXN1; (-) strand; PAM type: YTN; PAM sequence: TTC
ttccattgagttctttcttg

SEQ ID NO: 222442 - DNA, 20 bp, Artificial Sequence
  Description of Artificial Sequence: Synthetic oligonucleotide
  Target: ATXN1; (-) strand; PAM type: YTN; PAM sequence: TTA
catgtgttcttccattgagt

SEQ ID NO: 222443 - DNA, 20 bp, Artificial Sequence
  Description of Artificial Sequence: Synthetic oligonucleotide
  Target: ATXN1; (-) strand; PAM type: YTN; PAM sequence: TTT
acatgtgttcttccattgag

SEQ ID NO: 222444 - DNA, 20 bp, Artificial Sequence
  Description of Artificial Sequence: Synthetic oligonucleotide
  Target: ATXN1; (-) strand; PAM type: YTN; PAM sequence: TTT
tacatgtgttcttccattga

SEQ ID NO: 222445 - DNA, 20 bp, Artificial Sequence
  Description of Artificial Sequence: Synthetic oligonucleotide
  Target: ATXN1; (-) strand; PAM type: YTN; PAM sequence: CTT
ttacatgtgttcttccattg

SEQ ID NO: 222446 - DNA, 20 bp, Artificial Sequence
  Description of Artificial Sequence: Synthetic oligonucleotide
  Target: ATXN1; (-) strand; PAM type: YTN; PAM sequence: TTG
aatgtacagacttttacatg

SEQ ID NO: 222447 - DNA, 20 bp, Artificial Sequence
  Description of Artificial Sequence: Synthetic oligonucleotide
  Target: ATXN1; (-) strand; PAM type: YTN; PAM sequence: TTT
gaatgtacagacttttacat

SEQ ID NO: 222448 - DNA, 20 bp, Artificial Sequence
  Description of Artificial Sequence: Synthetic oligonucleotide
  Target: ATXN1; (-) strand; PAM type: YTN; PAM sequence: TTA
aaagaggaatggtttgaatg

SEQ ID NO: 222449 - DNA, 20 bp, Artificial Sequence
  Description of Artificial Sequence: Synthetic oligonucleotide
  Target: ATXN1; (-) strand; PAM type: YTN; PAM sequence: TTT
aaaagaggaatggtttgaat

SEQ ID NO: 222450 - DNA, 20 bp, Artificial Sequence
  Description of Artificial Sequence: Synthetic oligonucleotide
  Target: ATXN1; (-) strand; PAM type: YTN; PAM sequence: TTT
taaaagaggaatggtttgaa

SEQ ID NO: 222451 - DNA, 20 bp, Artificial Sequence
  Description of Artificial Sequence: Synthetic oligonucleotide
  Target: ATXN1; (-) strand; PAM type: YTN; PAM sequence: TTA
attttaaaagaggaatggtt

SEQ ID NO: 222452 - DNA, 20 bp, Artificial Sequence
  Description of Artificial Sequence: Synthetic oligonucleotide
  Target: ATXN1; (-) strand; PAM type: YTN; PAM sequence: CTT
aattttaaaagaggaatggt

SEQ ID NO: 222453 - DNA, 20 bp, Artificial Sequence
  Description of Artificial Sequence: Synthetic oligonucleotide
  Target: ATXN1; (-) strand; PAM type: YTN; PAM sequence: CTG
tagtgatacaatacttaatt

SEQ ID NO: 222454 - DNA, 20 bp, Artificial Sequence
  Description of Artificial Sequence: Synthetic oligonucleotide
  Target: ATXN1; (-) strand; PAM type: YTN; PAM sequence: TTA
actgtagtgatacaatactt

SEQ ID NO: 222455 - DNA, 20 bp, Artificial Sequence
  Description of Artificial Sequence: Synthetic oligonucleotide
  Target: ATXN1; (-) strand; PAM type: YTN; PAM sequence: TTT
aactgtagtgatacaatact

SEQ ID NO: 222456 - DNA, 20 bp, Artificial Sequence
  Description of Artificial Sequence: Synthetic oligonucleotide
  Target: ATXN1; (-) strand; PAM type: YTN; PAM sequence: CTA
atccccccgtttaactgtag

SEQ ID NO: 222457 - DNA, 20 bp, Artificial Sequence
  Description of Artificial Sequence: Synthetic oligonucleotide
  Target: ATXN1; (-) strand; PAM type: YTN; PAM sequence: TTA
tctaatccccccgtttaact

SEQ ID NO: 222458 - DNA, 20 bp, Artificial Sequence
  Description of Artificial Sequence: Synthetic oligonucleotide
  Target: ATXN1; (-) strand; PAM type: YTN; PAM sequence: TTT
atctaatccccccgtttaac

SEQ ID NO: 222459 - DNA, 20 bp, Artificial Sequence
  Description of Artificial Sequence: Synthetic oligonucleotide
  Target: ATXN1; (-) strand; PAM type: YTN; PAM sequence: CTT
tatctaatccccccgtttaa

SEQ ID NO: 222460 - DNA, 20 bp, Artificial Sequence
  Description of Artificial Sequence: Synthetic oligonucleotide
  Target: ATXN1; (-) strand; PAM type: YTN; PAM sequence: TTA
tctttatctaatccccccgt

SEQ ID NO: 222461 - DNA, 20 bp, Artificial Sequence
  Description of Artificial Sequence: Synthetic oligonucleotide
  Target: ATXN1; (-) strand; PAM type: YTN; PAM sequence: CTT
atctttatctaatccccccg

SEQ ID NO: 222462 - DNA, 20 bp, Artificial Sequence
  Description of Artificial Sequence: Synthetic oligonucleotide
  Target: ATXN1; (-) strand; PAM type: YTN; PAM sequence: TTA
cttatctttatctaatcccc

SEQ ID NO: 222463 - DNA, 20 bp, Artificial Sequence
  Description of Artificial Sequence: Synthetic oligonucleotide
  Target: ATXN1; (-) strand; PAM type: YTN; PAM sequence: TTT
acttatctttatctaatccc

SEQ ID NO: 222464 - DNA, 20 bp, Artificial Sequence
  Description of Artificial Sequence: Synthetic oligonucleotide
  Target: ATXN1; (-) strand; PAM type: YTN; PAM sequence: TTT
tacttatctttatctaatcc

SEQ ID NO: 222465 - DNA, 20 bp, Artificial Sequence
  Description of Artificial Sequence: Synthetic oligonucleotide
  Target: ATXN1; (-) strand; PAM type: YTN; PAM sequence: CTG
gaaaacaccaatattttact

SEQ ID NO: 222466 - DNA, 20 bp, Artificial Sequence
  Description of Artificial Sequence: Synthetic oligonucleotide
  Target: ATXN1; (-) strand; PAM type: YTN; PAM sequence: TTG
ctggaaaacaccaatatttt

SEQ ID NO: 222467 - DNA, 20 bp, Artificial Sequence
  Description of Artificial Sequence: Synthetic oligonucleotide
  Target: ATXN1; (-) strand; PAM type: YTN; PAM sequence: CTT
gctggaaaacaccaatattt

SEQ ID NO: 222468 - DNA, 20 bp, Artificial Sequence
  Description of Artificial Sequence: Synthetic oligonucleotide
  Target: ATXN1; (-) strand; PAM type: YTN; PAM sequence: TTA
caacagaatgaagtaatact

SEQ ID NO: 222469 - DNA, 20 bp, Artificial Sequence
  Description of Artificial Sequence: Synthetic oligonucleotide
  Target: ATXN1; (-) strand; PAM type: YTN; PAM sequence: CTA
ttacaacagaatgaagtaat

SEQ ID NO: 222470 - DNA, 20 bp, Artificial Sequence
  Description of Artificial Sequence: Synthetic oligonucleotide
  Target: ATXN1; (-) strand; PAM type: YTN; PAM sequence: TTA
ctattacaacagaatgaagt

SEQ ID NO: 222471 - DNA, 20 bp, Artificial Sequence
  Description of Artificial Sequence: Synthetic oligonucleotide
  Target: ATXN1; (-) strand; PAM type: YTN; PAM sequence: CTT
actattacaacagaatgaag

SEQ ID NO: 222472 - DNA, 20 bp, Artificial Sequence
  Description of Artificial Sequence: Synthetic oligonucleotide
  Target: ATXN1; (-) strand; PAM type: YTN; PAM sequence: TTA
aagaagcttactattacaac

SEQ ID NO: 222473 - DNA, 20 bp, Artificial Sequence
  Description of Artificial Sequence: Synthetic oligonucleotide
  Target: ATXN1; (-) strand; PAM type: YTN; PAM sequence: TTA
aagttaaagaagcttactat

SEQ ID NO: 222474 - DNA, 20 bp, Artificial Sequence
  Description of Artificial Sequence: Synthetic oligonucleotide
  Target: ATXN1; (-) strand; PAM type: YTN; PAM sequence: TTC
attaaagttaaagaagctta

SEQ ID NO: 222475 - DNA, 20 bp, Artificial Sequence
  Description of Artificial Sequence: Synthetic oligonucleotide
  Target: ATXN1; (-) strand; PAM type: YTN; PAM sequence: TTA
atattcattaaagttaaaga

SEQ ID NO: 222476 - DNA, 20 bp, Artificial Sequence
  Description of Artificial Sequence: Synthetic oligonucleotide
  Target: ATXN1; (-) strand; PAM type: YTN; PAM sequence: TTG
ttaatattcattaaagttaa

SEQ ID NO: 222477 - DNA, 20 bp, Artificial Sequence
  Description of Artificial Sequence: Synthetic oligonucleotide
  Target: ATXN1; (-) strand; PAM type: YTN; PAM sequence: TTT
gttaatattcattaaagtta

SEQ ID NO: 222478 - DNA, 20 bp, Artificial Sequence
  Description of Artificial Sequence: Synthetic oligonucleotide
  Target: ATXN1; (-) strand; PAM type: YTN; PAM sequence: TTA
acaacagtacatttgttaat

SEQ ID NO: 222479 - DNA, 20 bp, Artificial Sequence
  Description of Artificial Sequence: Synthetic oligonucleotide
  Target: ATXN1; (-) strand; PAM type: YTN; PAM sequence: TTT
aacaacagtacatttgttaa

SEQ ID NO: 222480 - DNA, 20 bp, Artificial Sequence
  Description of Artificial Sequence: Synthetic oligonucleotide
  Target: ATXN1; (-) strand; PAM type: YTN; PAM sequence: CTT
taacaacagtacatttgtta

SEQ ID NO: 222481 - DNA, 20 bp, Artificial Sequence
  Description of Artificial Sequence: Synthetic oligonucleotide
  Target: ATXN1; (-) strand; PAM type: YTN; PAM sequence: TTA
actttaacaacagtacattt

SEQ ID NO: 222482 - DNA, 20 bp, Artificial Sequence
  Description of Artificial Sequence: Synthetic oligonucleotide
  Target: ATXN1; (-) strand; PAM type: YTN; PAM sequence: TTT
aactttaacaacagtacatt

SEQ ID NO: 222483 - DNA, 20 bp, Artificial Sequence
  Description of Artificial Sequence: Synthetic oligonucleotide
  Target: ATXN1; (-) strand; PAM type: YTN; PAM sequence: CTT
taactttaacaacagtacat

SEQ ID NO: 222484 - DNA, 20 bp, Artificial Sequence
  Description of Artificial Sequence: Synthetic oligonucleotide
  Target: ATXN1; (-) strand; PAM type: YTN; PAM sequence: TTC
ctttaactttaacaacagta

SEQ ID NO: 222485 - DNA, 20 bp, Artificial Sequence
  Description of Artificial Sequence: Synthetic oligonucleotide
  Target: ATXN1; (-) strand; PAM type: YTN; PAM sequence: CTA
cagttcctttaactttaaca

SEQ ID NO: 222486 - DNA, 20 bp, Artificial Sequence
  Description of Artificial Sequence: Synthetic oligonucleotide
  Target: ATXN1; (-) strand; PAM type: YTN; PAM sequence: CTC
aataggagatcctacagttc

SEQ ID NO: 222487 - DNA, 20 bp, Artificial Sequence
  Description of Artificial Sequence: Synthetic oligonucleotide
  Target: ATXN1; (-) strand; PAM type: YTN; PAM sequence: TTA
tgaactcaataggagatcct

SEQ ID NO: 222488 - DNA, 20 bp, Artificial Sequence
  Description of Artificial Sequence: Synthetic oligonucleotide
  Target: ATXN1; (-) strand; PAM type: YTN; PAM sequence: TTA
ccacattatgaactcaatag

SEQ ID NO: 222489 - DNA, 20 bp, Artificial Sequence
  Description of Artificial Sequence: Synthetic oligonucleotide
  Target: ATXN1; (-) strand; PAM type: YTN; PAM sequence: TTA
atattaccacattatgaact

SEQ ID NO: 222490 - DNA, 20 bp, Artificial Sequence
  Description of Artificial Sequence: Synthetic oligonucleotide
  Target: ATXN1; (-) strand; PAM type: YTN; PAM sequence: CTT
aatattaccacattatgaac

SEQ ID NO: 222491 - DNA, 20 bp, Artificial Sequence
  Description of Artificial Sequence: Synthetic oligonucleotide
  Target: ATXN1; (-) strand; PAM type: YTN; PAM sequence: CTC
ttaatattaccacattatga

SEQ ID NO: 222492 - DNA, 20 bp, Artificial Sequence
  Description of Artificial Sequence: Synthetic oligonucleotide
  Target: ATXN1; (-) strand; PAM type: YTN; PAM sequence: TTA
ctcttaatattaccacatta

SEQ ID NO: 222493 - DNA, 20 bp, Artificial Sequence
  Description of Artificial Sequence: Synthetic oligonucleotide
  Target: ATXN1; (-) strand; PAM type: YTN; PAM sequence: TTA
aaaattactcttaatattac

SEQ ID NO: 222494 - DNA, 20 bp, Artificial Sequence
  Description of Artificial Sequence: Synthetic oligonucleotide
  Target: ATXN1; (-) strand; PAM type: YTN; PAM sequence: TTT
aaaaattactcttaatatta

SEQ ID NO: 222495 - DNA, 20 bp, Artificial Sequence
  Description of Artificial Sequence: Synthetic oligonucleotide
  Target: ATXN1; (-) strand; PAM type: YTN; PAM sequence: TTT
taaaaattactcttaatatt

SEQ ID NO: 222496 - DNA, 20 bp, Artificial Sequence
  Description of Artificial Sequence: Synthetic oligonucleotide
  Target: ATXN1; (-) strand; PAM type: YTN; PAM sequence: TTA
ttttaaaaattactcttaat

SEQ ID NO: 222497 - DNA, 20 bp, Artificial Sequence
  Description of Artificial Sequence: Synthetic oligonucleotide
  Target: ATXN1; (-) strand; PAM type: YTN; PAM sequence: TTA
aaagaaattattttaaaaat

SEQ ID NO: 222498 - DNA, 20 bp, Artificial Sequence
  Description of Artificial Sequence: Synthetic oligonucleotide
  Target: ATXN1; (-) strand; PAM type: YTN; PAM sequence: TTT
aaaagaaattattttaaaaa

SEQ ID NO: 222499 - DNA, 20 bp, Artificial Sequence
  Description of Artificial Sequence: Synthetic oligonucleotide
  Target: ATXN1; (-) strand; PAM type: YTN; PAM sequence: CTT
taaaagaaattattttaaaa

SEQ ID NO: 222500 - DNA, 20 bp, Artificial Sequence
  Description of Artificial Sequence: Synthetic oligonucleotide
  Target: ATXN1; (-) strand; PAM type: YTN; PAM sequence: TTA
tctttaaaagaaattatttt

SEQ ID NO: 222501 - DNA, 20 bp, Artificial Sequence
  Description of Artificial Sequence: Synthetic oligonucleotide
  Target: ATXN1; (-) strand; PAM type: YTN; PAM sequence: TTT
atctttaaaagaaattattt

SEQ ID NO: 222502 - DNA, 20 bp, Artificial Sequence
  Description of Artificial Sequence: Synthetic oligonucleotide
  Target: ATXN1; (-) strand; PAM type: YTN; PAM sequence: TTA
aatatttatctttaaaagaa

SEQ ID NO: 222503 - DNA, 20 bp, Artificial Sequence
  Description of Artificial Sequence: Synthetic oligonucleotide
  Target: ATXN1; (-) strand; PAM type: YTN; PAM sequence: TTG
aaaaggcagataatatagca

SEQ ID NO: 222504 - DNA, 20 bp, Artificial Sequence
  Description of Artificial Sequence: Synthetic oligonucleotide
  Target: ATXN1; (-) strand; PAM type: YTN; PAM sequence: TTT
gaaaaggcagataatatagc

SEQ ID NO: 222505 - DNA, 20 bp, Artificial Sequence
  Description of Artificial Sequence: Synthetic oligonucleotide
  Target: ATXN1; (-) strand; PAM type: YTN; PAM sequence: TTT
tgaaaaggcagataatatag

SEQ ID NO: 222506 - DNA, 20 bp, Artificial Sequence
  Description of Artificial Sequence: Synthetic oligonucleotide
  Target: ATXN1; (-) strand; PAM type: YTN; PAM sequence: TTT
ttgaaaaggcagataatata

SEQ ID NO: 222507 - DNA, 20 bp, Artificial Sequence
  Description of Artificial Sequence: Synthetic oligonucleotide
  Target: ATXN1; (-) strand; PAM type: YTN; PAM sequence: CTT
tttgaaaaggcagataatat

SEQ ID NO: 222508 - DNA, 20 bp, Artificial Sequence
  Description of Artificial Sequence: Synthetic oligonucleotide
  Target: ATXN1; (-) strand; PAM type: YTN; PAM sequence: TTA
actttttgaaaaggcagata

SEQ ID NO: 222509 - DNA, 20 bp, Artificial Sequence
  Description of Artificial Sequence: Synthetic oligonucleotide
  Target: ATXN1; (-) strand; PAM type: YTN; PAM sequence: TTT
aactttttgaaaaggcagat

SEQ ID NO: 222510 - DNA, 20 bp, Artificial Sequence
  Description of Artificial Sequence: Synthetic oligonucleotide
  Target: ATXN1; (-) strand; PAM type: YTN; PAM sequence: CTT
taactttttgaaaaggcaga

SEQ ID NO: 222511 - DNA, 20 bp, Artificial Sequence
  Description of Artificial Sequence: Synthetic oligonucleotide
  Target: ATXN1; (-) strand; PAM type: YTN; PAM sequence: CTA
tgtgctttaactttttgaaa

SEQ ID NO: 222512 - DNA, 20 bp, Artificial Sequence
  Description of Artificial Sequence: Synthetic oligonucleotide
  Target: ATXN1; (-) strand; PAM type: YTN; PAM sequence: TTG
actatgtgctttaacttttt

SEQ ID NO: 222513 - DNA, 20 bp, Artificial Sequence
  Description of Artificial Sequence: Synthetic oligonucleotide
  Target: ATXN1; (-) strand; PAM type: YTN; PAM sequence: CTT
gactatgtgctttaactttt

SEQ ID NO: 222514 - DNA, 20 bp, Artificial Sequence
  Description of Artificial Sequence: Synthetic oligonucleotide
  Target: ATXN1; (-) strand; PAM type: YTN; PAM sequence: TTA
cttgactatgtgctttaact

SEQ ID NO: 222515 - DNA, 20 bp, Artificial Sequence
  Description of Artificial Sequence: Synthetic oligonucleotide
  Target: ATXN1; (-) strand; PAM type: YTN; PAM sequence: CTT
acttgactatgtgctttaac

SEQ ID NO: 222516 - DNA, 20 bp, Artificial Sequence
  Description of Artificial Sequence: Synthetic oligonucleotide
  Target: ATXN1; (-) strand; PAM type: YTN; PAM sequence: TTG
acacttacttgactatgtgc

SEQ ID NO: 222517 - DNA, 20 bp, Artificial Sequence
  Description of Artificial Sequence: Synthetic oligonucleotide
  Target: ATXN1; (-) strand; PAM type: YTN; PAM sequence: TTT
gacacttacttgactatgtg

SEQ ID NO: 222518 - DNA, 20 bp, Artificial Sequence
  Description of Artificial Sequence: Synthetic oligonucleotide
  Target: ATXN1; (-) strand; PAM type: YTN; PAM sequence: TTT
tgacacttacttgactatgt

SEQ ID NO: 222519 - DNA, 20 bp, Artificial Sequence
  Description of Artificial Sequence: Synthetic oligonucleotide
  Target: ATXN1; (-) strand; PAM type: YTN; PAM sequence: TTT
ttgacacttacttgactatg

SEQ ID NO: 222520 - DNA, 20 bp, Artificial Sequence
  Description of Artificial Sequence: Synthetic oligonucleotide
  Target: ATXN1; (-) strand; PAM type: YTN; PAM sequence: TTG
gcaaatttttgacacttact

SEQ ID NO: 222521 - DNA, 20 bp, Artificial Sequence
  Description of Artificial Sequence: Synthetic oligonucleotide
  Target: ATXN1; (-) strand; PAM type: YTN; PAM sequence: CTT
ggcaaatttttgacacttac

SEQ ID NO: 222522 - DNA, 20 bp, Artificial Sequence
  Description of Artificial Sequence: Synthetic oligonucleotide
  Target: ATXN1; (-) strand; PAM type: YTN; PAM sequence: TTG
ggccttggcaaatttttgac

SEQ ID NO: 222523 - DNA, 20 bp, Artificial Sequence
  Description of Artificial Sequence: Synthetic oligonucleotide
  Target: ATXN1; (-) strand; PAM type: YTN; PAM sequence: CTA
ggaaagaaaaataaaggtgt

SEQ ID NO: 222524 - DNA, 20 bp, Artificial Sequence
  Description of Artificial Sequence: Synthetic oligonucleotide
  Target: ATXN1; (-) strand; PAM type: YTN; PAM sequence: TTC
aagacagtgaaaaactagga

SEQ ID NO: 222525 - DNA, 20 bp, Artificial Sequence
  Description of Artificial Sequence: Synthetic oligonucleotide
  Target: ATXN1; (-) strand; PAM type: YTN; PAM sequence: CTT
caagacagtgaaaaactagg

SEQ ID NO: 222526 - DNA, 20 bp, Artificial Sequence
  Description of Artificial Sequence: Synthetic oligonucleotide
  Target: ATXN1; (-) strand; PAM type: YTN; PAM sequence: CTG
tgggtaaaagacttcaagac

SEQ ID NO: 222527 - DNA, 20 bp, Artificial Sequence
  Description of Artificial Sequence: Synthetic oligonucleotide
  Target: ATXN1; (-) strand; PAM type: YTN; PAM sequence: TTG
aatatgggagactgtgggta

SEQ ID NO: 222528 - DNA, 20 bp, Artificial Sequence
  Description of Artificial Sequence: Synthetic oligonucleotide
  Target: ATXN1; (-) strand; PAM type: YTN; PAM sequence: CTG
tattgaatatgggagactgt

SEQ ID NO: 222529 - DNA, 20 bp, Artificial Sequence
  Description of Artificial Sequence: Synthetic oligonucleotide
  Target: ATXN1; (-) strand; PAM type: YTN; PAM sequence: TTA
tctgtattgaatatgggaga

SEQ ID NO: 222530 - DNA, 20 bp, Artificial Sequence
  Description of Artificial Sequence: Synthetic oligonucleotide
  Target: ATXN1; (-) strand; PAM type: YTN; PAM sequence: TTA
ttatctgtattgaatatggg

SEQ ID NO: 222531 - DNA, 20 bp, Artificial Sequence
  Description of Artificial Sequence: Synthetic oligonucleotide
  Target: ATXN1; (-) strand; PAM type: YTN; PAM sequence: TTT
attatctgtattgaatatgg

SEQ ID NO: 222532 - DNA, 20 bp, Artificial Sequence
  Description of Artificial Sequence: Synthetic oligonucleotide
  Target: ATXN1; (-) strand; PAM type: YTN; PAM sequence: CTG
atagaatttattatctgtat

SEQ ID NO: 222533 - DNA, 20 bp, Artificial Sequence
  Description of Artificial Sequence: Synthetic oligonucleotide
  Target: ATXN1; (-) strand; PAM type: YTN; PAM sequence: TTC
tgatagaatttattatctgt

SEQ ID NO: 222534 - DNA, 20 bp, Artificial Sequence
  Description of Artificial Sequence: Synthetic oligonucleotide
  Target: ATXN1; (-) strand; PAM type: YTN; PAM sequence: TTA
cacattctgatagaatttat

SEQ ID NO: 222535 - DNA, 20 bp, Artificial Sequence
  Description of Artificial Sequence: Synthetic oligonucleotide
  Target: ATXN1; (-) strand; PAM type: YTN; PAM sequence: TTT
acacattctgatagaattta

SEQ ID NO: 222536 - DNA, 20 bp, Artificial Sequence
  Description of Artificial Sequence: Synthetic oligonucleotide
  Target: ATXN1; (-) strand; PAM type: YTN; PAM sequence: CTT
tacacattctgatagaattt

SEQ ID NO: 222537 - DNA, 20 bp, Artificial Sequence
  Description of Artificial Sequence: Synthetic oligonucleotide
  Target: ATXN1; (-) strand; PAM type: YTN; PAM sequence: TTG
aactttacacattctgatag

SEQ ID NO: 222538 - DNA, 20 bp, Artificial Sequence
  Description of Artificial Sequence: Synthetic oligonucleotide
  Target: ATXN1; (-) strand; PAM type: YTN; PAM sequence: TTT
gaactttacacattctgata

SEQ ID NO: 222539 - DNA, 20 bp, Artificial Sequence
  Description of Artificial Sequence: Synthetic oligonucleotide
  Target: ATXN1; (-) strand; PAM type: YTN; PAM sequence: CTA
tttgaactttacacattctg

SEQ ID NO: 222540 - DNA, 20 bp, Artificial Sequence
  Description of Artificial Sequence: Synthetic oligonucleotide
  Target: ATXN1; (-) strand; PAM type: YTN; PAM sequence: CTG
atacctatttgaactttaca

SEQ ID NO: 222541 - DNA, 20 bp, Artificial Sequence
  Description of Artificial Sequence: Synthetic oligonucleotide
  Target: ATXN1; (-) strand; PAM type: YTN; PAM sequence: CTC
tgatacctatttgaacttta

SEQ ID NO: 222542 - DNA, 20 bp, Artificial Sequence
  Description of Artificial Sequence: Synthetic oligonucleotide
  Target: ATXN1; (-) strand; PAM type: YTN; PAM sequence: CTC
ccaccagaaaaaaacaagag

SEQ ID NO: 222543 - DNA, 20 bp, Artificial Sequence
  Description of Artificial Sequence: Synthetic oligonucleotide
  Target: ATXN1; (-) strand; PAM type: YTN; PAM sequence: CTG
ctcccaccagaaaaaaacaa

SEQ ID NO: 222544 - DNA, 20 bp, Artificial Sequence
  Description of Artificial Sequence: Synthetic oligonucleotide
  Target: ATXN1; (-) strand; PAM type: YTN; PAM sequence: TTC
tgctcccaccagaaaaaaac

SEQ ID NO: 222545 - DNA, 20 bp, Artificial Sequence
  Description of Artificial Sequence: Synthetic oligonucleotide
  Target: ATXN1; (-) strand; PAM type: YTN; PAM sequence: CTA
cacaggccaattctgctccc

SEQ ID NO: 222546 - DNA, 20 bp, Artificial Sequence
  Description of Artificial Sequence: Synthetic oligonucleotide
  Target: ATXN1; (-) strand; PAM type: YTN; PAM sequence: CTC
tacacaggccaattctgctc

SEQ ID NO: 222547 - DNA, 20 bp, Artificial Sequence
  Description of Artificial Sequence: Synthetic oligonucleotide
  Target: ATXN1; (-) strand; PAM type: YTN; PAM sequence: CTG
accctctacacaggccaatt

SEQ ID NO: 222548 - DNA, 20 bp, Artificial Sequence
  Description of Artificial Sequence: Synthetic oligonucleotide
  Target: ATXN1; (-) strand; PAM type: YTN; PAM sequence: CTA
cccctgaccctctacacagg

SEQ ID NO: 222549 - DNA, 20 bp, Artificial Sequence
  Description of Artificial Sequence: Synthetic oligonucleotide
  Target: ATXN1; (-) strand; PAM type: YTN; PAM sequence: CTG
ggtctacccctgaccctcta

SEQ ID NO: 222550 - DNA, 20 bp, Artificial Sequence
  Description of Artificial Sequence: Synthetic oligonucleotide
  Target: ATXN1; (-) strand; PAM type: YTN; PAM sequence: TTA
cagtgtcccaaagatgcctg

SEQ ID NO: 222551 - DNA, 20 bp, Artificial Sequence
  Description of Artificial Sequence: Synthetic oligonucleotide
  Target: ATXN1; (-) strand; PAM type: YTN; PAM sequence: TTA
gttacagtgtcccaaagatg

SEQ ID NO: 222552 - DNA, 20 bp, Artificial Sequence
  Description of Artificial Sequence: Synthetic oligonucleotide
  Target: ATXN1; (-) strand; PAM type: YTN; PAM sequence: TTG
tgataattagttacagtgtc

SEQ ID NO: 222553 - DNA, 20 bp, Artificial Sequence
  Description of Artificial Sequence: Synthetic oligonucleotide
  Target: ATXN1; (-) strand; PAM type: YTN; PAM sequence: CTG
aaagcaaatgttgtgataat

SEQ ID NO: 222554 - DNA, 20 bp, Artificial Sequence
  Description of Artificial Sequence: Synthetic oligonucleotide
  Target: ATXN1; (-) strand; PAM type: YTN; PAM sequence: TTC
tgaaagcaaatgttgtgata

SEQ ID NO: 222555 - DNA, 20 bp, Artificial Sequence
  Description of Artificial Sequence: Synthetic oligonucleotide
  Target: ATXN1; (-) strand; PAM type: YTN; PAM sequence: CTT
ctgaaagcaaatgttgtgat

SEQ ID NO: 222556 - DNA, 20 bp, Artificial Sequence
  Description of Artificial Sequence: Synthetic oligonucleotide
  Target: ATXN1; (-) strand; PAM type: YTN; PAM sequence: CTG
gggcttctgaaagcaaatgt

SEQ ID NO: 222557 - DNA, 20 bp, Artificial Sequence
  Description of Artificial Sequence: Synthetic oligonucleotide
  Target: ATXN1; (-) strand; PAM type: YTN; PAM sequence: TTC
tggggcttctgaaagcaaat

SEQ ID NO: 222558 - DNA, 20 bp, Artificial Sequence
  Description of Artificial Sequence: Synthetic oligonucleotide
  Target: ATXN1; (-) strand; PAM type: YTN; PAM sequence: TTT
ctggggcttctgaaagcaaa

SEQ ID NO: 222559 - DNA, 20 bp, Artificial Sequence
  Description of Artificial Sequence: Synthetic oligonucleotide
  Target: ATXN1; (-) strand; PAM type: YTN; PAM sequence: CTT
tctggggcttctgaaagcaa

SEQ ID NO: 222560 - DNA, 20 bp, Artificial Sequence
  Description of Artificial Sequence: Synthetic oligonucleotide
  Target: ATXN1; (-) strand; PAM type: YTN; PAM sequence: TTG
gggggtagggggcctttctg

SEQ ID NO: 222561 - DNA, 20 bp, Artificial Sequence
  Description of Artificial Sequence: Synthetic oligonucleotide
  Target: ATXN1; (-) strand; PAM type: YTN; PAM sequence: TTT
ggggggtagggggcctttct

SEQ ID NO: 222562 - DNA, 20 bp, Artificial Sequence
  Description of Artificial Sequence: Synthetic oligonucleotide
  Target: ATXN1; (-) strand; PAM type: YTN; PAM sequence: TTA
gagaaggaaaagaaagaaaa

SEQ ID NO: 222563 - DNA, 20 bp, Artificial Sequence
  Description of Artificial Sequence: Synthetic oligonucleotide
  Target: ATXN1; (-) strand; PAM type: YTN; PAM sequence: CTG
tagattagagaaggaaaaga

SEQ ID NO: 222564 - DNA, 20 bp, Artificial Sequence
  Description of Artificial Sequence: Synthetic oligonucleotide
  Target: ATXN1; (-) strand; PAM type: YTN; PAM sequence: CTC
agcacactgtagattagaga

SEQ ID NO: 222565 - DNA, 20 bp, Artificial Sequence
  Description of Artificial Sequence: Synthetic oligonucleotide
  Target: ATXN1; (-) strand; PAM type: YTN; PAM sequence: TTG
gaactcagcacactgtagat

SEQ ID NO: 222566 - DNA, 20 bp, Artificial Sequence
  Description of Artificial Sequence: Synthetic oligonucleotide
  Target: ATXN1; (-) strand; PAM type: YTN; PAM sequence: TTT
ggaactcagcacactgtaga

SEQ ID NO: 222567 - DNA, 20 bp, Artificial Sequence
  Description of Artificial Sequence: Synthetic oligonucleotide
  Target: ATXN1; (-) strand; PAM type: YTN; PAM sequence: CTT
tggaactcagcacactgtag

SEQ ID NO: 222568 - DNA, 20 bp, Artificial Sequence
  Description of Artificial Sequence: Synthetic oligonucleotide
  Target: ATXN1; (-) strand; PAM type: YTN; PAM sequence: TTG
ctttggaactcagcacactg

SEQ ID NO: 222569 - DNA, 20 bp, Artificial Sequence
  Description of Artificial Sequence: Synthetic oligonucleotide
  Target: ATXN1; (-) strand; PAM type: YTN; PAM sequence: TTT
gctttggaactcagcacact

SEQ ID NO: 222570 - DNA, 20 bp, Artificial Sequence
  Description of Artificial Sequence: Synthetic oligonucleotide
  Target: ATXN1; (-) strand; PAM type: YTN; PAM sequence: CTG
aaaagtataatggatgagaa

SEQ ID NO: 222571 - DNA, 20 bp, Artificial Sequence
  Description of Artificial Sequence: Synthetic oligonucleotide
  Target: ATXN1; (-) strand; PAM type: YTN; PAM sequence: TTC
aaaaaagaagctgaaaagta

SEQ ID NO: 222572 - DNA, 20 bp, Artificial Sequence
  Description of Artificial Sequence: Synthetic oligonucleotide
  Target: ATXN1; (-) strand; PAM type: YTN; PAM sequence: TTT
caaaaaagaagctgaaaagt

SEQ ID NO: 222573 - DNA, 20 bp, Artificial Sequence
  Description of Artificial Sequence: Synthetic oligonucleotide
  Target: ATXN1; (-) strand; PAM type: YTN; PAM sequence: CTC
ccggaggaatgtatgtttca

SEQ ID NO: 222574 - DNA, 20 bp, Artificial Sequence
  Description of Artificial Sequence: Synthetic oligonucleotide
  Target: ATXN1; (-) strand; PAM type: YTN; PAM sequence: TTA
atcctcccggaggaatgtat

SEQ ID NO: 222575 - DNA, 20 bp, Artificial Sequence
  Description of Artificial Sequence: Synthetic oligonucleotide
  Target: ATXN1; (-) strand; PAM type: YTN; PAM sequence: TTG
ttaatcctcccggaggaatg

SEQ ID NO: 222576 - DNA, 20 bp, Artificial Sequence
  Description of Artificial Sequence: Synthetic oligonucleotide
  Target: ATXN1; (-) strand; PAM type: YTN; PAM sequence: TTT
gttaatcctcccggaggaat

SEQ ID NO: 222577 - DNA, 20 bp, Artificial Sequence
  Description of Artificial Sequence: Synthetic oligonucleotide
  Target: ATXN1; (-) strand; PAM type: YTN; PAM sequence: CTC
agtttgttaatcctcccgga

SEQ ID NO: 222578 - DNA, 20 bp, Artificial Sequence
  Description of Artificial Sequence: Synthetic oligonucleotide
  Target: ATXN1; (-) strand; PAM type: YTN; PAM sequence: TTA
gtatctcagtttgttaatcc

SEQ ID NO: 222579 - DNA, 20 bp, Artificial Sequence
  Description of Artificial Sequence: Synthetic oligonucleotide
  Target: ATXN1; (-) strand; PAM type: YTN; PAM sequence: TTG
ttagtatctcagtttgttaa

SEQ ID NO: 222580 - DNA, 20 bp, Artificial Sequence
  Description of Artificial Sequence: Synthetic oligonucleotide
  Target: ATXN1; (-) strand; PAM type: YTN; PAM sequence: CTT
gttagtatctcagtttgtta

SEQ ID NO: 222581 - DNA, 20 bp, Artificial Sequence
  Description of Artificial Sequence: Synthetic oligonucleotide
  Target: ATXN1; (-) strand; PAM type: YTN; PAM sequence: CTG
atgaatgaaccacacagctt

SEQ ID NO: 222582 - DNA, 20 bp, Artificial Sequence
  Description of Artificial Sequence: Synthetic oligonucleotide
  Target: ATXN1; (-) strand; PAM type: YTN; PAM sequence: TTG
aagggtctgatgaatgaacc

SEQ ID NO: 222583 - DNA, 20 bp, Artificial Sequence
  Description of Artificial Sequence: Synthetic oligonucleotide
  Target: ATXN1; (-) strand; PAM type: YTN; PAM sequence: CTT
gaagggtctgatgaatgaac

SEQ ID NO: 222584 - DNA, 20 bp, Artificial Sequence
  Description of Artificial Sequence: Synthetic oligonucleotide
  Target: ATXN1; (-) strand; PAM type: YTN; PAM sequence: TTC
ccttgaagggtctgatgaat

SEQ ID NO: 222585 - DNA, 20 bp, Artificial Sequence
  Description of Artificial Sequence: Synthetic oligonucleotide
  Target: ATXN1; (-) strand; PAM type: YTN; PAM sequence: CTT
cccttgaagggtctgatgaa

SEQ ID NO: 222586 - DNA, 20 bp, Artificial Sequence
  Description of Artificial Sequence: Synthetic oligonucleotide
  Target: ATXN1; (-) strand; PAM type: YTN; PAM sequence: TTC
ttcccttgaagggtctgatg

SEQ ID NO: 222587 - DNA, 20 bp, Artificial Sequence
  Description of Artificial Sequence: Synthetic oligonucleotide
  Target: ATXN1; (-) strand; PAM type: YTN; PAM sequence: CTT
cttcccttgaagggtctgat

SEQ ID NO: 222588 - DNA, 20 bp, Artificial Sequence
  Description of Artificial Sequence: Synthetic oligonucleotide
  Target: ATXN1; (-) strand; PAM type: YTN; PAM sequence: CTG
ggtccttcttcccttgaagg

SEQ ID NO: 222589 - DNA, 20 bp, Artificial Sequence
  Description of Artificial Sequence: Synthetic oligonucleotide
  Target: ATXN1; (-) strand; PAM type: YTN; PAM sequence: CTG
ccctgggtccttcttccctt

SEQ ID NO: 222590 - DNA, 20 bp, Artificial Sequence
  Description of Artificial Sequence: Synthetic oligonucleotide
  Target: ATXN1; (-) strand; PAM type: YTN; PAM sequence: CTG
ccccagtgtcagagctgccc

SEQ ID NO: 222591 - DNA, 20 bp, Artificial Sequence
  Description of Artificial Sequence: Synthetic oligonucleotide
  Target: ATXN1; (-) strand; PAM type: YTN; PAM sequence: CTC
acccctgccccagtgtcaga

SEQ ID NO: 222592 - DNA, 20 bp, Artificial Sequence
  Description of Artificial Sequence: Synthetic oligonucleotide
  Target: ATXN1; (-) strand; PAM type: YTN; PAM sequence: TTG
ggtgatgcctcacccctgcc

SEQ ID NO: 222593 - DNA, 20 bp, Artificial Sequence
  Description of Artificial Sequence: Synthetic oligonucleotide
  Target: ATXN1; (-) strand; PAM type: YTN; PAM sequence: CTT
gggtgatgcctcacccctgc

SEQ ID NO: 222594 - DNA, 20 bp, Artificial Sequence
  Description of Artificial Sequence: Synthetic oligonucleotide
  Target: ATXN1; (-) strand; PAM type: YTN; PAM sequence: CTC
ttgggtgatgcctcacccct

SEQ ID NO: 222595 - DNA, 20 bp, Artificial Sequence
  Description of Artificial Sequence: Synthetic oligonucleotide
  Target: ATXN1; (-) strand; PAM type: YTN; PAM sequence: CTC
tcttgggtgatgcctcaccc

SEQ ID NO: 222596 - DNA, 20 bp, Artificial Sequence
  Description of Artificial Sequence: Synthetic oligonucleotide
  Target: ATXN1; (-) strand; PAM type: YTN; PAM sequence: CTC
tctcttgggtgatgcctcac

SEQ ID NO: 222597 - DNA, 20 bp, Artificial Sequence
  Description of Artificial Sequence: Synthetic oligonucleotide
  Target: ATXN1; (-) strand; PAM type: YTN; PAM sequence: TTG
ctctctcttgggtgatgcct

SEQ ID NO: 222598 - DNA, 20 bp, Artificial Sequence
  Description of Artificial Sequence: Synthetic oligonucleotide
  Target: ATXN1; (-) strand; PAM type: YTN; PAM sequence: CTT
gctctctcttgggtgatgcc

SEQ ID NO: 222599 - DNA, 20 bp, Artificial Sequence
  Description of Artificial Sequence: Synthetic oligonucleotide
  Target: ATXN1; (-) strand; PAM type: YTN; PAM sequence: CTG
ccccttgctctctcttgggt

SEQ ID NO: 222600 - DNA, 20 bp, Artificial Sequence
  Description of Artificial Sequence: Synthetic oligonucleotide
  Target: ATXN1; (-) strand; PAM type: YTN; PAM sequence: CTG
gaacctgccccttgctctct

SEQ ID NO: 222601 - DNA, 20 bp, Artificial Sequence
  Description of Artificial Sequence: Synthetic oligonucleotide
  Target: ATXN1; (-) strand; PAM type: YTN; PAM sequence: TTC
tggaacctgccccttgctct

SEQ ID NO: 222602 - DNA, 20 bp, Artificial Sequence
  Description of Artificial Sequence: Synthetic oligonucleotide
  Target: ATXN1; (-) strand; PAM type: YTN; PAM sequence: TTT
ctggaacctgccccttgctc

SEQ ID NO: 222603 - DNA, 20 bp, Artificial Sequence
  Description of Artificial Sequence: Synthetic oligonucleotide
  Target: ATXN1; (-) strand; PAM type: YTN; PAM sequence: TTT
tctggaacctgccccttgct

SEQ ID NO: 222604 - DNA, 20 bp, Artificial Sequence
  Description of Artificial Sequence: Synthetic oligonucleotide
  Target: ATXN1; (-) strand; PAM type: YTN; PAM sequence: TTG
ttttctggaacctgcccctt

SEQ ID NO: 222605 - DNA, 20 bp, Artificial Sequence
  Description of Artificial Sequence: Synthetic oligonucleotide
  Target: ATXN1; (-) strand; PAM type: YTN; PAM sequence: CTT
gttttctggaacctgcccct

SEQ ID NO: 222606 - DNA, 20 bp, Artificial Sequence
  Description of Artificial Sequence: Synthetic oligonucleotide
  Target: ATXN1; (-) strand; PAM type: YTN; PAM sequence: TTC
ccttgttttctggaacctgc

SEQ ID NO: 222607 - DNA, 20 bp, Artificial Sequence
  Description of Artificial Sequence: Synthetic oligonucleotide
  Target: ATXN1; (-) strand; PAM type: YTN; PAM sequence: TTT
cccttgttttctggaacctg

SEQ ID NO: 222608 - DNA, 20 bp, Artificial Sequence
  Description of Artificial Sequence: Synthetic oligonucleotide
  Target: ATXN1; (-) strand; PAM type: YTN; PAM sequence: CTG
gtttcccttgttttctggaa

SEQ ID NO: 222609 - DNA, 20 bp, Artificial Sequence
  Description of Artificial Sequence: Synthetic oligonucleotide
  Target: ATXN1; (-) strand; PAM type: YTN; PAM sequence: TTG
gagcataggacagtaactgg

SEQ ID NO: 222610 - DNA, 20 bp, Artificial Sequence
  Description of Artificial Sequence: Synthetic oligonucleotide
  Target: ATXN1; (-) strand; PAM type: YTN; PAM sequence: TTA
ggcagttggagcataggaca

SEQ ID NO: 222611 - DNA, 20 bp, Artificial Sequence
  Description of Artificial Sequence: Synthetic oligonucleotide
  Target: ATXN1; (-) strand; PAM type: YTN; PAM sequence: TTT
aggcagttggagcataggac

SEQ ID NO: 222612 - DNA, 20 bp, Artificial Sequence
  Description of Artificial Sequence: Synthetic oligonucleotide
  Target: ATXN1; (-) strand; PAM type: YTN; PAM sequence: TTA
aggtttaggcagttggagca

SEQ ID NO: 222613 - DNA, 20 bp, Artificial Sequence
  Description of Artificial Sequence: Synthetic oligonucleotide
  Target: ATXN1; (-) strand; PAM type: YTN; PAM sequence: TTT
aaggtttaggcagttggagc

SEQ ID NO: 222614 - DNA, 20 bp, Artificial Sequence
  Description of Artificial Sequence: Synthetic oligonucleotide
  Target: ATXN1; (-) strand; PAM type: YTN; PAM sequence: TTT
taaggtttaggcagttggag

SEQ ID NO: 222615 - DNA, 20 bp, Artificial Sequence
  Description of Artificial Sequence: Synthetic oligonucleotide
  Target: ATXN1; (-) strand; PAM type: YTN; PAM sequence: TTC
attttaaggtttaggcagtt

SEQ ID NO: 222616 - DNA, 20 bp, Artificial Sequence
  Description of Artificial Sequence: Synthetic oligonucleotide
  Target: ATXN1; (-) strand; PAM type: YTN; PAM sequence: TTT
cattttaaggtttaggcagt

SEQ ID NO: 222617 - DNA, 20 bp, Artificial Sequence
  Description of Artificial Sequence: Synthetic oligonucleotide
  Target: ATXN1; (-) strand; PAM type: YTN; PAM sequence: TTG
tttcattttaaggtttaggc

SEQ ID NO: 222618 - DNA, 20 bp, Artificial Sequence
  Description of Artificial Sequence: Synthetic oligonucleotide
  Target: ATXN1; (-) strand; PAM type: YTN; PAM sequence: TTT
gtttcattttaaggtttagg

SEQ ID NO: 222619 - DNA, 20 bp, Artificial Sequence
  Description of Artificial Sequence: Synthetic oligonucleotide
  Target: ATXN1; (-) strand; PAM type: YTN; PAM sequence: TTG
tatttgtttcattttaaggt

SEQ ID NO: 222620 - DNA, 20 bp, Artificial Sequence
  Description of Artificial Sequence: Synthetic oligonucleotide
  Target: ATXN1; (-) strand; PAM type: YTN; PAM sequence: CTT
gtatttgtttcattttaagg

SEQ ID NO: 222621 - DNA, 20 bp, Artificial Sequence
  Description of Artificial Sequence: Synthetic oligonucleotide
  Target: ATXN1; (-) strand; PAM type: YTN; PAM sequence: TTA
cttgtatttgtttcatttta

SEQ ID NO: 222622 - DNA, 20 bp, Artificial Sequence
  Description of Artificial Sequence: Synthetic oligonucleotide
  Target: ATXN1; (-) strand; PAM type: YTN; PAM sequence: TTG
tatataacagtgaaaaacac

SEQ ID NO: 222623 - DNA, 20 bp, Artificial Sequence
  Description of Artificial Sequence: Synthetic oligonucleotide
  Target: ATXN1; (-) strand; PAM type: YTN; PAM sequence: CTT
gtatataacagtgaaaaaca

SEQ ID NO: 222624 - DNA, 20 bp, Artificial Sequence
  Description of Artificial Sequence: Synthetic oligonucleotide
  Target: ATXN1; (-) strand; PAM type: YTN; PAM sequence: CTG
ccttgtatataacagtgaaa

SEQ ID NO: 222625 - DNA, 20 bp, Artificial Sequence
  Description of Artificial Sequence: Synthetic oligonucleotide
  Target: ATXN1; (-) strand; PAM type: YTN; PAM sequence: TTA
tgtggccaataggctgcctt

SEQ ID NO: 222626 - DNA, 20 bp, Artificial Sequence
  Description of Artificial Sequence: Synthetic oligonucleotide
  Target: ATXN1; (-) strand; PAM type: YTN; PAM sequence: TTA
agaattatgtggccaatagg

SEQ ID NO: 222627 - DNA, 20 bp, Artificial Sequence
  Description of Artificial Sequence: Synthetic oligonucleotide
  Target: ATXN1; (-) strand; PAM type: YTN; PAM sequence: TTT
aagaattatgtggccaatag

SEQ ID NO: 222628 - DNA, 20 bp, Artificial Sequence
  Description of Artificial Sequence: Synthetic oligonucleotide
  Target: ATXN1; (-) strand; PAM type: YTN; PAM sequence: TTG
tttaagaattatgtggccaa

SEQ ID NO: 222629 - DNA, 20 bp, Artificial Sequence
  Description of Artificial Sequence: Synthetic oligonucleotide
  Target: ATXN1; (-) strand; PAM type: YTN; PAM sequence: CTG
gttgtttaagaattatgtgg

SEQ ID NO: 222630 - DNA, 20 bp, Artificial Sequence
  Description of Artificial Sequence: Synthetic oligonucleotide
  Target: ATXN1; (-) strand; PAM type: YTN; PAM sequence: TTC
tggttgtttaagaattatgt

SEQ ID NO: 222631 - DNA, 20 bp, Artificial Sequence
  Description of Artificial Sequence: Synthetic oligonucleotide
  Target: ATXN1; (-) strand; PAM type: YTN; PAM sequence: TTT
ctggttgtttaagaattatg

SEQ ID NO: 222632 - DNA, 20 bp, Artificial Sequence
  Description of Artificial Sequence: Synthetic oligonucleotide
  Target: ATXN1; (-) strand; PAM type: YTN; PAM sequence: TTT
tctggttgtttaagaattat

SEQ ID NO: 222633 - DNA, 20 bp, Artificial Sequence
  Description of Artificial Sequence: Synthetic oligonucleotide
  Target: ATXN1; (-) strand; PAM type: YTN; PAM sequence: TTT
ttctggttgtttaagaatta

SEQ ID NO: 222634 - DNA, 20 bp, Artificial Sequence
  Description of Artificial Sequence: Synthetic oligonucleotide
  Target: ATXN1; (-) strand; PAM type: YTN; PAM sequence: TTT
tttctggttgtttaagaatt

SEQ ID NO: 222635 - DNA, 20 bp, Artificial Sequence
  Description of Artificial Sequence: Synthetic oligonucleotide
  Target: ATXN1; (-) strand; PAM type: YTN; PAM sequence: CTT
ttttctggttgtttaagaat

SEQ ID NO: 222636 - DNA, 20 bp, Artificial Sequence
  Description of Artificial Sequence: Synthetic oligonucleotide
  Target: ATXN1; (-) strand; PAM type: YTN; PAM sequence: TTC
agcttttttctggttgttta

SEQ ID NO: 222637 - DNA, 20 bp, Artificial Sequence
  Description of Artificial Sequence: Synthetic oligonucleotide
  Target: ATXN1; (-) strand; PAM type: YTN; PAM sequence: CTT
cagcttttttctggttgttt

SEQ ID NO: 222638 - DNA, 20 bp, Artificial Sequence
  Description of Artificial Sequence: Synthetic oligonucleotide
  Target: ATXN1; (-) strand; PAM type: YTN; PAM sequence: TTG
atggtcatacttcagctttt

SEQ ID NO: 222639 - DNA, 20 bp, Artificial Sequence
  Description of Artificial Sequence: Synthetic oligonucleotide
  Target: ATXN1; (-) strand; PAM type: YTN; PAM sequence: TTC
catgtcccgtattgatggtc

SEQ ID NO: 222640 - DNA, 20 bp, Artificial Sequence
  Description of Artificial Sequence: Synthetic oligonucleotide
  Target: ATXN1; (-) strand; PAM type: YTN; PAM sequence: TTG
gcatgttccatgtcccgtat

SEQ ID NO: 222641 - DNA, 20 bp, Artificial Sequence
  Description of Artificial Sequence: Synthetic oligonucleotide
  Target: ATXN1; (-) strand; PAM type: YTN; PAM sequence: TTT
ggcatgttccatgtcccgta

SEQ ID NO: 222642 - DNA, 20 bp, Artificial Sequence
  Description of Artificial Sequence: Synthetic oligonucleotide
  Target: ATXN1; (-) strand; PAM type: YTN; PAM sequence: TTT
tggcatgttccatgtcccgt

SEQ ID NO: 222643 - DNA, 20 bp, Artificial Sequence
  Description of Artificial Sequence: Synthetic oligonucleotide
  Target: ATXN1; (-) strand; PAM type: YTN; PAM sequence: CTT
ttggcatgttccatgtcccg

SEQ ID NO: 222644 - DNA, 20 bp, Artificial Sequence
  Description of Artificial Sequence: Synthetic oligonucleotide
  Target: ATXN1; (-) strand; PAM type: YTN; PAM sequence: TTC
gatcttttggcatgttccat

SEQ ID NO: 222645 - DNA, 20 bp, Artificial Sequence
  Description of Artificial Sequence: Synthetic oligonucleotide
  Target: ATXN1; (-) strand; PAM type: YTN; PAM sequence: TTT
cgatcttttggcatgttcca

SEQ ID NO: 222646 - DNA, 20 bp, Artificial Sequence
  Description of Artificial Sequence: Synthetic oligonucleotide
  Target: ATXN1; (-) strand; PAM type: YTN; PAM sequence: CTT
tcgatcttttggcatgttcc

SEQ ID NO: 222647 - DNA, 20 bp, Artificial Sequence
  Description of Artificial Sequence: Synthetic oligonucleotide
  Target: ATXN1; (-) strand; PAM type: YTN; PAM sequence: CTA
aagagggggaagaaagaatc

SEQ ID NO: 222648 - DNA, 20 bp, Artificial Sequence
  Description of Artificial Sequence: Synthetic oligonucleotide
  Target: ATXN1; (-) strand; PAM type: YTN; PAM sequence: TTA
gtcctaaagagggggaagaa

SEQ ID NO: 222649 - DNA, 20 bp, Artificial Sequence
  Description of Artificial Sequence: Synthetic oligonucleotide
  Target: ATXN1; (-) strand; PAM type: YTN; PAM sequence: TTT
agtcctaaagagggggaaga

SEQ ID NO: 222650 - DNA, 20 bp, Artificial Sequence
  Description of Artificial Sequence: Synthetic oligonucleotide
  Target: ATXN1; (-) strand; PAM type: YTN; PAM sequence: CTG
tttagtcctaaagaggggga

SEQ ID NO: 222651 - DNA, 20 bp, Artificial Sequence
  Description of Artificial Sequence: Synthetic oligonucleotide
  Target: ATXN1; (-) strand; PAM type: YTN; PAM sequence: TTA
tgcccacagctgtttagtcc

SEQ ID NO: 222652 - DNA, 20 bp, Artificial Sequence
  Description of Artificial Sequence: Synthetic oligonucleotide
  Target: ATXN1; (-) strand; PAM type: YTN; PAM sequence: TTT
atgcccacagctgtttagtc

SEQ ID NO: 222653 - DNA, 20 bp, Artificial Sequence
  Description of Artificial Sequence: Synthetic oligonucleotide
  Target: ATXN1; (-) strand; PAM type: YTN; PAM sequence: CTT
tatgcccacagctgtttagt

SEQ ID NO: 222654 - DNA, 20 bp, Artificial Sequence
  Description of Artificial Sequence: Synthetic oligonucleotide
  Target: ATXN1; (-) strand; PAM type: YTN; PAM sequence: TTC
tttatgcccacagctgttta

SEQ ID NO: 222655 - DNA, 20 bp, Artificial Sequence
  Description of Artificial Sequence: Synthetic oligonucleotide
  Target: ATXN1; (-) strand; PAM type: YTN; PAM sequence: TTT
ctttatgcccacagctgttt

SEQ ID NO: 222656 - DNA, 20 bp, Artificial Sequence
  Description of Artificial Sequence: Synthetic oligonucleotide
  Target: ATXN1; (-) strand; PAM type: YTN; PAM sequence: TTT
tctttatgcccacagctgtt

SEQ ID NO: 222657 - DNA, 20 bp, Artificial Sequence
  Description of Artificial Sequence: Synthetic oligonucleotide
  Target: ATXN1; (-) strand; PAM type: YTN; PAM sequence: TTT
ttctttatgcccacagctgt

SEQ ID NO: 222658 - DNA, 20 bp, Artificial Sequence
  Description of Artificial Sequence: Synthetic oligonucleotide
  Target: ATXN1; (-) strand; PAM type: YTN; PAM sequence: TTT
tttctttatgcccacagctg

SEQ ID NO: 222659 - DNA, 20 bp, Artificial Sequence
  Description of Artificial Sequence: Synthetic oligonucleotide
  Target: ATXN1; (-) strand; PAM type: YTN; PAM sequence: TTA
ttttttctttatgcccacag

SEQ ID NO: 222660 - DNA, 20 bp, Artificial Sequence
  Description of Artificial Sequence: Synthetic oligonucleotide
  Target: ATXN1; (-) strand; PAM type: YTN; PAM sequence: TTT
attttttctttatgcccaca

SEQ ID NO: 222661 - DNA, 20 bp, Artificial Sequence
  Description of Artificial Sequence: Synthetic oligonucleotide
  Target: ATXN1; (-) strand; PAM type: YTN; PAM sequence: CTA
aaataatggaatttattttt

SEQ ID NO: 222662 - DNA, 20 bp, Artificial Sequence
  Description of Artificial Sequence: Synthetic oligonucleotide
  Target: ATXN1; (-) strand; PAM type: YTN; PAM sequence: TTC
taaaataatggaatttattt

SEQ ID NO: 222663 - DNA, 20 bp, Artificial Sequence
  Description of Artificial Sequence: Synthetic oligonucleotide
  Target: ATXN1; (-) strand; PAM type: YTN; PAM sequence: TTT
ctaaaataatggaatttatt

SEQ ID NO: 222664 - DNA, 20 bp, Artificial Sequence
  Description of Artificial Sequence: Synthetic oligonucleotide
  Target: ATXN1; (-) strand; PAM type: YTN; PAM sequence: CTT
tctaaaataatggaatttat

SEQ ID NO: 222665 - DNA, 20 bp, Artificial Sequence
  Description of Artificial Sequence: Synthetic oligonucleotide
  Target: ATXN1; (-) strand; PAM type: YTN; PAM sequence: TTA
tgctttctaaaataatggaa

SEQ ID NO: 222666 - DNA, 20 bp, Artificial Sequence
  Description of Artificial Sequence: Synthetic oligonucleotide
  Target: ATXN1; (-) strand; PAM type: YTN; PAM sequence: CTC
aaagaaataatgaagggtgg

SEQ ID NO: 222667 - DNA, 20 bp, Artificial Sequence
  Description of Artificial Sequence: Synthetic oligonucleotide
  Target: ATXN1; (-) strand; PAM type: YTN; PAM sequence: TTC
tcaaagaaataatgaagggt

SEQ ID NO: 222668 - DNA, 20 bp, Artificial Sequence
  Description of Artificial Sequence: Synthetic oligonucleotide
  Target: ATXN1; (-) strand; PAM type: YTN; PAM sequence: TTC
caaccattctcaaagaaata

SEQ ID NO: 222669 - DNA, 20 bp, Artificial Sequence
  Description of Artificial Sequence: Synthetic oligonucleotide
  Target: ATXN1; (-) strand; PAM type: YTN; PAM sequence: CTC
gtagatgtaataattccaac

SEQ ID NO: 222670 - DNA, 20 bp, Artificial Sequence
  Description of Artificial Sequence: Synthetic oligonucleotide
  Target: ATXN1; (-) strand; PAM type: YTN; PAM sequence: CTC
tcgtagatgtaataattcca

SEQ ID NO: 222671 - DNA, 20 bp, Artificial Sequence
  Description of Artificial Sequence: Synthetic oligonucleotide
  Target: ATXN1; (-) strand; PAM type: YTN; PAM sequence: CTA
acctctcgtagatgtaataa

SEQ ID NO: 222672 - DNA, 20 bp, Artificial Sequence
  Description of Artificial Sequence: Synthetic oligonucleotide
  Target: ATXN1; (-) strand; PAM type: YTN; PAM sequence: CTC
aatcgatagaggctaacctc

SEQ ID NO: 222673 - DNA, 20 bp, Artificial Sequence
  Description of Artificial Sequence: Synthetic oligonucleotide
  Target: ATXN1; (-) strand; PAM type: YTN; PAM sequence: TTA
atgaaatcactcaatcgata

SEQ ID NO: 222674 - DNA, 20 bp, Artificial Sequence
  Description of Artificial Sequence: Synthetic oligonucleotide
  Target: ATXN1; (-) strand; PAM type: YTN; PAM sequence: TTT
aatgaaatcactcaatcgat

SEQ ID NO: 222675 - DNA, 20 bp, Artificial Sequence
  Description of Artificial Sequence: Synthetic oligonucleotide
  Target: ATXN1; (-) strand; PAM type: YTN; PAM sequence: TTT
taatgaaatcactcaatcga

SEQ ID NO: 222676 - DNA, 20 bp, Artificial Sequence
  Description of Artificial Sequence: Synthetic oligonucleotide
  Target: ATXN1; (-) strand; PAM type: YTN; PAM sequence: TTT
ttaatgaaatcactcaatcg

SEQ ID NO: 222677 - DNA, 20 bp, Artificial Sequence
  Description of Artificial Sequence: Synthetic oligonucleotide
  Target: ATXN1; (-) strand; PAM type: YTN; PAM sequence: TTT
tttaatgaaatcactcaatc

SEQ ID NO: 222678 - DNA, 20 bp, Artificial Sequence
  Description of Artificial Sequence: Synthetic oligonucleotide
  Target: ATXN1; (-) strand; PAM type: YTN; PAM sequence: TTT
ttttaatgaaatcactcaat

SEQ ID NO: 222679 - DNA, 20 bp, Artificial Sequence
  Description of Artificial Sequence: Synthetic oligonucleotide
  Target: ATXN1; (-) strand; PAM type: YTN; PAM sequence: TTA
atttttttaatgaaatcact

SEQ ID NO: 222680 - DNA, 20 bp, Artificial Sequence
  Description of Artificial Sequence: Synthetic oligonucleotide
  Target: ATXN1; (-) strand; PAM type: YTN; PAM sequence: TTT
aatttttttaatgaaatcac

SEQ ID NO: 222681 - DNA, 20 bp, Artificial Sequence
  Description of Artificial Sequence: Synthetic oligonucleotide
  Target: ATXN1; (-) strand; PAM type: YTN; PAM sequence: CTG
gtttaatttttttaatgaaa

SEQ ID NO: 222682 - DNA, 20 bp, Artificial Sequence
  Description of Artificial Sequence: Synthetic oligonucleotide
  Target: ATXN1; (-) strand; PAM type: YTN; PAM sequence: CTC
aatcactggtttaatttttt

SEQ ID NO: 222683 - DNA, 20 bp, Artificial Sequence
  Description of Artificial Sequence: Synthetic oligonucleotide
  Target: ATXN1; (-) strand; PAM type: YTN; PAM sequence: TTA
gctcaatcactggtttaatt

SEQ ID NO: 222684 - DNA, 20 bp, Artificial Sequence
  Description of Artificial Sequence: Synthetic oligonucleotide
  Target: ATXN1; (-) strand; PAM type: YTN; PAM sequence: TTT
agctcaatcactggtttaat

SEQ ID NO: 222685 - DNA, 20 bp, Artificial Sequence
  Description of Artificial Sequence: Synthetic oligonucleotide
  Target: ATXN1; (-) strand; PAM type: YTN; PAM sequence: TTT
tagctcaatcactggtttaa

SEQ ID NO: 222686 - DNA, 20 bp, Artificial Sequence
  Description of Artificial Sequence: Synthetic oligonucleotide
  Target: ATXN1; (-) strand; PAM type: YTN; PAM sequence: CTC
attttagctcaatcactggt

SEQ ID NO: 222687 - DNA, 20 bp, Artificial Sequence
  Description of Artificial Sequence: Synthetic oligonucleotide
  Target: ATXN1; (-) strand; PAM type: YTN; PAM sequence: TTG
gccactcattttagctcaat

SEQ ID NO: 222688 - DNA, 20 bp, Artificial Sequence
  Description of Artificial Sequence: Synthetic oligonucleotide
  Target: ATXN1; (-) strand; PAM type: YTN; PAM sequence: CTT
ggccactcattttagctcaa

SEQ ID NO: 222689 - DNA, 20 bp, Artificial Sequence
  Description of Artificial Sequence: Synthetic oligonucleotide
  Target: ATXN1; (-) strand; PAM type: YTN; PAM sequence: TTG
tagcttggccactcatttta

SEQ ID NO: 222690 - DNA, 20 bp, Artificial Sequence
  Description of Artificial Sequence: Synthetic oligonucleotide
  Target: ATXN1; (-) strand; PAM type: YTN; PAM sequence: CTT
gtagcttggccactcatttt

SEQ ID NO: 222691 - DNA, 20 bp, Artificial Sequence
  Description of Artificial Sequence: Synthetic oligonucleotide
  Target: ATXN1; (-) strand; PAM type: YTN; PAM sequence: TTG
gtcttgtagcttggccactc

SEQ ID NO: 222692 - DNA, 20 bp, Artificial Sequence
  Description of Artificial Sequence: Synthetic oligonucleotide
  Target: ATXN1; (-) strand; PAM type: YTN; PAM sequence: TTT
ggtcttgtagcttggccact

SEQ ID NO: 222693 - DNA, 20 bp, Artificial Sequence
  Description of Artificial Sequence: Synthetic oligonucleotide
  Target: ATXN1; (-) strand; PAM type: YTN; PAM sequence: TTT
tggtcttgtagcttggccac

SEQ ID NO: 222694 - DNA, 20 bp, Artificial Sequence
  Description of Artificial Sequence: Synthetic oligonucleotide
  Target: ATXN1; (-) strand; PAM type: YTN; PAM sequence: TTT
ttggtcttgtagcttggcca

SEQ ID NO: 222695 - DNA, 20 bp, Artificial Sequence
  Description of Artificial Sequence: Synthetic oligonucleotide
  Target: ATXN1; (-) strand; PAM type: YTN; PAM sequence: TTG
accacacacaatttttggtc

SEQ ID NO: 222696 - DNA, 20 bp, Artificial Sequence
  Description of Artificial Sequence: Synthetic oligonucleotide
  Target: ATXN1; (-) strand; PAM type: YTN; PAM sequence: CTG
ttgaccacacacaatttttg

SEQ ID NO: 222697 - DNA, 20 bp, Artificial Sequence
  Description of Artificial Sequence: Synthetic oligonucleotide
  Target: ATXN1; (-) strand; PAM type: YTN; PAM sequence: CTC
acctgttgaccacacacaat

SEQ ID NO: 222698 - DNA, 20 bp, Artificial Sequence
  Description of Artificial Sequence: Synthetic oligonucleotide
  Target: ATXN1; (-) strand; PAM type: YTN; PAM sequence: CTC
tcacctgttgaccacacaca

SEQ ID NO: 222699 - DNA, 20 bp, Artificial Sequence
  Description of Artificial Sequence: Synthetic oligonucleotide
  Target: ATXN1; (-) strand; PAM type: YTN; PAM sequence: TTC
ctctcacctgttgaccacac

SEQ ID NO: 222700 - DNA, 20 bp, Artificial Sequence
  Description of Artificial Sequence: Synthetic oligonucleotide
  Target: ATXN1; (-) strand; PAM type: YTN; PAM sequence: TTC
cacattcctctcacctgttg

SEQ ID NO: 222701 - DNA, 20 bp, Artificial Sequence
  Description of Artificial Sequence: Synthetic oligonucleotide
  Target: ATXN1; (-) strand; PAM type: YTN; PAM sequence: CTA
tattccacattcctctcacc

SEQ ID NO: 222702 - DNA, 20 bp, Artificial Sequence
  Description of Artificial Sequence: Synthetic oligonucleotide
  Target: ATXN1; (-) strand; PAM type: YTN; PAM sequence: CTC
ctatattccacattcctctc

SEQ ID NO: 222703 - DNA, 20 bp, Artificial Sequence
  Description of Artificial Sequence: Synthetic oligonucleotide
  Target: ATXN1; (-) strand; PAM type: YTN; PAM sequence: TTA
ggtagctcctatattccaca

SEQ ID NO: 222704 - DNA, 20 bp, Artificial Sequence
  Description of Artificial Sequence: Synthetic oligonucleotide
  Target: ATXN1; (-) strand; PAM type: YTN; PAM sequence: TTG
attaggtagctcctatattc

SEQ ID NO: 222705 - DNA, 20 bp, Artificial Sequence
  Description of Artificial Sequence: Synthetic oligonucleotide
  Target: ATXN1; (-) strand; PAM type: YTN; PAM sequence: TTG
gaattgattaggtagctcct

SEQ ID NO: 222706 - DNA, 20 bp, Artificial Sequence
  Description of Artificial Sequence: Synthetic oligonucleotide
  Target: ATXN1; (-) strand; PAM type: YTN; PAM sequence: TTT
ggaattgattaggtagctcc

SEQ ID NO: 222707 - DNA, 20 bp, Artificial Sequence
  Description of Artificial Sequence: Synthetic oligonucleotide
  Target: ATXN1; (-) strand; PAM type: YTN; PAM sequence: CTT
tggaattgattaggtagctc

SEQ ID NO: 222708 - DNA, 20 bp, Artificial Sequence
  Description of Artificial Sequence: Synthetic oligonucleotide
  Target: ATXN1; (-) strand; PAM type: YTN; PAM sequence: TTC
ctttggaattgattaggtag

SEQ ID NO: 222709 - DNA, 20 bp, Artificial Sequence
  Description of Artificial Sequence: Synthetic oligonucleotide
  Target: ATXN1; (-) strand; PAM type: YTN; PAM sequence: CTT
cctttggaattgattaggta

SEQ ID NO: 222710 - DNA, 20 bp, Artificial Sequence
  Description of Artificial Sequence: Synthetic oligonucleotide
  Target: ATXN1; (-) strand; PAM type: YTN; PAM sequence: CTC
ccttcctttggaattgatta

SEQ ID NO: 222711 - DNA, 20 bp, Artificial Sequence
  Description of Artificial Sequence: Synthetic oligonucleotide
  Target: ATXN1; (-) strand; PAM type: YTN; PAM sequence: TTG
gtggggagaaataacaatca

SEQ ID NO: 222712 - DNA, 20 bp, Artificial Sequence
  Description of Artificial Sequence: Synthetic oligonucleotide
  Target: ATXN1; (-) strand; PAM type: YTN; PAM sequence: CTG
tcccattggtggggagaaat

SEQ ID NO: 222713 - DNA, 20 bp, Artificial Sequence
  Description of Artificial Sequence: Synthetic oligonucleotide
  Target: ATXN1; (-) strand; PAM type: YTN; PAM sequence: CTG
gagcactgtcccattggtgg

SEQ ID NO: 222714 - DNA, 20 bp, Artificial Sequence
  Description of Artificial Sequence: Synthetic oligonucleotide
  Target: ATXN1; (-) strand; PAM type: YTN; PAM sequence: CTA
ctggagcactgtcccattgg

SEQ ID NO: 222715 - DNA, 20 bp, Artificial Sequence
  Description of Artificial Sequence: Synthetic oligonucleotide
  Target: ATXN1; (-) strand; PAM type: YTN; PAM sequence: CTG
gggtctactggagcactgtc

SEQ ID NO: 222716 - DNA, 20 bp, Artificial Sequence
  Description of Artificial Sequence: Synthetic oligonucleotide
  Target: ATXN1; (-) strand; PAM type: YTN; PAM sequence: TTA
aatagaagatcctggggtct

SEQ ID NO: 222717 - DNA, 20 bp, Artificial Sequence
  Description of Artificial Sequence: Synthetic oligonucleotide
  Target: ATXN1; (-) strand; PAM type: YTN; PAM sequence: TTA
caacagccattaaatagaag

SEQ ID NO: 222718 - DNA, 20 bp, Artificial Sequence
  Description of Artificial Sequence: Synthetic oligonucleotide
  Target: ATXN1; (-) strand; PAM type: YTN; PAM sequence: CTT
acaacagccattaaatagaa

SEQ ID NO: 222719 - DNA, 20 bp, Artificial Sequence
  Description of Artificial Sequence: Synthetic oligonucleotide
  Target: ATXN1; (-) strand; PAM type: YTN; PAM sequence: TTC
caagaggaacagagatagag

SEQ ID NO: 222720 - DNA, 20 bp, Artificial Sequence
  Description of Artificial Sequence: Synthetic oligonucleotide
  Target: ATXN1; (-) strand; PAM type: YTN; PAM sequence: CTT
ccaagaggaacagagataga

SEQ ID NO: 222721 - DNA, 20 bp, Artificial Sequence
  Description of Artificial Sequence: Synthetic oligonucleotide
  Target: ATXN1; (-) strand; PAM type: YTN; PAM sequence: TTC
ttccaagaggaacagagata

SEQ ID NO: 222722 - DNA, 20 bp, Artificial Sequence
  Description of Artificial Sequence: Synthetic oligonucleotide
  Target: ATXN1; (-) strand; PAM type: YTN; PAM sequence: TTT
cttccaagaggaacagagat

SEQ ID NO: 222723 - DNA, 20 bp, Artificial Sequence
  Description of Artificial Sequence: Synthetic oligonucleotide
  Target: ATXN1; (-) strand; PAM type: YTN; PAM sequence: TTT
tcttccaagaggaacagaga

SEQ ID NO: 222724 - DNA, 20 bp, Artificial Sequence
  Description of Artificial Sequence: Synthetic oligonucleotide
  Target: ATXN1; (-) strand; PAM type: YTN; PAM sequence: CTT
ttcttccaagaggaacagag

SEQ ID NO: 222725 - DNA, 20 bp, Artificial Sequence
  Description of Artificial Sequence: Synthetic oligonucleotide
  Target: ATXN1; (-) strand; PAM type: YTN; PAM sequence: CTC
agtggcaccttttcttccaa

SEQ ID NO: 222726 - DNA, 20 bp, Artificial Sequence
  Description of Artificial Sequence: Synthetic oligonucleotide
  Target: ATXN1; (-) strand; PAM type: YTN; PAM sequence: TTG
tcctcagtggcaccttttct

SEQ ID NO: 222727 - DNA, 20 bp, Artificial Sequence
  Description of Artificial Sequence: Synthetic oligonucleotide
  Target: ATXN1; (-) strand; PAM type: YTN; PAM sequence: CTT
gtcctcagtggcaccttttc

SEQ ID NO: 222728 - DNA, 20 bp, Artificial Sequence
  Description of Artificial Sequence: Synthetic oligonucleotide
  Target: ATXN1; (-) strand; PAM type: YTN; PAM sequence: TTC
ccttgtcctcagtggcacct

SEQ ID NO: 222729 - DNA, 20 bp, Artificial Sequence
  Description of Artificial Sequence: Synthetic oligonucleotide
  Target: ATXN1; (-) strand; PAM type: YTN; PAM sequence: TTG
ttcccttgtcctcagtggca

SEQ ID NO: 222730 - DNA, 20 bp, Artificial Sequence
  Description of Artificial Sequence: Synthetic oligonucleotide
  Target: ATXN1; (-) strand; PAM type: YTN; PAM sequence: CTT
gttcccttgtcctcagtggc

SEQ ID NO: 222731 - DNA, 20 bp, Artificial Sequence
  Description of Artificial Sequence: Synthetic oligonucleotide
  Target: ATXN1; (-) strand; PAM type: YTN; PAM sequence: TTC
ttgttcccttgtcctcagtg

SEQ ID NO: 222732 - DNA, 20 bp, Artificial Sequence
  Description of Artificial Sequence: Synthetic oligonucleotide
  Target: ATXN1; (-) strand; PAM type: YTN; PAM sequence: TTG
acacagattcttgttccctt

SEQ ID NO: 222733 - DNA, 20 bp, Artificial Sequence
  Description of Artificial Sequence: Synthetic oligonucleotide
  Target: ATXN1; (-) strand; PAM type: YTN; PAM sequence: TTG
attgacacagattcttgttc

SEQ ID NO: 222734 - DNA, 20 bp, Artificial Sequence
  Description of Artificial Sequence: Synthetic oligonucleotide
  Target: ATXN1; (-) strand; PAM type: YTN; PAM sequence: TTG
ttgattgacacagattcttg

SEQ ID NO: 222735 - DNA, 20 bp, Artificial Sequence
  Description of Artificial Sequence: Synthetic oligonucleotide
  Target: ATXN1; (-) strand; PAM type: YTN; PAM sequence: TTC
aggggcattgttgattgaca

SEQ ID NO: 222736 - DNA, 20 bp, Artificial Sequence
  Description of Artificial Sequence: Synthetic oligonucleotide
  Target: ATXN1; (-) strand; PAM type: YTN; PAM sequence: CTT
caggggcattgttgattgac

SEQ ID NO: 222737 - DNA, 20 bp, Artificial Sequence
  Description of Artificial Sequence: Synthetic oligonucleotide
  Target: ATXN1; (-) strand; PAM type: YTN; PAM sequence: TTA
cttcaggggcattgttgatt

SEQ ID NO: 222738 - DNA, 20 bp, Artificial Sequence
  Description of Artificial Sequence: Synthetic oligonucleotide
  Target: ATXN1; (-) strand; PAM type: YTN; PAM sequence: TTT
acttcaggggcattgttgat

SEQ ID NO: 222739 - DNA, 20 bp, Artificial Sequence
  Description of Artificial Sequence: Synthetic oligonucleotide
  Target: ATXN1; (-) strand; PAM type: YTN; PAM sequence: CTG
gtttacttcaggggcattgt

SEQ ID NO: 222740 - DNA, 20 bp, Artificial Sequence
  Description of Artificial Sequence: Synthetic oligonucleotide
  Target: ATXN1; (-) strand; PAM type: YTN; PAM sequence: CTG
cctggtttacttcaggggca

SEQ ID NO: 222741 - DNA, 20 bp, Artificial Sequence
  Description of Artificial Sequence: Synthetic oligonucleotide
  Target: ATXN1; (-) strand; PAM type: YTN; PAM sequence: CTG
tgcagtgcggacctgcctgg

SEQ ID NO: 222742 - DNA, 20 bp, Artificial Sequence
  Description of Artificial Sequence: Synthetic oligonucleotide
  Target: ATXN1; (-) strand; PAM type: YTN; PAM sequence: CTG
agactgtgcagtgcggacct

SEQ ID NO: 222743 - DNA, 20 bp, Artificial Sequence
  Description of Artificial Sequence: Synthetic oligonucleotide
  Target: ATXN1; (-) strand; PAM type: YTN; PAM sequence: TTA
cagctgagactgtgcagtgc

SEQ ID NO: 222744 - DNA, 20 bp, Artificial Sequence
  Description of Artificial Sequence: Synthetic oligonucleotide
  Target: ATXN1; (-) strand; PAM type: YTN; PAM sequence: TTG
ggatagaattacagctgaga

SEQ ID NO: 222745 - DNA, 20 bp, Artificial Sequence
  Description of Artificial Sequence: Synthetic oligonucleotide
  Target: ATXN1; (-) strand; PAM type: YTN; PAM sequence: CTT
gggatagaattacagctgag

SEQ ID NO: 222746 - DNA, 20 bp, Artificial Sequence
  Description of Artificial Sequence: Synthetic oligonucleotide
  Target: ATXN1; (-) strand; PAM type: YTN; PAM sequence: TTC
ttgggatagaattacagctg

SEQ ID NO: 222747 - DNA, 20 bp, Artificial Sequence
  Description of Artificial Sequence: Synthetic oligonucleotide
  Target: ATXN1; (-) strand; PAM type: YTN; PAM sequence: TTT
cttgggatagaattacagct

SEQ ID NO: 222748 - DNA, 20 bp, Artificial Sequence
  Description of Artificial Sequence: Synthetic oligonucleotide
  Target: ATXN1; (-) strand; PAM type: YTN; PAM sequence: CTG
gtttcttgggatagaattac

SEQ ID NO: 222749 - DNA, 20 bp, Artificial Sequence
  Description of Artificial Sequence: Synthetic oligonucleotide
  Target: ATXN1; (-) strand; PAM type: YTN; PAM sequence: CTC
tggtttcttgggatagaatt

SEQ ID NO: 222750 - DNA, 20 bp, Artificial Sequence
  Description of Artificial Sequence: Synthetic oligonucleotide
  Target: ATXN1; (-) strand; PAM type: YTN; PAM sequence: CTG
tgctctggtttcttgggata

SEQ ID NO: 222751 - DNA, 20 bp, Artificial Sequence
  Description of Artificial Sequence: Synthetic oligonucleotide
  Target: ATXN1; (-) strand; PAM type: YTN; PAM sequence: CTG
gtcctgtgctctggtttctt

SEQ ID NO: 222752 - DNA, 20 bp, Artificial Sequence
  Description of Artificial Sequence: Synthetic oligonucleotide
  Target: ATXN1; (-) strand; PAM type: YTN; PAM sequence: CTC
tggtcctgtgctctggtttc

SEQ ID NO: 222753 - DNA, 20 bp, Artificial Sequence
  Description of Artificial Sequence: Synthetic oligonucleotide
  Target: ATXN1; (-) strand; PAM type: YTN; PAM sequence: TTA
agtgtggctctggtcctgtg

SEQ ID NO: 222754 - DNA, 20 bp, Artificial Sequence
  Description of Artificial Sequence: Synthetic oligonucleotide
  Target: ATXN1; (-) strand; PAM type: YTN; PAM sequence: CTT
aagtgtggctctggtcctgt

SEQ ID NO: 222755 - DNA, 20 bp, Artificial Sequence
  Description of Artificial Sequence: Synthetic oligonucleotide
  Target: ATXN1; (-) strand; PAM type: YTN; PAM sequence: CTG
caggcttaagtgtggctctg

SEQ ID NO: 222756 - DNA, 20 bp, Artificial Sequence
  Description of Artificial Sequence: Synthetic oligonucleotide
  Target: ATXN1; (-) strand; PAM type: YTN; PAM sequence: CTA
cactgcaggcttaagtgtgg

SEQ ID NO: 222757 - DNA, 20 bp, Artificial Sequence
  Description of Artificial Sequence: Synthetic oligonucleotide
  Target: ATXN1; (-) strand; PAM type: YTN; PAM sequence: CTG
tcacgtggccccatggcgtc

SEQ ID NO: 222758 - DNA, 20 bp, Artificial Sequence
  Description of Artificial Sequence: Synthetic oligonucleotide
  Target: ATXN1; (-) strand; PAM type: YTN; PAM sequence: TTG
gagaggcaggctgtcacgtg

SEQ ID NO: 222759 - DNA, 20 bp, Artificial Sequence
  Description of Artificial Sequence: Synthetic oligonucleotide
  Target: ATXN1; (-) strand; PAM type: YTN; PAM sequence: TTT
ggagaggcaggctgtcacgt

SEQ ID NO: 222760 - DNA, 20 bp, Artificial Sequence
  Description of Artificial Sequence: Synthetic oligonucleotide
  Target: ATXN1; (-) strand; PAM type: YTN; PAM sequence: CTT
tggagaggcaggctgtcacg

SEQ ID NO: 222761 - DNA, 20 bp, Artificial Sequence
  Description of Artificial Sequence: Synthetic oligonucleotide
  Target: ATXN1; (-) strand; PAM type: YTN; PAM sequence: CTG
acagtaacagctttggagag

SEQ ID NO: 222762 - DNA, 20 bp, Artificial Sequence
  Description of Artificial Sequence: Synthetic oligonucleotide
  Target: ATXN1; (-) strand; PAM type: YTN; PAM sequence: CTA
ctgacagtaacagctttgga

SEQ ID NO: 222763 - DNA, 20 bp, Artificial Sequence
  Description of Artificial Sequence: Synthetic oligonucleotide
  Target: ATXN1; (-) strand; PAM type: YTN; PAM sequence: CTA
aatactactgacagtaacag

SEQ ID NO: 222764 - DNA, 20 bp, Artificial Sequence
  Description of Artificial Sequence: Synthetic oligonucleotide
  Target: ATXN1; (-) strand; PAM type: YTN; PAM sequence: CTC
taaatactactgacagtaac

SEQ ID NO: 222765 - DNA, 20 bp, Artificial Sequence
  Description of Artificial Sequence: Synthetic oligonucleotide
  Target: ATXN1; (-) strand; PAM type: YTN; PAM sequence: TTC
ctctaaatactactgacagt

SEQ ID NO: 222766 - DNA, 20 bp, Artificial Sequence
  Description of Artificial Sequence: Synthetic oligonucleotide
  Target: ATXN1; (-) strand; PAM type: YTN; PAM sequence: TTT
cctctaaatactactgacag

SEQ ID NO: 222767 - DNA, 20 bp, Artificial Sequence
  Description of Artificial Sequence: Synthetic oligonucleotide
  Target: ATXN1; (-) strand; PAM type: YTN; PAM sequence: CTT
tcctctaaatactactgaca

SEQ ID NO: 222768 - DNA, 20 bp, Artificial Sequence
  Description of Artificial Sequence: Synthetic oligonucleotide
  Target: ATXN1; (-) strand; PAM type: YTN; PAM sequence: TTC
ctttcctctaaatactactg

SEQ ID NO: 222769 - DNA, 20 bp, Artificial Sequence
  Description of Artificial Sequence: Synthetic oligonucleotide
  Target: ATXN1; (-) strand; PAM type: YTN; PAM sequence: TTT
cctttcctctaaatactact

SEQ ID NO: 222770 - DNA, 20 bp, Artificial Sequence
  Description of Artificial Sequence: Synthetic oligonucleotide
  Target: ATXN1; (-) strand; PAM type: YTN; PAM sequence: TTT
tcctttcctctaaatactac

SEQ ID NO: 222771 - DNA, 20 bp, Artificial Sequence
  Description of Artificial Sequence: Synthetic oligonucleotide
  Target: ATXN1; (-) strand; PAM type: YTN; PAM sequence: TTT
ttcctttcctctaaatacta

SEQ ID NO: 222772 - DNA, 20 bp, Artificial Sequence
  Description of Artificial Sequence: Synthetic oligonucleotide
  Target: ATXN1; (-) strand; PAM type: YTN; PAM sequence: TTT
tttcctttcctctaaatact

SEQ ID NO: 222773 - DNA, 20 bp, Artificial Sequence
  Description of Artificial Sequence: Synthetic oligonucleotide
  Target: ATXN1; (-) strand; PAM type: YTN; PAM sequence: CTT
ttttcctttcctctaaatac

SEQ ID NO: 222774 - DNA, 20 bp, Artificial Sequence
  Description of Artificial Sequence: Synthetic oligonucleotide
  Target: ATXN1; (-) strand; PAM type: YTN; PAM sequence: TTA
caacttttttcctttcctct

SEQ ID NO: 222775 - DNA, 20 bp, Artificial Sequence
  Description of Artificial Sequence: Synthetic oligonucleotide
  Target: ATXN1; (-) strand; PAM type: YTN; PAM sequence: TTG
ttacaacttttttcctttcc

SEQ ID NO: 222776 - DNA, 20 bp, Artificial Sequence
  Description of Artificial Sequence: Synthetic oligonucleotide
  Target: ATXN1; (-) strand; PAM type: YTN; PAM sequence: CTT
gttacaacttttttcctttc

SEQ ID NO: 222777 - DNA, 20 bp, Artificial Sequence
  Description of Artificial Sequence: Synthetic oligonucleotide
  Target: ATXN1; (-) strand; PAM type: YTN; PAM sequence: TTA
cacttgttacaacttttttc

SEQ ID NO: 222778 - DNA, 20 bp, Artificial Sequence
  Description of Artificial Sequence: Synthetic oligonucleotide
  Target: ATXN1; (-) strand; PAM type: YTN; PAM sequence: TTC
gtgttacacttgttacaact

SEQ ID NO: 222779 - DNA, 20 bp, Artificial Sequence
  Description of Artificial Sequence: Synthetic oligonucleotide
  Target: ATXN1; (-) strand; PAM type: YTN; PAM sequence: TTA
atgttcgtgttacacttgtt

SEQ ID NO: 222780 - DNA, 20 bp, Artificial Sequence
  Description of Artificial Sequence: Synthetic oligonucleotide
  Target: ATXN1; (-) strand; PAM type: YTN; PAM sequence: CTT
aatgttcgtgttacacttgt

SEQ ID NO: 222781 - DNA, 20 bp, Artificial Sequence
  Description of Artificial Sequence: Synthetic oligonucleotide
  Target: ATXN1; (-) strand; PAM type: YTN; PAM sequence: TTC
cttaatgttcgtgttacact

SEQ ID NO: 222782 - DNA, 20 bp, Artificial Sequence
  Description of Artificial Sequence: Synthetic oligonucleotide
  Target: ATXN1; (-) strand; PAM type: YTN; PAM sequence: TTG
gtattccttaatgttcgtgt

SEQ ID NO: 222783 - DNA, 20 bp, Artificial Sequence
  Description of Artificial Sequence: Synthetic oligonucleotide
  Target: ATXN1; (-) strand; PAM type: YTN; PAM sequence: CTT
ggtattccttaatgttcgtg

SEQ ID NO: 222784 - DNA, 20 bp, Artificial Sequence
  Description of Artificial Sequence: Synthetic oligonucleotide
  Target: ATXN1; (-) strand; PAM type: YTN; PAM sequence: CTG
acttggtattccttaatgtt

SEQ ID NO: 222785 - DNA, 20 bp, Artificial Sequence
  Description of Artificial Sequence: Synthetic oligonucleotide
  Target: ATXN1; (-) strand; PAM type: YTN; PAM sequence: CTC
tgacttggtattccttaatg

SEQ ID NO: 222786 - DNA, 20 bp, Artificial Sequence
  Description of Artificial Sequence: Synthetic oligonucleotide
  Target: ATXN1; (-) strand; PAM type: YTN; PAM sequence: TTG
gctctgacttggtattcctt

SEQ ID NO: 222787 - DNA, 20 bp, Artificial Sequence
  Description of Artificial Sequence: Synthetic oligonucleotide
  Target: ATXN1; (-) strand; PAM type: YTN; PAM sequence: CTA
attggctctgacttggtatt

SEQ ID NO: 222788 - DNA, 20 bp, Artificial Sequence
  Description of Artificial Sequence: Synthetic oligonucleotide
  Target: ATXN1; (-) strand; PAM type: YTN; PAM sequence: TTA
tcgtcctaattggctctgac

SEQ ID NO: 222789 - DNA, 20 bp, Artificial Sequence
  Description of Artificial Sequence: Synthetic oligonucleotide
  Target: ATXN1; (-) strand; PAM type: YTN; PAM sequence: TTC
atatgcatgaggcaggagtg

SEQ ID NO: 222790 - DNA, 20 bp, Artificial Sequence
  Description of Artificial Sequence: Synthetic oligonucleotide
  Target: ATXN1; (-) strand; PAM type: YTN; PAM sequence: TTT
catatgcatgaggcaggagt

SEQ ID NO: 222791 - DNA, 20 bp, Artificial Sequence
  Description of Artificial Sequence: Synthetic oligonucleotide
  Target: ATXN1; (-) strand; PAM type: YTN; PAM sequence: TTT
tcatatgcatgaggcaggag

SEQ ID NO: 222792 - DNA, 20 bp, Artificial Sequence
  Description of Artificial Sequence: Synthetic oligonucleotide
  Target: ATXN1; (-) strand; PAM type: YTN; PAM sequence: TTT
ttcatatgcatgaggcagga

SEQ ID NO: 222793 - DNA, 20 bp, Artificial Sequence
  Description of Artificial Sequence: Synthetic oligonucleotide
  Target: ATXN1; (-) strand; PAM type: YTN; PAM sequence: CTT
tttcatatgcatgaggcagg

SEQ ID NO: 222794 - DNA, 20 bp, Artificial Sequence
  Description of Artificial Sequence: Synthetic oligonucleotide
  Target: ATXN1; (-) strand; PAM type: YTN; PAM sequence: TTG
atggcggatcctttttcata

SEQ ID NO: 222795 - DNA, 20 bp, Artificial Sequence
  Description of Artificial Sequence: Synthetic oligonucleotide
  Target: ATXN1; (-) strand; PAM type: YTN; PAM sequence: CTC
attgatggcggatccttttt

SEQ ID NO: 222796 - DNA, 20 bp, Artificial Sequence
  Description of Artificial Sequence: Synthetic oligonucleotide
  Target: ATXN1; (-) strand; PAM type: YTN; PAM sequence: TTG
ctcattgatggcggatcctt

SEQ ID NO: 222797 - DNA, 20 bp, Artificial Sequence
  Description of Artificial Sequence: Synthetic oligonucleotide
  Target: ATXN1; (-) strand; PAM type: YTN; PAM sequence: TTA
ttgctcattgatggcggatc

SEQ ID NO: 222798 - DNA, 20 bp, Artificial Sequence
  Description of Artificial Sequence: Synthetic oligonucleotide
  Target: ATXN1; (-) strand; PAM type: YTN; PAM sequence: TTC
ccacaaatcccatgcattat

SEQ ID NO: 222799 - DNA, 20 bp, Artificial Sequence
  Description of Artificial Sequence: Synthetic oligonucleotide
  Target: ATXN1; (-) strand; PAM type: YTN; PAM sequence: TTA
gagcattcccacaaatccca

SEQ ID NO: 222800 - DNA, 20 bp, Artificial Sequence
  Description of Artificial Sequence: Synthetic oligonucleotide
  Target: ATXN1; (-) strand; PAM type: YTN; PAM sequence: TTG
aagttagagcattcccacaa

SEQ ID NO: 222801 - DNA, 20 bp, Artificial Sequence
  Description of Artificial Sequence: Synthetic oligonucleotide
  Target: ATXN1; (-) strand; PAM type: YTN; PAM sequence: TTG
atgtattgaagttagagcat

SEQ ID NO: 222802 - DNA, 20 bp, Artificial Sequence
  Description of Artificial Sequence: Synthetic oligonucleotide
  Target: ATXN1; (-) strand; PAM type: YTN; PAM sequence: TTT
gatgtattgaagttagagca

SEQ ID NO: 222803 - DNA, 20 bp, Artificial Sequence
  Description of Artificial Sequence: Synthetic oligonucleotide
  Target: ATXN1; (-) strand; PAM type: YTN; PAM sequence: CTT
tgatgtattgaagttagagc

SEQ ID NO: 222804 - DNA, 20 bp, Artificial Sequence
  Description of Artificial Sequence: Synthetic oligonucleotide
  Target: ATXN1; (-) strand; PAM type: YTN; PAM sequence: CTA
atgggaataaaaaagacgga

SEQ ID NO: 222805 - DNA, 20 bp, Artificial Sequence
  Description of Artificial Sequence: Synthetic oligonucleotide
  Target: ATXN1; (-) strand; PAM type: YTN; PAM sequence: TTC
atccagacaagggtgagcta

SEQ ID NO: 222806 - DNA, 20 bp, Artificial Sequence
  Description of Artificial Sequence: Synthetic oligonucleotide
  Target: ATXN1; (-) strand; PAM type: YTN; PAM sequence: TTT
catccagacaagggtgagct

SEQ ID NO: 222807 - DNA, 20 bp, Artificial Sequence
  Description of Artificial Sequence: Synthetic oligonucleotide
  Target: ATXN1; (-) strand; PAM type: YTN; PAM sequence: CTT
tcatccagacaagggtgagc

SEQ ID NO: 222808 - DNA, 20 bp, Artificial Sequence
  Description of Artificial Sequence: Synthetic oligonucleotide
  Target: ATXN1; (-) strand; PAM type: YTN; PAM sequence: CTC
tttcatccagacaagggtga

SEQ ID NO: 222809 - DNA, 20 bp, Artificial Sequence
  Description of Artificial Sequence: Synthetic oligonucleotide
  Target: ATXN1; (-) strand; PAM type: YTN; PAM sequence: CTG
agctctttcatccagacaag

SEQ ID NO: 222810 - DNA, 20 bp, Artificial Sequence
  Description of Artificial Sequence: Synthetic oligonucleotide
  Target: ATXN1; (-) strand; PAM type: YTN; PAM sequence: TTC
actgagctctttcatccaga

SEQ ID NO: 222811 - DNA, 20 bp, Artificial Sequence
  Description of Artificial Sequence: Synthetic oligonucleotide
  Target: ATXN1; (-) strand; PAM type: YTN; PAM sequence: TTG
attcactgagctctttcatc

SEQ ID NO: 222812 - DNA, 20 bp, Artificial Sequence
  Description of Artificial Sequence: Synthetic oligonucleotide
  Target: ATXN1; (-) strand; PAM type: YTN; PAM sequence: TTC
aacagaagcagttgattcac

SEQ ID NO: 222813 - DNA, 20 bp, Artificial Sequence
  Description of Artificial Sequence: Synthetic oligonucleotide
  Target: ATXN1; (-) strand; PAM type: YTN; PAM sequence: TTG
aaaaatatataaacagttca

SEQ ID NO: 222814 - DNA, 20 bp, Artificial Sequence
  Description of Artificial Sequence: Synthetic oligonucleotide
  Target: ATXN1; (-) strand; PAM type: YTN; PAM sequence: CTT
gaaaaatatataaacagttc

SEQ ID NO: 222815 - DNA, 20 bp, Artificial Sequence
  Description of Artificial Sequence: Synthetic oligonucleotide
  Target: ATXN1; (-) strand; PAM type: YTN; PAM sequence: CTA
atcatgacttgaaaaatata

SEQ ID NO: 222816 - DNA, 20 bp, Artificial Sequence
  Description of Artificial Sequence: Synthetic oligonucleotide
  Target: ATXN1; (-) strand; PAM type: YTN; PAM sequence: CTA
atggcctaatcatgacttga

SEQ ID NO: 222817 - DNA, 20 bp, Artificial Sequence
  Description of Artificial Sequence: Synthetic oligonucleotide
  Target: ATXN1; (-) strand; PAM type: YTN; PAM sequence: CTC
agtgactaatggcctaatca

SEQ ID NO: 222818 - DNA, 20 bp, Artificial Sequence
  Description of Artificial Sequence: Synthetic oligonucleotide
  Target: ATXN1; (-) strand; PAM type: YTN; PAM sequence: CTG
tgcaatatgctcagtgacta

SEQ ID NO: 222819 - DNA, 20 bp, Artificial Sequence
  Description of Artificial Sequence: Synthetic oligonucleotide
  Target: ATXN1; (-) strand; PAM type: YTN; PAM sequence: TTA
ctgtgcaatatgctcagtga

SEQ ID NO: 222820 - DNA, 20 bp, Artificial Sequence
  Description of Artificial Sequence: Synthetic oligonucleotide
  Target: ATXN1; (-) strand; PAM type: YTN; PAM sequence: TTT
actgtgcaatatgctcagtg

SEQ ID NO: 222821 - DNA, 20 bp, Artificial Sequence
  Description of Artificial Sequence: Synthetic oligonucleotide
  Target: ATXN1; (-) strand; PAM type: YTN; PAM sequence: CTA
gtttactgtgcaatatgctc

SEQ ID NO: 222822 - DNA, 20 bp, Artificial Sequence
  Description of Artificial Sequence: Synthetic oligonucleotide
  Target: ATXN1; (-) strand; PAM type: YTN; PAM sequence: CTC
tagtttactgtgcaatatgc

SEQ ID NO: 222823 - DNA, 20 bp, Artificial Sequence
  Description of Artificial Sequence: Synthetic oligonucleotide
  Target: ATXN1; (-) strand; PAM type: YTN; PAM sequence: TTA
ctctagtttactgtgcaata

SEQ ID NO: 222824 - DNA, 20 bp, Artificial Sequence
  Description of Artificial Sequence: Synthetic oligonucleotide
  Target: ATXN1; (-) strand; PAM type: YTN; PAM sequence: TTG
cataatggcagttactctag

SEQ ID NO: 222825 - DNA, 20 bp, Artificial Sequence
  Description of Artificial Sequence: Synthetic oligonucleotide
  Target: ATXN1; (-) strand; PAM type: YTN; PAM sequence: TTG
ggaagttgcataatggcagt

SEQ ID NO: 222826 - DNA, 20 bp, Artificial Sequence
  Description of Artificial Sequence: Synthetic oligonucleotide
  Target: ATXN1; (-) strand; PAM type: YTN; PAM sequence: CTT
gggaagttgcataatggcag

SEQ ID NO: 222827 - DNA, 20 bp, Artificial Sequence
  Description of Artificial Sequence: Synthetic oligonucleotide
  Target: ATXN1; (-) strand; PAM type: YTN; PAM sequence: TTC
ttgggaagttgcataatggc

SEQ ID NO: 222828 - DNA, 20 bp, Artificial Sequence
  Description of Artificial Sequence: Synthetic oligonucleotide
  Target: ATXN1; (-) strand; PAM type: YTN; PAM sequence: CTG
tatgttcttgggaagttgca

SEQ ID NO: 222829 - DNA, 20 bp, Artificial Sequence
  Description of Artificial Sequence: Synthetic oligonucleotide
  Target: ATXN1; (-) strand; PAM type: YTN; PAM sequence: CTC
tgtatgttcttgggaagttg

SEQ ID NO: 222830 - DNA, 20 bp, Artificial Sequence
  Description of Artificial Sequence: Synthetic oligonucleotide
  Target: ATXN1; (-) strand; PAM type: YTN; PAM sequence: CTC
tctgtatgttcttgggaagt

SEQ ID NO: 222831 - DNA, 20 bp, Artificial Sequence
  Description of Artificial Sequence: Synthetic oligonucleotide
  Target: ATXN1; (-) strand; PAM type: YTN; PAM sequence: CTG
taaatgctctctgtatgttc

SEQ ID NO: 222832 - DNA, 20 bp, Artificial Sequence
  Description of Artificial Sequence: Synthetic oligonucleotide
  Target: ATXN1; (-) strand; PAM type: YTN; PAM sequence: CTC
actgtaaatgctctctgtat

SEQ ID NO: 222833 - DNA, 20 bp, Artificial Sequence
  Description of Artificial Sequence: Synthetic oligonucleotide
  Target: ATXN1; (-) strand; PAM type: YTN; PAM sequence: CTG
tggcctcactgtaaatgctc

SEQ ID NO: 222834 - DNA, 20 bp, Artificial Sequence
  Description of Artificial Sequence: Synthetic oligonucleotide
  Target: ATXN1; (-) strand; PAM type: YTN; PAM sequence: CTG
gcactgtggcctcactgtaa

SEQ ID NO: 222835 - DNA, 20 bp, Artificial Sequence
  Description of Artificial Sequence: Synthetic oligonucleotide
  Target: ATXN1; (-) strand; PAM type: YTN; PAM sequence: TTG
ctggcactgtggcctcactg

SEQ ID NO: 222836 - DNA, 20 bp, Artificial Sequence
  Description of Artificial Sequence: Synthetic oligonucleotide
  Target: ATXN1; (-) strand; PAM type: YTN; PAM sequence: TTT
gctggcactgtggcctcact

SEQ ID NO: 222837 - DNA, 20 bp, Artificial Sequence
  Description of Artificial Sequence: Synthetic oligonucleotide
  Target: ATXN1; (-) strand; PAM type: YTN; PAM sequence: TTT
tgctggcactgtggcctcac

SEQ ID NO: 222838 - DNA, 20 bp, Artificial Sequence
  Description of Artificial Sequence: Synthetic oligonucleotide
  Target: ATXN1; (-) strand; PAM type: YTN; PAM sequence: TTG
cacattttgctggcactgtg

SEQ ID NO: 222839 - DNA, 20 bp, Artificial Sequence
  Description of Artificial Sequence: Synthetic oligonucleotide
  Target: ATXN1; (-) strand; PAM type: YTN; PAM sequence: CTC
cattgcacattttgctggca

SEQ ID NO: 222840 - DNA, 20 bp, Artificial Sequence
  Description of Artificial Sequence: Synthetic oligonucleotide
  Target: ATXN1; (-) strand; PAM type: YTN; PAM sequence: CTG
ataaatagtctccattgcac

SEQ ID NO: 222841 - DNA, 20 bp, Artificial Sequence
  Description of Artificial Sequence: Synthetic oligonucleotide
  Target: ATXN1; (-) strand; PAM type: YTN; PAM sequence: TTG
ctgataaatagtctccattg

SEQ ID NO: 222842 - DNA, 20 bp, Artificial Sequence
  Description of Artificial Sequence: Synthetic oligonucleotide
  Target: ATXN1; (-) strand; PAM type: YTN; PAM sequence: TTA
taattgctgataaatagtct

SEQ ID NO: 222843 - DNA, 20 bp, Artificial Sequence
  Description of Artificial Sequence: Synthetic oligonucleotide
  Target: ATXN1; (-) strand; PAM type: YTN; PAM sequence: CTT
ataattgctgataaatagtc

SEQ ID NO: 222844 - DNA, 20 bp, Artificial Sequence
  Description of Artificial Sequence: Synthetic oligonucleotide
  Target: ATXN1; (-) strand; PAM type: YTN; PAM sequence: TTC
ttataattgctgataaatag

SEQ ID NO: 222845 - DNA, 20 bp, Artificial Sequence
  Description of Artificial Sequence: Synthetic oligonucleotide
  Target: ATXN1; (-) strand; PAM type: YTN; PAM sequence: TTA
aatgcacagttcttataatt

SEQ ID NO: 222846 - DNA, 20 bp, Artificial Sequence
  Description of Artificial Sequence: Synthetic oligonucleotide
  Target: ATXN1; (-) strand; PAM type: YTN; PAM sequence: TTT
aaatgcacagttcttataat

SEQ ID NO: 222847 - DNA, 20 bp, Artificial Sequence
  Description of Artificial Sequence: Synthetic oligonucleotide
  Target: ATXN1; (-) strand; PAM type: YTN; PAM sequence: TTG
gcatttaaatgcacagttct

SEQ ID NO: 222848 - DNA, 20 bp, Artificial Sequence
  Description of Artificial Sequence: Synthetic oligonucleotide
  Target: ATXN1; (-) strand; PAM type: YTN; PAM sequence: TTT
ggcatttaaatgcacagttc

SEQ ID NO: 222849 - DNA, 20 bp, Artificial Sequence
  Description of Artificial Sequence: Synthetic oligonucleotide
  Target: ATXN1; (-) strand; PAM type: YTN; PAM sequence: TTA
tttggcatttaaatgcacag

SEQ ID NO: 222850 - DNA, 20 bp, Artificial Sequence
  Description of Artificial Sequence: Synthetic oligonucleotide
  Target: ATXN1; (-) strand; PAM type: YTN; PAM sequence: TTT
atttggcatttaaatgcaca

SEQ ID NO: 222851 - DNA, 20 bp, Artificial Sequence
  Description of Artificial Sequence: Synthetic oligonucleotide
  Target: ATXN1; (-) strand; PAM type: YTN; PAM sequence: TTT
tatttggcatttaaatgcac

SEQ ID NO: 222852 - DNA, 20 bp, Artificial Sequence
  Description of Artificial Sequence: Synthetic oligonucleotide
  Target: ATXN1; (-) strand; PAM type: YTN; PAM sequence: CTG
ccacgtgtatattttatttg

SEQ ID NO: 222853 - DNA, 20 bp, Artificial Sequence
  Description of Artificial Sequence: Synthetic oligonucleotide
  Target: ATXN1; (-) strand; PAM type: YTN; PAM sequence: CTG
tatctgccacgtgtatattt

SEQ ID NO: 222854 - DNA, 20 bp, Artificial Sequence
  Description of Artificial Sequence: Synthetic oligonucleotide
  Target: ATXN1; (-) strand; PAM type: YTN; PAM sequence: TTC
tgtatctgccacgtgtatat

SEQ ID NO: 222855 - DNA, 20 bp, Artificial Sequence
  Description of Artificial Sequence: Synthetic oligonucleotide
  Target: ATXN1; (-) strand; PAM type: YTN; PAM sequence: CTC
aagttctgtatctgccacgt

SEQ ID NO: 222856 - DNA, 20 bp, Artificial Sequence
  Description of Artificial Sequence: Synthetic oligonucleotide
  Target: ATXN1; (-) strand; PAM type: YTN; PAM sequence: TTC
cccctcaagttctgtatctg

SEQ ID NO: 222857 - DNA, 20 bp, Artificial Sequence
  Description of Artificial Sequence: Synthetic oligonucleotide
  Target: ATXN1; (-) strand; PAM type: YTN; PAM sequence: TTT
ccccctcaagttctgtatct

SEQ ID NO: 222858 - DNA, 20 bp, Artificial Sequence
  Description of Artificial Sequence: Synthetic oligonucleotide
  Target: ATXN1; (-) strand; PAM type: YTN; PAM sequence: TTT
tccccctcaagttctgtatc

SEQ ID NO: 222859 - DNA, 20 bp, Artificial Sequence
  Description of Artificial Sequence: Synthetic oligonucleotide
  Target: ATXN1; (-) strand; PAM type: YTN; PAM sequence: CTT
ttccccctcaagttctgtat

SEQ ID NO: 222860 - DNA, 20 bp, Artificial Sequence
  Description of Artificial Sequence: Synthetic oligonucleotide
  Target: ATXN1; (-) strand; PAM type: YTN; PAM sequence: TTA
atcatgcatcttttccccct

SEQ ID NO: 222861 - DNA, 20 bp, Artificial Sequence
  Description of Artificial Sequence: Synthetic oligonucleotide
  Target: ATXN1; (-) strand; PAM type: YTN; PAM sequence: TTT
aatcatgcatcttttccccc

SEQ ID NO: 222862 - DNA, 20 bp, Artificial Sequence
  Description of Artificial Sequence: Synthetic oligonucleotide
  Target: ATXN1; (-) strand; PAM type: YTN; PAM sequence: CTT
taatcatgcatcttttcccc

SEQ ID NO: 222863 - DNA, 20 bp, Artificial Sequence
  Description of Artificial Sequence: Synthetic oligonucleotide
  Target: ATXN1; (-) strand; PAM type: YTN; PAM sequence: TTG
gtactttaatcatgcatctt

SEQ ID NO: 222864 - DNA, 20 bp, Artificial Sequence
  Description of Artificial Sequence: Synthetic oligonucleotide
  Target: ATXN1; (-) strand; PAM type: YTN; PAM sequence: TTC
agaagagcaaatattggtac

SEQ ID NO: 222865 - DNA, 20 bp, Artificial Sequence
  Description of Artificial Sequence: Synthetic oligonucleotide
  Target: ATXN1; (-) strand; PAM type: YTN; PAM sequence: CTA
atacattcagaagagcaaat

SEQ ID NO: 222866 - DNA, 20 bp, Artificial Sequence
  Description of Artificial Sequence: Synthetic oligonucleotide
  Target: ATXN1; (-) strand; PAM type: YTN; PAM sequence: CTC
taatacattcagaagagcaa

SEQ ID NO: 222867 - DNA, 20 bp, Artificial Sequence
  Description of Artificial Sequence: Synthetic oligonucleotide
  Target: ATXN1; (-) strand; PAM type: YTN; PAM sequence: TTC
aggctctaatacattcagaa

SEQ ID NO: 222868 - DNA, 20 bp, Artificial Sequence
  Description of Artificial Sequence: Synthetic oligonucleotide
  Target: ATXN1; (-) strand; PAM type: YTN; PAM sequence: TTT
caggctctaatacattcaga

SEQ ID NO: 222869 - DNA, 20 bp, Artificial Sequence
  Description of Artificial Sequence: Synthetic oligonucleotide
  Target: ATXN1; (-) strand; PAM type: YTN; PAM sequence: TTT
tcaggctctaatacattcag

SEQ ID NO: 222870 - DNA, 20 bp, Artificial Sequence
  Description of Artificial Sequence: Synthetic oligonucleotide
  Target: ATXN1; (-) strand; PAM type: YTN; PAM sequence: TTC
gttttcaggctctaatacat

SEQ ID NO: 222871 - DNA, 20 bp, Artificial Sequence
  Description of Artificial Sequence: Synthetic oligonucleotide
  Target: ATXN1; (-) strand; PAM type: YTN; PAM sequence: TTT
cgttttcaggctctaataca

SEQ ID NO: 222872 - DNA, 20 bp, Artificial Sequence
  Description of Artificial Sequence: Synthetic oligonucleotide
  Target: ATXN1; (-) strand; PAM type: YTN; PAM sequence: CTT
tcgttttcaggctctaatac

SEQ ID NO: 222873 - DNA, 20 bp, Artificial Sequence
  Description of Artificial Sequence: Synthetic oligonucleotide
  Target: ATXN1; (-) strand; PAM type: YTN; PAM sequence: TTC
agggggactttcgttttcag

SEQ ID NO: 222874 - DNA, 20 bp, Artificial Sequence
  Description of Artificial Sequence: Synthetic oligonucleotide
  Target: ATXN1; (-) strand; PAM type: YTN; PAM sequence: CTG
gttcagggggactttcgttt

SEQ ID NO: 222875 - DNA, 20 bp, Artificial Sequence
  Description of Artificial Sequence: Synthetic oligonucleotide
  Target: ATXN1; (-) strand; PAM type: YTN; PAM sequence: TTC
tggttcagggggactttcgt

SEQ ID NO: 222876 - DNA, 20 bp, Artificial Sequence
  Description of Artificial Sequence: Synthetic oligonucleotide
  Target: ATXN1; (-) strand; PAM type: YTN; PAM sequence: CTT
ctggttcagggggactttcg

SEQ ID NO: 222877 - DNA, 20 bp, Artificial Sequence
  Description of Artificial Sequence: Synthetic oligonucleotide
  Target: ATXN1; (-) strand; PAM type: YTN; PAM sequence: TTC
gcttctggttcagggggact

SEQ ID NO: 222878 - DNA, 20 bp, Artificial Sequence
  Description of Artificial Sequence: Synthetic oligonucleotide
  Target: ATXN1; (-) strand; PAM type: YTN; PAM sequence: TTC
aagattcgcttctggttcag

SEQ ID NO: 222879 - DNA, 20 bp, Artificial Sequence
  Description of Artificial Sequence: Synthetic oligonucleotide
  Target: ATXN1; (-) strand; PAM type: YTN; PAM sequence: CTG
agttcaagattcgcttctgg

SEQ ID NO: 222880 - DNA, 20 bp, Artificial Sequence
  Description of Artificial Sequence: Synthetic oligonucleotide
  Target: ATXN1; (-) strand; PAM type: YTN; PAM sequence: CTG
agactgagttcaagattcgc

SEQ ID NO: 222881 - DNA, 20 bp, Artificial Sequence
  Description of Artificial Sequence: Synthetic oligonucleotide
  Target: ATXN1; (-) strand; PAM type: YTN; PAM sequence: CTA
actgagactgagttcaagat

SEQ ID NO: 222882 - DNA, 20 bp, Artificial Sequence
  Description of Artificial Sequence: Synthetic oligonucleotide
  Target: ATXN1; (-) strand; PAM type: YTN; PAM sequence: CTA
accaagctaactgagactga

SEQ ID NO: 222883 - DNA, 20 bp, Artificial Sequence
  Description of Artificial Sequence: Synthetic oligonucleotide
  Target: ATXN1; (-) strand; PAM type: YTN; PAM sequence: TTC
ggaaggagaacagcggctaa

SEQ ID NO: 222884 - DNA, 20 bp, Artificial Sequence
  Description of Artificial Sequence: Synthetic oligonucleotide
  Target: ATXN1; (-) strand; PAM type: YTN; PAM sequence: TTG
gcaggtatgggggcattcgg

SEQ ID NO: 222885 - DNA, 20 bp, Artificial Sequence
  Description of Artificial Sequence: Synthetic oligonucleotide
  Target: ATXN1; (-) strand; PAM type: YTN; PAM sequence: TTC
agatacagatgttggcaggt

SEQ ID NO: 222886 - DNA, 20 bp, Artificial Sequence
  Description of Artificial Sequence: Synthetic oligonucleotide
  Target: ATXN1; (-) strand; PAM type: YTN; PAM sequence: TTG
agtgtgttcagatacagatg

SEQ ID NO: 222887 - DNA, 20 bp, Artificial Sequence
  Description of Artificial Sequence: Synthetic oligonucleotide
  Target: ATXN1; (-) strand; PAM type: YTN; PAM sequence: TTG
gacccaacattgagtgtgtt

SEQ ID NO: 222888 - DNA, 20 bp, Artificial Sequence
  Description of Artificial Sequence: Synthetic oligonucleotide
  Target: ATXN1; (-) strand; PAM type: YTN; PAM sequence: TTA
tgttggacccaacattgagt

SEQ ID NO: 222889 - DNA, 20 bp, Artificial Sequence
  Description of Artificial Sequence: Synthetic oligonucleotide
  Target: ATXN1; (-) strand; PAM type: YTN; PAM sequence: CTT
atgttggacccaacattgag

SEQ ID NO: 222890 - DNA, 20 bp, Artificial Sequence
  Description of Artificial Sequence: Synthetic oligonucleotide
  Target: ATXN1; (-) strand; PAM type: YTN; PAM sequence: TTC
cttatgttggacccaacatt

SEQ ID NO: 222891 - DNA, 20 bp, Artificial Sequence
  Description of Artificial Sequence: Synthetic oligonucleotide
  Target: ATXN1; (-) strand; PAM type: YTN; PAM sequence: TTA
ataagaaagaagaagggaaa

SEQ ID NO: 222892 - DNA, 20 bp, Artificial Sequence
  Description of Artificial Sequence: Synthetic oligonucleotide
  Target: ATXN1; (-) strand; PAM type: YTN; PAM sequence: TTT
aataagaaagaagaagggaa

SEQ ID NO: 222893 - DNA, 20 bp, Artificial Sequence
  Description of Artificial Sequence: Synthetic oligonucleotide
  Target: ATXN1; (-) strand; PAM type: YTN; PAM sequence: CTT
taataagaaagaagaaggga

SEQ ID NO: 222894 - DNA, 20 bp, Artificial Sequence
  Description of Artificial Sequence: Synthetic oligonucleotide
  Target: ATXN1; (-) strand; PAM type: YTN; PAM sequence: CTG
ggaatctttaataagaaaga

SEQ ID NO: 222895 - DNA, 20 bp, Artificial Sequence
  Description of Artificial Sequence: Synthetic oligonucleotide
  Target: ATXN1; (-) strand; PAM type: YTN; PAM sequence: CTG
aggcctgggaatctttaata

SEQ ID NO: 222896 - DNA, 20 bp, Artificial Sequence
  Description of Artificial Sequence: Synthetic oligonucleotide
  Target: ATXN1; (-) strand; PAM type: YTN; PAM sequence: TTG
ggtagggggtgatgctgagg

SEQ ID NO: 222897 - DNA, 20 bp, Artificial Sequence
  Description of Artificial Sequence: Synthetic oligonucleotide
  Target: ATXN1; (-) strand; PAM type: YTN; PAM sequence: CTT
gggtagggggtgatgctgag

SEQ ID NO: 222898 - DNA, 20 bp, Artificial Sequence
  Description of Artificial Sequence: Synthetic oligonucleotide
  Target: ATXN1; (-) strand; PAM type: YTN; PAM sequence: TTA
tccaagtgcttgggtagggg

SEQ ID NO: 222899 - DNA, 20 bp, Artificial Sequence
  Description of Artificial Sequence: Synthetic oligonucleotide
  Target: ATXN1; (-) strand; PAM type: YTN; PAM sequence: CTG
aattatccaagtgcttgggt

SEQ ID NO: 222900 - DNA, 20 bp, Artificial Sequence
  Description of Artificial Sequence: Synthetic oligonucleotide
  Target: ATXN1; (-) strand; PAM type: YTN; PAM sequence: CTA
ctgaattatccaagtgcttg

SEQ ID NO: 222901 - DNA, 20 bp, Artificial Sequence
  Description of Artificial Sequence: Synthetic oligonucleotide
  Target: ATXN1; (-) strand; PAM type: YTN; PAM sequence: CTC
tactgaattatccaagtgct

SEQ ID NO: 222902 - DNA, 20 bp, Artificial Sequence
  Description of Artificial Sequence: Synthetic oligonucleotide
  Target: ATXN1; (-) strand; PAM type: YTN; PAM sequence: CTC
cccagtggcctctactgaat

SEQ ID NO: 222903 - DNA, 20 bp, Artificial Sequence
  Description of Artificial Sequence: Synthetic oligonucleotide
  Target: ATXN1; (-) strand; PAM type: YTN; PAM sequence: TTC
tccccagtggcctctactga

SEQ ID NO: 222904 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaagttctcccc

SEQ ID NO: 222905 - DNA, 20 bp, Artificial Sequence
  Description of Artificial Sequence: Synthetic oligonucleotide
  Target: ATXN1; (-) strand; PAM type: YTN; PAM sequence: CTC
catctcaaaaaaaaaaagtt

SEQ ID NO: 222906 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagtgagactcca

SEQ ID NO: 222907 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagagtga

SEQ ID NO: 222908 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggtgacag

SEQ ID NO: 222909 - DNA, 20 bp, Artificial Sequence
  Description of Artificial Sequence: Synthetic oligonucleotide
  Target: ATXN1; (-) strand; PAM type: YTN; PAM sequence: TTG
catcactgcactccagcctg

SEQ ID NO: 222910 - DNA, 20 bp, Artificial Sequence
  Description of Artificial Sequence: Synthetic oligonucleotide
  Target: ATXN1; (-) strand; PAM type: YTN; PAM sequence: CTG
agattgcatcactgcactcc

SEQ ID NO: 222911 - DNA, 20 bp, Artificial Sequence
  Description of Artificial Sequence: Synthetic oligonucleotide
  Target: ATXN1; (-) strand; PAM type: YTN; PAM sequence: TTG
cagtgagctgagattgcatc

SEQ ID NO: 222912 - DNA, 20 bp, Artificial Sequence
  Description of Artificial Sequence: Synthetic oligonucleotide
  Target: ATXN1; (-) strand; PAM type: YTN; PAM sequence: CTG
ggaggtggaggttgcagtga

SEQ ID NO: 222913 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggtggaggttg

SEQ ID NO: 222914 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggtggaggtt

SEQ ID NO: 222915 - DNA, 20 bp, Artificial Sequence
  Description of Artificial Sequence: Synthetic oligonucleotide
  Target: ATXN1; (-) strand; PAM type: YTN; PAM sequence: CTG
aggcacgagaatcacttgaa

SEQ ID NO: 222916 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcacgagaat

SEQ ID NO: 222917 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcacgagaa

SEQ ID NO: 222918 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcacga

SEQ ID NO: 222919 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacttgggag

SEQ ID NO: 222920 - DNA, 20 bp, Artificial Sequence
  Description of Artificial Sequence: Synthetic oligonucleotide
  Target: ATXN1; (-) strand; PAM type: YTN; PAM sequence: CTG
ggtgtggtggtgcacacctg

SEQ ID NO: 222921 - DNA, 20 bp, Artificial Sequence
  Description of Artificial Sequence: Synthetic oligonucleotide
  Target: ATXN1; (-) strand; PAM type: YTN; PAM sequence: TTA
gctgggtgtggtggtgcaca

SEQ ID NO: 222922 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagctgg

SEQ ID NO: 222923 - DNA, 20 bp, Artificial Sequence
  Description of Artificial Sequence: Synthetic oligonucleotide
  Target: ATXN1; (-) strand; PAM type: YTN; PAM sequence: TTA
ctaaaaatacaaaaattagc

SEQ ID NO: 222924 - DNA, 20 bp, Artificial Sequence
  Description of Artificial Sequence: Synthetic oligonucleotide
  Target: ATXN1; (-) strand; PAM type: YTN; PAM sequence: TTT
actaaaaatacaaaaattag

SEQ ID NO: 222925 - DNA, 20 bp, Artificial Sequence
  Description of Artificial Sequence: Synthetic oligonucleotide
  Target: ATXN1; (-) strand; PAM type: YTN; PAM sequence: CTT
tactaaaaatacaaaaatta

SEQ ID NO: 222926 - DNA, 20 bp, Artificial Sequence
  Description of Artificial Sequence: Synthetic oligonucleotide
  Target: ATXN1; (-) strand; PAM type: YTN; PAM sequence: CTG
catctttactaaaaatacaa

SEQ ID NO: 222927 - DNA, 20 bp, Artificial Sequence
  Description of Artificial Sequence: Synthetic oligonucleotide
  Target: ATXN1; (-) strand; PAM type: YTN; PAM sequence: CTG
gccatcatggtgaaactgca

SEQ ID NO: 222928 - DNA, 20 bp, Artificial Sequence
  Description of Artificial Sequence: Synthetic oligonucleotide
  Target: ATXN1; (-) strand; PAM type: YTN; PAM sequence: TTC
gagacaagcctggccatcat

SEQ ID NO: 222929 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcgagacaa

SEQ ID NO: 222930 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggcggacagat

SEQ ID NO: 222931 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggcggacaga

SEQ ID NO: 222932 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggcggacag

SEQ ID NO: 222933 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 222934 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccagcact

SEQ ID NO: 222935 - DNA, 20 bp, Artificial Sequence
  Description of Artificial Sequence: Synthetic oligonucleotide
  Target: ATXN1; (-) strand; PAM type: YTN; PAM sequence: TTC
agaaaaccccagagaggcca

SEQ ID NO: 222936 - DNA, 20 bp, Artificial Sequence
  Description of Artificial Sequence: Synthetic oligonucleotide
  Target: ATXN1; (-) strand; PAM type: YTN; PAM sequence: CTT
cagaaaaccccagagaggcc

SEQ ID NO: 222937 - DNA, 20 bp, Artificial Sequence
  Description of Artificial Sequence: Synthetic oligonucleotide
  Target: ATXN1; (-) strand; PAM type: YTN; PAM sequence: CTA
tgtggcttcagaaaacccca

SEQ ID NO: 222938 - DNA, 20 bp, Artificial Sequence
  Description of Artificial Sequence: Synthetic oligonucleotide
  Target: ATXN1; (-) strand; PAM type: YTN; PAM sequence: CTC
aaacatgtaagtctatgtgg

SEQ ID NO: 222939 - DNA, 20 bp, Artificial Sequence
  Description of Artificial Sequence: Synthetic oligonucleotide
  Target: ATXN1; (-) strand; PAM type: YTN; PAM sequence: TTG
aatgggaaatcctcaaacat

SEQ ID NO: 222940 - DNA, 20 bp, Artificial Sequence
  Description of Artificial Sequence: Synthetic oligonucleotide
  Target: ATXN1; (-) strand; PAM type: YTN; PAM sequence: TTT
gaatgggaaatcctcaaaca

SEQ ID NO: 222941 - DNA, 20 bp, Artificial Sequence
  Description of Artificial Sequence: Synthetic oligonucleotide
  Target: ATXN1; (-) strand; PAM type: YTN; PAM sequence: CTT
tgaatgggaaatcctcaaac

SEQ ID NO: 222942 - DNA, 20 bp, Artificial Sequence
  Description of Artificial Sequence: Synthetic oligonucleotide
  Target: ATXN1; (-) strand; PAM type: YTN; PAM sequence: TTA
ggactttgaatgggaaatcc

SEQ ID NO: 222943 - DNA, 20 bp, Artificial Sequence
  Description of Artificial Sequence: Synthetic oligonucleotide
  Target: ATXN1; (-) strand; PAM type: YTN; PAM sequence: TTT
aggactttgaatgggaaatc

SEQ ID NO: 222944 - DNA, 20 bp, Artificial Sequence
  Description of Artificial Sequence: Synthetic oligonucleotide
  Target: ATXN1; (-) strand; PAM type: YTN; PAM sequence: CTT
taggactttgaatgggaaat

SEQ ID NO: 222945 - DNA, 20 bp, Artificial Sequence
  Description of Artificial Sequence: Synthetic oligonucleotide
  Target: ATXN1; (-) strand; PAM type: YTN; PAM sequence: TTC
tttaggactttgaatgggaa

SEQ ID NO: 222946 - DNA, 20 bp, Artificial Sequence
  Description of Artificial Sequence: Synthetic oligonucleotide
  Target: ATXN1; (-) strand; PAM type: YTN; PAM sequence: TTA
gtgttctttaggactttgaa

SEQ ID NO: 222947 - DNA, 20 bp, Artificial Sequence
  Description of Artificial Sequence: Synthetic oligonucleotide
  Target: ATXN1; (-) strand; PAM type: YTN; PAM sequence: CTA
ttagtgttctttaggacttt

SEQ ID NO: 222948 - DNA, 20 bp, Artificial Sequence
  Description of Artificial Sequence: Synthetic oligonucleotide
  Target: ATXN1; (-) strand; PAM type: YTN; PAM sequence: TTC
tattagtgttctttaggact

SEQ ID NO: 222949 - DNA, 20 bp, Artificial Sequence
  Description of Artificial Sequence: Synthetic oligonucleotide
  Target: ATXN1; (-) strand; PAM type: YTN; PAM sequence: CTT
ctattagtgttctttaggac

SEQ ID NO: 222950 - DNA, 20 bp, Artificial Sequence
  Description of Artificial Sequence: Synthetic oligonucleotide
  Target: ATXN1; (-) strand; PAM type: YTN; PAM sequence: TTC
ttctattagtgttctttagg

SEQ ID NO: 222951 - DNA, 20 bp, Artificial Sequence
  Description of Artificial Sequence: Synthetic oligonucleotide
  Target: ATXN1; (-) strand; PAM type: YTN; PAM sequence: TTT
cttctattagtgttctttag

SEQ ID NO: 222952 - DNA, 20 bp, Artificial Sequence
  Description of Artificial Sequence: Synthetic oligonucleotide
  Target: ATXN1; (-) strand; PAM type: YTN; PAM sequence: TTT
tcttctattagtgttcttta

SEQ ID NO: 222953 - DNA, 20 bp, Artificial Sequence
  Description of Artificial Sequence: Synthetic oligonucleotide
  Target: ATXN1; (-) strand; PAM type: YTN; PAM sequence: TTT
ttcttctattagtgttcttt

SEQ ID NO: 222954 - DNA, 20 bp, Artificial Sequence
  Description of Artificial Sequence: Synthetic oligonucleotide
  Target: ATXN1; (-) strand; PAM type: YTN; PAM sequence: CTT
tttcttctattagtgttctt

SEQ ID NO: 222955 - DNA, 20 bp, Artificial Sequence
  Description of Artificial Sequence: Synthetic oligonucleotide
  Target: ATXN1; (-) strand; PAM type: YTN; PAM sequence: TTC
tttttcttctattagtgttc

SEQ ID NO: 222956 - DNA, 20 bp, Artificial Sequence
  Description of Artificial Sequence: Synthetic oligonucleotide
  Target: ATXN1; (-) strand; PAM type: YTN; PAM sequence: TTT
ctttttcttctattagtgtt

SEQ ID NO: 222957 - DNA, 20 bp, Artificial Sequence
  Description of Artificial Sequence: Synthetic oligonucleotide
  Target: ATXN1; (-) strand; PAM type: YTN; PAM sequence: CTT
tctttttcttctattagtgt

SEQ ID NO: 222958 - DNA, 20 bp, Artificial Sequence
  Description of Artificial Sequence: Synthetic oligonucleotide
  Target: ATXN1; (-) strand; PAM type: YTN; PAM sequence: TTC
ctttctttttcttctattag

SEQ ID NO: 222959 - DNA, 20 bp, Artificial Sequence
  Description of Artificial Sequence: Synthetic oligonucleotide
  Target: ATXN1; (-) strand; PAM type: YTN; PAM sequence: TTA
catgttcctttctttttctt

SEQ ID NO: 222960 - DNA, 20 bp, Artificial Sequence
  Description of Artificial Sequence: Synthetic oligonucleotide
  Target: ATXN1; (-) strand; PAM type: YTN; PAM sequence: TTT
acatgttcctttctttttct

SEQ ID NO: 222961 - DNA, 20 bp, Artificial Sequence
  Description of Artificial Sequence: Synthetic oligonucleotide
  Target: ATXN1; (-) strand; PAM type: YTN; PAM sequence: TTT
tacatgttcctttctttttc

SEQ ID NO: 222962 - DNA, 20 bp, Artificial Sequence
  Description of Artificial Sequence: Synthetic oligonucleotide
  Target: ATXN1; (-) strand; PAM type: YTN; PAM sequence: CTT
ttacatgttcctttcttttt

SEQ ID NO: 222963 - DNA, 20 bp, Artificial Sequence
  Description of Artificial Sequence: Synthetic oligonucleotide
  Target: ATXN1; (-) strand; PAM type: YTN; PAM sequence: TTA
aatgccacttttacatgttc

SEQ ID NO: 222964 - DNA, 20 bp, Artificial Sequence
  Description of Artificial Sequence: Synthetic oligonucleotide
  Target: ATXN1; (-) strand; PAM type: YTN; PAM sequence: CTG
ataaattaaatgccactttt

SEQ ID NO: 222965 - DNA, 20 bp, Artificial Sequence
  Description of Artificial Sequence: Synthetic oligonucleotide
  Target: ATXN1; (-) strand; PAM type: YTN; PAM sequence: CTA
agggtcctgataaattaaat

SEQ ID NO: 222966 - DNA, 20 bp, Artificial Sequence
  Description of Artificial Sequence: Synthetic oligonucleotide
  Target: ATXN1; (-) strand; PAM type: YTN; PAM sequence: TTA
tcatgggcaatgtatgtgaa

SEQ ID NO: 222967 - DNA, 20 bp, Artificial Sequence
  Description of Artificial Sequence: Synthetic oligonucleotide
  Target: ATXN1; (-) strand; PAM type: YTN; PAM sequence: CTT
atcatgggcaatgtatgtga

SEQ ID NO: 222968 - DNA, 20 bp, Artificial Sequence
  Description of Artificial Sequence: Synthetic oligonucleotide
  Target: ATXN1; (-) strand; PAM type: YTN; PAM sequence: CTG
gcttatcatgggcaatgtat

SEQ ID NO: 222969 - DNA, 20 bp, Artificial Sequence
  Description of Artificial Sequence: Synthetic oligonucleotide
  Target: ATXN1; (-) strand; PAM type: YTN; PAM sequence: TTG
tcactggcttatcatgggca

SEQ ID NO: 222970 - DNA, 20 bp, Artificial Sequence
  Description of Artificial Sequence: Synthetic oligonucleotide
  Target: ATXN1; (-) strand; PAM type: YTN; PAM sequence: TTT
gtcactggcttatcatgggc

SEQ ID NO: 222971 - DNA, 20 bp, Artificial Sequence
  Description of Artificial Sequence: Synthetic oligonucleotide
  Target: ATXN1; (-) strand; PAM type: YTN; PAM sequence: TTA
tatttgtcactggcttatca

SEQ ID NO: 222972 - DNA, 20 bp, Artificial Sequence
  Description of Artificial Sequence: Synthetic oligonucleotide
  Target: ATXN1; (-) strand; PAM type: YTN; PAM sequence: TTC
aattatatttgtcactggct

SEQ ID NO: 222973 - DNA, 20 bp, Artificial Sequence
  Description of Artificial Sequence: Synthetic oligonucleotide
  Target: ATXN1; (-) strand; PAM type: YTN; PAM sequence: CTT
caattatatttgtcactggc

SEQ ID NO: 222974 - DNA, 20 bp, Artificial Sequence
  Description of Artificial Sequence: Synthetic oligonucleotide
  Target: ATXN1; (-) strand; PAM type: YTN; PAM sequence: TTA
aaacttcaattatatttgtc

SEQ ID NO: 222975 - DNA, 20 bp, Artificial Sequence
  Description of Artificial Sequence: Synthetic oligonucleotide
  Target: ATXN1; (-) strand; PAM type: YTN; PAM sequence: TTT
aaaacttcaattatatttgt

SEQ ID NO: 222976 - DNA, 20 bp, Artificial Sequence
  Description of Artificial Sequence: Synthetic oligonucleotide
  Target: ATXN1; (-) strand; PAM type: YTN; PAM sequence: CTT
taaaacttcaattatatttg

SEQ ID NO: 222977 - DNA, 20 bp, Artificial Sequence
  Description of Artificial Sequence: Synthetic oligonucleotide
  Target: ATXN1; (-) strand; PAM type: YTN; PAM sequence: TTG
cacatgtactttaaaacttc

SEQ ID NO: 222978 - DNA, 20 bp, Artificial Sequence
  Description of Artificial Sequence: Synthetic oligonucleotide
  Target: ATXN1; (-) strand; PAM type: YTN; PAM sequence: CTT
gcacatgtactttaaaactt

SEQ ID NO: 222979 - DNA, 20 bp, Artificial Sequence
  Description of Artificial Sequence: Synthetic oligonucleotide
  Target: ATXN1; (-) strand; PAM type: YTN; PAM sequence: CTG
atcccttgcacatgtacttt

SEQ ID NO: 222980 - DNA, 20 bp, Artificial Sequence
  Description of Artificial Sequence: Synthetic oligonucleotide
  Target: ATXN1; (-) strand; PAM type: YTN; PAM sequence: TTC
aagtagctgatcccttgcac

SEQ ID NO: 222981 - DNA, 20 bp, Artificial Sequence
  Description of Artificial Sequence: Synthetic oligonucleotide
  Target: ATXN1; (-) strand; PAM type: YTN; PAM sequence: TTT
caagtagctgatcccttgca

SEQ ID NO: 222982 - DNA, 20 bp, Artificial Sequence
  Description of Artificial Sequence: Synthetic oligonucleotide
  Target: ATXN1; (-) strand; PAM type: YTN; PAM sequence: CTG
ggaggtttcaagtagctgat

SEQ ID NO: 222983 - DNA, 20 bp, Artificial Sequence
  Description of Artificial Sequence: Synthetic oligonucleotide
  Target: ATXN1; (-) strand; PAM type: YTN; PAM sequence: CTG
ctgggaggtttcaagtagct

SEQ ID NO: 222984 - DNA, 20 bp, Artificial Sequence
  Description of Artificial Sequence: Synthetic oligonucleotide
  Target: ATXN1; (-) strand; PAM type: YTN; PAM sequence: TTC
ctgctgggaggtttcaagta

SEQ ID NO: 222985 - DNA, 20 bp, Artificial Sequence
  Description of Artificial Sequence: Synthetic oligonucleotide
  Target: ATXN1; (-) strand; PAM type: YTN; PAM sequence: TTT
cctgctgggaggtttcaagt

SEQ ID NO: 222986 - DNA, 20 bp, Artificial Sequence
  Description of Artificial Sequence: Synthetic oligonucleotide
  Target: ATXN1; (-) strand; PAM type: YTN; PAM sequence: TTT
tcctgctgggaggtttcaag

SEQ ID NO: 222987 - DNA, 20 bp, Artificial Sequence
  Description of Artificial Sequence: Synthetic oligonucleotide
  Target: ATXN1; (-) strand; PAM type: YTN; PAM sequence: TTG
ttttcctgctgggaggtttc

SEQ ID NO: 222988 - DNA, 20 bp, Artificial Sequence
  Description of Artificial Sequence: Synthetic oligonucleotide
  Target: ATXN1; (-) strand; PAM type: YTN; PAM sequence: CTT
gttttcctgctgggaggttt

SEQ ID NO: 222989 - DNA, 20 bp, Artificial Sequence
  Description of Artificial Sequence: Synthetic oligonucleotide
  Target: ATXN1; (-) strand; PAM type: YTN; PAM sequence: TTC
ttgttttcctgctgggaggt

SEQ ID NO: 222990 - DNA, 20 bp, Artificial Sequence
  Description of Artificial Sequence: Synthetic oligonucleotide
  Target: ATXN1; (-) strand; PAM type: YTN; PAM sequence: TTT
cttgttttcctgctgggagg

SEQ ID NO: 222991 - DNA, 20 bp, Artificial Sequence
  Description of Artificial Sequence: Synthetic oligonucleotide
  Target: ATXN1; (-) strand; PAM type: YTN; PAM sequence: TTA
tttcttgttttcctgctggg

SEQ ID NO: 222992 - DNA, 20 bp, Artificial Sequence
  Description of Artificial Sequence: Synthetic oligonucleotide
  Target: ATXN1; (-) strand; PAM type: YTN; PAM sequence: CTT
atttcttgttttcctgctgg

SEQ ID NO: 222993 - DNA, 20 bp, Artificial Sequence
  Description of Artificial Sequence: Synthetic oligonucleotide
  Target: ATXN1; (-) strand; PAM type: YTN; PAM sequence: CTC
atggtcccttatttcttgtt

SEQ ID NO: 222994 - DNA, 20 bp, Artificial Sequence
  Description of Artificial Sequence: Synthetic oligonucleotide
  Target: ATXN1; (-) strand; PAM type: YTN; PAM sequence: TTC
ctcatggtcccttatttctt

SEQ ID NO: 222995 - DNA, 20 bp, Artificial Sequence
  Description of Artificial Sequence: Synthetic oligonucleotide
  Target: ATXN1; (-) strand; PAM type: YTN; PAM sequence: CTT
cctcatggtcccttatttct

SEQ ID NO: 222996 - DNA, 20 bp, Artificial Sequence
  Description of Artificial Sequence: Synthetic oligonucleotide
  Target: ATXN1; (-) strand; PAM type: YTN; PAM sequence: CTC
ttcctcatggtcccttattt

SEQ ID NO: 222997 - DNA, 20 bp, Artificial Sequence
  Description of Artificial Sequence: Synthetic oligonucleotide
  Target: ATXN1; (-) strand; PAM type: YTN; PAM sequence: CTG
gatctcttcctcatggtccc

SEQ ID NO: 222998 - DNA, 20 bp, Artificial Sequence
  Description of Artificial Sequence: Synthetic oligonucleotide
  Target: ATXN1; (-) strand; PAM type: YTN; PAM sequence: TTG
tacagtaaatgtggagacct

SEQ ID NO: 222999 - DNA, 20 bp, Artificial Sequence
  Description of Artificial Sequence: Synthetic oligonucleotide
  Target: ATXN1; (-) strand; PAM type: YTN; PAM sequence: CTT
gtacagtaaatgtggagacc

SEQ ID NO: 223000 - DNA, 20 bp, Artificial Sequence
  Description of Artificial Sequence: Synthetic oligonucleotide
  Target: ATXN1; (-) strand; PAM type: YTN; PAM sequence: TTA
cttgtacagtaaatgtggag

SEQ ID NO: 223001 - DNA, 20 bp, Artificial Sequence
  Description of Artificial Sequence: Synthetic oligonucleotide
  Target: ATXN1; (-) strand; PAM type: YTN; PAM sequence: TTA
ttacttgtacagtaaatgtg

SEQ ID NO: 223002 - DNA, 20 bp, Artificial Sequence
  Description of Artificial Sequence: Synthetic oligonucleotide
  Target: ATXN1; (-) strand; PAM type: YTN; PAM sequence: TTA
tgttattacttgtacagtaa

SEQ ID NO: 223003 - DNA, 20 bp, Artificial Sequence
  Description of Artificial Sequence: Synthetic oligonucleotide
  Target: ATXN1; (-) strand; PAM type: YTN; PAM sequence: CTT
atgttattacttgtacagta

SEQ ID NO: 223004 - DNA, 20 bp, Artificial Sequence
  Description of Artificial Sequence: Synthetic oligonucleotide
  Target: ATXN1; (-) strand; PAM type: YTN; PAM sequence: TTG
cttatgttattacttgtaca

SEQ ID NO: 223005 - DNA, 20 bp, Artificial Sequence
  Description of Artificial Sequence: Synthetic oligonucleotide
  Target: ATXN1; (-) strand; PAM type: YTN; PAM sequence: CTT
gcttatgttattacttgtac

SEQ ID NO: 223006 - DNA, 20 bp, Artificial Sequence
  Description of Artificial Sequence: Synthetic oligonucleotide
  Target: ATXN1; (-) strand; PAM type: YTN; PAM sequence: CTC
ttgcttatgttattacttgt

SEQ ID NO: 223007 - DNA, 20 bp, Artificial Sequence
  Description of Artificial Sequence: Synthetic oligonucleotide
  Target: ATXN1; (-) strand; PAM type: YTN; PAM sequence: TTA
ggaagtctcttgcttatgtt

SEQ ID NO: 223008 - DNA, 20 bp, Artificial Sequence
  Description of Artificial Sequence: Synthetic oligonucleotide
  Target: ATXN1; (-) strand; PAM type: YTN; PAM sequence: CTT
aggaagtctcttgcttatgt

SEQ ID NO: 223009 - DNA, 20 bp, Artificial Sequence
  Description of Artificial Sequence: Synthetic oligonucleotide
  Target: ATXN1; (-) strand; PAM type: YTN; PAM sequence: CTC
ttaggaagtctcttgcttat

SEQ ID NO: 223010 - DNA, 20 bp, Artificial Sequence
  Description of Artificial Sequence: Synthetic oligonucleotide
  Target: ATXN1; (-) strand; PAM type: YTN; PAM sequence: CTA
taaaacactcttaggaagtc

SEQ ID NO: 223011 - DNA, 20 bp, Artificial Sequence
  Description of Artificial Sequence: Synthetic oligonucleotide
  Target: ATXN1; (-) strand; PAM type: YTN; PAM sequence: TTG
ccatgtaaaatactataaaa

SEQ ID NO: 223012 - DNA, 20 bp, Artificial Sequence
  Description of Artificial Sequence: Synthetic oligonucleotide
  Target: ATXN1; (-) strand; PAM type: YTN; PAM sequence: CTT
gccatgtaaaatactataaa

SEQ ID NO: 223013 - DNA, 20 bp, Artificial Sequence
  Description of Artificial Sequence: Synthetic oligonucleotide
  Target: ATXN1; (-) strand; PAM type: YTN; PAM sequence: CTG
gagagtaagagtcttgccat

SEQ ID NO: 223014 - DNA, 20 bp, Artificial Sequence
  Description of Artificial Sequence: Synthetic oligonucleotide
  Target: ATXN1; (-) strand; PAM type: YTN; PAM sequence: TTA
acagactggagagtaagagt

SEQ ID NO: 223015 - DNA, 20 bp, Artificial Sequence
  Description of Artificial Sequence: Synthetic oligonucleotide
  Target: ATXN1; (-) strand; PAM type: YTN; PAM sequence: CTC
aacaaataaatacatataaa

SEQ ID NO: 223016 - DNA, 20 bp, Artificial Sequence
  Description of Artificial Sequence: Synthetic oligonucleotide
  Target: ATXN1; (-) strand; PAM type: YTN; PAM sequence: CTA
aaatatataactcaacaaat

SEQ ID NO: 223017 - DNA, 20 bp, Artificial Sequence
  Description of Artificial Sequence: Synthetic oligonucleotide
  Target: ATXN1; (-) strand; PAM type: YTN; PAM sequence: TTC
agctaaaatatataactcaa

SEQ ID NO: 223018 - DNA, 20 bp, Artificial Sequence
  Description of Artificial Sequence: Synthetic oligonucleotide
  Target: ATXN1; (-) strand; PAM type: YTN; PAM sequence: TTC
caagttcagctaaaatatat

SEQ ID NO: 223019 - DNA, 20 bp, Artificial Sequence
  Description of Artificial Sequence: Synthetic oligonucleotide
  Target: ATXN1; (-) strand; PAM type: YTN; PAM sequence: CTG
tcattccaagttcagctaaa

SEQ ID NO: 223020 - DNA, 20 bp, Artificial Sequence
  Description of Artificial Sequence: Synthetic oligonucleotide
  Target: ATXN1; (-) strand; PAM type: YTN; PAM sequence: TTA
aaaataactgtcattccaag

SEQ ID NO: 223021 - DNA, 20 bp, Artificial Sequence
  Description of Artificial Sequence: Synthetic oligonucleotide
  Target: ATXN1; (-) strand; PAM type: YTN; PAM sequence: CTT
aaaaataactgtcattccaa

SEQ ID NO: 223022 - DNA, 20 bp, Artificial Sequence
  Description of Artificial Sequence: Synthetic oligonucleotide
  Target: ATXN1; (-) strand; PAM type: YTN; PAM sequence: CTC
ttaaaaataactgtcattcc

SEQ ID NO: 223023 - DNA, 20 bp, Artificial Sequence
  Description of Artificial Sequence: Synthetic oligonucleotide
  Target: ATXN1; (-) strand; PAM type: YTN; PAM sequence: TTG
gtagcctcttaaaaataact

SEQ ID NO: 223024 - DNA, 20 bp, Artificial Sequence
  Description of Artificial Sequence: Synthetic oligonucleotide
  Target: ATXN1; (-) strand; PAM type: YTN; PAM sequence: CTG
acccatgttggtagcctctt

SEQ ID NO: 223025 - DNA, 20 bp, Artificial Sequence
  Description of Artificial Sequence: Synthetic oligonucleotide
  Target: ATXN1; (-) strand; PAM type: YTN; PAM sequence: TTC
ctgacccatgttggtagcct

SEQ ID NO: 223026 - DNA, 20 bp, Artificial Sequence
  Description of Artificial Sequence: Synthetic oligonucleotide
  Target: ATXN1; (-) strand; PAM type: YTN; PAM sequence: CTT
cctgacccatgttggtagcc

SEQ ID NO: 223027 - DNA, 20 bp, Artificial Sequence
  Description of Artificial Sequence: Synthetic oligonucleotide
  Target: ATXN1; (-) strand; PAM type: YTN; PAM sequence: TTC
ttcctgacccatgttggtag

SEQ ID NO: 223028 - DNA, 20 bp, Artificial Sequence
  Description of Artificial Sequence: Synthetic oligonucleotide
  Target: ATXN1; (-) strand; PAM type: YTN; PAM sequence: CTG
aggttcttcctgacccatgt

SEQ ID NO: 223029 - DNA, 20 bp, Artificial Sequence
  Description of Artificial Sequence: Synthetic oligonucleotide
  Target: ATXN1; (-) strand; PAM type: YTN; PAM sequence: TTC
tgaggttcttcctgacccat

SEQ ID NO: 223030 - DNA, 20 bp, Artificial Sequence
  Description of Artificial Sequence: Synthetic oligonucleotide
  Target: ATXN1; (-) strand; PAM type: YTN; PAM sequence: TTT
ctgaggttcttcctgaccca

SEQ ID NO: 223031 - DNA, 20 bp, Artificial Sequence
  Description of Artificial Sequence: Synthetic oligonucleotide
  Target: ATXN1; (-) strand; PAM type: YTN; PAM sequence: CTG
tgagccaggtttctgaggtt

SEQ ID NO: 223032 - DNA, 20 bp, Artificial Sequence
  Description of Artificial Sequence: Synthetic oligonucleotide
  Target: ATXN1; (-) strand; PAM type: YTN; PAM sequence: TTA
tgccagagcaactgtgagcc

SEQ ID NO: 223033 - DNA, 20 bp, Artificial Sequence
  Description of Artificial Sequence: Synthetic oligonucleotide
  Target: ATXN1; (-) strand; PAM type: YTN; PAM sequence: TTT
atgccagagcaactgtgagc

SEQ ID NO: 223034 - DNA, 20 bp, Artificial Sequence
  Description of Artificial Sequence: Synthetic oligonucleotide
  Target: ATXN1; (-) strand; PAM type: YTN; PAM sequence: TTT
tatgccagagcaactgtgag

SEQ ID NO: 223035 - DNA, 20 bp, Artificial Sequence
  Description of Artificial Sequence: Synthetic oligonucleotide
  Target: ATXN1; (-) strand; PAM type: YTN; PAM sequence: TTT
ttatgccagagcaactgtga

SEQ ID NO: 223036 - DNA, 20 bp, Artificial Sequence
  Description of Artificial Sequence: Synthetic oligonucleotide
  Target: ATXN1; (-) strand; PAM type: YTN; PAM sequence: CTT
tttatgccagagcaactgtg

SEQ ID NO: 223037 - DNA, 20 bp, Artificial Sequence
  Description of Artificial Sequence: Synthetic oligonucleotide
  Target: ATXN1; (-) strand; PAM type: YTN; PAM sequence: TTG
gcggtcaaggctttttatgc

SEQ ID NO: 223038 - DNA, 20 bp, Artificial Sequence
  Description of Artificial Sequence: Synthetic oligonucleotide
  Target: ATXN1; (-) strand; PAM type: YTN; PAM sequence: TTT
ggcggtcaaggctttttatg

SEQ ID NO: 223039 - DNA, 20 bp, Artificial Sequence
  Description of Artificial Sequence: Synthetic oligonucleotide
  Target: ATXN1; (-) strand; PAM type: YTN; PAM sequence: TTT
tggcggtcaaggctttttat

SEQ ID NO: 223040 - DNA, 20 bp, Artificial Sequence
  Description of Artificial Sequence: Synthetic oligonucleotide
  Target: ATXN1; (-) strand; PAM type: YTN; PAM sequence: TTG
gttttggcggtcaaggcttt

SEQ ID NO: 223041 - DNA, 20 bp, Artificial Sequence
  Description of Artificial Sequence: Synthetic oligonucleotide
  Target: ATXN1; (-) strand; PAM type: YTN; PAM sequence: CTG
gttggttttggcggtcaagg

SEQ ID NO: 223042 - DNA, 20 bp, Artificial Sequence
  Description of Artificial Sequence: Synthetic oligonucleotide
  Target: ATXN1; (-) strand; PAM type: YTN; PAM sequence: CTC
cctggttggttttggcggtc

SEQ ID NO: 223043 - DNA, 20 bp, Artificial Sequence
  Description of Artificial Sequence: Synthetic oligonucleotide
  Target: ATXN1; (-) strand; PAM type: YTN; PAM sequence: CTC
atcaactccctggttggttt

SEQ ID NO: 223044 - DNA, 20 bp, Artificial Sequence
  Description of Artificial Sequence: Synthetic oligonucleotide
  Target: ATXN1; (-) strand; PAM type: YTN; PAM sequence: CTA
gatctcatcaactccctggt

SEQ ID NO: 223045 - DNA, 20 bp, Artificial Sequence
  Description of Artificial Sequence: Synthetic oligonucleotide
  Target: ATXN1; (-) strand; PAM type: YTN; PAM sequence: TTG
gaaacctagatctcatcaac

SEQ ID NO: 223046 - DNA, 20 bp, Artificial Sequence
  Description of Artificial Sequence: Synthetic oligonucleotide
  Target: ATXN1; (-) strand; PAM type: YTN; PAM sequence: TTT
ggaaacctagatctcatcaa

SEQ ID NO: 223047 - DNA, 20 bp, Artificial Sequence
  Description of Artificial Sequence: Synthetic oligonucleotide
  Target: ATXN1; (-) strand; PAM type: YTN; PAM sequence: TTT
tggaaacctagatctcatca

SEQ ID NO: 223048 - DNA, 20 bp, Artificial Sequence
  Description of Artificial Sequence: Synthetic oligonucleotide
  Target: ATXN1; (-) strand; PAM type: YTN; PAM sequence: TTC
gtggtgttttggaaacctag

SEQ ID NO: 223049 - DNA, 20 bp, Artificial Sequence
  Description of Artificial Sequence: Synthetic oligonucleotide
  Target: ATXN1; (-) strand; PAM type: YTN; PAM sequence: TTT
cgtggtgttttggaaaccta

SEQ ID NO: 223050 - DNA, 20 bp, Artificial Sequence
  Description of Artificial Sequence: Synthetic oligonucleotide
  Target: ATXN1; (-) strand; PAM type: YTN; PAM sequence: TTT
tcgtggtgttttggaaacct

SEQ ID NO: 223051 - DNA, 20 bp, Artificial Sequence
  Description of Artificial Sequence: Synthetic oligonucleotide
  Target: ATXN1; (-) strand; PAM type: YTN; PAM sequence: CTT
ttcgtggtgttttggaaacc

SEQ ID NO: 223052 - DNA, 20 bp, Artificial Sequence
  Description of Artificial Sequence: Synthetic oligonucleotide
  Target: ATXN1; (-) strand; PAM type: YTN; PAM sequence: TTA
atggccagatgggagaaagc

SEQ ID NO: 223053 - DNA, 20 bp, Artificial Sequence
  Description of Artificial Sequence: Synthetic oligonucleotide
  Target: ATXN1; (-) strand; PAM type: YTN; PAM sequence: TTT
aatggccagatgggagaaag

SEQ ID NO: 223054 - DNA, 20 bp, Artificial Sequence
  Description of Artificial Sequence: Synthetic oligonucleotide
  Target: ATXN1; (-) strand; PAM type: YTN; PAM sequence: TTT
taatggccagatgggagaaa

SEQ ID NO: 223055 - DNA, 20 bp, Artificial Sequence
  Description of Artificial Sequence: Synthetic oligonucleotide
  Target: ATXN1; (-) strand; PAM type: YTN; PAM sequence: TTT
ttaatggccagatgggagaa

SEQ ID NO: 223056 - DNA, 20 bp, Artificial Sequence
  Description of Artificial Sequence: Synthetic oligonucleotide
  Target: ATXN1; (-) strand; PAM type: YTN; PAM sequence: TTT
tttaatggccagatgggaga

SEQ ID NO: 223057 - DNA, 20 bp, Artificial Sequence
  Description of Artificial Sequence: Synthetic oligonucleotide
  Target: ATXN1; (-) strand; PAM type: YTN; PAM sequence: TTT
ttttaatggccagatgggag

SEQ ID NO: 223058 - DNA, 20 bp, Artificial Sequence
  Description of Artificial Sequence: Synthetic oligonucleotide
  Target: ATXN1; (-) strand; PAM type: YTN; PAM sequence: TTT
tttttaatggccagatggga

SEQ ID NO: 223059 - DNA, 20 bp, Artificial Sequence
  Description of Artificial Sequence: Synthetic oligonucleotide
  Target: ATXN1; (-) strand; PAM type: YTN; PAM sequence: TTT
ttttttaatggccagatggg

SEQ ID NO: 223060 - DNA, 20 bp, Artificial Sequence
  Description of Artificial Sequence: Synthetic oligonucleotide
  Target: ATXN1; (-) strand; PAM type: YTN; PAM sequence: TTT
tttttttaatggccagatgg

SEQ ID NO: 223061 - DNA, 20 bp, Artificial Sequence
  Description of Artificial Sequence: Synthetic oligonucleotide
  Target: ATXN1; (-) strand; PAM type: YTN; PAM sequence: TTT
ttttttttaatggccagatg

SEQ ID NO: 223062 - DNA, 20 bp, Artificial Sequence
  Description of Artificial Sequence: Synthetic oligonucleotide
  Target: ATXN1; (-) strand; PAM type: YTN; PAM sequence: CTA
tttttttttttaatggccag

SEQ ID NO: 223063 - DNA, 20 bp, Artificial Sequence
  Description of Artificial Sequence: Synthetic oligonucleotide
  Target: ATXN1; (-) strand; PAM type: YTN; PAM sequence: TTG
gtaaataactattttttttt

SEQ ID NO: 223064 - DNA, 20 bp, Artificial Sequence
  Description of Artificial Sequence: Synthetic oligonucleotide
  Target: ATXN1; (-) strand; PAM type: YTN; PAM sequence: TTT
ggtaaataactatttttttt

SEQ ID NO: 223065 - DNA, 20 bp, Artificial Sequence
  Description of Artificial Sequence: Synthetic oligonucleotide
  Target: ATXN1; (-) strand; PAM type: YTN; PAM sequence: CTT
tggtaaataactattttttt

SEQ ID NO: 223066 - DNA, 20 bp, Artificial Sequence
  Description of Artificial Sequence: Synthetic oligonucleotide
  Target: ATXN1; (-) strand; PAM type: YTN; PAM sequence: TTC
tttggtaaataactattttt

SEQ ID NO: 223067 - DNA, 20 bp, Artificial Sequence
  Description of Artificial Sequence: Synthetic oligonucleotide
  Target: ATXN1; (-) strand; PAM type: YTN; PAM sequence: CTT
ctttggtaaataactatttt

SEQ ID NO: 223068 - DNA, 20 bp, Artificial Sequence
  Description of Artificial Sequence: Synthetic oligonucleotide
  Target: ATXN1; (-) strand; PAM type: YTN; PAM sequence: TTA
caaaaagaatcttctttggt

SEQ ID NO: 223069 - DNA, 20 bp, Artificial Sequence
  Description of Artificial Sequence: Synthetic oligonucleotide
  Target: ATXN1; (-) strand; PAM type: YTN; PAM sequence: TTG
tattacaaaaagaatcttct

SEQ ID NO: 223070 - DNA, 20 bp, Artificial Sequence
  Description of Artificial Sequence: Synthetic oligonucleotide
  Target: ATXN1; (-) strand; PAM type: YTN; PAM sequence: TTG
attgtattacaaaaagaatc

SEQ ID NO: 223071 - DNA, 20 bp, Artificial Sequence
  Description of Artificial Sequence: Synthetic oligonucleotide
  Target: ATXN1; (-) strand; PAM type: YTN; PAM sequence: CTA
aacacaggaggaagtgattg

SEQ ID NO: 223072 - DNA, 20 bp, Artificial Sequence
  Description of Artificial Sequence: Synthetic oligonucleotide
  Target: ATXN1; (-) strand; PAM type: YTN; PAM sequence: TTG
aaccctaaacacaggaggaa

SEQ ID NO: 223073 - DNA, 20 bp, Artificial Sequence
  Description of Artificial Sequence: Synthetic oligonucleotide
  Target: ATXN1; (-) strand; PAM type: YTN; PAM sequence: TTT
gaaccctaaacacaggagga

SEQ ID NO: 223074 - DNA, 20 bp, Artificial Sequence
  Description of Artificial Sequence: Synthetic oligonucleotide
  Target: ATXN1; (-) strand; PAM type: YTN; PAM sequence: CTA
gatttgaaccctaaacacag

SEQ ID NO: 223075 - DNA, 20 bp, Artificial Sequence
  Description of Artificial Sequence: Synthetic oligonucleotide
  Target: ATXN1; (-) strand; PAM type: YTN; PAM sequence: TTC
tagatttgaaccctaaacac

SEQ ID NO: 223076 - DNA, 20 bp, Artificial Sequence
  Description of Artificial Sequence: Synthetic oligonucleotide
  Target: ATXN1; (-) strand; PAM type: YTN; PAM sequence: CTT
ctagatttgaaccctaaaca

SEQ ID NO: 223077 - DNA, 20 bp, Artificial Sequence
  Description of Artificial Sequence: Synthetic oligonucleotide
  Target: ATXN1; (-) strand; PAM type: YTN; PAM sequence: CTG
acatatggacttctagattt

SEQ ID NO: 223078 - DNA, 20 bp, Artificial Sequence
  Description of Artificial Sequence: Synthetic oligonucleotide
  Target: ATXN1; (-) strand; PAM type: YTN; PAM sequence: CTA
gactgacatatggacttcta

SEQ ID NO: 223079 - DNA, 20 bp, Artificial Sequence
  Description of Artificial Sequence: Synthetic oligonucleotide
  Target: ATXN1; (-) strand; PAM type: YTN; PAM sequence: CTA
agctagactgacatatggac

SEQ ID NO: 223080 - DNA, 20 bp, Artificial Sequence
  Description of Artificial Sequence: Synthetic oligonucleotide
  Target: ATXN1; (-) strand; PAM type: YTN; PAM sequence: CTC
taagctagactgacatatgg

SEQ ID NO: 223081 - DNA, 20 bp, Artificial Sequence
  Description of Artificial Sequence: Synthetic oligonucleotide
  Target: ATXN1; (-) strand; PAM type: YTN; PAM sequence: TTG
ctctaagctagactgacata

SEQ ID NO: 223082 - DNA, 20 bp, Artificial Sequence
  Description of Artificial Sequence: Synthetic oligonucleotide
  Target: ATXN1; (-) strand; PAM type: YTN; PAM sequence: TTT
gctctaagctagactgacat

SEQ ID NO: 223083 - DNA, 20 bp, Artificial Sequence
  Description of Artificial Sequence: Synthetic oligonucleotide
  Target: ATXN1; (-) strand; PAM type: YTN; PAM sequence: TTT
tgctctaagctagactgaca

SEQ ID NO: 223084 - DNA, 20 bp, Artificial Sequence
  Description of Artificial Sequence: Synthetic oligonucleotide
  Target: ATXN1; (-) strand; PAM type: YTN; PAM sequence: CTA
cattttgctctaagctagac

SEQ ID NO: 223085 - DNA, 20 bp, Artificial Sequence
  Description of Artificial Sequence: Synthetic oligonucleotide
  Target: ATXN1; (-) strand; PAM type: YTN; PAM sequence: CTA
gtccaaggtgaagaaagcta

SEQ ID NO: 223086 - DNA, 20 bp, Artificial Sequence
  Description of Artificial Sequence: Synthetic oligonucleotide
  Target: ATXN1; (-) strand; PAM type: YTN; PAM sequence: TTC
tagtccaaggtgaagaaagc

SEQ ID NO: 223087 - DNA, 20 bp, Artificial Sequence
  Description of Artificial Sequence: Synthetic oligonucleotide
  Target: ATXN1; (-) strand; PAM type: YTN; PAM sequence: TTG
ttctagtccaaggtgaagaa

SEQ ID NO: 223088 - DNA, 20 bp, Artificial Sequence
  Description of Artificial Sequence: Synthetic oligonucleotide
  Target: ATXN1; (-) strand; PAM type: YTN; PAM sequence: CTC
ataggttgttctagtccaag

SEQ ID NO: 223089 - DNA, 20 bp, Artificial Sequence
  Description of Artificial Sequence: Synthetic oligonucleotide
  Target: ATXN1; (-) strand; PAM type: YTN; PAM sequence: CTC
tcataggttgttctagtcca

SEQ ID NO: 223090 - DNA, 20 bp, Artificial Sequence
  Description of Artificial Sequence: Synthetic oligonucleotide
  Target: ATXN1; (-) strand; PAM type: YTN; PAM sequence: TTC
tctcataggttgttctagtc

SEQ ID NO: 223091 - DNA, 20 bp, Artificial Sequence
  Description of Artificial Sequence: Synthetic oligonucleotide
  Target: ATXN1; (-) strand; PAM type: YTN; PAM sequence: TTT
ctctcataggttgttctagt

SEQ ID NO: 223092 - DNA, 20 bp, Artificial Sequence
  Description of Artificial Sequence: Synthetic oligonucleotide
  Target: ATXN1; (-) strand; PAM type: YTN; PAM sequence: CTT
tctctcataggttgttctag

SEQ ID NO: 223093 - DNA, 20 bp, Artificial Sequence
  Description of Artificial Sequence: Synthetic oligonucleotide
  Target: ATXN1; (-) strand; PAM type: YTN; PAM sequence: TTG
ggcaccatctttctctcata

SEQ ID NO: 223094 - DNA, 20 bp, Artificial Sequence
  Description of Artificial Sequence: Synthetic oligonucleotide
  Target: ATXN1; (-) strand; PAM type: YTN; PAM sequence: CTG
gcccattgggcaccatcttt

SEQ ID NO: 223095 - DNA, 20 bp, Artificial Sequence
  Description of Artificial Sequence: Synthetic oligonucleotide
  Target: ATXN1; (-) strand; PAM type: YTN; PAM sequence: CTG
tgtgctggcccattgggcac

SEQ ID NO: 223096 - DNA, 20 bp, Artificial Sequence
  Description of Artificial Sequence: Synthetic oligonucleotide
  Target: ATXN1; (-) strand; PAM type: YTN; PAM sequence: TTA
gaaagcagctgtgtgctggc

SEQ ID NO: 223097 - DNA, 20 bp, Artificial Sequence
  Description of Artificial Sequence: Synthetic oligonucleotide
  Target: ATXN1; (-) strand; PAM type: YTN; PAM sequence: TTT
agaaagcagctgtgtgctgg

SEQ ID NO: 223098 - DNA, 20 bp, Artificial Sequence
  Description of Artificial Sequence: Synthetic oligonucleotide
  Target: ATXN1; (-) strand; PAM type: YTN; PAM sequence: CTG
tcaatttagaaagcagctgt

SEQ ID NO: 223099 - DNA, 20 bp, Artificial Sequence
  Description of Artificial Sequence: Synthetic oligonucleotide
  Target: ATXN1; (-) strand; PAM type: YTN; PAM sequence: CTC
agggctgtcaatttagaaag

SEQ ID NO: 223100 - DNA, 20 bp, Artificial Sequence
  Description of Artificial Sequence: Synthetic oligonucleotide
  Target: ATXN1; (-) strand; PAM type: YTN; PAM sequence: CTG
tccatggagaagctcagggc

SEQ ID NO: 223101 - DNA, 20 bp, Artificial Sequence
  Description of Artificial Sequence: Synthetic oligonucleotide
  Target: ATXN1; (-) strand; PAM type: YTN; PAM sequence: TTG
gaacactgtccatggagaag

SEQ ID NO: 223102 - DNA, 20 bp, Artificial Sequence
  Description of Artificial Sequence: Synthetic oligonucleotide
  Target: ATXN1; (-) strand; PAM type: YTN; PAM sequence: TTT
ggaacactgtccatggagaa

SEQ ID NO: 223103 - DNA, 20 bp, Artificial Sequence
  Description of Artificial Sequence: Synthetic oligonucleotide
  Target: ATXN1; (-) strand; PAM type: YTN; PAM sequence: TTT
tggaacactgtccatggaga

SEQ ID NO: 223104 - DNA, 20 bp, Artificial Sequence
  Description of Artificial Sequence: Synthetic oligonucleotide
  Target: ATXN1; (-) strand; PAM type: YTN; PAM sequence: TTA
gttttggaacactgtccatg

SEQ ID NO: 223105 - DNA, 20 bp, Artificial Sequence
  Description of Artificial Sequence: Synthetic oligonucleotide
  Target: ATXN1; (-) strand; PAM type: YTN; PAM sequence: CTA
acagccacagttagttttgg

SEQ ID NO: 223106 - DNA, 20 bp, Artificial Sequence
  Description of Artificial Sequence: Synthetic oligonucleotide
  Target: ATXN1; (-) strand; PAM type: YTN; PAM sequence: TTA
tcctaacagccacagttagt

SEQ ID NO: 223107 - DNA, 20 bp, Artificial Sequence
  Description of Artificial Sequence: Synthetic oligonucleotide
  Target: ATXN1; (-) strand; PAM type: YTN; PAM sequence: TTT
atcctaacagccacagttag

SEQ ID NO: 223108 - DNA, 20 bp, Artificial Sequence
  Description of Artificial Sequence: Synthetic oligonucleotide
  Target: ATXN1; (-) strand; PAM type: YTN; PAM sequence: CTT
tatcctaacagccacagtta

SEQ ID NO: 223109 - DNA, 20 bp, Artificial Sequence
  Description of Artificial Sequence: Synthetic oligonucleotide
  Target: ATXN1; (-) strand; PAM type: YTN; PAM sequence: CTC
tttatcctaacagccacagt

SEQ ID NO: 223110 - DNA, 20 bp, Artificial Sequence
  Description of Artificial Sequence: Synthetic oligonucleotide
  Target: ATXN1; (-) strand; PAM type: YTN; PAM sequence: CTG
ccctctttatcctaacagcc

SEQ ID NO: 223111 - DNA, 20 bp, Artificial Sequence
  Description of Artificial Sequence: Synthetic oligonucleotide
  Target: ATXN1; (-) strand; PAM type: YTN; PAM sequence: CTG
agaaactgccctctttatcc

SEQ ID NO: 223112 - DNA, 20 bp, Artificial Sequence
  Description of Artificial Sequence: Synthetic oligonucleotide
  Target: ATXN1; (-) strand; PAM type: YTN; PAM sequence: CTG
aagctgagaaactgccctct

SEQ ID NO: 223113 - DNA, 20 bp, Artificial Sequence
  Description of Artificial Sequence: Synthetic oligonucleotide
  Target: ATXN1; (-) strand; PAM type: YTN; PAM sequence: TTA
aaggcactgaagctgagaaa

SEQ ID NO: 223114 - DNA, 20 bp, Artificial Sequence
  Description of Artificial Sequence: Synthetic oligonucleotide
  Target: ATXN1; (-) strand; PAM type: YTN; PAM sequence: CTT
aaaggcactgaagctgagaa

SEQ ID NO: 223115 - DNA, 20 bp, Artificial Sequence
  Description of Artificial Sequence: Synthetic oligonucleotide
  Target: ATXN1; (-) strand; PAM type: YTN; PAM sequence: TTG
aaataaccttaaaggcactg

SEQ ID NO: 223116 - DNA, 20 bp, Artificial Sequence
  Description of Artificial Sequence: Synthetic oligonucleotide
  Target: ATXN1; (-) strand; PAM type: YTN; PAM sequence: TTA
acagaggtggaaagttgaaa

SEQ ID NO: 223117 - DNA, 20 bp, Artificial Sequence
  Description of Artificial Sequence: Synthetic oligonucleotide
  Target: ATXN1; (-) strand; PAM type: YTN; PAM sequence: CTG
cagcgtagttaacagaggtg

SEQ ID NO: 223118 - DNA, 20 bp, Artificial Sequence
  Description of Artificial Sequence: Synthetic oligonucleotide
  Target: ATXN1; (-) strand; PAM type: YTN; PAM sequence: TTC
tgcagcgtagttaacagagg

SEQ ID NO: 223119 - DNA, 20 bp, Artificial Sequence
  Description of Artificial Sequence: Synthetic oligonucleotide
  Target: ATXN1; (-) strand; PAM type: YTN; PAM sequence: TTT
ctgcagcgtagttaacagag

SEQ ID NO: 223120 - DNA, 20 bp, Artificial Sequence
  Description of Artificial Sequence: Synthetic oligonucleotide
  Target: ATXN1; (-) strand; PAM type: YTN; PAM sequence: TTC
agtgtcaaaagtttctgcag

SEQ ID NO: 223121 - DNA, 20 bp, Artificial Sequence
  Description of Artificial Sequence: Synthetic oligonucleotide
  Target: ATXN1; (-) strand; PAM type: YTN; PAM sequence: TTA
aggagagttcagtgtcaaaa

SEQ ID NO: 223122 - DNA, 20 bp, Artificial Sequence
  Description of Artificial Sequence: Synthetic oligonucleotide
  Target: ATXN1; (-) strand; PAM type: YTN; PAM sequence: TTA
tggatattaaggagagttca

SEQ ID NO: 223123 - DNA, 20 bp, Artificial Sequence
  Description of Artificial Sequence: Synthetic oligonucleotide
  Target: ATXN1; (-) strand; PAM type: YTN; PAM sequence: CTT
atggatattaaggagagttc

SEQ ID NO: 223124 - DNA, 20 bp, Artificial Sequence
  Description of Artificial Sequence: Synthetic oligonucleotide
  Target: ATXN1; (-) strand; PAM type: YTN; PAM sequence: CTG
gcttatggatattaaggaga

SEQ ID NO: 223125 - DNA, 20 bp, Artificial Sequence
  Description of Artificial Sequence: Synthetic oligonucleotide
  Target: ATXN1; (-) strand; PAM type: YTN; PAM sequence: CTC
tggcttatggatattaagga

SEQ ID NO: 223126 - DNA, 20 bp, Artificial Sequence
  Description of Artificial Sequence: Synthetic oligonucleotide
  Target: ATXN1; (-) strand; PAM type: YTN; PAM sequence: CTA
atgaacatctctggcttatg

SEQ ID NO: 223127 - DNA, 20 bp, Artificial Sequence
  Description of Artificial Sequence: Synthetic oligonucleotide
  Target: ATXN1; (-) strand; PAM type: YTN; PAM sequence: TTC
taatgaacatctctggctta

SEQ ID NO: 223128 - DNA, 20 bp, Artificial Sequence
  Description of Artificial Sequence: Synthetic oligonucleotide
  Target: ATXN1; (-) strand; PAM type: YTN; PAM sequence: TTT
ctaatgaacatctctggctt

SEQ ID NO: 223129 - DNA, 20 bp, Artificial Sequence
  Description of Artificial Sequence: Synthetic oligonucleotide
  Target: ATXN1; (-) strand; PAM type: YTN; PAM sequence: TTT
tctaatgaacatctctggct

SEQ ID NO: 223130 - DNA, 20 bp, Artificial Sequence
  Description of Artificial Sequence: Synthetic oligonucleotide
  Target: ATXN1; (-) strand; PAM type: YTN; PAM sequence: TTT
ttctaatgaacatctctggc

SEQ ID NO: 223131 - DNA, 20 bp, Artificial Sequence
  Description of Artificial Sequence: Synthetic oligonucleotide
  Target: ATXN1; (-) strand; PAM type: YTN; PAM sequence: CTG
atgaggagtgagaaattttt

SEQ ID NO: 223132 - DNA, 20 bp, Artificial Sequence
  Description of Artificial Sequence: Synthetic oligonucleotide
  Target: ATXN1; (-) strand; PAM type: YTN; PAM sequence: CTG
tctgatgaggagtgagaaat

SEQ ID NO: 223133 - DNA, 20 bp, Artificial Sequence
  Description of Artificial Sequence: Synthetic oligonucleotide
  Target: ATXN1; (-) strand; PAM type: YTN; PAM sequence: TTC
agctgtctgatgaggagtga

SEQ ID NO: 223134 - DNA, 20 bp, Artificial Sequence
  Description of Artificial Sequence: Synthetic oligonucleotide
  Target: ATXN1; (-) strand; PAM type: YTN; PAM sequence: CTT
cagctgtctgatgaggagtg

SEQ ID NO: 223135 - DNA, 20 bp, Artificial Sequence
  Description of Artificial Sequence: Synthetic oligonucleotide
  Target: ATXN1; (-) strand; PAM type: YTN; PAM sequence: CTC
aggtcttcagctgtctgatg

SEQ ID NO: 223136 - DNA, 20 bp, Artificial Sequence
  Description of Artificial Sequence: Synthetic oligonucleotide
  Target: ATXN1; (-) strand; PAM type: YTN; PAM sequence: CTC
cagaataggggaagacaaag

SEQ ID NO: 223137 - DNA, 20 bp, Artificial Sequence
  Description of Artificial Sequence: Synthetic oligonucleotide
  Target: ATXN1; (-) strand; PAM type: YTN; PAM sequence: TTC
aatgtgatctccagaatagg

SEQ ID NO: 223138 - DNA, 20 bp, Artificial Sequence
  Description of Artificial Sequence: Synthetic oligonucleotide
  Target: ATXN1; (-) strand; PAM type: YTN; PAM sequence: CTT
caatgtgatctccagaatag

SEQ ID NO: 223139 - DNA, 20 bp, Artificial Sequence
  Description of Artificial Sequence: Synthetic oligonucleotide
  Target: ATXN1; (-) strand; PAM type: YTN; PAM sequence: TTC
aggtagcccaaaaatccctt

SEQ ID NO: 223140 - DNA, 20 bp, Artificial Sequence
  Description of Artificial Sequence: Synthetic oligonucleotide
  Target: ATXN1; (-) strand; PAM type: YTN; PAM sequence: TTT
caggtagcccaaaaatccct

SEQ ID NO: 223141 - DNA, 20 bp, Artificial Sequence
  Description of Artificial Sequence: Synthetic oligonucleotide
  Target: ATXN1; (-) strand; PAM type: YTN; PAM sequence: CTT
tcaggtagcccaaaaatccc

SEQ ID NO: 223142 - DNA, 20 bp, Artificial Sequence
  Description of Artificial Sequence: Synthetic oligonucleotide
  Target: ATXN1; (-) strand; PAM type: YTN; PAM sequence: CTG
tcataaacactttcaggtag

SEQ ID NO: 223143 - DNA, 20 bp, Artificial Sequence
  Description of Artificial Sequence: Synthetic oligonucleotide
  Target: ATXN1; (-) strand; PAM type: YTN; PAM sequence: CTG
tctgtcataaacactttcag

SEQ ID NO: 223144 - DNA, 20 bp, Artificial Sequence
  Description of Artificial Sequence: Synthetic oligonucleotide
  Target: ATXN1; (-) strand; PAM type: YTN; PAM sequence: CTG
aatccaagagtctgtctgtc

SEQ ID NO: 223145 - DNA, 20 bp, Artificial Sequence
  Description of Artificial Sequence: Synthetic oligonucleotide
  Target: ATXN1; (-) strand; PAM type: YTN; PAM sequence: CTA
agcctgaatccaagagtctg

SEQ ID NO: 223146 - DNA, 20 bp, Artificial Sequence
  Description of Artificial Sequence: Synthetic oligonucleotide
  Target: ATXN1; (-) strand; PAM type: YTN; PAM sequence: TTG
tcctaagcctgaatccaaga

SEQ ID NO: 223147 - DNA, 20 bp, Artificial Sequence
  Description of Artificial Sequence: Synthetic oligonucleotide
  Target: ATXN1; (-) strand; PAM type: YTN; PAM sequence: CTT
gtcctaagcctgaatccaag

SEQ ID NO: 223148 - DNA, 20 bp, Artificial Sequence
  Description of Artificial Sequence: Synthetic oligonucleotide
  Target: ATXN1; (-) strand; PAM type: YTN; PAM sequence: TTG
cttgtcctaagcctgaatcc

SEQ ID NO: 223149 - DNA, 20 bp, Artificial Sequence
  Description of Artificial Sequence: Synthetic oligonucleotide
  Target: ATXN1; (-) strand; PAM type: YTN; PAM sequence: TTT
gcttgtcctaagcctgaatc

SEQ ID NO: 223150 - DNA, 20 bp, Artificial Sequence
  Description of Artificial Sequence: Synthetic oligonucleotide
  Target: ATXN1; (-) strand; PAM type: YTN; PAM sequence: CTC
atatgaaaggtttgcttgtc

SEQ ID NO: 223151 - DNA, 20 bp, Artificial Sequence
  Description of Artificial Sequence: Synthetic oligonucleotide
  Target: ATXN1; (-) strand; PAM type: YTN; PAM sequence: TTA
aggactcatatgaaaggttt

SEQ ID NO: 223152 - DNA, 20 bp, Artificial Sequence
  Description of Artificial Sequence: Synthetic oligonucleotide
  Target: ATXN1; (-) strand; PAM type: YTN; PAM sequence: TTT
aaggactcatatgaaaggtt

SEQ ID NO: 223153 - DNA, 20 bp, Artificial Sequence
  Description of Artificial Sequence: Synthetic oligonucleotide
  Target: ATXN1; (-) strand; PAM type: YTN; PAM sequence: TTT
taaggactcatatgaaaggt

SEQ ID NO: 223154 - DNA, 20 bp, Artificial Sequence
  Description of Artificial Sequence: Synthetic oligonucleotide
  Target: ATXN1; (-) strand; PAM type: YTN; PAM sequence: TTT
ttaaggactcatatgaaagg

SEQ ID NO: 223155 - DNA, 20 bp, Artificial Sequence
  Description of Artificial Sequence: Synthetic oligonucleotide
  Target: ATXN1; (-) strand; PAM type: YTN; PAM sequence: CTG
tttttaaggactcatatgaa

SEQ ID NO: 223156 - DNA, 20 bp, Artificial Sequence
  Description of Artificial Sequence: Synthetic oligonucleotide
  Target: ATXN1; (-) strand; PAM type: YTN; PAM sequence: CTG
tctgtttttaaggactcata

SEQ ID NO: 223157 - DNA, 20 bp, Artificial Sequence
  Description of Artificial Sequence: Synthetic oligonucleotide
  Target: ATXN1; (-) strand; PAM type: YTN; PAM sequence: TTA
caaacagagcactgtctgtt

SEQ ID NO: 223158 - DNA, 20 bp, Artificial Sequence
  Description of Artificial Sequence: Synthetic oligonucleotide
  Target: ATXN1; (-) strand; PAM type: YTN; PAM sequence: TTC
aaagttacaaacagagcact

SEQ ID NO: 223159 - DNA, 20 bp, Artificial Sequence
  Description of Artificial Sequence: Synthetic oligonucleotide
  Target: ATXN1; (-) strand; PAM type: YTN; PAM sequence: CTA
gaatggagttcaaagttaca

SEQ ID NO: 223160 - DNA, 20 bp, Artificial Sequence
  Description of Artificial Sequence: Synthetic oligonucleotide
  Target: ATXN1; (-) strand; PAM type: YTN; PAM sequence: TTG
tactagaatggagttcaaag

SEQ ID NO: 223161 - DNA, 20 bp, Artificial Sequence
  Description of Artificial Sequence: Synthetic oligonucleotide
  Target: ATXN1; (-) strand; PAM type: YTN; PAM sequence: TTT
gtactagaatggagttcaaa

SEQ ID NO: 223162 - DNA, 20 bp, Artificial Sequence
  Description of Artificial Sequence: Synthetic oligonucleotide
  Target: ATXN1; (-) strand; PAM type: YTN; PAM sequence: TTG
ccaagcatgtttgtactaga

SEQ ID NO: 223163 - DNA, 20 bp, Artificial Sequence
  Description of Artificial Sequence: Synthetic oligonucleotide
  Target: ATXN1; (-) strand; PAM type: YTN; PAM sequence: CTA
gttgccaagcatgtttgtac

SEQ ID NO: 223164 - DNA, 20 bp, Artificial Sequence
  Description of Artificial Sequence: Synthetic oligonucleotide
  Target: ATXN1; (-) strand; PAM type: YTN; PAM sequence: CTC
cggcactagttgccaagcat

SEQ ID NO: 223165 - DNA, 20 bp, Artificial Sequence
  Description of Artificial Sequence: Synthetic oligonucleotide
  Target: ATXN1; (-) strand; PAM type: YTN; PAM sequence: TTA
accctccggcactagttgcc

SEQ ID NO: 223166 - DNA, 20 bp, Artificial Sequence
  Description of Artificial Sequence: Synthetic oligonucleotide
  Target: ATXN1; (-) strand; PAM type: YTN; PAM sequence: CTG
gttaaccctccggcactagt

SEQ ID NO: 223167 - DNA, 20 bp, Artificial Sequence
  Description of Artificial Sequence: Synthetic oligonucleotide
  Target: ATXN1; (-) strand; PAM type: YTN; PAM sequence: CTC
tggttaaccctccggcacta

SEQ ID NO: 223168 - DNA, 20 bp, Artificial Sequence
  Description of Artificial Sequence: Synthetic oligonucleotide
  Target: ATXN1; (-) strand; PAM type: YTN; PAM sequence: CTC
tctggttaaccctccggcac

SEQ ID NO: 223169 - DNA, 20 bp, Artificial Sequence
  Description of Artificial Sequence: Synthetic oligonucleotide
  Target: ATXN1; (-) strand; PAM type: YTN; PAM sequence: TTG
ccaggaagaaaactctctgg

SEQ ID NO: 223170 - DNA, 20 bp, Artificial Sequence
  Description of Artificial Sequence: Synthetic oligonucleotide
  Target: ATXN1; (-) strand; PAM type: YTN; PAM sequence: TTT
gccaggaagaaaactctctg

SEQ ID NO: 223171 - DNA, 20 bp, Artificial Sequence
  Description of Artificial Sequence: Synthetic oligonucleotide
  Target: ATXN1; (-) strand; PAM type: YTN; PAM sequence: TTA
atacccatggtggcggcaga

SEQ ID NO: 223172 - DNA, 20 bp, Artificial Sequence
  Description of Artificial Sequence: Synthetic oligonucleotide
  Target: ATXN1; (-) strand; PAM type: YTN; PAM sequence: CTG
gagtgttaatacccatggtg

SEQ ID NO: 223173 - DNA, 20 bp, Artificial Sequence
  Description of Artificial Sequence: Synthetic oligonucleotide
  Target: ATXN1; (-) strand; PAM type: YTN; PAM sequence: TTG
cagggatcctggagtgttaa

SEQ ID NO: 223174 - DNA, 20 bp, Artificial Sequence
  Description of Artificial Sequence: Synthetic oligonucleotide
  Target: ATXN1; (-) strand; PAM type: YTN; PAM sequence: CTC
agggcaggggatgaggaata

SEQ ID NO: 223175 - DNA, 20 bp, Artificial Sequence
  Description of Artificial Sequence: Synthetic oligonucleotide
  Target: ATXN1; (-) strand; PAM type: YTN; PAM sequence: TTG
ggcacagataatatctcagg

SEQ ID NO: 223176 - DNA, 20 bp, Artificial Sequence
  Description of Artificial Sequence: Synthetic oligonucleotide
  Target: ATXN1; (-) strand; PAM type: YTN; PAM sequence: CTT
gggcacagataatatctcag

SEQ ID NO: 223177 - DNA, 20 bp, Artificial Sequence
  Description of Artificial Sequence: Synthetic oligonucleotide
  Target: ATXN1; (-) strand; PAM type: YTN; PAM sequence: CTG
cagcttgggcacagataata

SEQ ID NO: 223178 - DNA, 20 bp, Artificial Sequence
  Description of Artificial Sequence: Synthetic oligonucleotide
  Target: ATXN1; (-) strand; PAM type: YTN; PAM sequence: CTC
aacccctgcagcttgggcac

SEQ ID NO: 223179 - DNA, 20 bp, Artificial Sequence
  Description of Artificial Sequence: Synthetic oligonucleotide
  Target: ATXN1; (-) strand; PAM type: YTN; PAM sequence: TTG
gcaccagatgtgtgacctca

SEQ ID NO: 223180 - DNA, 20 bp, Artificial Sequence
  Description of Artificial Sequence: Synthetic oligonucleotide
  Target: ATXN1; (-) strand; PAM type: YTN; PAM sequence: CTT
ggcaccagatgtgtgacctc

SEQ ID NO: 223181 - DNA, 20 bp, Artificial Sequence
  Description of Artificial Sequence: Synthetic oligonucleotide
  Target: ATXN1; (-) strand; PAM type: YTN; PAM sequence: CTC
cttggcaccagatgtgtgac

SEQ ID NO: 223182 - DNA, 20 bp, Artificial Sequence
  Description of Artificial Sequence: Synthetic oligonucleotide
  Target: ATXN1; (-) strand; PAM type: YTN; PAM sequence: CTG
acagctccttggcaccagat

SEQ ID NO: 223183 - DNA, 20 bp, Artificial Sequence
  Description of Artificial Sequence: Synthetic oligonucleotide
  Target: ATXN1; (-) strand; PAM type: YTN; PAM sequence: CTG
gaggcactgacagctccttg

SEQ ID NO: 223184 - DNA, 20 bp, Artificial Sequence
  Description of Artificial Sequence: Synthetic oligonucleotide
  Target: ATXN1; (-) strand; PAM type: YTN; PAM sequence: CTG
ctggaggcactgacagctcc

SEQ ID NO: 223185 - DNA, 20 bp, Artificial Sequence
  Description of Artificial Sequence: Synthetic oligonucleotide
  Target: ATXN1; (-) strand; PAM type: YTN; PAM sequence: CTG
tgccactgctggaggcactg

SEQ ID NO: 223186 - DNA, 20 bp, Artificial Sequence
  Description of Artificial Sequence: Synthetic oligonucleotide
  Target: ATXN1; (-) strand; PAM type: YTN; PAM sequence: CTG
tcagcatgccagaccaaggg

SEQ ID NO: 223187 - DNA, 20 bp, Artificial Sequence
  Description of Artificial Sequence: Synthetic oligonucleotide
  Target: ATXN1; (-) strand; PAM type: YTN; PAM sequence: TTC
tgtcagcatgccagaccaag

SEQ ID NO: 223188 - DNA, 20 bp, Artificial Sequence
  Description of Artificial Sequence: Synthetic oligonucleotide
  Target: ATXN1; (-) strand; PAM type: YTN; PAM sequence: TTT
ctgtcagcatgccagaccaa

SEQ ID NO: 223189 - DNA, 20 bp, Artificial Sequence
  Description of Artificial Sequence: Synthetic oligonucleotide
  Target: ATXN1; (-) strand; PAM type: YTN; PAM sequence: TTT
tctgtcagcatgccagacca

SEQ ID NO: 223190 - DNA, 20 bp, Artificial Sequence
  Description of Artificial Sequence: Synthetic oligonucleotide
  Target: ATXN1; (-) strand; PAM type: YTN; PAM sequence: CTG
agtcacagacaaatgatgaa

SEQ ID NO: 223191 - DNA, 20 bp, Artificial Sequence
  Description of Artificial Sequence: Synthetic oligonucleotide
  Target: ATXN1; (-) strand; PAM type: YTN; PAM sequence: CTC
tgagtcacagacaaatgatg

SEQ ID NO: 223192 - DNA, 20 bp, Artificial Sequence
  Description of Artificial Sequence: Synthetic oligonucleotide
  Target: ATXN1; (-) strand; PAM type: YTN; PAM sequence: CTG
cctctgagtcacagacaaat

SEQ ID NO: 223193 - DNA, 20 bp, Artificial Sequence
  Description of Artificial Sequence: Synthetic oligonucleotide
  Target: ATXN1; (-) strand; PAM type: YTN; PAM sequence: TTG
gccccatggtctgcctctga

SEQ ID NO: 223194 - DNA, 20 bp, Artificial Sequence
  Description of Artificial Sequence: Synthetic oligonucleotide
  Target: ATXN1; (-) strand; PAM type: YTN; PAM sequence: TTG
ttggccccatggtctgcctc

SEQ ID NO: 223195 - DNA, 20 bp, Artificial Sequence
  Description of Artificial Sequence: Synthetic oligonucleotide
  Target: ATXN1; (-) strand; PAM type: YTN; PAM sequence: TTT
gttggccccatggtctgcct

SEQ ID NO: 223196 - DNA, 20 bp, Artificial Sequence
  Description of Artificial Sequence: Synthetic oligonucleotide
  Target: ATXN1; (-) strand; PAM type: YTN; PAM sequence: CTG
gatttgttggccccatggtc

SEQ ID NO: 223197 - DNA, 20 bp, Artificial Sequence
  Description of Artificial Sequence: Synthetic oligonucleotide
  Target: ATXN1; (-) strand; PAM type: YTN; PAM sequence: TTC
aagcgtgatcatgggctgga

SEQ ID NO: 223198 - DNA, 20 bp, Artificial Sequence
  Description of Artificial Sequence: Synthetic oligonucleotide
  Target: ATXN1; (-) strand; PAM type: YTN; PAM sequence: CTT
caagcgtgatcatgggctgg

SEQ ID NO: 223199 - DNA, 20 bp, Artificial Sequence
  Description of Artificial Sequence: Synthetic oligonucleotide
  Target: ATXN1; (-) strand; PAM type: YTN; PAM sequence: CTG
tgccttcaagcgtgatcatg

SEQ ID NO: 223200 - DNA, 20 bp, Artificial Sequence
  Description of Artificial Sequence: Synthetic oligonucleotide
  Target: ATXN1; (-) strand; PAM type: YTN; PAM sequence: CTA
gatatccctgtgccttcaag

SEQ ID NO: 223201 - DNA, 20 bp, Artificial Sequence
  Description of Artificial Sequence: Synthetic oligonucleotide
  Target: ATXN1; (-) strand; PAM type: YTN; PAM sequence: TTC
tagatatccctgtgccttca

SEQ ID NO: 223202 - DNA, 20 bp, Artificial Sequence
  Description of Artificial Sequence: Synthetic oligonucleotide
  Target: ATXN1; (-) strand; PAM type: YTN; PAM sequence: CTT
ctagatatccctgtgccttc

SEQ ID NO: 223203 - DNA, 20 bp, Artificial Sequence
  Description of Artificial Sequence: Synthetic oligonucleotide
  Target: ATXN1; (-) strand; PAM type: YTN; PAM sequence: TTG
ggggatgacttctagatatc

SEQ ID NO: 223204 - DNA, 20 bp, Artificial Sequence
  Description of Artificial Sequence: Synthetic oligonucleotide
  Target: ATXN1; (-) strand; PAM type: YTN; PAM sequence: TTT
gggggatgacttctagatat

SEQ ID NO: 223205 - DNA, 20 bp, Artificial Sequence
  Description of Artificial Sequence: Synthetic oligonucleotide
  Target: ATXN1; (-) strand; PAM type: YTN; PAM sequence: CTG
aagtttgggggatgacttct

SEQ ID NO: 223206 - DNA, 20 bp, Artificial Sequence
  Description of Artificial Sequence: Synthetic oligonucleotide
  Target: ATXN1; (-) strand; PAM type: YTN; PAM sequence: TTG
acaatagtccctgaagtttg

SEQ ID NO: 223207 - DNA, 20 bp, Artificial Sequence
  Description of Artificial Sequence: Synthetic oligonucleotide
  Target: ATXN1; (-) strand; PAM type: YTN; PAM sequence: TTT
gacaatagtccctgaagttt

SEQ ID NO: 223208 - DNA, 20 bp, Artificial Sequence
  Description of Artificial Sequence: Synthetic oligonucleotide
  Target: ATXN1; (-) strand; PAM type: YTN; PAM sequence: CTG
tatcccaagaaggtttgaca

SEQ ID NO: 223209 - DNA, 20 bp, Artificial Sequence
  Description of Artificial Sequence: Synthetic oligonucleotide
  Target: ATXN1; (-) strand; PAM type: YTN; PAM sequence: CTG
agaaatatgtctgtatccca

SEQ ID NO: 223210 - DNA, 20 bp, Artificial Sequence
  Description of Artificial Sequence: Synthetic oligonucleotide
  Target: ATXN1; (-) strand; PAM type: YTN; PAM sequence: TTC
caaaggagatctgagaaata

SEQ ID NO: 223211 - DNA, 20 bp, Artificial Sequence
  Description of Artificial Sequence: Synthetic oligonucleotide
  Target: ATXN1; (-) strand; PAM type: YTN; PAM sequence: TTT
ccaaaggagatctgagaaat

SEQ ID NO: 223212 - DNA, 20 bp, Artificial Sequence
  Description of Artificial Sequence: Synthetic oligonucleotide
  Target: ATXN1; (-) strand; PAM type: YTN; PAM sequence: CTT
tccaaaggagatctgagaaa

SEQ ID NO: 223213 - DNA, 20 bp, Artificial Sequence
  Description of Artificial Sequence: Synthetic oligonucleotide
  Target: ATXN1; (-) strand; PAM type: YTN; PAM sequence: CTA
agatctttccaaaggagatc

SEQ ID NO: 223214 - DNA, 20 bp, Artificial Sequence
  Description of Artificial Sequence: Synthetic oligonucleotide
  Target: ATXN1; (-) strand; PAM type: YTN; PAM sequence: CTG
tcaagcaagtctaagatctt

SEQ ID NO: 223215 - DNA, 20 bp, Artificial Sequence
  Description of Artificial Sequence: Synthetic oligonucleotide
  Target: ATXN1; (-) strand; PAM type: YTN; PAM sequence: CTC
caaggacccctgtcaagcaa

SEQ ID NO: 223216 - DNA, 20 bp, Artificial Sequence
  Description of Artificial Sequence: Synthetic oligonucleotide
  Target: ATXN1; (-) strand; PAM type: YTN; PAM sequence: TTG
atcatctccaaggacccctg

SEQ ID NO: 223217 - DNA, 20 bp, Artificial Sequence
  Description of Artificial Sequence: Synthetic oligonucleotide
  Target: ATXN1; (-) strand; PAM type: YTN; PAM sequence: TTT
gatcatctccaaggacccct

SEQ ID NO: 223218 - DNA, 20 bp, Artificial Sequence
  Description of Artificial Sequence: Synthetic oligonucleotide
  Target: ATXN1; (-) strand; PAM type: YTN; PAM sequence: TTA
tggatttgatcatctccaag

SEQ ID NO: 223219 - DNA, 20 bp, Artificial Sequence
  Description of Artificial Sequence: Synthetic oligonucleotide
  Target: ATXN1; (-) strand; PAM type: YTN; PAM sequence: TTA
aaatgagaggagggttatgg

SEQ ID NO: 223220 - DNA, 20 bp, Artificial Sequence
  Description of Artificial Sequence: Synthetic oligonucleotide
  Target: ATXN1; (-) strand; PAM type: YTN; PAM sequence: TTT
aaaatgagaggagggttatg

SEQ ID NO: 223221 - DNA, 20 bp, Artificial Sequence
  Description of Artificial Sequence: Synthetic oligonucleotide
  Target: ATXN1; (-) strand; PAM type: YTN; PAM sequence: CTT
taaaatgagaggagggttat

SEQ ID NO: 223222 - DNA, 20 bp, Artificial Sequence
  Description of Artificial Sequence: Synthetic oligonucleotide
  Target: ATXN1; (-) strand; PAM type: YTN; PAM sequence: CTC
ccataaagaatccaataaag

SEQ ID NO: 223223 - DNA, 20 bp, Artificial Sequence
  Description of Artificial Sequence: Synthetic oligonucleotide
  Target: ATXN1; (-) strand; PAM type: YTN; PAM sequence: TTG
gtctcccataaagaatccaa

SEQ ID NO: 223224 - DNA, 20 bp, Artificial Sequence
  Description of Artificial Sequence: Synthetic oligonucleotide
  Target: ATXN1; (-) strand; PAM type: YTN; PAM sequence: CTT
ggtctcccataaagaatcca

SEQ ID NO: 223225 - DNA, 20 bp, Artificial Sequence
  Description of Artificial Sequence: Synthetic oligonucleotide
  Target: ATXN1; (-) strand; PAM type: YTN; PAM sequence: TTG
gtccacaggaagcaatccaa

SEQ ID NO: 223226 - DNA, 20 bp, Artificial Sequence
  Description of Artificial Sequence: Synthetic oligonucleotide
  Target: ATXN1; (-) strand; PAM type: YTN; PAM sequence: CTT
ggtccacaggaagcaatcca

SEQ ID NO: 223227 - DNA, 20 bp, Artificial Sequence
  Description of Artificial Sequence: Synthetic oligonucleotide
  Target: ATXN1; (-) strand; PAM type: YTN; PAM sequence: CTA
gaaaacatcatccttggtcc

SEQ ID NO: 223228 - DNA, 20 bp, Artificial Sequence
  Description of Artificial Sequence: Synthetic oligonucleotide
  Target: ATXN1; (-) strand; PAM type: YTN; PAM sequence: TTC
aataagtccctagaaaacat

SEQ ID NO: 223229 - DNA, 20 bp, Artificial Sequence
  Description of Artificial Sequence: Synthetic oligonucleotide
  Target: ATXN1; (-) strand; PAM type: YTN; PAM sequence: TTT
caataagtccctagaaaaca

SEQ ID NO: 223230 - DNA, 20 bp, Artificial Sequence
  Description of Artificial Sequence: Synthetic oligonucleotide
  Target: ATXN1; (-) strand; PAM type: YTN; PAM sequence: CTC
aagtttcaataagtccctag

SEQ ID NO: 223231 - DNA, 20 bp, Artificial Sequence
  Description of Artificial Sequence: Synthetic oligonucleotide
  Target: ATXN1; (-) strand; PAM type: YTN; PAM sequence: CTC
tcaagtttcaataagtccct

SEQ ID NO: 223232 - DNA, 20 bp, Artificial Sequence
  Description of Artificial Sequence: Synthetic oligonucleotide
  Target: ATXN1; (-) strand; PAM type: YTN; PAM sequence: TTC
cgactctcaagtttcaataa

SEQ ID NO: 223233 - DNA, 20 bp, Artificial Sequence
  Description of Artificial Sequence: Synthetic oligonucleotide
  Target: ATXN1; (-) strand; PAM type: YTN; PAM sequence: CTT
ccgactctcaagtttcaata

SEQ ID NO: 223234 - DNA, 20 bp, Artificial Sequence
  Description of Artificial Sequence: Synthetic oligonucleotide
  Target: ATXN1; (-) strand; PAM type: YTN; PAM sequence: TTC
agaccacttccgactctcaa

SEQ ID NO: 223235 - DNA, 20 bp, Artificial Sequence
  Description of Artificial Sequence: Synthetic oligonucleotide
  Target: ATXN1; (-) strand; PAM type: YTN; PAM sequence: CTT
cagaccacttccgactctca

SEQ ID NO: 223236 - DNA, 20 bp, Artificial Sequence
  Description of Artificial Sequence: Synthetic oligonucleotide
  Target: ATXN1; (-) strand; PAM type: YTN; PAM sequence: CTA
aatcaaacaatccttcagac

SEQ ID NO: 223237 - DNA, 20 bp, Artificial Sequence
  Description of Artificial Sequence: Synthetic oligonucleotide
  Target: ATXN1; (-) strand; PAM type: YTN; PAM sequence: TTC
acaggaccactaaatcaaac

SEQ ID NO: 223238 - DNA, 20 bp, Artificial Sequence
  Description of Artificial Sequence: Synthetic oligonucleotide
  Target: ATXN1; (-) strand; PAM type: YTN; PAM sequence: TTA
ggcaatgtcagttcacagga

SEQ ID NO: 223239 - DNA, 20 bp, Artificial Sequence
  Description of Artificial Sequence: Synthetic oligonucleotide
  Target: ATXN1; (-) strand; PAM type: YTN; PAM sequence: CTA
ttaggcaatgtcagttcaca

SEQ ID NO: 223240 - DNA, 20 bp, Artificial Sequence
  Description of Artificial Sequence: Synthetic oligonucleotide
  Target: ATXN1; (-) strand; PAM type: YTN; PAM sequence: TTA
caacagctattaggcaatgt

SEQ ID NO: 223241 - DNA, 20 bp, Artificial Sequence
  Description of Artificial Sequence: Synthetic oligonucleotide
  Target: ATXN1; (-) strand; PAM type: YTN; PAM sequence: TTA
tgttacaacagctattaggc

SEQ ID NO: 223242 - DNA, 20 bp, Artificial Sequence
  Description of Artificial Sequence: Synthetic oligonucleotide
  Target: ATXN1; (-) strand; PAM type: YTN; PAM sequence: TTT
atgttacaacagctattagg

SEQ ID NO: 223243 - DNA, 20 bp, Artificial Sequence
  Description of Artificial Sequence: Synthetic oligonucleotide
  Target: ATXN1; (-) strand; PAM type: YTN; PAM sequence: CTT
tatgttacaacagctattag

SEQ ID NO: 223244 - DNA, 20 bp, Artificial Sequence
  Description of Artificial Sequence: Synthetic oligonucleotide
  Target: ATXN1; (-) strand; PAM type: YTN; PAM sequence: CTG
agaatctttatgttacaaca

SEQ ID NO: 223245 - DNA, 20 bp, Artificial Sequence
  Description of Artificial Sequence: Synthetic oligonucleotide
  Target: ATXN1; (-) strand; PAM type: YTN; PAM sequence: CTG
agacctgagaatctttatgt

SEQ ID NO: 223246 - DNA, 20 bp, Artificial Sequence
  Description of Artificial Sequence: Synthetic oligonucleotide
  Target: ATXN1; (-) strand; PAM type: YTN; PAM sequence: TTG
ggtaaggggtggggctgaga

SEQ ID NO: 223247 - DNA, 20 bp, Artificial Sequence
  Description of Artificial Sequence: Synthetic oligonucleotide
  Target: ATXN1; (-) strand; PAM type: YTN; PAM sequence: TTT
gggtaaggggtggggctgag

SEQ ID NO: 223248 - DNA, 20 bp, Artificial Sequence
  Description of Artificial Sequence: Synthetic oligonucleotide
  Target: ATXN1; (-) strand; PAM type: YTN; PAM sequence: TTA
gccaagggtttgggtaaggg

SEQ ID NO: 223249 - DNA, 20 bp, Artificial Sequence
  Description of Artificial Sequence: Synthetic oligonucleotide
  Target: ATXN1; (-) strand; PAM type: YTN; PAM sequence: CTG
tggaattagccaagggtttg

SEQ ID NO: 223250 - DNA, 20 bp, Artificial Sequence
  Description of Artificial Sequence: Synthetic oligonucleotide
  Target: ATXN1; (-) strand; PAM type: YTN; PAM sequence: CTC
tgtggaattagccaagggtt

SEQ ID NO: 223251 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagtgagacaggc

SEQ ID NO: 223252 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcgacagagtga

SEQ ID NO: 223253 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcgacag

SEQ ID NO: 223254 - DNA, 20 bp, Artificial Sequence
  Description of Artificial Sequence: Synthetic oligonucleotide
  Target: ATXN1; (-) strand; PAM type: YTN; PAM sequence: CTG
gagagccactgcactccagc

SEQ ID NO: 223255 - DNA, 20 bp, Artificial Sequence
  Description of Artificial Sequence: Synthetic oligonucleotide
  Target: ATXN1; (-) strand; PAM type: YTN; PAM sequence: TTC
agaaaaccctggagagccac

SEQ ID NO: 223256 - DNA, 20 bp, Artificial Sequence
  Description of Artificial Sequence: Synthetic oligonucleotide
  Target: ATXN1; (-) strand; PAM type: YTN; PAM sequence: CTT
cagaaaaccctggagagcca

SEQ ID NO: 223257 - DNA, 20 bp, Artificial Sequence
  Description of Artificial Sequence: Synthetic oligonucleotide
  Target: ATXN1; (-) strand; PAM type: YTN; PAM sequence: TTC
aaatgtggcttcagaaaacc

SEQ ID NO: 223258 - DNA, 20 bp, Artificial Sequence
  Description of Artificial Sequence: Synthetic oligonucleotide
  Target: ATXN1; (-) strand; PAM type: YTN; PAM sequence: TTT
caaatgtggcttcagaaaac

SEQ ID NO: 223259 - DNA, 20 bp, Artificial Sequence
  Description of Artificial Sequence: Synthetic oligonucleotide
  Target: ATXN1; (-) strand; PAM type: YTN; PAM sequence: TTT
tcaaatgtggcttcagaaaa

SEQ ID NO: 223260 - DNA, 20 bp, Artificial Sequence
  Description of Artificial Sequence: Synthetic oligonucleotide
  Target: ATXN1; (-) strand; PAM type: YTN; PAM sequence: TTA
tataagtggttttcaaatgt

SEQ ID NO: 223261 - DNA, 20 bp, Artificial Sequence
  Description of Artificial Sequence: Synthetic oligonucleotide
  Target: ATXN1; (-) strand; PAM type: YTN; PAM sequence: TTG
ggttatataagtggttttca

SEQ ID NO: 223262 - DNA, 20 bp, Artificial Sequence
  Description of Artificial Sequence: Synthetic oligonucleotide
  Target: ATXN1; (-) strand; PAM type: YTN; PAM sequence: TTA
ggaaaatgaggaagttgggt

SEQ ID NO: 223263 - DNA, 20 bp, Artificial Sequence
  Description of Artificial Sequence: Synthetic oligonucleotide
  Target: ATXN1; (-) strand; PAM type: YTN; PAM sequence: CTT
aggaaaatgaggaagttggg

SEQ ID NO: 223264 - DNA, 20 bp, Artificial Sequence
  Description of Artificial Sequence: Synthetic oligonucleotide
  Target: ATXN1; (-) strand; PAM type: YTN; PAM sequence: CTG
agccttaggaaaatgaggaa

SEQ ID NO: 223265 - DNA, 20 bp, Artificial Sequence
  Description of Artificial Sequence: Synthetic oligonucleotide
  Target: ATXN1; (-) strand; PAM type: YTN; PAM sequence: CTC
tgagccttaggaaaatgagg

SEQ ID NO: 223266 - DNA, 20 bp, Artificial Sequence
  Description of Artificial Sequence: Synthetic oligonucleotide
  Target: ATXN1; (-) strand; PAM type: YTN; PAM sequence: TTC
tctgagccttaggaaaatga

SEQ ID NO: 223267 - DNA, 20 bp, Artificial Sequence
  Description of Artificial Sequence: Synthetic oligonucleotide
  Target: ATXN1; (-) strand; PAM type: YTN; PAM sequence: TTG
gcaaataaccgaagttctct

SEQ ID NO: 223268 - DNA, 20 bp, Artificial Sequence
  Description of Artificial Sequence: Synthetic oligonucleotide
  Target: ATXN1; (-) strand; PAM type: YTN; PAM sequence: TTT
ggcaaataaccgaagttctc

SEQ ID NO: 223269 - DNA, 20 bp, Artificial Sequence
  Description of Artificial Sequence: Synthetic oligonucleotide
  Target: ATXN1; (-) strand; PAM type: YTN; PAM sequence: CTT
tggcaaataaccgaagttct

SEQ ID NO: 223270 - DNA, 20 bp, Artificial Sequence
  Description of Artificial Sequence: Synthetic oligonucleotide
  Target: ATXN1; (-) strand; PAM type: YTN; PAM sequence: TTG
tgcggcctttggcaaataac

SEQ ID NO: 223271 - DNA, 20 bp, Artificial Sequence
  Description of Artificial Sequence: Synthetic oligonucleotide
  Target: ATXN1; (-) strand; PAM type: YTN; PAM sequence: CTG
ttgtgcggcctttggcaaat

SEQ ID NO: 223272 - DNA, 20 bp, Artificial Sequence
  Description of Artificial Sequence: Synthetic oligonucleotide
  Target: ATXN1; (-) strand; PAM type: YTN; PAM sequence: TTA
actgttgtgcggcctttggc

SEQ ID NO: 223273 - DNA, 20 bp, Artificial Sequence
  Description of Artificial Sequence: Synthetic oligonucleotide
  Target: ATXN1; (-) strand; PAM type: YTN; PAM sequence: CTG
tcattaactgttgtgcggcc

SEQ ID NO: 223274 - DNA, 20 bp, Artificial Sequence
  Description of Artificial Sequence: Synthetic oligonucleotide
  Target: ATXN1; (-) strand; PAM type: YTN; PAM sequence: TTA
ggcctgtcattaactgttgt

SEQ ID NO: 223275 - DNA, 20 bp, Artificial Sequence
  Description of Artificial Sequence: Synthetic oligonucleotide
  Target: ATXN1; (-) strand; PAM type: YTN; PAM sequence: CTT
aggcctgtcattaactgttg

SEQ ID NO: 223276 - DNA, 20 bp, Artificial Sequence
  Description of Artificial Sequence: Synthetic oligonucleotide
  Target: ATXN1; (-) strand; PAM type: YTN; PAM sequence: CTG
ggtggaagtcttaggcctgt

SEQ ID NO: 223277 - DNA, 20 bp, Artificial Sequence
  Description of Artificial Sequence: Synthetic oligonucleotide
  Target: ATXN1; (-) strand; PAM type: YTN; PAM sequence: CTG
ggaactgggtggaagtctta

SEQ ID NO: 223278 - DNA, 20 bp, Artificial Sequence
  Description of Artificial Sequence: Synthetic oligonucleotide
  Target: ATXN1; (-) strand; PAM type: YTN; PAM sequence: TTG
agcacgctgggaactgggtg

SEQ ID NO: 223279 - DNA, 20 bp, Artificial Sequence
  Description of Artificial Sequence: Synthetic oligonucleotide
  Target: ATXN1; (-) strand; PAM type: YTN; PAM sequence: CTG
gttgagcacgctgggaactg

SEQ ID NO: 223280 - DNA, 20 bp, Artificial Sequence
  Description of Artificial Sequence: Synthetic oligonucleotide
  Target: ATXN1; (-) strand; PAM type: YTN; PAM sequence: CTC
agaaagtaaatgcaaagacc

SEQ ID NO: 223281 - DNA, 20 bp, Artificial Sequence
  Description of Artificial Sequence: Synthetic oligonucleotide
  Target: ATXN1; (-) strand; PAM type: YTN; PAM sequence: CTA
aatgctcagaaagtaaatgc

SEQ ID NO: 223282 - DNA, 20 bp, Artificial Sequence
  Description of Artificial Sequence: Synthetic oligonucleotide
  Target: ATXN1; (-) strand; PAM type: YTN; PAM sequence: CTG
aacgctaaatgctcagaaag

SEQ ID NO: 223283 - DNA, 20 bp, Artificial Sequence
  Description of Artificial Sequence: Synthetic oligonucleotide
  Target: ATXN1; (-) strand; PAM type: YTN; PAM sequence: TTA
ctgaacgctaaatgctcaga

SEQ ID NO: 223284 - DNA, 20 bp, Artificial Sequence
  Description of Artificial Sequence: Synthetic oligonucleotide
  Target: ATXN1; (-) strand; PAM type: YTN; PAM sequence: TTT
actgaacgctaaatgctcag

SEQ ID NO: 223285 - DNA, 20 bp, Artificial Sequence
  Description of Artificial Sequence: Synthetic oligonucleotide
  Target: ATXN1; (-) strand; PAM type: YTN; PAM sequence: TTT
tactgaacgctaaatgctca

SEQ ID NO: 223286 - DNA, 20 bp, Artificial Sequence
  Description of Artificial Sequence: Synthetic oligonucleotide
  Target: ATXN1; (-) strand; PAM type: YTN; PAM sequence: TTG
aggttttactgaacgctaaa

SEQ ID NO: 223287 - DNA, 20 bp, Artificial Sequence
  Description of Artificial Sequence: Synthetic oligonucleotide
  Target: ATXN1; (-) strand; PAM type: YTN; PAM sequence: TTA
gcagagagtaaatgattgag

SEQ ID NO: 223288 - DNA, 20 bp, Artificial Sequence
  Description of Artificial Sequence: Synthetic oligonucleotide
  Target: ATXN1; (-) strand; PAM type: YTN; PAM sequence: CTA
ttagcagagagtaaatgatt

SEQ ID NO: 223289 - DNA, 20 bp, Artificial Sequence
  Description of Artificial Sequence: Synthetic oligonucleotide
  Target: ATXN1; (-) strand; PAM type: YTN; PAM sequence: CTC
tattagcagagagtaaatga

SEQ ID NO: 223290 - DNA, 20 bp, Artificial Sequence
  Description of Artificial Sequence: Synthetic oligonucleotide
  Target: ATXN1; (-) strand; PAM type: YTN; PAM sequence: TTA
tctctattagcagagagtaa

SEQ ID NO: 223291 - DNA, 20 bp, Artificial Sequence
  Description of Artificial Sequence: Synthetic oligonucleotide
  Target: ATXN1; (-) strand; PAM type: YTN; PAM sequence: TTA
agaatacattatctctatta

SEQ ID NO: 223292 - DNA, 20 bp, Artificial Sequence
  Description of Artificial Sequence: Synthetic oligonucleotide
  Target: ATXN1; (-) strand; PAM type: YTN; PAM sequence: TTC
attaagaatacattatctct

SEQ ID NO: 223293 - DNA, 20 bp, Artificial Sequence
  Description of Artificial Sequence: Synthetic oligonucleotide
  Target: ATXN1; (-) strand; PAM type: YTN; PAM sequence: TTA
tatattcattaagaatacat

SEQ ID NO: 223294 - DNA, 20 bp, Artificial Sequence
  Description of Artificial Sequence: Synthetic oligonucleotide
  Target: ATXN1; (-) strand; PAM type: YTN; PAM sequence: TTG
aattatatattcattaagaa

SEQ ID NO: 223295 - DNA, 20 bp, Artificial Sequence
  Description of Artificial Sequence: Synthetic oligonucleotide
  Target: ATXN1; (-) strand; PAM type: YTN; PAM sequence: TTC
aaggaaattgaattatatat

SEQ ID NO: 223296 - DNA, 20 bp, Artificial Sequence
  Description of Artificial Sequence: Synthetic oligonucleotide
  Target: ATXN1; (-) strand; PAM type: YTN; PAM sequence: TTA
tataatacattcaaggaaat

SEQ ID NO: 223297 - DNA, 20 bp, Artificial Sequence
  Description of Artificial Sequence: Synthetic oligonucleotide
  Target: ATXN1; (-) strand; PAM type: YTN; PAM sequence: TTA
taggttatataatacattca

SEQ ID NO: 223298 - DNA, 20 bp, Artificial Sequence
  Description of Artificial Sequence: Synthetic oligonucleotide
  Target: ATXN1; (-) strand; PAM type: YTN; PAM sequence: TTT
ataggttatataatacattc

SEQ ID NO: 223299 - DNA, 20 bp, Artificial Sequence
  Description of Artificial Sequence: Synthetic oligonucleotide
  Target: ATXN1; (-) strand; PAM type: YTN; PAM sequence: TTT
tataggttatataatacatt

SEQ ID NO: 223300 - DNA, 20 bp, Artificial Sequence
  Description of Artificial Sequence: Synthetic oligonucleotide
  Target: ATXN1; (-) strand; PAM type: YTN; PAM sequence: CTA
aaattttataggttatataa

SEQ ID NO: 223301 - DNA, 20 bp, Artificial Sequence
  Description of Artificial Sequence: Synthetic oligonucleotide
  Target: ATXN1; (-) strand; PAM type: YTN; PAM sequence: CTA
ataagatcctaaaattttat

SEQ ID NO: 223302 - DNA, 20 bp, Artificial Sequence
  Description of Artificial Sequence: Synthetic oligonucleotide
  Target: ATXN1; (-) strand; PAM type: YTN; PAM sequence: TTG
ctaataagatcctaaaattt

SEQ ID NO: 223303 - DNA, 20 bp, Artificial Sequence
  Description of Artificial Sequence: Synthetic oligonucleotide
  Target: ATXN1; (-) strand; PAM type: YTN; PAM sequence: CTT
gctaataagatcctaaaatt

SEQ ID NO: 223304 - DNA, 20 bp, Artificial Sequence
  Description of Artificial Sequence: Synthetic oligonucleotide
  Target: ATXN1; (-) strand; PAM type: YTN; PAM sequence: TTA
acttgctaataagatcctaa

SEQ ID NO: 223305 - DNA, 20 bp, Artificial Sequence
  Description of Artificial Sequence: Synthetic oligonucleotide
  Target: ATXN1; (-) strand; PAM type: YTN; PAM sequence: TTT
aacttgctaataagatccta

SEQ ID NO: 223306 - DNA, 20 bp, Artificial Sequence
  Description of Artificial Sequence: Synthetic oligonucleotide
  Target: ATXN1; (-) strand; PAM type: YTN; PAM sequence: TTA
agaaaggagacatttaactt

SEQ ID NO: 223307 - DNA, 20 bp, Artificial Sequence
  Description of Artificial Sequence: Synthetic oligonucleotide
  Target: ATXN1; (-) strand; PAM type: YTN; PAM sequence: TTT
aagaaaggagacatttaact

SEQ ID NO: 223308 - DNA, 20 bp, Artificial Sequence
  Description of Artificial Sequence: Synthetic oligonucleotide
  Target: ATXN1; (-) strand; PAM type: YTN; PAM sequence: CTA
atttaagaaaggagacattt

SEQ ID NO: 223309 - DNA, 20 bp, Artificial Sequence
  Description of Artificial Sequence: Synthetic oligonucleotide
  Target: ATXN1; (-) strand; PAM type: YTN; PAM sequence: TTC
aaaaaaaaaaaaccagccct

SEQ ID NO: 223310 - DNA, 20 bp, Artificial Sequence
  Description of Artificial Sequence: Synthetic oligonucleotide
  Target: ATXN1; (-) strand; PAM type: YTN; PAM sequence: CTT
caaaaaaaaaaaaccagccc

SEQ ID NO: 223311 - DNA, 20 bp, Artificial Sequence
  Description of Artificial Sequence: Synthetic oligonucleotide
  Target: ATXN1; (-) strand; PAM type: YTN; PAM sequence: TTC
ttcaaaaaaaaaaaaccagc

SEQ ID NO: 223312 - DNA, 20 bp, Artificial Sequence
  Description of Artificial Sequence: Synthetic oligonucleotide
  Target: ATXN1; (-) strand; PAM type: YTN; PAM sequence: TTA
attcttcaaaaaaaaaaaac

SEQ ID NO: 223313 - DNA, 20 bp, Artificial Sequence
  Description of Artificial Sequence: Synthetic oligonucleotide
  Target: ATXN1; (-) strand; PAM type: YTN; PAM sequence: CTT
aattcttcaaaaaaaaaaaa

SEQ ID NO: 223314 - DNA, 20 bp, Artificial Sequence
  Description of Artificial Sequence: Synthetic oligonucleotide
  Target: ATXN1; (-) strand; PAM type: YTN; PAM sequence: TTA
atgaagaatccttaattctt

SEQ ID NO: 223315 - DNA, 20 bp, Artificial Sequence
  Description of Artificial Sequence: Synthetic oligonucleotide
  Target: ATXN1; (-) strand; PAM type: YTN; PAM sequence: TTA
gaacatgaaggcgaattaat

SEQ ID NO: 223316 - DNA, 20 bp, Artificial Sequence
  Description of Artificial Sequence: Synthetic oligonucleotide
  Target: ATXN1; (-) strand; PAM type: YTN; PAM sequence: CTT
agaacatgaaggcgaattaa

SEQ ID NO: 223317 - DNA, 20 bp, Artificial Sequence
  Description of Artificial Sequence: Synthetic oligonucleotide
  Target: ATXN1; (-) strand; PAM type: YTN; PAM sequence: CTC
ttagaacatgaaggcgaatt

SEQ ID NO: 223318 - DNA, 20 bp, Artificial Sequence
  Description of Artificial Sequence: Synthetic oligonucleotide
  Target: ATXN1; (-) strand; PAM type: YTN; PAM sequence: TTA
tcactcttagaacatgaagg

SEQ ID NO: 223319 - DNA, 20 bp, Artificial Sequence
  Description of Artificial Sequence: Synthetic oligonucleotide
  Target: ATXN1; (-) strand; PAM type: YTN; PAM sequence: CTT
atcactcttagaacatgaag

SEQ ID NO: 223320 - DNA, 20 bp, Artificial Sequence
  Description of Artificial Sequence: Synthetic oligonucleotide
  Target: ATXN1; (-) strand; PAM type: YTN; PAM sequence: CTC
ttatcactcttagaacatga

SEQ ID NO: 223321 - DNA, 20 bp, Artificial Sequence
  Description of Artificial Sequence: Synthetic oligonucleotide
  Target: ATXN1; (-) strand; PAM type: YTN; PAM sequence: TTC
ccgtgaagtctcttatcact

SEQ ID NO: 223322 - DNA, 20 bp, Artificial Sequence
  Description of Artificial Sequence: Synthetic oligonucleotide
  Target: ATXN1; (-) strand; PAM type: YTN; PAM sequence: TTT
cccgtgaagtctcttatcac

SEQ ID NO: 223323 - DNA, 20 bp, Artificial Sequence
  Description of Artificial Sequence: Synthetic oligonucleotide
  Target: ATXN1; (-) strand; PAM type: YTN; PAM sequence: TTG
tttcccgtgaagtctcttat

SEQ ID NO: 223324 - DNA, 20 bp, Artificial Sequence
  Description of Artificial Sequence: Synthetic oligonucleotide
  Target: ATXN1; (-) strand; PAM type: YTN; PAM sequence: TTT
gtttcccgtgaagtctctta

SEQ ID NO: 223325 - DNA, 20 bp, Artificial Sequence
  Description of Artificial Sequence: Synthetic oligonucleotide
  Target: ATXN1; (-) strand; PAM type: YTN; PAM sequence: CTG
atttgtttcccgtgaagtct

SEQ ID NO: 223326 - DNA, 20 bp, Artificial Sequence
  Description of Artificial Sequence: Synthetic oligonucleotide
  Target: ATXN1; (-) strand; PAM type: YTN; PAM sequence: TTC
tgatttgtttcccgtgaagt

SEQ ID NO: 223327 - DNA, 20 bp, Artificial Sequence
  Description of Artificial Sequence: Synthetic oligonucleotide
  Target: ATXN1; (-) strand; PAM type: YTN; PAM sequence: CTT
ctgatttgtttcccgtgaag

SEQ ID NO: 223328 - DNA, 20 bp, Artificial Sequence
  Description of Artificial Sequence: Synthetic oligonucleotide
  Target: ATXN1; (-) strand; PAM type: YTN; PAM sequence: TTG
tgcttctgatttgtttcccg

SEQ ID NO: 223329 - DNA, 20 bp, Artificial Sequence
  Description of Artificial Sequence: Synthetic oligonucleotide
  Target: ATXN1; (-) strand; PAM type: YTN; PAM sequence: CTT
gtgcttctgatttgtttccc

SEQ ID NO: 223330 - DNA, 20 bp, Artificial Sequence
  Description of Artificial Sequence: Synthetic oligonucleotide
  Target: ATXN1; (-) strand; PAM type: YTN; PAM sequence: CTC
acttgtgcttctgatttgtt

SEQ ID NO: 223331 - DNA, 20 bp, Artificial Sequence
  Description of Artificial Sequence: Synthetic oligonucleotide
  Target: ATXN1; (-) strand; PAM type: YTN; PAM sequence: TTC
actcacttgtgcttctgatt

SEQ ID NO: 223332 - DNA, 20 bp, Artificial Sequence
  Description of Artificial Sequence: Synthetic oligonucleotide
  Target: ATXN1; (-) strand; PAM type: YTN; PAM sequence: TTT
cactcacttgtgcttctgat

SEQ ID NO: 223333 - DNA, 20 bp, Artificial Sequence
  Description of Artificial Sequence: Synthetic oligonucleotide
  Target: ATXN1; (-) strand; PAM type: YTN; PAM sequence: CTA
aagaaaatttcactcacttg

SEQ ID NO: 223334 - DNA, 20 bp, Artificial Sequence
  Description of Artificial Sequence: Synthetic oligonucleotide
  Target: ATXN1; (-) strand; PAM type: YTN; PAM sequence: TTG
tcctaaagaaaatttcactc

SEQ ID NO: 223335 - DNA, 20 bp, Artificial Sequence
  Description of Artificial Sequence: Synthetic oligonucleotide
  Target: ATXN1; (-) strand; PAM type: YTN; PAM sequence: TTC
gttgtcctaaagaaaatttc

SEQ ID NO: 223336 - DNA, 20 bp, Artificial Sequence
  Description of Artificial Sequence: Synthetic oligonucleotide
  Target: ATXN1; (-) strand; PAM type: YTN; PAM sequence: TTT
cgttgtcctaaagaaaattt

SEQ ID NO: 223337 - DNA, 20 bp, Artificial Sequence
  Description of Artificial Sequence: Synthetic oligonucleotide
  Target: ATXN1; (-) strand; PAM type: YTN; PAM sequence: CTT
tcgttgtcctaaagaaaatt

SEQ ID NO: 223338 - DNA, 20 bp, Artificial Sequence
  Description of Artificial Sequence: Synthetic oligonucleotide
  Target: ATXN1; (-) strand; PAM type: YTN; PAM sequence: TTC
tttcgttgtcctaaagaaaa

SEQ ID NO: 223339 - DNA, 20 bp, Artificial Sequence
  Description of Artificial Sequence: Synthetic oligonucleotide
  Target: ATXN1; (-) strand; PAM type: YTN; PAM sequence: TTT
ctttcgttgtcctaaagaaa

SEQ ID NO: 223340 - DNA, 20 bp, Artificial Sequence
  Description of Artificial Sequence: Synthetic oligonucleotide
  Target: ATXN1; (-) strand; PAM type: YTN; PAM sequence: TTG
accatttctttcgttgtcct

SEQ ID NO: 223341 - DNA, 20 bp, Artificial Sequence
  Description of Artificial Sequence: Synthetic oligonucleotide
  Target: ATXN1; (-) strand; PAM type: YTN; PAM sequence: TTC
attgaccatttctttcgttg

SEQ ID NO: 223342 - DNA, 20 bp, Artificial Sequence
  Description of Artificial Sequence: Synthetic oligonucleotide
  Target: ATXN1; (-) strand; PAM type: YTN; PAM sequence: TTA
gttcattgaccatttctttc

SEQ ID NO: 223343 - DNA, 20 bp, Artificial Sequence
  Description of Artificial Sequence: Synthetic oligonucleotide
  Target: ATXN1; (-) strand; PAM type: YTN; PAM sequence: TTA
acaaatatgttagttcattg

SEQ ID NO: 223344 - DNA, 20 bp, Artificial Sequence
  Description of Artificial Sequence: Synthetic oligonucleotide
  Target: ATXN1; (-) strand; PAM type: YTN; PAM sequence: CTG
tagaagttaacaaatatgtt

SEQ ID NO: 223345 - DNA, 20 bp, Artificial Sequence
  Description of Artificial Sequence: Synthetic oligonucleotide
  Target: ATXN1; (-) strand; PAM type: YTN; PAM sequence: TTG
tctgtagaagttaacaaata

SEQ ID NO: 223346 - DNA, 20 bp, Artificial Sequence
  Description of Artificial Sequence: Synthetic oligonucleotide
  Target: ATXN1; (-) strand; PAM type: YTN; PAM sequence: CTG
gagccagaagtgggagggtg

SEQ ID NO: 223347 - DNA, 20 bp, Artificial Sequence
  Description of Artificial Sequence: Synthetic oligonucleotide
  Target: ATXN1; (-) strand; PAM type: YTN; PAM sequence: TTC
tggagccagaagtgggaggg

SEQ ID NO: 223348 - DNA, 20 bp, Artificial Sequence
  Description of Artificial Sequence: Synthetic oligonucleotide
  Target: ATXN1; (-) strand; PAM type: YTN; PAM sequence: TTT
ctggagccagaagtgggagg

SEQ ID NO: 223349 - DNA, 20 bp, Artificial Sequence
  Description of Artificial Sequence: Synthetic oligonucleotide
  Target: ATXN1; (-) strand; PAM type: YTN; PAM sequence: TTC
ccacatagtaagtaacaagt

SEQ ID NO: 223350 - DNA, 20 bp, Artificial Sequence
  Description of Artificial Sequence: Synthetic oligonucleotide
  Target: ATXN1; (-) strand; PAM type: YTN; PAM sequence: CTT
cccacatagtaagtaacaag

SEQ ID NO: 223351 - DNA, 20 bp, Artificial Sequence
  Description of Artificial Sequence: Synthetic oligonucleotide
  Target: ATXN1; (-) strand; PAM type: YTN; PAM sequence: TTC
cttcccacatagtaagtaac

SEQ ID NO: 223352 - DNA, 20 bp, Artificial Sequence
  Description of Artificial Sequence: Synthetic oligonucleotide
  Target: ATXN1; (-) strand; PAM type: YTN; PAM sequence: TTG
aattccttcccacatagtaa

SEQ ID NO: 223353 - DNA, 20 bp, Artificial Sequence
  Description of Artificial Sequence: Synthetic oligonucleotide
  Target: ATXN1; (-) strand; PAM type: YTN; PAM sequence: TTT
gaattccttcccacatagta

SEQ ID NO: 223354 - DNA, 20 bp, Artificial Sequence
  Description of Artificial Sequence: Synthetic oligonucleotide
  Target: ATXN1; (-) strand; PAM type: YTN; PAM sequence: CTG
acataacagtgaaagcattt

SEQ ID NO: 223355 - DNA, 20 bp, Artificial Sequence
  Description of Artificial Sequence: Synthetic oligonucleotide
  Target: ATXN1; (-) strand; PAM type: YTN; PAM sequence: TTG
acctgacataacagtgaaag

SEQ ID NO: 223356 - DNA, 20 bp, Artificial Sequence
  Description of Artificial Sequence: Synthetic oligonucleotide
  Target: ATXN1; (-) strand; PAM type: YTN; PAM sequence: TTA
acagattgacctgacataac

SEQ ID NO: 223357 - DNA, 20 bp, Artificial Sequence
  Description of Artificial Sequence: Synthetic oligonucleotide
  Target: ATXN1; (-) strand; PAM type: YTN; PAM sequence: CTT
aacagattgacctgacataa

SEQ ID NO: 223358 - DNA, 20 bp, Artificial Sequence
  Description of Artificial Sequence: Synthetic oligonucleotide
  Target: ATXN1; (-) strand; PAM type: YTN; PAM sequence: TTA
caatacacttaacagattga

SEQ ID NO: 223359 - DNA, 20 bp, Artificial Sequence
  Description of Artificial Sequence: Synthetic oligonucleotide
  Target: ATXN1; (-) strand; PAM type: YTN; PAM sequence: TTT
acaatacacttaacagattg

SEQ ID NO: 223360 - DNA, 20 bp, Artificial Sequence
  Description of Artificial Sequence: Synthetic oligonucleotide
  Target: ATXN1; (-) strand; PAM type: YTN; PAM sequence: CTG
atgtggcaaaaatttacaat

SEQ ID NO: 223361 - DNA, 20 bp, Artificial Sequence
  Description of Artificial Sequence: Synthetic oligonucleotide
  Target: ATXN1; (-) strand; PAM type: YTN; PAM sequence: TTA
gtgatcaaagtgggatactg

SEQ ID NO: 223362 - DNA, 20 bp, Artificial Sequence
  Description of Artificial Sequence: Synthetic oligonucleotide
  Target: ATXN1; (-) strand; PAM type: YTN; PAM sequence: CTA
atatacaaatggcattagtg

SEQ ID NO: 223363 - DNA, 20 bp, Artificial Sequence
  Description of Artificial Sequence: Synthetic oligonucleotide
  Target: ATXN1; (-) strand; PAM type: YTN; PAM sequence: TTA
caagctaatatacaaatggc

SEQ ID NO: 223364 - DNA, 20 bp, Artificial Sequence
  Description of Artificial Sequence: Synthetic oligonucleotide
  Target: ATXN1; (-) strand; PAM type: YTN; PAM sequence: TTA
tgatcagtgtgtattacaag

SEQ ID NO: 223365 - DNA, 20 bp, Artificial Sequence
  Description of Artificial Sequence: Synthetic oligonucleotide
  Target: ATXN1; (-) strand; PAM type: YTN; PAM sequence: TTT
atgatcagtgtgtattacaa

SEQ ID NO: 223366 - DNA, 20 bp, Artificial Sequence
  Description of Artificial Sequence: Synthetic oligonucleotide
  Target: ATXN1; (-) strand; PAM type: YTN; PAM sequence: CTT
tatgatcagtgtgtattaca

SEQ ID NO: 223367 - DNA, 20 bp, Artificial Sequence
  Description of Artificial Sequence: Synthetic oligonucleotide
  Target: ATXN1; (-) strand; PAM type: YTN; PAM sequence: TTG
ctttatgatcagtgtgtatt

SEQ ID NO: 223368 - DNA, 20 bp, Artificial Sequence
  Description of Artificial Sequence: Synthetic oligonucleotide
  Target: ATXN1; (-) strand; PAM type: YTN; PAM sequence: TTA
ttgctttatgatcagtgtgt

SEQ ID NO: 223369 - DNA, 20 bp, Artificial Sequence
  Description of Artificial Sequence: Synthetic oligonucleotide
  Target: ATXN1; (-) strand; PAM type: YTN; PAM sequence: TTT
attgctttatgatcagtgtg

SEQ ID NO: 223370 - DNA, 20 bp, Artificial Sequence
  Description of Artificial Sequence: Synthetic oligonucleotide
  Target: ATXN1; (-) strand; PAM type: YTN; PAM sequence: TTT
tattgctttatgatcagtgt

SEQ ID NO: 223371 - DNA, 20 bp, Artificial Sequence
  Description of Artificial Sequence: Synthetic oligonucleotide
  Target: ATXN1; (-) strand; PAM type: YTN; PAM sequence: TTA
gcaaaatgcagttttattgc

SEQ ID NO: 223372 - DNA, 20 bp, Artificial Sequence
  Description of Artificial Sequence: Synthetic oligonucleotide
  Target: ATXN1; (-) strand; PAM type: YTN; PAM sequence: TTT
agcaaaatgcagttttattg

SEQ ID NO: 223373 - DNA, 20 bp, Artificial Sequence
  Description of Artificial Sequence: Synthetic oligonucleotide
  Target: ATXN1; (-) strand; PAM type: YTN; PAM sequence: TTA
aagtttagcaaaatgcagtt

SEQ ID NO: 223374 - DNA, 20 bp, Artificial Sequence
  Description of Artificial Sequence: Synthetic oligonucleotide
  Target: ATXN1; (-) strand; PAM type: YTN; PAM sequence: TTT
aaagtttagcaaaatgcagt

SEQ ID NO: 223375 - DNA, 20 bp, Artificial Sequence
  Description of Artificial Sequence: Synthetic oligonucleotide
  Target: ATXN1; (-) strand; PAM type: YTN; PAM sequence: TTT
taaagtttagcaaaatgcag

SEQ ID NO: 223376 - DNA, 20 bp, Artificial Sequence
  Description of Artificial Sequence: Synthetic oligonucleotide
  Target: ATXN1; (-) strand; PAM type: YTN; PAM sequence: TTT
ttaaagtttagcaaaatgca

SEQ ID NO: 223377 - DNA, 20 bp, Artificial Sequence
  Description of Artificial Sequence: Synthetic oligonucleotide
  Target: ATXN1; (-) strand; PAM type: YTN; PAM sequence: TTC
atttttaaagtttagcaaaa

SEQ ID NO: 223378 - DNA, 20 bp, Artificial Sequence
  Description of Artificial Sequence: Synthetic oligonucleotide
  Target: ATXN1; (-) strand; PAM type: YTN; PAM sequence: CTT
catttttaaagtttagcaaa

SEQ ID NO: 223379 - DNA, 20 bp, Artificial Sequence
  Description of Artificial Sequence: Synthetic oligonucleotide
  Target: ATXN1; (-) strand; PAM type: YTN; PAM sequence: TTG
ggcaaaagccttcattttta

SEQ ID NO: 223380 - DNA, 20 bp, Artificial Sequence
  Description of Artificial Sequence: Synthetic oligonucleotide
  Target: ATXN1; (-) strand; PAM type: YTN; PAM sequence: CTG
aataatgggggcggggaggt

SEQ ID NO: 223381 - DNA, 20 bp, Artificial Sequence
  Description of Artificial Sequence: Synthetic oligonucleotide
  Target: ATXN1; (-) strand; PAM type: YTN; PAM sequence: TTC
tgaataatgggggcggggag

SEQ ID NO: 223382 - DNA, 20 bp, Artificial Sequence
  Description of Artificial Sequence: Synthetic oligonucleotide
  Target: ATXN1; (-) strand; PAM type: YTN; PAM sequence: TTA
ttctgaataatgggggcggg

SEQ ID NO: 223383 - DNA, 20 bp, Artificial Sequence
  Description of Artificial Sequence: Synthetic oligonucleotide
  Target: ATXN1; (-) strand; PAM type: YTN; PAM sequence: CTT
attctgaataatgggggcgg

SEQ ID NO: 223384 - DNA, 20 bp, Artificial Sequence
  Description of Artificial Sequence: Synthetic oligonucleotide
  Target: ATXN1; (-) strand; PAM type: YTN; PAM sequence: CTC
cacttattctgaataatggg

SEQ ID NO: 223385 - DNA, 20 bp, Artificial Sequence
  Description of Artificial Sequence: Synthetic oligonucleotide
  Target: ATXN1; (-) strand; PAM type: YTN; PAM sequence: CTC
cacactccacttattctgaa

SEQ ID NO: 223386 - DNA, 20 bp, Artificial Sequence
  Description of Artificial Sequence: Synthetic oligonucleotide
  Target: ATXN1; (-) strand; PAM type: YTN; PAM sequence: CTC
cccagaaagggaaaacccaa

SEQ ID NO: 223387 - DNA, 20 bp, Artificial Sequence
  Description of Artificial Sequence: Synthetic oligonucleotide
  Target: ATXN1; (-) strand; PAM type: YTN; PAM sequence: TTC
ctccccagaaagggaaaacc

SEQ ID NO: 223388 - DNA, 20 bp, Artificial Sequence
  Description of Artificial Sequence: Synthetic oligonucleotide
  Target: ATXN1; (-) strand; PAM type: YTN; PAM sequence: TTG
ttcctccccagaaagggaaa

SEQ ID NO: 223389 - DNA, 20 bp, Artificial Sequence
  Description of Artificial Sequence: Synthetic oligonucleotide
  Target: ATXN1; (-) strand; PAM type: YTN; PAM sequence: TTT
gttcctccccagaaagggaa

SEQ ID NO: 223390 - DNA, 20 bp, Artificial Sequence
  Description of Artificial Sequence: Synthetic oligonucleotide
  Target: ATXN1; (-) strand; PAM type: YTN; PAM sequence: TTC
atttgttcctccccagaaag

SEQ ID NO: 223391 - DNA, 20 bp, Artificial Sequence
  Description of Artificial Sequence: Synthetic oligonucleotide
  Target: ATXN1; (-) strand; PAM type: YTN; PAM sequence: CTC
attcatttgttcctccccag

SEQ ID NO: 223392 - DNA, 20 bp, Artificial Sequence
  Description of Artificial Sequence: Synthetic oligonucleotide
  Target: ATXN1; (-) strand; PAM type: YTN; PAM sequence: TTA
ctcattcatttgttcctccc

SEQ ID NO: 223393 - DNA, 20 bp, Artificial Sequence
  Description of Artificial Sequence: Synthetic oligonucleotide
  Target: ATXN1; (-) strand; PAM type: YTN; PAM sequence: CTA
gttactcattcatttgttcc

SEQ ID NO: 223394 - DNA, 20 bp, Artificial Sequence
  Description of Artificial Sequence: Synthetic oligonucleotide
  Target: ATXN1; (-) strand; PAM type: YTN; PAM sequence: CTC
actagttactcattcatttg

SEQ ID NO: 223395 - DNA, 20 bp, Artificial Sequence
  Description of Artificial Sequence: Synthetic oligonucleotide
  Target: ATXN1; (-) strand; PAM type: YTN; PAM sequence: CTA
agatgccctcactagttact

SEQ ID NO: 223396 - DNA, 20 bp, Artificial Sequence
  Description of Artificial Sequence: Synthetic oligonucleotide
  Target: ATXN1; (-) strand; PAM type: YTN; PAM sequence: CTC
cctaagatgccctcactagt

SEQ ID NO: 223397 - DNA, 20 bp, Artificial Sequence
  Description of Artificial Sequence: Synthetic oligonucleotide
  Target: ATXN1; (-) strand; PAM type: YTN; PAM sequence: CTG
tgggcgggggaactccctaa

SEQ ID NO: 223398 - DNA, 20 bp, Artificial Sequence
  Description of Artificial Sequence: Synthetic oligonucleotide
  Target: ATXN1; (-) strand; PAM type: YTN; PAM sequence: CTC
atagtctgtgggcgggggaa

SEQ ID NO: 223399 - DNA, 20 bp, Artificial Sequence
  Description of Artificial Sequence: Synthetic oligonucleotide
  Target: ATXN1; (-) strand; PAM type: YTN; PAM sequence: TTC
aaatcaagatgcctcatagt

SEQ ID NO: 223400 - DNA, 20 bp, Artificial Sequence
  Description of Artificial Sequence: Synthetic oligonucleotide
  Target: ATXN1; (-) strand; PAM type: YTN; PAM sequence: TTT
caaatcaagatgcctcatag

SEQ ID NO: 223401 - DNA, 20 bp, Artificial Sequence
  Description of Artificial Sequence: Synthetic oligonucleotide
  Target: ATXN1; (-) strand; PAM type: YTN; PAM sequence: CTT
tcaaatcaagatgcctcata

SEQ ID NO: 223402 - DNA, 20 bp, Artificial Sequence
  Description of Artificial Sequence: Synthetic oligonucleotide
  Target: ATXN1; (-) strand; PAM type: YTN; PAM sequence: TTC
ctttcaaatcaagatgcctc

SEQ ID NO: 223403 - DNA, 20 bp, Artificial Sequence
  Description of Artificial Sequence: Synthetic oligonucleotide
  Target: ATXN1; (-) strand; PAM type: YTN; PAM sequence: TTG
tgtattcctttcaaatcaag

SEQ ID NO: 223404 - DNA, 20 bp, Artificial Sequence
  Description of Artificial Sequence: Synthetic oligonucleotide
  Target: ATXN1; (-) strand; PAM type: YTN; PAM sequence: TTG
tgtgcgtgtggtgtgggtgc

SEQ ID NO: 223405 - DNA, 20 bp, Artificial Sequence
  Description of Artificial Sequence: Synthetic oligonucleotide
  Target: ATXN1; (-) strand; PAM type: YTN; PAM sequence: TTT
gtgtgcgtgtggtgtgggtg

SEQ ID NO: 223406 - DNA, 20 bp, Artificial Sequence
  Description of Artificial Sequence: Synthetic oligonucleotide
  Target: ATXN1; (-) strand; PAM type: YTN; PAM sequence: TTT
tgtgtgcgtgtggtgtgggt

SEQ ID NO: 223407 - DNA, 20 bp, Artificial Sequence
  Description of Artificial Sequence: Synthetic oligonucleotide
  Target: ATXN1; (-) strand; PAM type: YTN; PAM sequence: TTT
ttgtgtgcgtgtggtgtggg

SEQ ID NO: 223408 - DNA, 20 bp, Artificial Sequence
  Description of Artificial Sequence: Synthetic oligonucleotide
  Target: ATXN1; (-) strand; PAM type: YTN; PAM sequence: TTA
aaagtgtttttgtgtgcgtg

SEQ ID NO: 223409 - DNA, 20 bp, Artificial Sequence
  Description of Artificial Sequence: Synthetic oligonucleotide
  Target: ATXN1; (-) strand; PAM type: YTN; PAM sequence: TTT
aaaagtgtttttgtgtgcgt

SEQ ID NO: 223410 - DNA, 20 bp, Artificial Sequence
  Description of Artificial Sequence: Synthetic oligonucleotide
  Target: ATXN1; (-) strand; PAM type: YTN; PAM sequence: CTT
taaaagtgtttttgtgtgcg

SEQ ID NO: 223411 - DNA, 20 bp, Artificial Sequence
  Description of Artificial Sequence: Synthetic oligonucleotide
  Target: ATXN1; (-) strand; PAM type: YTN; PAM sequence: TTA
tgtaagaagtcaactttaaa

SEQ ID NO: 223412 - DNA, 20 bp, Artificial Sequence
  Description of Artificial Sequence: Synthetic oligonucleotide
  Target: ATXN1; (-) strand; PAM type: YTN; PAM sequence: TTT
atgtaagaagtcaactttaa

SEQ ID NO: 223413 - DNA, 20 bp, Artificial Sequence
  Description of Artificial Sequence: Synthetic oligonucleotide
  Target: ATXN1; (-) strand; PAM type: YTN; PAM sequence: TTT
tatgtaagaagtcaacttta

SEQ ID NO: 223414 - DNA, 20 bp, Artificial Sequence
  Description of Artificial Sequence: Synthetic oligonucleotide
  Target: ATXN1; (-) strand; PAM type: YTN; PAM sequence: CTT
ttatgtaagaagtcaacttt

SEQ ID NO: 223415 - DNA, 20 bp, Artificial Sequence
  Description of Artificial Sequence: Synthetic oligonucleotide
  Target: ATXN1; (-) strand; PAM type: YTN; PAM sequence: CTG
gcttttatgtaagaagtcaa

SEQ ID NO: 223416 - DNA, 20 bp, Artificial Sequence
  Description of Artificial Sequence: Synthetic oligonucleotide
  Target: ATXN1; (-) strand; PAM type: YTN; PAM sequence: CTG
ctggcttttatgtaagaagt

SEQ ID NO: 223417 - DNA, 20 bp, Artificial Sequence
  Description of Artificial Sequence: Synthetic oligonucleotide
  Target: ATXN1; (-) strand; PAM type: YTN; PAM sequence: CTA
gcagggagtactgctggctt

SEQ ID NO: 223418 - DNA, 20 bp, Artificial Sequence
  Description of Artificial Sequence: Synthetic oligonucleotide
  Target: ATXN1; (-) strand; PAM type: YTN; PAM sequence: TTC
tagcagggagtactgctggc

SEQ ID NO: 223419 - DNA, 20 bp, Artificial Sequence
  Description of Artificial Sequence: Synthetic oligonucleotide
  Target: ATXN1; (-) strand; PAM type: YTN; PAM sequence: TTC
agattctagcagggagtact

SEQ ID NO: 223420 - DNA, 20 bp, Artificial Sequence
  Description of Artificial Sequence: Synthetic oligonucleotide
  Target: ATXN1; (-) strand; PAM type: YTN; PAM sequence: CTT
cagattctagcagggagtac

SEQ ID NO: 223421 - DNA, 20 bp, Artificial Sequence
  Description of Artificial Sequence: Synthetic oligonucleotide
  Target: ATXN1; (-) strand; PAM type: YTN; PAM sequence: TTC
ttcagattctagcagggagt

SEQ ID NO: 223422 - DNA, 20 bp, Artificial Sequence
  Description of Artificial Sequence: Synthetic oligonucleotide
  Target: ATXN1; (-) strand; PAM type: YTN; PAM sequence: TTT
cttcagattctagcagggag

SEQ ID NO: 223423 - DNA, 20 bp, Artificial Sequence
  Description of Artificial Sequence: Synthetic oligonucleotide
  Target: ATXN1; (-) strand; PAM type: YTN; PAM sequence: TTT
tcttcagattctagcaggga

SEQ ID NO: 223424 - DNA, 20 bp, Artificial Sequence
  Description of Artificial Sequence: Synthetic oligonucleotide
  Target: ATXN1; (-) strand; PAM type: YTN; PAM sequence: CTT
ttcttcagattctagcaggg

SEQ ID NO: 223425 - DNA, 20 bp, Artificial Sequence
  Description of Artificial Sequence: Synthetic oligonucleotide
  Target: ATXN1; (-) strand; PAM type: YTN; PAM sequence: TTC
ttttcttcagattctagcag

SEQ ID NO: 223426 - DNA, 20 bp, Artificial Sequence
  Description of Artificial Sequence: Synthetic oligonucleotide
  Target: ATXN1; (-) strand; PAM type: YTN; PAM sequence: TTG
ccagtaaaataataatagta

SEQ ID NO: 223427 - DNA, 20 bp, Artificial Sequence
  Description of Artificial Sequence: Synthetic oligonucleotide
  Target: ATXN1; (-) strand; PAM type: YTN; PAM sequence: CTT
gccagtaaaataataatagt

SEQ ID NO: 223428 - DNA, 20 bp, Artificial Sequence
  Description of Artificial Sequence: Synthetic oligonucleotide
  Target: ATXN1; (-) strand; PAM type: YTN; PAM sequence: CTG
aaaggccttgccagtaaaat

SEQ ID NO: 223429 - DNA, 20 bp, Artificial Sequence
  Description of Artificial Sequence: Synthetic oligonucleotide
  Target: ATXN1; (-) strand; PAM type: YTN; PAM sequence: TTG
aatgaagcataaccccctga

SEQ ID NO: 223430 - DNA, 20 bp, Artificial Sequence
  Description of Artificial Sequence: Synthetic oligonucleotide
  Target: ATXN1; (-) strand; PAM type: YTN; PAM sequence: CTC
aattgaatgaagcataaccc

SEQ ID NO: 223431 - DNA, 20 bp, Artificial Sequence
  Description of Artificial Sequence: Synthetic oligonucleotide
  Target: ATXN1; (-) strand; PAM type: YTN; PAM sequence: TTA
ggctcaattgaatgaagcat

SEQ ID NO: 223432 - DNA, 20 bp, Artificial Sequence
  Description of Artificial Sequence: Synthetic oligonucleotide
  Target: ATXN1; (-) strand; PAM type: YTN; PAM sequence: TTA
tcaattaggctcaattgaat

SEQ ID NO: 223433 - DNA, 20 bp, Artificial Sequence
  Description of Artificial Sequence: Synthetic oligonucleotide
  Target: ATXN1; (-) strand; PAM type: YTN; PAM sequence: TTT
atcaattaggctcaattgaa

SEQ ID NO: 223434 - DNA, 20 bp, Artificial Sequence
  Description of Artificial Sequence: Synthetic oligonucleotide
  Target: ATXN1; (-) strand; PAM type: YTN; PAM sequence: CTT
tatcaattaggctcaattga

SEQ ID NO: 223435 - DNA, 20 bp, Artificial Sequence
  Description of Artificial Sequence: Synthetic oligonucleotide
  Target: ATXN1; (-) strand; PAM type: YTN; PAM sequence: TTA
gctttatcaattaggctcaa

SEQ ID NO: 223436 - DNA, 20 bp, Artificial Sequence
  Description of Artificial Sequence: Synthetic oligonucleotide
  Target: ATXN1; (-) strand; PAM type: YTN; PAM sequence: CTG
taaacatgtgttagctttat

SEQ ID NO: 223437 - DNA, 20 bp, Artificial Sequence
  Description of Artificial Sequence: Synthetic oligonucleotide
  Target: ATXN1; (-) strand; PAM type: YTN; PAM sequence: TTA
cctgtaaacatgtgttagct

SEQ ID NO: 223438 - DNA, 20 bp, Artificial Sequence
  Description of Artificial Sequence: Synthetic oligonucleotide
  Target: ATXN1; (-) strand; PAM type: YTN; PAM sequence: TTA
ttacctgtaaacatgtgtta

SEQ ID NO: 223439 - DNA, 20 bp, Artificial Sequence
  Description of Artificial Sequence: Synthetic oligonucleotide
  Target: ATXN1; (-) strand; PAM type: YTN; PAM sequence: TTT
attacctgtaaacatgtgtt

SEQ ID NO: 223440 - DNA, 20 bp, Artificial Sequence
  Description of Artificial Sequence: Synthetic oligonucleotide
  Target: ATXN1; (-) strand; PAM type: YTN; PAM sequence: TTT
tattacctgtaaacatgtgt

SEQ ID NO: 223441 - DNA, 20 bp, Artificial Sequence
  Description of Artificial Sequence: Synthetic oligonucleotide
  Target: ATXN1; (-) strand; PAM type: YTN; PAM sequence: TTT
ttattacctgtaaacatgtg

SEQ ID NO: 223442 - DNA, 20 bp, Artificial Sequence
  Description of Artificial Sequence: Synthetic oligonucleotide
  Target: ATXN1; (-) strand; PAM type: YTN; PAM sequence: TTC
atttttattacctgtaaaca

SEQ ID NO: 223443 - DNA, 20 bp, Artificial Sequence
  Description of Artificial Sequence: Synthetic oligonucleotide
  Target: ATXN1; (-) strand; PAM type: YTN; PAM sequence: CTT
catttttattacctgtaaac

SEQ ID NO: 223444 - DNA, 20 bp, Artificial Sequence
  Description of Artificial Sequence: Synthetic oligonucleotide
  Target: ATXN1; (-) strand; PAM type: YTN; PAM sequence: TTC
catgtagatagtacttcatt

SEQ ID NO: 223445 - DNA, 20 bp, Artificial Sequence
  Description of Artificial Sequence: Synthetic oligonucleotide
  Target: ATXN1; (-) strand; PAM type: YTN; PAM sequence: TTT
ccatgtagatagtacttcat

SEQ ID NO: 223446 - DNA, 20 bp, Artificial Sequence
  Description of Artificial Sequence: Synthetic oligonucleotide
  Target: ATXN1; (-) strand; PAM type: YTN; PAM sequence: TTG
tttccatgtagatagtactt

SEQ ID NO: 223447 - DNA, 20 bp, Artificial Sequence
  Description of Artificial Sequence: Synthetic oligonucleotide
  Target: ATXN1; (-) strand; PAM type: YTN; PAM sequence: TTT
gtttccatgtagatagtact

SEQ ID NO: 223448 - DNA, 20 bp, Artificial Sequence
  Description of Artificial Sequence: Synthetic oligonucleotide
  Target: ATXN1; (-) strand; PAM type: YTN; PAM sequence: CTG
atttgtttccatgtagatag

SEQ ID NO: 223449 - DNA, 20 bp, Artificial Sequence
  Description of Artificial Sequence: Synthetic oligonucleotide
  Target: ATXN1; (-) strand; PAM type: YTN; PAM sequence: CTC
cctgatttgtttccatgtag

SEQ ID NO: 223450 - DNA, 20 bp, Artificial Sequence
  Description of Artificial Sequence: Synthetic oligonucleotide
  Target: ATXN1; (-) strand; PAM type: YTN; PAM sequence: CTG
ctccctgatttgtttccatg

SEQ ID NO: 223451 - DNA, 20 bp, Artificial Sequence
  Description of Artificial Sequence: Synthetic oligonucleotide
  Target: ATXN1; (-) strand; PAM type: YTN; PAM sequence: CTC
tgctccctgatttgtttcca

SEQ ID NO: 223452 - DNA, 20 bp, Artificial Sequence
  Description of Artificial Sequence: Synthetic oligonucleotide
  Target: ATXN1; (-) strand; PAM type: YTN; PAM sequence: TTC
ctctgctccctgatttgttt

SEQ ID NO: 223453 - DNA, 20 bp, Artificial Sequence
  Description of Artificial Sequence: Synthetic oligonucleotide
  Target: ATXN1; (-) strand; PAM type: YTN; PAM sequence: CTG
gttcctctgctccctgattt

SEQ ID NO: 223454 - DNA, 20 bp, Artificial Sequence
  Description of Artificial Sequence: Synthetic oligonucleotide
  Target: ATXN1; (-) strand; PAM type: YTN; PAM sequence: TTA
aagaatgaataatgactggt

SEQ ID NO: 223455 - DNA, 20 bp, Artificial Sequence
  Description of Artificial Sequence: Synthetic oligonucleotide
  Target: ATXN1; (-) strand; PAM type: YTN; PAM sequence: TTT
aaagaatgaataatgactgg

SEQ ID NO: 223456 - DNA, 20 bp, Artificial Sequence
  Description of Artificial Sequence: Synthetic oligonucleotide
  Target: ATXN1; (-) strand; PAM type: YTN; PAM sequence: TTA
cagtttaaagaatgaataat

SEQ ID NO: 223457 - DNA, 20 bp, Artificial Sequence
  Description of Artificial Sequence: Synthetic oligonucleotide
  Target: ATXN1; (-) strand; PAM type: YTN; PAM sequence: TTT
acagtttaaagaatgaataa

SEQ ID NO: 223458 - DNA, 20 bp, Artificial Sequence
  Description of Artificial Sequence: Synthetic oligonucleotide
  Target: ATXN1; (-) strand; PAM type: YTN; PAM sequence: TTT
tacagtttaaagaatgaata

SEQ ID NO: 223459 - DNA, 20 bp, Artificial Sequence
  Description of Artificial Sequence: Synthetic oligonucleotide
  Target: ATXN1; (-) strand; PAM type: YTN; PAM sequence: TTT
ttacagtttaaagaatgaat

SEQ ID NO: 223460 - DNA, 20 bp, Artificial Sequence
  Description of Artificial Sequence: Synthetic oligonucleotide
  Target: ATXN1; (-) strand; PAM type: YTN; PAM sequence: TTA
gtttttacagtttaaagaat

SEQ ID NO: 223461 - DNA, 20 bp, Artificial Sequence
  Description of Artificial Sequence: Synthetic oligonucleotide
  Target: ATXN1; (-) strand; PAM type: YTN; PAM sequence: TTT
agtttttacagtttaaagaa

SEQ ID NO: 223462 - DNA, 20 bp, Artificial Sequence
  Description of Artificial Sequence: Synthetic oligonucleotide
  Target: ATXN1; (-) strand; PAM type: YTN; PAM sequence: TTT
tagtttttacagtttaaaga

SEQ ID NO: 223463 - DNA, 20 bp, Artificial Sequence
  Description of Artificial Sequence: Synthetic oligonucleotide
  Target: ATXN1; (-) strand; PAM type: YTN; PAM sequence: TTA
gagaacattttagtttttac

SEQ ID NO: 223464 - DNA, 20 bp, Artificial Sequence
  Description of Artificial Sequence: Synthetic oligonucleotide
  Target: ATXN1; (-) strand; PAM type: YTN; PAM sequence: CTT
agagaacattttagttttta

SEQ ID NO: 223465 - DNA, 20 bp, Artificial Sequence
  Description of Artificial Sequence: Synthetic oligonucleotide
  Target: ATXN1; (-) strand; PAM type: YTN; PAM sequence: TTG
ataatgcttagagaacattt

SEQ ID NO: 223466 - DNA, 20 bp, Artificial Sequence
  Description of Artificial Sequence: Synthetic oligonucleotide
  Target: ATXN1; (-) strand; PAM type: YTN; PAM sequence: CTT
gataatgcttagagaacatt

SEQ ID NO: 223467 - DNA, 20 bp, Artificial Sequence
  Description of Artificial Sequence: Synthetic oligonucleotide
  Target: ATXN1; (-) strand; PAM type: YTN; PAM sequence: TTA
ggacttgataatgcttagag

SEQ ID NO: 223468 - DNA, 20 bp, Artificial Sequence
  Description of Artificial Sequence: Synthetic oligonucleotide
  Target: ATXN1; (-) strand; PAM type: YTN; PAM sequence: TTT
aggacttgataatgcttaga

SEQ ID NO: 223469 - DNA, 20 bp, Artificial Sequence
  Description of Artificial Sequence: Synthetic oligonucleotide
  Target: ATXN1; (-) strand; PAM type: YTN; PAM sequence: TTG
tttaggacttgataatgctt

SEQ ID NO: 223470 - DNA, 20 bp, Artificial Sequence
  Description of Artificial Sequence: Synthetic oligonucleotide
  Target: ATXN1; (-) strand; PAM type: YTN; PAM sequence: TTT
gtttaggacttgataatgct

SEQ ID NO: 223471 - DNA, 20 bp, Artificial Sequence
  Description of Artificial Sequence: Synthetic oligonucleotide
  Target: ATXN1; (-) strand; PAM type: YTN; PAM sequence: TTT
tgtttaggacttgataatgc

SEQ ID NO: 223472 - DNA, 20 bp, Artificial Sequence
  Description of Artificial Sequence: Synthetic oligonucleotide
  Target: ATXN1; (-) strand; PAM type: YTN; PAM sequence: TTT
ttgtttaggacttgataatg

SEQ ID NO: 223473 - DNA, 20 bp, Artificial Sequence
  Description of Artificial Sequence: Synthetic oligonucleotide
  Target: ATXN1; (-) strand; PAM type: YTN; PAM sequence: TTA
tatttttgtttaggacttga

SEQ ID NO: 223474 - DNA, 20 bp, Artificial Sequence
  Description of Artificial Sequence: Synthetic oligonucleotide
  Target: ATXN1; (-) strand; PAM type: YTN; PAM sequence: TTG
tgaaattatatttttgttta

SEQ ID NO: 223475 - DNA, 20 bp, Artificial Sequence
  Description of Artificial Sequence: Synthetic oligonucleotide
  Target: ATXN1; (-) strand; PAM type: YTN; PAM sequence: TTT
gtgaaattatatttttgttt

SEQ ID NO: 223476 - DNA, 20 bp, Artificial Sequence
  Description of Artificial Sequence: Synthetic oligonucleotide
  Target: ATXN1; (-) strand; PAM type: YTN; PAM sequence: CTT
tgtgaaattatatttttgtt

SEQ ID NO: 223477 - DNA, 20 bp, Artificial Sequence
  Description of Artificial Sequence: Synthetic oligonucleotide
  Target: ATXN1; (-) strand; PAM type: YTN; PAM sequence: TTG
ctttgtgaaattatattttt

SEQ ID NO: 223478 - DNA, 20 bp, Artificial Sequence
  Description of Artificial Sequence: Synthetic oligonucleotide
  Target: ATXN1; (-) strand; PAM type: YTN; PAM sequence: TTT
gctttgtgaaattatatttt

SEQ ID NO: 223479 - DNA, 20 bp, Artificial Sequence
  Description of Artificial Sequence: Synthetic oligonucleotide
  Target: ATXN1; (-) strand; PAM type: YTN; PAM sequence: CTT
tgctttgtgaaattatattt

SEQ ID NO: 223480 - DNA, 20 bp, Artificial Sequence
  Description of Artificial Sequence: Synthetic oligonucleotide
  Target: ATXN1; (-) strand; PAM type: YTN; PAM sequence: TTG
aacgataaaatgaatgtctt

SEQ ID NO: 223481 - DNA, 20 bp, Artificial Sequence
  Description of Artificial Sequence: Synthetic oligonucleotide
  Target: ATXN1; (-) strand; PAM type: YTN; PAM sequence: TTA
ttgaacgataaaatgaatgt

SEQ ID NO: 223482 - DNA, 20 bp, Artificial Sequence
  Description of Artificial Sequence: Synthetic oligonucleotide
  Target: ATXN1; (-) strand; PAM type: YTN; PAM sequence: TTT
attgaacgataaaatgaatg

SEQ ID NO: 223483 - DNA, 20 bp, Artificial Sequence
  Description of Artificial Sequence: Synthetic oligonucleotide
  Target: ATXN1; (-) strand; PAM type: YTN; PAM sequence: TTA
aaataatttattgaacgata

SEQ ID NO: 223484 - DNA, 20 bp, Artificial Sequence
  Description of Artificial Sequence: Synthetic oligonucleotide
  Target: ATXN1; (-) strand; PAM type: YTN; PAM sequence: CTT
aaaataatttattgaacgat

SEQ ID NO: 223485 - DNA, 20 bp, Artificial Sequence
  Description of Artificial Sequence: Synthetic oligonucleotide
  Target: ATXN1; (-) strand; PAM type: YTN; PAM sequence: CTC
ttaaaataatttattgaacg

SEQ ID NO: 223486 - DNA, 20 bp, Artificial Sequence
  Description of Artificial Sequence: Synthetic oligonucleotide
  Target: ATXN1; (-) strand; PAM type: YTN; PAM sequence: CTG
ctcttaaaataatttattga

SEQ ID NO: 223487 - DNA, 20 bp, Artificial Sequence
  Description of Artificial Sequence: Synthetic oligonucleotide
  Target: ATXN1; (-) strand; PAM type: YTN; PAM sequence: TTC
tgctcttaaaataatttatt

SEQ ID NO: 223488 - DNA, 20 bp, Artificial Sequence
  Description of Artificial Sequence: Synthetic oligonucleotide
  Target: ATXN1; (-) strand; PAM type: YTN; PAM sequence: TTT
ctgctcttaaaataatttat

SEQ ID NO: 223489 - DNA, 20 bp, Artificial Sequence
  Description of Artificial Sequence: Synthetic oligonucleotide
  Target: ATXN1; (-) strand; PAM type: YTN; PAM sequence: CTT
tctgctcttaaaataattta

SEQ ID NO: 223490 - DNA, 20 bp, Artificial Sequence
  Description of Artificial Sequence: Synthetic oligonucleotide
  Target: ATXN1; (-) strand; PAM type: YTN; PAM sequence: CTA
aagtcagtgctttctgctct

SEQ ID NO: 223491 - DNA, 20 bp, Artificial Sequence
  Description of Artificial Sequence: Synthetic oligonucleotide
  Target: ATXN1; (-) strand; PAM type: YTN; PAM sequence: TTA
agaacagagataacaaataa

SEQ ID NO: 223492 - DNA, 20 bp, Artificial Sequence
  Description of Artificial Sequence: Synthetic oligonucleotide
  Target: ATXN1; (-) strand; PAM type: YTN; PAM sequence: TTT
aagaacagagataacaaata

SEQ ID NO: 223493 - DNA, 20 bp, Artificial Sequence
  Description of Artificial Sequence: Synthetic oligonucleotide
  Target: ATXN1; (-) strand; PAM type: YTN; PAM sequence: TTT
taagaacagagataacaaat

SEQ ID NO: 223494 - DNA, 20 bp, Artificial Sequence
  Description of Artificial Sequence: Synthetic oligonucleotide
  Target: ATXN1; (-) strand; PAM type: YTN; PAM sequence: TTT
ttaagaacagagataacaaa

SEQ ID NO: 223495 - DNA, 20 bp, Artificial Sequence
  Description of Artificial Sequence: Synthetic oligonucleotide
  Target: ATXN1; (-) strand; PAM type: YTN; PAM sequence: TTC
catttttaagaacagagata

SEQ ID NO: 223496 - DNA, 20 bp, Artificial Sequence
  Description of Artificial Sequence: Synthetic oligonucleotide
  Target: ATXN1; (-) strand; PAM type: YTN; PAM sequence: CTG
gaaatattccatttttaaga

SEQ ID NO: 223497 - DNA, 20 bp, Artificial Sequence
  Description of Artificial Sequence: Synthetic oligonucleotide
  Target: ATXN1; (-) strand; PAM type: YTN; PAM sequence: TTG
tccctggaaatattccattt

SEQ ID NO: 223498 - DNA, 20 bp, Artificial Sequence
  Description of Artificial Sequence: Synthetic oligonucleotide
  Target: ATXN1; (-) strand; PAM type: YTN; PAM sequence: TTT
gtccctggaaatattccatt

SEQ ID NO: 223499 - DNA, 20 bp, Artificial Sequence
  Description of Artificial Sequence: Synthetic oligonucleotide
  Target: ATXN1; (-) strand; PAM type: YTN; PAM sequence: TTT
tgtccctggaaatattccat

SEQ ID NO: 223500 - DNA, 20 bp, Artificial Sequence
  Description of Artificial Sequence: Synthetic oligonucleotide
  Target: ATXN1; (-) strand; PAM type: YTN; PAM sequence: TTT
ttgtccctggaaatattcca

SEQ ID NO: 223501 - DNA, 20 bp, Artificial Sequence
  Description of Artificial Sequence: Synthetic oligonucleotide
  Target: ATXN1; (-) strand; PAM type: YTN; PAM sequence: CTT
tttgtccctggaaatattcc

SEQ ID NO: 223502 - DNA, 20 bp, Artificial Sequence
  Description of Artificial Sequence: Synthetic oligonucleotide
  Target: ATXN1; (-) strand; PAM type: YTN; PAM sequence: TTA
tactttttgtccctggaaat

SEQ ID NO: 223503 - DNA, 20 bp, Artificial Sequence
  Description of Artificial Sequence: Synthetic oligonucleotide
  Target: ATXN1; (-) strand; PAM type: YTN; PAM sequence: CTT
atactttttgtccctggaaa

SEQ ID NO: 223504 - DNA, 20 bp, Artificial Sequence
  Description of Artificial Sequence: Synthetic oligonucleotide
  Target: ATXN1; (-) strand; PAM type: YTN; PAM sequence: TTA
cttatactttttgtccctgg

SEQ ID NO: 223505 - DNA, 20 bp, Artificial Sequence
  Description of Artificial Sequence: Synthetic oligonucleotide
  Target: ATXN1; (-) strand; PAM type: YTN; PAM sequence: TTA
atcacgtattacttatactt

SEQ ID NO: 223506 - DNA, 20 bp, Artificial Sequence
  Description of Artificial Sequence: Synthetic oligonucleotide
  Target: ATXN1; (-) strand; PAM type: YTN; PAM sequence: TTA
aaatatatgaaaccatatta

SEQ ID NO: 223507 - DNA, 20 bp, Artificial Sequence
  Description of Artificial Sequence: Synthetic oligonucleotide
  Target: ATXN1; (-) strand; PAM type: YTN; PAM sequence: TTT
aaaatatatgaaaccatatt

SEQ ID NO: 223508 - DNA, 20 bp, Artificial Sequence
  Description of Artificial Sequence: Synthetic oligonucleotide
  Target: ATXN1; (-) strand; PAM type: YTN; PAM sequence: TTT
taaaatatatgaaaccatat

SEQ ID NO: 223509 - DNA, 20 bp, Artificial Sequence
  Description of Artificial Sequence: Synthetic oligonucleotide
  Target: ATXN1; (-) strand; PAM type: YTN; PAM sequence: TTT
ttaaaatatatgaaaccata

SEQ ID NO: 223510 - DNA, 20 bp, Artificial Sequence
  Description of Artificial Sequence: Synthetic oligonucleotide
  Target: ATXN1; (-) strand; PAM type: YTN; PAM sequence: TTA
aatgtcagatatttttaaaa

SEQ ID NO: 223511 - DNA, 20 bp, Artificial Sequence
  Description of Artificial Sequence: Synthetic oligonucleotide
  Target: ATXN1; (-) strand; PAM type: YTN; PAM sequence: TTT
aaatgtcagatatttttaaa

SEQ ID NO: 223512 - DNA, 20 bp, Artificial Sequence
  Description of Artificial Sequence: Synthetic oligonucleotide
  Target: ATXN1; (-) strand; PAM type: YTN; PAM sequence: TTT
taaatgtcagatatttttaa

SEQ ID NO: 223513 - DNA, 20 bp, Artificial Sequence
  Description of Artificial Sequence: Synthetic oligonucleotide
  Target: ATXN1; (-) strand; PAM type: YTN; PAM sequence: TTG
ttttaaatgtcagatatttt

SEQ ID NO: 223514 - DNA, 20 bp, Artificial Sequence
  Description of Artificial Sequence: Synthetic oligonucleotide
  Target: ATXN1; (-) strand; PAM type: YTN; PAM sequence: TTA
agatattgttttaaatgtca

SEQ ID NO: 223515 - DNA, 20 bp, Artificial Sequence
  Description of Artificial Sequence: Synthetic oligonucleotide
  Target: ATXN1; (-) strand; PAM type: YTN; PAM sequence: TTC
ggtattaagatattgtttta

SEQ ID NO: 223516 - DNA, 20 bp, Artificial Sequence
  Description of Artificial Sequence: Synthetic oligonucleotide
  Target: ATXN1; (-) strand; PAM type: YTN; PAM sequence: TTA
agaatattcggtattaagat

SEQ ID NO: 223517 - DNA, 20 bp, Artificial Sequence
  Description of Artificial Sequence: Synthetic oligonucleotide
  Target: ATXN1; (-) strand; PAM type: YTN; PAM sequence: TTC
attaagaatattcggtatta

SEQ ID NO: 223518 - DNA, 20 bp, Artificial Sequence
  Description of Artificial Sequence: Synthetic oligonucleotide
  Target: ATXN1; (-) strand; PAM type: YTN; PAM sequence: TTT
cattaagaatattcggtatt

SEQ ID NO: 223519 - DNA, 20 bp, Artificial Sequence
  Description of Artificial Sequence: Synthetic oligonucleotide
  Target: ATXN1; (-) strand; PAM type: YTN; PAM sequence: TTT
tcattaagaatattcggtat

SEQ ID NO: 223520 - DNA, 20 bp, Artificial Sequence
  Description of Artificial Sequence: Synthetic oligonucleotide
  Target: ATXN1; (-) strand; PAM type: YTN; PAM sequence: CTT
ttcattaagaatattcggta

SEQ ID NO: 223521 - DNA, 20 bp, Artificial Sequence
  Description of Artificial Sequence: Synthetic oligonucleotide
  Target: ATXN1; (-) strand; PAM type: YTN; PAM sequence: TTC
aaaaaaaacagaacttttca

SEQ ID NO: 223522 - DNA, 20 bp, Artificial Sequence
  Description of Artificial Sequence: Synthetic oligonucleotide
  Target: ATXN1; (-) strand; PAM type: YTN; PAM sequence: TTT
caaaaaaaacagaacttttc

SEQ ID NO: 223523 - DNA, 20 bp, Artificial Sequence
  Description of Artificial Sequence: Synthetic oligonucleotide
  Target: ATXN1; (-) strand; PAM type: YTN; PAM sequence: TTT
tcaaaaaaaacagaactttt

SEQ ID NO: 223524 - DNA, 20 bp, Artificial Sequence
  Description of Artificial Sequence: Synthetic oligonucleotide
  Target: ATXN1; (-) strand; PAM type: YTN; PAM sequence: CTT
ttcaaaaaaaacagaacttt

SEQ ID NO: 223525 - DNA, 20 bp, Artificial Sequence
  Description of Artificial Sequence: Synthetic oligonucleotide
  Target: ATXN1; (-) strand; PAM type: YTN; PAM sequence: TTG
acatgtatgtatggaggact

SEQ ID NO: 223526 - DNA, 20 bp, Artificial Sequence
  Description of Artificial Sequence: Synthetic oligonucleotide
  Target: ATXN1; (-) strand; PAM type: YTN; PAM sequence: TTG
tgaattgacatgtatgtatg

SEQ ID NO: 223527 - DNA, 20 bp, Artificial Sequence
  Description of Artificial Sequence: Synthetic oligonucleotide
  Target: ATXN1; (-) strand; PAM type: YTN; PAM sequence: TTT
gtgaattgacatgtatgtat

SEQ ID NO: 223528 - DNA, 20 bp, Artificial Sequence
  Description of Artificial Sequence: Synthetic oligonucleotide
  Target: ATXN1; (-) strand; PAM type: YTN; PAM sequence: TTT
tgtgaattgacatgtatgta

SEQ ID NO: 223529 - DNA, 20 bp, Artificial Sequence
  Description of Artificial Sequence: Synthetic oligonucleotide
  Target: ATXN1; (-) strand; PAM type: YTN; PAM sequence: TTT
ttgtgaattgacatgtatgt

SEQ ID NO: 223530 - DNA, 20 bp, Artificial Sequence
  Description of Artificial Sequence: Synthetic oligonucleotide
  Target: ATXN1; (-) strand; PAM type: YTN; PAM sequence: TTG
catttttgtgaattgacatg

SEQ ID NO: 223531 - DNA, 20 bp, Artificial Sequence
  Description of Artificial Sequence: Synthetic oligonucleotide
  Target: ATXN1; (-) strand; PAM type: YTN; PAM sequence: TTT
gcatttttgtgaattgacat

SEQ ID NO: 223532 - DNA, 20 bp, Artificial Sequence
  Description of Artificial Sequence: Synthetic oligonucleotide
  Target: ATXN1; (-) strand; PAM type: YTN; PAM sequence: TTA
gaatttgcatttttgtgaat

SEQ ID NO: 223533 - DNA, 20 bp, Artificial Sequence
  Description of Artificial Sequence: Synthetic oligonucleotide
  Target: ATXN1; (-) strand; PAM type: YTN; PAM sequence: TTT
agaatttgcatttttgtgaa

SEQ ID NO: 223534 - DNA, 20 bp, Artificial Sequence
  Description of Artificial Sequence: Synthetic oligonucleotide
  Target: ATXN1; (-) strand; PAM type: YTN; PAM sequence: TTT
tagaatttgcatttttgtga

SEQ ID NO: 223535 - DNA, 20 bp, Artificial Sequence
  Description of Artificial Sequence: Synthetic oligonucleotide
  Target: ATXN1; (-) strand; PAM type: YTN; PAM sequence: TTT
ttagaatttgcatttttgtg

SEQ ID NO: 223536 - DNA, 20 bp, Artificial Sequence
  Description of Artificial Sequence: Synthetic oligonucleotide
  Target: ATXN1; (-) strand; PAM type: YTN; PAM sequence: TTG
agtaatttttagaatttgca

SEQ ID NO: 223537 - DNA, 20 bp, Artificial Sequence
  Description of Artificial Sequence: Synthetic oligonucleotide
  Target: ATXN1; (-) strand; PAM type: YTN; PAM sequence: TTT
gagtaatttttagaatttgc

SEQ ID NO: 223538 - DNA, 20 bp, Artificial Sequence
  Description of Artificial Sequence: Synthetic oligonucleotide
  Target: ATXN1; (-) strand; PAM type: YTN; PAM sequence: TTT
tgagtaatttttagaatttg

SEQ ID NO: 223539 - DNA, 20 bp, Artificial Sequence
  Description of Artificial Sequence: Synthetic oligonucleotide
  Target: ATXN1; (-) strand; PAM type: YTN; PAM sequence: CTG
caaaatatagtatcaggaag

SEQ ID NO: 223540 - DNA, 20 bp, Artificial Sequence
  Description of Artificial Sequence: Synthetic oligonucleotide
  Target: ATXN1; (-) strand; PAM type: YTN; PAM sequence: TTG
ccaccatgcactgcaaaata

SEQ ID NO: 223541 - DNA, 20 bp, Artificial Sequence
  Description of Artificial Sequence: Synthetic oligonucleotide
  Target: ATXN1; (-) strand; PAM type: YTN; PAM sequence: TTT
gccaccatgcactgcaaaat

SEQ ID NO: 223542 - DNA, 20 bp, Artificial Sequence
  Description of Artificial Sequence: Synthetic oligonucleotide
  Target: ATXN1; (-) strand; PAM type: YTN; PAM sequence: CTT
tgccaccatgcactgcaaaa

SEQ ID NO: 223543 - DNA, 20 bp, Artificial Sequence
  Description of Artificial Sequence: Synthetic oligonucleotide
  Target: ATXN1; (-) strand; PAM type: YTN; PAM sequence: TTG
cctttgccaccatgcactgc

SEQ ID NO: 223544 - DNA, 20 bp, Artificial Sequence
  Description of Artificial Sequence: Synthetic oligonucleotide
  Target: ATXN1; (-) strand; PAM type: YTN; PAM sequence: TTA
ttgcctttgccaccatgcac

SEQ ID NO: 223545 - DNA, 20 bp, Artificial Sequence
  Description of Artificial Sequence: Synthetic oligonucleotide
  Target: ATXN1; (-) strand; PAM type: YTN; PAM sequence: CTT
attgcctttgccaccatgca

SEQ ID NO: 223546 - DNA, 20 bp, Artificial Sequence
  Description of Artificial Sequence: Synthetic oligonucleotide
  Target: ATXN1; (-) strand; PAM type: YTN; PAM sequence: TTA
ccaaaaaccttattgccttt

SEQ ID NO: 223547 - DNA, 20 bp, Artificial Sequence
  Description of Artificial Sequence: Synthetic oligonucleotide
  Target: ATXN1; (-) strand; PAM type: YTN; PAM sequence: CTG
tgtaacaaggtattaccaaa

SEQ ID NO: 223548 - DNA, 20 bp, Artificial Sequence
  Description of Artificial Sequence: Synthetic oligonucleotide
  Target: ATXN1; (-) strand; PAM type: YTN; PAM sequence: CTA
taaataatctgtgtaacaag

SEQ ID NO: 223549 - DNA, 20 bp, Artificial Sequence
  Description of Artificial Sequence: Synthetic oligonucleotide
  Target: ATXN1; (-) strand; PAM type: YTN; PAM sequence: TTG
ggatgactataaataatctg

SEQ ID NO: 223550 - DNA, 20 bp, Artificial Sequence
  Description of Artificial Sequence: Synthetic oligonucleotide
  Target: ATXN1; (-) strand; PAM type: YTN; PAM sequence: TTT
gggatgactataaataatct

SEQ ID NO: 223551 - DNA, 20 bp, Artificial Sequence
  Description of Artificial Sequence: Synthetic oligonucleotide
  Target: ATXN1; (-) strand; PAM type: YTN; PAM sequence: TTT
tgggatgactataaataatc

SEQ ID NO: 223552 - DNA, 20 bp, Artificial Sequence
  Description of Artificial Sequence: Synthetic oligonucleotide
  Target: ATXN1; (-) strand; PAM type: YTN; PAM sequence: TTA
tgtatgttttgggatgacta

SEQ ID NO: 223553 - DNA, 20 bp, Artificial Sequence
  Description of Artificial Sequence: Synthetic oligonucleotide
  Target: ATXN1; (-) strand; PAM type: YTN; PAM sequence: CTG
tgttatgtatgttttgggat

SEQ ID NO: 223554 - DNA, 20 bp, Artificial Sequence
  Description of Artificial Sequence: Synthetic oligonucleotide
  Target: ATXN1; (-) strand; PAM type: YTN; PAM sequence: CTC
tgtgttatgtatgttttggg

SEQ ID NO: 223555 - DNA, 20 bp, Artificial Sequence
  Description of Artificial Sequence: Synthetic oligonucleotide
  Target: ATXN1; (-) strand; PAM type: YTN; PAM sequence: TTA
agactctgtgttatgtatgt

SEQ ID NO: 223556 - DNA, 20 bp, Artificial Sequence
  Description of Artificial Sequence: Synthetic oligonucleotide
  Target: ATXN1; (-) strand; PAM type: YTN; PAM sequence: TTT
aagactctgtgttatgtatg

SEQ ID NO: 223557 - DNA, 20 bp, Artificial Sequence
  Description of Artificial Sequence: Synthetic oligonucleotide
  Target: ATXN1; (-) strand; PAM type: YTN; PAM sequence: TTA
aaatttaagactctgtgtta

SEQ ID NO: 223558 - DNA, 20 bp, Artificial Sequence
  Description of Artificial Sequence: Synthetic oligonucleotide
  Target: ATXN1; (-) strand; PAM type: YTN; PAM sequence: TTT
aaaatttaagactctgtgtt

SEQ ID NO: 223559 - DNA, 20 bp, Artificial Sequence
  Description of Artificial Sequence: Synthetic oligonucleotide
  Target: ATXN1; (-) strand; PAM type: YTN; PAM sequence: TTT
taaaatttaagactctgtgt

SEQ ID NO: 223560 - DNA, 20 bp, Artificial Sequence
  Description of Artificial Sequence: Synthetic oligonucleotide
  Target: ATXN1; (-) strand; PAM type: YTN; PAM sequence: CTG
atatggttttaaaatttaag

SEQ ID NO: 223561 - DNA, 20 bp, Artificial Sequence
  Description of Artificial Sequence: Synthetic oligonucleotide
  Target: ATXN1; (-) strand; PAM type: YTN; PAM sequence: TTA
gtatctgatatggttttaaa

SEQ ID NO: 223562 - DNA, 20 bp, Artificial Sequence
  Description of Artificial Sequence: Synthetic oligonucleotide
  Target: ATXN1; (-) strand; PAM type: YTN; PAM sequence: TTT
agtatctgatatggttttaa

SEQ ID NO: 223563 - DNA, 20 bp, Artificial Sequence
  Description of Artificial Sequence: Synthetic oligonucleotide
  Target: ATXN1; (-) strand; PAM type: YTN; PAM sequence: TTT
tagtatctgatatggtttta

SEQ ID NO: 223564 - DNA, 20 bp, Artificial Sequence
  Description of Artificial Sequence: Synthetic oligonucleotide
  Target: ATXN1; (-) strand; PAM type: YTN; PAM sequence: TTG
tatattttagtatctgatat

SEQ ID NO: 223565 - DNA, 20 bp, Artificial Sequence
  Description of Artificial Sequence: Synthetic oligonucleotide
  Target: ATXN1; (-) strand; PAM type: YTN; PAM sequence: CTG
gaaggataagttgtatattt

SEQ ID NO: 223566 - DNA, 20 bp, Artificial Sequence
  Description of Artificial Sequence: Synthetic oligonucleotide
  Target: ATXN1; (-) strand; PAM type: YTN; PAM sequence: TTA
ggaaagacctggaaggataa

SEQ ID NO: 223567 - DNA, 20 bp, Artificial Sequence
  Description of Artificial Sequence: Synthetic oligonucleotide
  Target: ATXN1; (-) strand; PAM type: YTN; PAM sequence: TTT
aggaaagacctggaaggata

SEQ ID NO: 223568 - DNA, 20 bp, Artificial Sequence
  Description of Artificial Sequence: Synthetic oligonucleotide
  Target: ATXN1; (-) strand; PAM type: YTN; PAM sequence: TTT
taggaaagacctggaaggat

SEQ ID NO: 223569 - DNA, 20 bp, Artificial Sequence
  Description of Artificial Sequence: Synthetic oligonucleotide
  Target: ATXN1; (-) strand; PAM type: YTN; PAM sequence: CTT
ttaggaaagacctggaagga

SEQ ID NO: 223570 - DNA, 20 bp, Artificial Sequence
  Description of Artificial Sequence: Synthetic oligonucleotide
  Target: ATXN1; (-) strand; PAM type: YTN; PAM sequence: TTC
ggaagtgtatgtataccttt

SEQ ID NO: 223571 - DNA, 20 bp, Artificial Sequence
  Description of Artificial Sequence: Synthetic oligonucleotide
  Target: ATXN1; (-) strand; PAM type: YTN; PAM sequence: CTT
cggaagtgtatgtatacctt

SEQ ID NO: 223572 - DNA, 20 bp, Artificial Sequence
  Description of Artificial Sequence: Synthetic oligonucleotide
  Target: ATXN1; (-) strand; PAM type: YTN; PAM sequence: CTA
cttcggaagtgtatgtatac

SEQ ID NO: 223573 - DNA, 20 bp, Artificial Sequence
  Description of Artificial Sequence: Synthetic oligonucleotide
  Target: ATXN1; (-) strand; PAM type: YTN; PAM sequence: TTA
tactacttcggaagtgtatg

SEQ ID NO: 223574 - DNA, 20 bp, Artificial Sequence
  Description of Artificial Sequence: Synthetic oligonucleotide
  Target: ATXN1; (-) strand; PAM type: YTN; PAM sequence: TTT
atactacttcggaagtgtat

SEQ ID NO: 223575 - DNA, 20 bp, Artificial Sequence
  Description of Artificial Sequence: Synthetic oligonucleotide
  Target: ATXN1; (-) strand; PAM type: YTN; PAM sequence: TTT
tatactacttcggaagtgta

SEQ ID NO: 223576 - DNA, 20 bp, Artificial Sequence
  Description of Artificial Sequence: Synthetic oligonucleotide
  Target: ATXN1; (-) strand; PAM type: YTN; PAM sequence: TTT
ttatactacttcggaagtgt

SEQ ID NO: 223577 - DNA, 20 bp, Artificial Sequence
  Description of Artificial Sequence: Synthetic oligonucleotide
  Target: ATXN1; (-) strand; PAM type: YTN; PAM sequence: TTT
tttatactacttcggaagtg

SEQ ID NO: 223578 - DNA, 20 bp, Artificial Sequence
  Description of Artificial Sequence: Synthetic oligonucleotide
  Target: ATXN1; (-) strand; PAM type: YTN; PAM sequence: TTT
ttttatactacttcggaagt

SEQ ID NO: 223579 - DNA, 20 bp, Artificial Sequence
  Description of Artificial Sequence: Synthetic oligonucleotide
  Target: ATXN1; (-) strand; PAM type: YTN; PAM sequence: TTT
tttttatactacttcggaag

SEQ ID NO: 223580 - DNA, 20 bp, Artificial Sequence
  Description of Artificial Sequence: Synthetic oligonucleotide
  Target: ATXN1; (-) strand; PAM type: YTN; PAM sequence: CTT
ttttttatactacttcggaa

SEQ ID NO: 223581 - DNA, 20 bp, Artificial Sequence
  Description of Artificial Sequence: Synthetic oligonucleotide
  Target: ATXN1; (-) strand; PAM type: YTN; PAM sequence: CTC
ttttttttatactacttcgg

SEQ ID NO: 223582 - DNA, 20 bp, Artificial Sequence
  Description of Artificial Sequence: Synthetic oligonucleotide
  Target: ATXN1; (-) strand; PAM type: YTN; PAM sequence: TTG
aaatgacctcttttttttat

SEQ ID NO: 223583 - DNA, 20 bp, Artificial Sequence
  Description of Artificial Sequence: Synthetic oligonucleotide
  Target: ATXN1; (-) strand; PAM type: YTN; PAM sequence: TTT
gaaatgacctctttttttta

SEQ ID NO: 223584 - DNA, 20 bp, Artificial Sequence
  Description of Artificial Sequence: Synthetic oligonucleotide
  Target: ATXN1; (-) strand; PAM type: YTN; PAM sequence: TTA
tcagatttgaaatgacctct

SEQ ID NO: 223585 - DNA, 20 bp, Artificial Sequence
  Description of Artificial Sequence: Synthetic oligonucleotide
  Target: ATXN1; (-) strand; PAM type: YTN; PAM sequence: TTC
acagtgcgttatcagatttg

SEQ ID NO: 223586 - DNA, 20 bp, Artificial Sequence
  Description of Artificial Sequence: Synthetic oligonucleotide
  Target: ATXN1; (-) strand; PAM type: YTN; PAM sequence: CTA
attcacagtgcgttatcaga

SEQ ID NO: 223587 - DNA, 20 bp, Artificial Sequence
  Description of Artificial Sequence: Synthetic oligonucleotide
  Target: ATXN1; (-) strand; PAM type: YTN; PAM sequence: TTC
actaattcacagtgcgttat

SEQ ID NO: 223588 - DNA, 20 bp, Artificial Sequence
  Description of Artificial Sequence: Synthetic oligonucleotide
  Target: ATXN1; (-) strand; PAM type: YTN; PAM sequence: TTA
agataattcactaattcaca

SEQ ID NO: 223589 - DNA, 20 bp, Artificial Sequence
  Description of Artificial Sequence: Synthetic oligonucleotide
  Target: ATXN1; (-) strand; PAM type: YTN; PAM sequence: TTG
ttaagataattcactaattc

SEQ ID NO: 223590 - DNA, 20 bp, Artificial Sequence
  Description of Artificial Sequence: Synthetic oligonucleotide
  Target: ATXN1; (-) strand; PAM type: YTN; PAM sequence: TTA
ggacagtgttgttaagataa

SEQ ID NO: 223591 - DNA, 20 bp, Artificial Sequence
  Description of Artificial Sequence: Synthetic oligonucleotide
  Target: ATXN1; (-) strand; PAM type: YTN; PAM sequence: TTA
attaggacagtgttgttaag

SEQ ID NO: 223592 - DNA, 20 bp, Artificial Sequence
  Description of Artificial Sequence: Synthetic oligonucleotide
  Target: ATXN1; (-) strand; PAM type: YTN; PAM sequence: CTT
aattaggacagtgttgttaa

SEQ ID NO: 223593 - DNA, 20 bp, Artificial Sequence
  Description of Artificial Sequence: Synthetic oligonucleotide
  Target: ATXN1; (-) strand; PAM type: YTN; PAM sequence: TTG
gtcttaattaggacagtgtt

SEQ ID NO: 223594 - DNA, 20 bp, Artificial Sequence
  Description of Artificial Sequence: Synthetic oligonucleotide
  Target: ATXN1; (-) strand; PAM type: YTN; PAM sequence: TTA
ttggtcttaattaggacagt

SEQ ID NO: 223595 - DNA, 20 bp, Artificial Sequence
  Description of Artificial Sequence: Synthetic oligonucleotide
  Target: ATXN1; (-) strand; PAM type: YTN; PAM sequence: CTT
attggtcttaattaggacag

SEQ ID NO: 223596 - DNA, 20 bp, Artificial Sequence
  Description of Artificial Sequence: Synthetic oligonucleotide
  Target: ATXN1; (-) strand; PAM type: YTN; PAM sequence: TTC
ttattggtcttaattaggac

SEQ ID NO: 223597 - DNA, 20 bp, Artificial Sequence
  Description of Artificial Sequence: Synthetic oligonucleotide
  Target: ATXN1; (-) strand; PAM type: YTN; PAM sequence: TTT
cttattggtcttaattagga

SEQ ID NO: 223598 - DNA, 20 bp, Artificial Sequence
  Description of Artificial Sequence: Synthetic oligonucleotide
  Target: ATXN1; (-) strand; PAM type: YTN; PAM sequence: CTT
tcttattggtcttaattagg

SEQ ID NO: 223599 - DNA, 20 bp, Artificial Sequence
  Description of Artificial Sequence: Synthetic oligonucleotide
  Target: ATXN1; (-) strand; PAM type: YTN; PAM sequence: TTG
gatggatggctttcttattg

SEQ ID NO: 223600 - DNA, 20 bp, Artificial Sequence
  Description of Artificial Sequence: Synthetic oligonucleotide
  Target: ATXN1; (-) strand; PAM type: YTN; PAM sequence: CTC
gtggaatattggatggatgg

SEQ ID NO: 223601 - DNA, 20 bp, Artificial Sequence
  Description of Artificial Sequence: Synthetic oligonucleotide
  Target: ATXN1; (-) strand; PAM type: YTN; PAM sequence: CTG
tctcgtggaatattggatgg

SEQ ID NO: 223602 - DNA, 20 bp, Artificial Sequence
  Description of Artificial Sequence: Synthetic oligonucleotide
  Target: ATXN1; (-) strand; PAM type: YTN; PAM sequence: CTG
gctgtctcgtggaatattgg

SEQ ID NO: 223603 - DNA, 20 bp, Artificial Sequence
  Description of Artificial Sequence: Synthetic oligonucleotide
  Target: ATXN1; (-) strand; PAM type: YTN; PAM sequence: TTA
cacaacgggaagcctggctg

SEQ ID NO: 223604 - DNA, 20 bp, Artificial Sequence
  Description of Artificial Sequence: Synthetic oligonucleotide
  Target: ATXN1; (-) strand; PAM type: YTN; PAM sequence: CTA
tgaggtgaataattacacaa

SEQ ID NO: 223605 - DNA, 20 bp, Artificial Sequence
  Description of Artificial Sequence: Synthetic oligonucleotide
  Target: ATXN1; (-) strand; PAM type: YTN; PAM sequence: TTC
aaggtggaccactatgaggt

SEQ ID NO: 223606 - DNA, 20 bp, Artificial Sequence
  Description of Artificial Sequence: Synthetic oligonucleotide
  Target: ATXN1; (-) strand; PAM type: YTN; PAM sequence: CTT
caaggtggaccactatgagg

SEQ ID NO: 223607 - DNA, 20 bp, Artificial Sequence
  Description of Artificial Sequence: Synthetic oligonucleotide
  Target: ATXN1; (-) strand; PAM type: YTN; PAM sequence: TTG
catgccttcaaggtggacca

SEQ ID NO: 223608 - DNA, 20 bp, Artificial Sequence
  Description of Artificial Sequence: Synthetic oligonucleotide
  Target: ATXN1; (-) strand; PAM type: YTN; PAM sequence: TTC
ggcataatgtgttgcatgcc

SEQ ID NO: 223609 - DNA, 20 bp, Artificial Sequence
  Description of Artificial Sequence: Synthetic oligonucleotide
  Target: ATXN1; (-) strand; PAM type: YTN; PAM sequence: TTT
cggcataatgtgttgcatgc

SEQ ID NO: 223610 - DNA, 20 bp, Artificial Sequence
  Description of Artificial Sequence: Synthetic oligonucleotide
  Target: ATXN1; (-) strand; PAM type: YTN; PAM sequence: TTT
tcggcataatgtgttgcatg

SEQ ID NO: 223611 - DNA, 20 bp, Artificial Sequence
  Description of Artificial Sequence: Synthetic oligonucleotide
  Target: ATXN1; (-) strand; PAM type: YTN; PAM sequence: CTT
ttcggcataatgtgttgcat

SEQ ID NO: 223612 - DNA, 20 bp, Artificial Sequence
  Description of Artificial Sequence: Synthetic oligonucleotide
  Target: ATXN1; (-) strand; PAM type: YTN; PAM sequence: CTC
ttttcggcataatgtgttgc

SEQ ID NO: 223613 - DNA, 20 bp, Artificial Sequence
  Description of Artificial Sequence: Synthetic oligonucleotide
  Target: ATXN1; (-) strand; PAM type: YTN; PAM sequence: CTA
tataaatatctcttttcggc

SEQ ID NO: 223614 - DNA, 20 bp, Artificial Sequence
  Description of Artificial Sequence: Synthetic oligonucleotide
  Target: ATXN1; (-) strand; PAM type: YTN; PAM sequence: TTC
tatataaatatctcttttcg

SEQ ID NO: 223615 - DNA, 20 bp, Artificial Sequence
  Description of Artificial Sequence: Synthetic oligonucleotide
  Target: ATXN1; (-) strand; PAM type: YTN; PAM sequence: CTT
ctatataaatatctcttttc

SEQ ID NO: 223616 - DNA, 20 bp, Artificial Sequence
  Description of Artificial Sequence: Synthetic oligonucleotide
  Target: ATXN1; (-) strand; PAM type: YTN; PAM sequence: TTC
ccttctatataaatatctct

SEQ ID NO: 223617 - DNA, 20 bp, Artificial Sequence
  Description of Artificial Sequence: Synthetic oligonucleotide
  Target: ATXN1; (-) strand; PAM type: YTN; PAM sequence: CTA
agtaattcccttctatataa

SEQ ID NO: 223618 - DNA, 20 bp, Artificial Sequence
  Description of Artificial Sequence: Synthetic oligonucleotide
  Target: ATXN1; (-) strand; PAM type: YTN; PAM sequence: TTA
gggacatccgcatgtcctaa

SEQ ID NO: 223619 - DNA, 20 bp, Artificial Sequence
  Description of Artificial Sequence: Synthetic oligonucleotide
  Target: ATXN1; (-) strand; PAM type: YTN; PAM sequence: TTT
agggacatccgcatgtccta

SEQ ID NO: 223620 - DNA, 20 bp, Artificial Sequence
  Description of Artificial Sequence: Synthetic oligonucleotide
  Target: ATXN1; (-) strand; PAM type: YTN; PAM sequence: TTT
tagggacatccgcatgtcct

SEQ ID NO: 223621 - DNA, 20 bp, Artificial Sequence
  Description of Artificial Sequence: Synthetic oligonucleotide
  Target: ATXN1; (-) strand; PAM type: YTN; PAM sequence: TTA
ttttagggacatccgcatgt

SEQ ID NO: 223622 - DNA, 20 bp, Artificial Sequence
  Description of Artificial Sequence: Synthetic oligonucleotide
  Target: ATXN1; (-) strand; PAM type: YTN; PAM sequence: TTT
attttagggacatccgcatg

SEQ ID NO: 223623 - DNA, 20 bp, Artificial Sequence
  Description of Artificial Sequence: Synthetic oligonucleotide
  Target: ATXN1; (-) strand; PAM type: YTN; PAM sequence: CTT
tattttagggacatccgcat

SEQ ID NO: 223624 - DNA, 20 bp, Artificial Sequence
  Description of Artificial Sequence: Synthetic oligonucleotide
  Target: ATXN1; (-) strand; PAM type: YTN; PAM sequence: CTC
gagtggtcaagaatctttat

SEQ ID NO: 223625 - DNA, 20 bp, Artificial Sequence
  Description of Artificial Sequence: Synthetic oligonucleotide
  Target: ATXN1; (-) strand; PAM type: YTN; PAM sequence: CTG
agtagctcgagtggtcaaga

SEQ ID NO: 223626 - DNA, 20 bp, Artificial Sequence
  Description of Artificial Sequence: Synthetic oligonucleotide
  Target: ATXN1; (-) strand; PAM type: YTN; PAM sequence: CTA
gagagaaatactgagtagct

SEQ ID NO: 223627 - DNA, 20 bp, Artificial Sequence
  Description of Artificial Sequence: Synthetic oligonucleotide
  Target: ATXN1; (-) strand; PAM type: YTN; PAM sequence: CTA
gcctagagagaaatactgag

SEQ ID NO: 223628 - DNA, 20 bp, Artificial Sequence
  Description of Artificial Sequence: Synthetic oligonucleotide
  Target: ATXN1; (-) strand; PAM type: YTN; PAM sequence: TTC
tagcctagagagaaatactg

SEQ ID NO: 223629 - DNA, 20 bp, Artificial Sequence
  Description of Artificial Sequence: Synthetic oligonucleotide
  Target: ATXN1; (-) strand; PAM type: YTN; PAM sequence: TTT
ctagcctagagagaaatact

SEQ ID NO: 223630 - DNA, 20 bp, Artificial Sequence
  Description of Artificial Sequence: Synthetic oligonucleotide
  Target: ATXN1; (-) strand; PAM type: YTN; PAM sequence: CTG
tttctagcctagagagaaat

SEQ ID NO: 223631 - DNA, 20 bp, Artificial Sequence
  Description of Artificial Sequence: Synthetic oligonucleotide
  Target: ATXN1; (-) strand; PAM type: YTN; PAM sequence: TTC
tgtttctagcctagagagaa

SEQ ID NO: 223632 - DNA, 20 bp, Artificial Sequence
  Description of Artificial Sequence: Synthetic oligonucleotide
  Target: ATXN1; (-) strand; PAM type: YTN; PAM sequence: TTT
ctgtttctagcctagagaga

SEQ ID NO: 223633 - DNA, 20 bp, Artificial Sequence
  Description of Artificial Sequence: Synthetic oligonucleotide
  Target: ATXN1; (-) strand; PAM type: YTN; PAM sequence: TTT
tctgtttctagcctagagag

SEQ ID NO: 223634 - DNA, 20 bp, Artificial Sequence
  Description of Artificial Sequence: Synthetic oligonucleotide
  Target: ATXN1; (-) strand; PAM type: YTN; PAM sequence: CTT
ttctgtttctagcctagaga

SEQ ID NO: 223635 - DNA, 20 bp, Artificial Sequence
  Description of Artificial Sequence: Synthetic oligonucleotide
  Target: ATXN1; (-) strand; PAM type: YTN; PAM sequence: TTA
atcttttctgtttctagcct

SEQ ID NO: 223636 - DNA, 20 bp, Artificial Sequence
  Description of Artificial Sequence: Synthetic oligonucleotide
  Target: ATXN1; (-) strand; PAM type: YTN; PAM sequence: TTT
aatcttttctgtttctagcc

SEQ ID NO: 223637 - DNA, 20 bp, Artificial Sequence
  Description of Artificial Sequence: Synthetic oligonucleotide
  Target: ATXN1; (-) strand; PAM type: YTN; PAM sequence: TTA
tttaatcttttctgtttcta

SEQ ID NO: 223638 - DNA, 20 bp, Artificial Sequence
  Description of Artificial Sequence: Synthetic oligonucleotide
  Target: ATXN1; (-) strand; PAM type: YTN; PAM sequence: TTC
ccatatgaatatgttattta

SEQ ID NO: 223639 - DNA, 20 bp, Artificial Sequence
  Description of Artificial Sequence: Synthetic oligonucleotide
  Target: ATXN1; (-) strand; PAM type: YTN; PAM sequence: CTT
cccatatgaatatgttattt

SEQ ID NO: 223640 - DNA, 20 bp, Artificial Sequence
  Description of Artificial Sequence: Synthetic oligonucleotide
  Target: ATXN1; (-) strand; PAM type: YTN; PAM sequence: TTG
acttcccatatgaatatgtt

SEQ ID NO: 223641 - DNA, 20 bp, Artificial Sequence
  Description of Artificial Sequence: Synthetic oligonucleotide
  Target: ATXN1; (-) strand; PAM type: YTN; PAM sequence: TTG
atggaaaaattgacttccca

SEQ ID NO: 223642 - DNA, 20 bp, Artificial Sequence
  Description of Artificial Sequence: Synthetic oligonucleotide
  Target: ATXN1; (-) strand; PAM type: YTN; PAM sequence: TTC
attgatggaaaaattgactt

SEQ ID NO: 223643 - DNA, 20 bp, Artificial Sequence
  Description of Artificial Sequence: Synthetic oligonucleotide
  Target: ATXN1; (-) strand; PAM type: YTN; PAM sequence: TTT
cattgatggaaaaattgact

SEQ ID NO: 223644 - DNA, 20 bp, Artificial Sequence
  Description of Artificial Sequence: Synthetic oligonucleotide
  Target: ATXN1; (-) strand; PAM type: YTN; PAM sequence: TTT
tcattgatggaaaaattgac

SEQ ID NO: 223645 - DNA, 20 bp, Artificial Sequence
  Description of Artificial Sequence: Synthetic oligonucleotide
  Target: ATXN1; (-) strand; PAM type: YTN; PAM sequence: CTT
ttcattgatggaaaaattga

SEQ ID NO: 223646 - DNA, 20 bp, Artificial Sequence
  Description of Artificial Sequence: Synthetic oligonucleotide
  Target: ATXN1; (-) strand; PAM type: YTN; PAM sequence: TTG
cttttcattgatggaaaaat

SEQ ID NO: 223647 - DNA, 20 bp, Artificial Sequence
  Description of Artificial Sequence: Synthetic oligonucleotide
  Target: ATXN1; (-) strand; PAM type: YTN; PAM sequence: CTT
gcttttcattgatggaaaaa

SEQ ID NO: 223648 - DNA, 20 bp, Artificial Sequence
  Description of Artificial Sequence: Synthetic oligonucleotide
  Target: ATXN1; (-) strand; PAM type: YTN; PAM sequence: TTC
ttgcttttcattgatggaaa

SEQ ID NO: 223649 - DNA, 20 bp, Artificial Sequence
  Description of Artificial Sequence: Synthetic oligonucleotide
  Target: ATXN1; (-) strand; PAM type: YTN; PAM sequence: TTT
cttgcttttcattgatggaa

SEQ ID NO: 223650 - DNA, 20 bp, Artificial Sequence
  Description of Artificial Sequence: Synthetic oligonucleotide
  Target: ATXN1; (-) strand; PAM type: YTN; PAM sequence: TTA
cggtttcttgcttttcattg

SEQ ID NO: 223651 - DNA, 20 bp, Artificial Sequence
  Description of Artificial Sequence: Synthetic oligonucleotide
  Target: ATXN1; (-) strand; PAM type: YTN; PAM sequence: CTT
acggtttcttgcttttcatt

SEQ ID NO: 223652 - DNA, 20 bp, Artificial Sequence
  Description of Artificial Sequence: Synthetic oligonucleotide
  Target: ATXN1; (-) strand; PAM type: YTN; PAM sequence: CTC
ttacggtttcttgcttttca

SEQ ID NO: 223653 - DNA, 20 bp, Artificial Sequence
  Description of Artificial Sequence: Synthetic oligonucleotide
  Target: ATXN1; (-) strand; PAM type: YTN; PAM sequence: TTG
aaatgctcttacggtttctt

SEQ ID NO: 223654 - DNA, 20 bp, Artificial Sequence
  Description of Artificial Sequence: Synthetic oligonucleotide
  Target: ATXN1; (-) strand; PAM type: YTN; PAM sequence: CTT
gaaatgctcttacggtttct

SEQ ID NO: 223655 - DNA, 20 bp, Artificial Sequence
  Description of Artificial Sequence: Synthetic oligonucleotide
  Target: ATXN1; (-) strand; PAM type: YTN; PAM sequence: TTG
ccttgaaatgctcttacggt

SEQ ID NO: 223656 - DNA, 20 bp, Artificial Sequence
  Description of Artificial Sequence: Synthetic oligonucleotide
  Target: ATXN1; (-) strand; PAM type: YTN; PAM sequence: CTT
gccttgaaatgctcttacgg

SEQ ID NO: 223657 - DNA, 20 bp, Artificial Sequence
  Description of Artificial Sequence: Synthetic oligonucleotide
  Target: ATXN1; (-) strand; PAM type: YTN; PAM sequence: TTA
aaagatcttgccttgaaatg

SEQ ID NO: 223658 - DNA, 20 bp, Artificial Sequence
  Description of Artificial Sequence: Synthetic oligonucleotide
  Target: ATXN1; (-) strand; PAM type: YTN; PAM sequence: TTT
aaaagatcttgccttgaaat

SEQ ID NO: 223659 - DNA, 20 bp, Artificial Sequence
  Description of Artificial Sequence: Synthetic oligonucleotide
  Target: ATXN1; (-) strand; PAM type: YTN; PAM sequence: CTT
taaaagatcttgccttgaaa

SEQ ID NO: 223660 - DNA, 20 bp, Artificial Sequence
  Description of Artificial Sequence: Synthetic oligonucleotide
  Target: ATXN1; (-) strand; PAM type: YTN; PAM sequence: TTG
taggactttaaaagatcttg

SEQ ID NO: 223661 - DNA, 20 bp, Artificial Sequence
  Description of Artificial Sequence: Synthetic oligonucleotide
  Target: ATXN1; (-) strand; PAM type: YTN; PAM sequence: TTT
gtaggactttaaaagatctt

SEQ ID NO: 223662 - DNA, 20 bp, Artificial Sequence
  Description of Artificial Sequence: Synthetic oligonucleotide
  Target: ATXN1; (-) strand; PAM type: YTN; PAM sequence: TTA
aatatttgtaggactttaaa

SEQ ID NO: 223663 - DNA, 20 bp, Artificial Sequence
  Description of Artificial Sequence: Synthetic oligonucleotide
  Target: ATXN1; (-) strand; PAM type: YTN; PAM sequence: CTT
aaatatttgtaggactttaa

SEQ ID NO: 223664 - DNA, 20 bp, Artificial Sequence
  Description of Artificial Sequence: Synthetic oligonucleotide
  Target: ATXN1; (-) strand; PAM type: YTN; PAM sequence: TTA
tacttaaatatttgtaggac

SEQ ID NO: 223665 - DNA, 20 bp, Artificial Sequence
  Description of Artificial Sequence: Synthetic oligonucleotide
  Target: ATXN1; (-) strand; PAM type: YTN; PAM sequence: TTA
aaaagtgtagagaggttata

SEQ ID NO: 223666 - DNA, 20 bp, Artificial Sequence
  Description of Artificial Sequence: Synthetic oligonucleotide
  Target: ATXN1; (-) strand; PAM type: YTN; PAM sequence: TTT
aaaaagtgtagagaggttat

SEQ ID NO: 223667 - DNA, 20 bp, Artificial Sequence
  Description of Artificial Sequence: Synthetic oligonucleotide
  Target: ATXN1; (-) strand; PAM type: YTN; PAM sequence: TTT
taaaaagtgtagagaggtta

SEQ ID NO: 223668 - DNA, 20 bp, Artificial Sequence
  Description of Artificial Sequence: Synthetic oligonucleotide
  Target: ATXN1; (-) strand; PAM type: YTN; PAM sequence: TTT
ttaaaaagtgtagagaggtt

SEQ ID NO: 223669 - DNA, 20 bp, Artificial Sequence
  Description of Artificial Sequence: Synthetic oligonucleotide
  Target: ATXN1; (-) strand; PAM type: YTN; PAM sequence: CTG
tatttttaaaaagtgtagag

SEQ ID NO: 223670 - DNA, 20 bp, Artificial Sequence
  Description of Artificial Sequence: Synthetic oligonucleotide
  Target: ATXN1; (-) strand; PAM type: YTN; PAM sequence: TTA
aataaactgtatttttaaaa

SEQ ID NO: 223671 - DNA, 20 bp, Artificial Sequence
  Description of Artificial Sequence: Synthetic oligonucleotide
  Target: ATXN1; (-) strand; PAM type: YTN; PAM sequence: TTT
aaataaactgtatttttaaa

SEQ ID NO: 223672 - DNA, 20 bp, Artificial Sequence
  Description of Artificial Sequence: Synthetic oligonucleotide
  Target: ATXN1; (-) strand; PAM type: YTN; PAM sequence: CTT
taaataaactgtatttttaa

SEQ ID NO: 223673 - DNA, 20 bp, Artificial Sequence
  Description of Artificial Sequence: Synthetic oligonucleotide
  Target: ATXN1; (-) strand; PAM type: YTN; PAM sequence: TTA
tatctttaaataaactgtat

SEQ ID NO: 223674 - DNA, 20 bp, Artificial Sequence
  Description of Artificial Sequence: Synthetic oligonucleotide
  Target: ATXN1; (-) strand; PAM type: YTN; PAM sequence: CTT
atatctttaaataaactgta

SEQ ID NO: 223675 - DNA, 20 bp, Artificial Sequence
  Description of Artificial Sequence: Synthetic oligonucleotide
  Target: ATXN1; (-) strand; PAM type: YTN; PAM sequence: TTC
cttatatctttaaataaact

SEQ ID NO: 223676 - DNA, 20 bp, Artificial Sequence
  Description of Artificial Sequence: Synthetic oligonucleotide
  Target: ATXN1; (-) strand; PAM type: YTN; PAM sequence: TTT
ccttatatctttaaataaac

SEQ ID NO: 223677 - DNA, 20 bp, Artificial Sequence
  Description of Artificial Sequence: Synthetic oligonucleotide
  Target: ATXN1; (-) strand; PAM type: YTN; PAM sequence: CTT
tccttatatctttaaataaa

SEQ ID NO: 223678 - DNA, 20 bp, Artificial Sequence
  Description of Artificial Sequence: Synthetic oligonucleotide
  Target: ATXN1; (-) strand; PAM type: YTN; PAM sequence: TTG
atggactttccttatatctt

SEQ ID NO: 223679 - DNA, 20 bp, Artificial Sequence
  Description of Artificial Sequence: Synthetic oligonucleotide
  Target: ATXN1; (-) strand; PAM type: YTN; PAM sequence: TTT
gatggactttccttatatct

SEQ ID NO: 223680 - DNA, 20 bp, Artificial Sequence
  Description of Artificial Sequence: Synthetic oligonucleotide
  Target: ATXN1; (-) strand; PAM type: YTN; PAM sequence: TTA
tttgatggactttccttata

SEQ ID NO: 223681 - DNA, 20 bp, Artificial Sequence
  Description of Artificial Sequence: Synthetic oligonucleotide
  Target: ATXN1; (-) strand; PAM type: YTN; PAM sequence: TTT
atttgatggactttccttat

SEQ ID NO: 223682 - DNA, 20 bp, Artificial Sequence
  Description of Artificial Sequence: Synthetic oligonucleotide
  Target: ATXN1; (-) strand; PAM type: YTN; PAM sequence: TTG
tttatttgatggactttcct

SEQ ID NO: 223683 - DNA, 20 bp, Artificial Sequence
  Description of Artificial Sequence: Synthetic oligonucleotide
  Target: ATXN1; (-) strand; PAM type: YTN; PAM sequence: CTT
gtttatttgatggactttcc

SEQ ID NO: 223684 - DNA, 20 bp, Artificial Sequence
  Description of Artificial Sequence: Synthetic oligonucleotide
  Target: ATXN1; (-) strand; PAM type: YTN; PAM sequence: TTC
ttgtttatttgatggacttt

SEQ ID NO: 223685 - DNA, 20 bp, Artificial Sequence
  Description of Artificial Sequence: Synthetic oligonucleotide
  Target: ATXN1; (-) strand; PAM type: YTN; PAM sequence: TTT
cttgtttatttgatggactt

SEQ ID NO: 223686 - DNA, 20 bp, Artificial Sequence
  Description of Artificial Sequence: Synthetic oligonucleotide
  Target: ATXN1; (-) strand; PAM type: YTN; PAM sequence: CTC
agtaaatatttcttgtttat

SEQ ID NO: 223687 - DNA, 20 bp, Artificial Sequence
  Description of Artificial Sequence: Synthetic oligonucleotide
  Target: ATXN1; (-) strand; PAM type: YTN; PAM sequence: TTC
tcagtaaatatttcttgttt

SEQ ID NO: 223688 - DNA, 20 bp, Artificial Sequence
  Description of Artificial Sequence: Synthetic oligonucleotide
  Target: ATXN1; (-) strand; PAM type: YTN; PAM sequence: CTG
gccacaaaggaggttctcag

SEQ ID NO: 223689 - DNA, 20 bp, Artificial Sequence
  Description of Artificial Sequence: Synthetic oligonucleotide
  Target: ATXN1; (-) strand; PAM type: YTN; PAM sequence: TTA
gatagaaacataatcctggc

SEQ ID NO: 223690 - DNA, 20 bp, Artificial Sequence
  Description of Artificial Sequence: Synthetic oligonucleotide
  Target: ATXN1; (-) strand; PAM type: YTN; PAM sequence: CTT
agatagaaacataatcctgg

SEQ ID NO: 223691 - DNA, 20 bp, Artificial Sequence
  Description of Artificial Sequence: Synthetic oligonucleotide
  Target: ATXN1; (-) strand; PAM type: YTN; PAM sequence: TTC
atgggacttagatagaaaca

SEQ ID NO: 223692 - DNA, 20 bp, Artificial Sequence
  Description of Artificial Sequence: Synthetic oligonucleotide
  Target: ATXN1; (-) strand; PAM type: YTN; PAM sequence: CTC
caagttcatgggacttagat

SEQ ID NO: 223693 - DNA, 20 bp, Artificial Sequence
  Description of Artificial Sequence: Synthetic oligonucleotide
  Target: ATXN1; (-) strand; PAM type: YTN; PAM sequence: TTG
taaatatgctccaagttcat

SEQ ID NO: 223694 - DNA, 20 bp, Artificial Sequence
  Description of Artificial Sequence: Synthetic oligonucleotide
  Target: ATXN1; (-) strand; PAM type: YTN; PAM sequence: TTT
gtaaatatgctccaagttca

SEQ ID NO: 223695 - DNA, 20 bp, Artificial Sequence
  Description of Artificial Sequence: Synthetic oligonucleotide
  Target: ATXN1; (-) strand; PAM type: YTN; PAM sequence: TTT
tgtaaatatgctccaagttc

SEQ ID NO: 223696 - DNA, 20 bp, Artificial Sequence
  Description of Artificial Sequence: Synthetic oligonucleotide
  Target: ATXN1; (-) strand; PAM type: YTN; PAM sequence: TTA
aataattttgtaaatatgct

SEQ ID NO: 223697 - DNA, 20 bp, Artificial Sequence
  Description of Artificial Sequence: Synthetic oligonucleotide
  Target: ATXN1; (-) strand; PAM type: YTN; PAM sequence: TTA
taaagttaaataattttgta

SEQ ID NO: 223698 - DNA, 20 bp, Artificial Sequence
  Description of Artificial Sequence: Synthetic oligonucleotide
  Target: ATXN1; (-) strand; PAM type: YTN; PAM sequence: TTT
ataaagttaaataattttgt

SEQ ID NO: 223699 - DNA, 20 bp, Artificial Sequence
  Description of Artificial Sequence: Synthetic oligonucleotide
  Target: ATXN1; (-) strand; PAM type: YTN; PAM sequence: CTT
tataaagttaaataattttg

SEQ ID NO: 223700 - DNA, 20 bp, Artificial Sequence
  Description of Artificial Sequence: Synthetic oligonucleotide
  Target: ATXN1; (-) strand; PAM type: YTN; PAM sequence: TTG
aaatactttataaagttaaa

SEQ ID NO: 223701 - DNA, 20 bp, Artificial Sequence
  Description of Artificial Sequence: Synthetic oligonucleotide
  Target: ATXN1; (-) strand; PAM type: YTN; PAM sequence: TTC
attgaaatactttataaagt

SEQ ID NO: 223702 - DNA, 20 bp, Artificial Sequence
  Description of Artificial Sequence: Synthetic oligonucleotide
  Target: ATXN1; (-) strand; PAM type: YTN; PAM sequence: TTA
ttcattgaaatactttataa

SEQ ID NO: 223703 - DNA, 20 bp, Artificial Sequence
  Description of Artificial Sequence: Synthetic oligonucleotide
  Target: ATXN1; (-) strand; PAM type: YTN; PAM sequence: CTG
cattattcattgaaatactt

SEQ ID NO: 223704 - DNA, 20 bp, Artificial Sequence
  Description of Artificial Sequence: Synthetic oligonucleotide
  Target: ATXN1; (-) strand; PAM type: YTN; PAM sequence: TTG
gaagactgcattattcattg

SEQ ID NO: 223705 - DNA, 20 bp, Artificial Sequence
  Description of Artificial Sequence: Synthetic oligonucleotide
  Target: ATXN1; (-) strand; PAM type: YTN; PAM sequence: TTT
ggaagactgcattattcatt

SEQ ID NO: 223706 - DNA, 20 bp, Artificial Sequence
  Description of Artificial Sequence: Synthetic oligonucleotide
  Target: ATXN1; (-) strand; PAM type: YTN; PAM sequence: TTT
tggaagactgcattattcat

SEQ ID NO: 223707 - DNA, 20 bp, Artificial Sequence
  Description of Artificial Sequence: Synthetic oligonucleotide
  Target: ATXN1; (-) strand; PAM type: YTN; PAM sequence: TTA
cagccccatgcacattttgg

SEQ ID NO: 223708 - DNA, 20 bp, Artificial Sequence
  Description of Artificial Sequence: Synthetic oligonucleotide
  Target: ATXN1; (-) strand; PAM type: YTN; PAM sequence: CTA
gatggaattacagccccatg

SEQ ID NO: 223709 - DNA, 20 bp, Artificial Sequence
  Description of Artificial Sequence: Synthetic oligonucleotide
  Target: ATXN1; (-) strand; PAM type: YTN; PAM sequence: TTG
taaacactagatggaattac

SEQ ID NO: 223710 - DNA, 20 bp, Artificial Sequence
  Description of Artificial Sequence: Synthetic oligonucleotide
  Target: ATXN1; (-) strand; PAM type: YTN; PAM sequence: TTA
tagtgtcattgtaaacacta

SEQ ID NO: 223711 - DNA, 20 bp, Artificial Sequence
  Description of Artificial Sequence: Synthetic oligonucleotide
  Target: ATXN1; (-) strand; PAM type: YTN; PAM sequence: CTT
atagtgtcattgtaaacact

SEQ ID NO: 223712 - DNA, 20 bp, Artificial Sequence
  Description of Artificial Sequence: Synthetic oligonucleotide
  Target: ATXN1; (-) strand; PAM type: YTN; PAM sequence: TTC
catccaaggcttatagtgtc

SEQ ID NO: 223713 - DNA, 20 bp, Artificial Sequence
  Description of Artificial Sequence: Synthetic oligonucleotide
  Target: ATXN1; (-) strand; PAM type: YTN; PAM sequence: TTG
taattccatccaaggcttat

SEQ ID NO: 223714 - DNA, 20 bp, Artificial Sequence
  Description of Artificial Sequence: Synthetic oligonucleotide
  Target: ATXN1; (-) strand; PAM type: YTN; PAM sequence: TTA
agattgtaattccatccaag

SEQ ID NO: 223715 - DNA, 20 bp, Artificial Sequence
  Description of Artificial Sequence: Synthetic oligonucleotide
  Target: ATXN1; (-) strand; PAM type: YTN; PAM sequence: TTC
ccattaagattgtaattcca

SEQ ID NO: 223716 - DNA, 20 bp, Artificial Sequence
  Description of Artificial Sequence: Synthetic oligonucleotide
  Target: ATXN1; (-) strand; PAM type: YTN; PAM sequence: TTG
ttcccattaagattgtaatt

SEQ ID NO: 223717 - DNA, 20 bp, Artificial Sequence
  Description of Artificial Sequence: Synthetic oligonucleotide
  Target: ATXN1; (-) strand; PAM type: YTN; PAM sequence: CTG
attgttcccattaagattgt

SEQ ID NO: 223718 - DNA, 20 bp, Artificial Sequence
  Description of Artificial Sequence: Synthetic oligonucleotide
  Target: ATXN1; (-) strand; PAM type: YTN; PAM sequence: CTC
tgattgttcccattaagatt

SEQ ID NO: 223719 - DNA, 20 bp, Artificial Sequence
  Description of Artificial Sequence: Synthetic oligonucleotide
  Target: ATXN1; (-) strand; PAM type: YTN; PAM sequence: CTG
agcatatggagtagtgcact

SEQ ID NO: 223720 - DNA, 20 bp, Artificial Sequence
  Description of Artificial Sequence: Synthetic oligonucleotide
  Target: ATXN1; (-) strand; PAM type: YTN; PAM sequence: CTC
tgagcatatggagtagtgca

SEQ ID NO: 223721 - DNA, 20 bp, Artificial Sequence
  Description of Artificial Sequence: Synthetic oligonucleotide
  Target: ATXN1; (-) strand; PAM type: YTN; PAM sequence: TTC
tctgagcatatggagtagtg

SEQ ID NO: 223722 - DNA, 20 bp, Artificial Sequence
  Description of Artificial Sequence: Synthetic oligonucleotide
  Target: ATXN1; (-) strand; PAM type: YTN; PAM sequence: CTG
aattctctgagcatatggag

SEQ ID NO: 223723 - DNA, 20 bp, Artificial Sequence
  Description of Artificial Sequence: Synthetic oligonucleotide
  Target: ATXN1; (-) strand; PAM type: YTN; PAM sequence: TTC
atcctgaattctctgagcat

SEQ ID NO: 223724 - DNA, 20 bp, Artificial Sequence
  Description of Artificial Sequence: Synthetic oligonucleotide
  Target: ATXN1; (-) strand; PAM type: YTN; PAM sequence: TTG
agttcatcctgaattctctg

SEQ ID NO: 223725 - DNA, 20 bp, Artificial Sequence
  Description of Artificial Sequence: Synthetic oligonucleotide
  Target: ATXN1; (-) strand; PAM type: YTN; PAM sequence: TTA
gaagttgagttcatcctgaa

SEQ ID NO: 223726 - DNA, 20 bp, Artificial Sequence
  Description of Artificial Sequence: Synthetic oligonucleotide
  Target: ATXN1; (-) strand; PAM type: YTN; PAM sequence: TTT
agaagttgagttcatcctga

SEQ ID NO: 223727 - DNA, 20 bp, Artificial Sequence
  Description of Artificial Sequence: Synthetic oligonucleotide
  Target: ATXN1; (-) strand; PAM type: YTN; PAM sequence: TTT
tagaagttgagttcatcctg

SEQ ID NO: 223728 - DNA, 20 bp, Artificial Sequence
  Description of Artificial Sequence: Synthetic oligonucleotide
  Target: ATXN1; (-) strand; PAM type: YTN; PAM sequence: TTA
ttttagaagttgagttcatc

SEQ ID NO: 223729 - DNA, 20 bp, Artificial Sequence
  Description of Artificial Sequence: Synthetic oligonucleotide
  Target: ATXN1; (-) strand; PAM type: YTN; PAM sequence: TTT
attttagaagttgagttcat

SEQ ID NO: 223730 - DNA, 20 bp, Artificial Sequence
  Description of Artificial Sequence: Synthetic oligonucleotide
  Target: ATXN1; (-) strand; PAM type: YTN; PAM sequence: TTT
tattttagaagttgagttca

SEQ ID NO: 223731 - DNA, 20 bp, Artificial Sequence
  Description of Artificial Sequence: Synthetic oligonucleotide
  Target: ATXN1; (-) strand; PAM type: YTN; PAM sequence: TTT
ttattttagaagttgagttc

SEQ ID NO: 223732 - DNA, 20 bp, Artificial Sequence
  Description of Artificial Sequence: Synthetic oligonucleotide
  Target: ATXN1; (-) strand; PAM type: YTN; PAM sequence: CTT
tttattttagaagttgagtt

SEQ ID NO: 223733 - DNA, 20 bp, Artificial Sequence
  Description of Artificial Sequence: Synthetic oligonucleotide
  Target: ATXN1; (-) strand; PAM type: YTN; PAM sequence: TTG
gtgctttttattttagaagt

SEQ ID NO: 223734 - DNA, 20 bp, Artificial Sequence
  Description of Artificial Sequence: Synthetic oligonucleotide
  Target: ATXN1; (-) strand; PAM type: YTN; PAM sequence: CTT
ggtgctttttattttagaag

SEQ ID NO: 223735 - DNA, 20 bp, Artificial Sequence
  Description of Artificial Sequence: Synthetic oligonucleotide
  Target: ATXN1; (-) strand; PAM type: YTN; PAM sequence: TTA
catgccaatggcttggtgct

SEQ ID NO: 223736 - DNA, 20 bp, Artificial Sequence
  Description of Artificial Sequence: Synthetic oligonucleotide
  Target: ATXN1; (-) strand; PAM type: YTN; PAM sequence: TTG
taattacatgccaatggctt

SEQ ID NO: 223737 - DNA, 20 bp, Artificial Sequence
  Description of Artificial Sequence: Synthetic oligonucleotide
  Target: ATXN1; (-) strand; PAM type: YTN; PAM sequence: CTG
gttgtaattacatgccaatg

SEQ ID NO: 223738 - DNA, 20 bp, Artificial Sequence
  Description of Artificial Sequence: Synthetic oligonucleotide
  Target: ATXN1; (-) strand; PAM type: YTN; PAM sequence: CTC
ctggttgtaattacatgcca

SEQ ID NO: 223739 - DNA, 20 bp, Artificial Sequence
  Description of Artificial Sequence: Synthetic oligonucleotide
  Target: ATXN1; (-) strand; PAM type: YTN; PAM sequence: TTG
gcctcctggttgtaattaca

SEQ ID NO: 223740 - DNA, 20 bp, Artificial Sequence
  Description of Artificial Sequence: Synthetic oligonucleotide
  Target: ATXN1; (-) strand; PAM type: YTN; PAM sequence: CTT
ggcctcctggttgtaattac

SEQ ID NO: 223741 - DNA, 20 bp, Artificial Sequence
  Description of Artificial Sequence: Synthetic oligonucleotide
  Target: ATXN1; (-) strand; PAM type: YTN; PAM sequence: CTA
gcaagcagacagcttggcct

SEQ ID NO: 223742 - DNA, 20 bp, Artificial Sequence
  Description of Artificial Sequence: Synthetic oligonucleotide
  Target: ATXN1; (-) strand; PAM type: YTN; PAM sequence: CTC
atatactagcaagcagacag

SEQ ID NO: 223743 - DNA, 20 bp, Artificial Sequence
  Description of Artificial Sequence: Synthetic oligonucleotide
  Target: ATXN1; (-) strand; PAM type: YTN; PAM sequence: TTC
tcatatactagcaagcagac

SEQ ID NO: 223744 - DNA, 20 bp, Artificial Sequence
  Description of Artificial Sequence: Synthetic oligonucleotide
  Target: ATXN1; (-) strand; PAM type: YTN; PAM sequence: TTT
ctcatatactagcaagcaga

SEQ ID NO: 223745 - DNA, 20 bp, Artificial Sequence
  Description of Artificial Sequence: Synthetic oligonucleotide
  Target: ATXN1; (-) strand; PAM type: YTN; PAM sequence: TTG
agcatttctcatatactagc

SEQ ID NO: 223746 - DNA, 20 bp, Artificial Sequence
  Description of Artificial Sequence: Synthetic oligonucleotide
  Target: ATXN1; (-) strand; PAM type: YTN; PAM sequence: TTC
aattgagcatttctcatata

SEQ ID NO: 223747 - DNA, 20 bp, Artificial Sequence
  Description of Artificial Sequence: Synthetic oligonucleotide
  Target: ATXN1; (-) strand; PAM type: YTN; PAM sequence: TTT
caattgagcatttctcatat

SEQ ID NO: 223748 - DNA, 20 bp, Artificial Sequence
  Description of Artificial Sequence: Synthetic oligonucleotide
  Target: ATXN1; (-) strand; PAM type: YTN; PAM sequence: CTT
tcaattgagcatttctcata

SEQ ID NO: 223749 - DNA, 20 bp, Artificial Sequence
  Description of Artificial Sequence: Synthetic oligonucleotide
  Target: ATXN1; (-) strand; PAM type: YTN; PAM sequence: CTA
caataaggtgagatggtact

SEQ ID NO: 223750 - DNA, 20 bp, Artificial Sequence
  Description of Artificial Sequence: Synthetic oligonucleotide
  Target: ATXN1; (-) strand; PAM type: YTN; PAM sequence: TTG
ctacaataaggtgagatggt

SEQ ID NO: 223751 - DNA, 20 bp, Artificial Sequence
  Description of Artificial Sequence: Synthetic oligonucleotide
  Target: ATXN1; (-) strand; PAM type: YTN; PAM sequence: TTT
gctacaataaggtgagatgg

SEQ ID NO: 223752 - DNA, 20 bp, Artificial Sequence
  Description of Artificial Sequence: Synthetic oligonucleotide
  Target: ATXN1; (-) strand; PAM type: YTN; PAM sequence: TTT
tgctacaataaggtgagatg

SEQ ID NO: 223753 - DNA, 20 bp, Artificial Sequence
  Description of Artificial Sequence: Synthetic oligonucleotide
  Target: ATXN1; (-) strand; PAM type: YTN; PAM sequence: TTA
aataggttttgctacaataa

SEQ ID NO: 223754 - DNA, 20 bp, Artificial Sequence
  Description of Artificial Sequence: Synthetic oligonucleotide
  Target: ATXN1; (-) strand; PAM type: YTN; PAM sequence: TTC
agatacattaaataggtttt

SEQ ID NO: 223755 - DNA, 20 bp, Artificial Sequence
  Description of Artificial Sequence: Synthetic oligonucleotide
  Target: ATXN1; (-) strand; PAM type: YTN; PAM sequence: TTT
cagatacattaaataggttt

SEQ ID NO: 223756 - DNA, 20 bp, Artificial Sequence
  Description of Artificial Sequence: Synthetic oligonucleotide
  Target: ATXN1; (-) strand; PAM type: YTN; PAM sequence: TTT
tcagatacattaaataggtt

SEQ ID NO: 223757 - DNA, 20 bp, Artificial Sequence
  Description of Artificial Sequence: Synthetic oligonucleotide
  Target: ATXN1; (-) strand; PAM type: YTN; PAM sequence: TTT
ttcagatacattaaataggt

SEQ ID NO: 223758 - DNA, 20 bp, Artificial Sequence
  Description of Artificial Sequence: Synthetic oligonucleotide
  Target: ATXN1; (-) strand; PAM type: YTN; PAM sequence: TTG
gagaggaagaggtttttcag

SEQ ID NO: 223759 - DNA, 20 bp, Artificial Sequence
  Description of Artificial Sequence: Synthetic oligonucleotide
  Target: ATXN1; (-) strand; PAM type: YTN; PAM sequence: TTT
ggagaggaagaggtttttca

SEQ ID NO: 223760 - DNA, 20 bp, Artificial Sequence
  Description of Artificial Sequence: Synthetic oligonucleotide
  Target: ATXN1; (-) strand; PAM type: YTN; PAM sequence: TTT
tggagaggaagaggtttttc

SEQ ID NO: 223761 - DNA, 20 bp, Artificial Sequence
  Description of Artificial Sequence: Synthetic oligonucleotide
  Target: ATXN1; (-) strand; PAM type: YTN; PAM sequence: TTA
attttggagaggaagaggtt

SEQ ID NO: 223762 - DNA, 20 bp, Artificial Sequence
  Description of Artificial Sequence: Synthetic oligonucleotide
  Target: ATXN1; (-) strand; PAM type: YTN; PAM sequence: TTT
aattttggagaggaagaggt

SEQ ID NO: 223763 - DNA, 20 bp, Artificial Sequence
  Description of Artificial Sequence: Synthetic oligonucleotide
  Target: ATXN1; (-) strand; PAM type: YTN; PAM sequence: CTC
atcacgaaagtcgaaagttt

SEQ ID NO: 223764 - DNA, 20 bp, Artificial Sequence
  Description of Artificial Sequence: Synthetic oligonucleotide
  Target: ATXN1; (-) strand; PAM type: YTN; PAM sequence: TTC
tcatcacgaaagtcgaaagt

SEQ ID NO: 223765 - DNA, 20 bp, Artificial Sequence
  Description of Artificial Sequence: Synthetic oligonucleotide
  Target: ATXN1; (-) strand; PAM type: YTN; PAM sequence: TTT
ctcatcacgaaagtcgaaag

SEQ ID NO: 223766 - DNA, 20 bp, Artificial Sequence
  Description of Artificial Sequence: Synthetic oligonucleotide
  Target: ATXN1; (-) strand; PAM type: YTN; PAM sequence: TTT
tctcatcacgaaagtcgaaa

SEQ ID NO: 223767 - DNA, 20 bp, Artificial Sequence
  Description of Artificial Sequence: Synthetic oligonucleotide
  Target: ATXN1; (-) strand; PAM type: YTN; PAM sequence: TTG
tggaaattttctcatcacga

SEQ ID NO: 223768 - DNA, 20 bp, Artificial Sequence
  Description of Artificial Sequence: Synthetic oligonucleotide
  Target: ATXN1; (-) strand; PAM type: YTN; PAM sequence: CTT
gtggaaattttctcatcacg

SEQ ID NO: 223769 - DNA, 20 bp, Artificial Sequence
  Description of Artificial Sequence: Synthetic oligonucleotide
  Target: ATXN1; (-) strand; PAM type: YTN; PAM sequence: CTA
tgtggtagacccttgtggaa

SEQ ID NO: 223770 - DNA, 20 bp, Artificial Sequence
  Description of Artificial Sequence: Synthetic oligonucleotide
  Target: ATXN1; (-) strand; PAM type: YTN; PAM sequence: CTC
tatgtggtagacccttgtgg

SEQ ID NO: 223771 - DNA, 20 bp, Artificial Sequence
  Description of Artificial Sequence: Synthetic oligonucleotide
  Target: ATXN1; (-) strand; PAM type: YTN; PAM sequence: TTG
tcatcacccgatatatatca

SEQ ID NO: 223772 - DNA, 20 bp, Artificial Sequence
  Description of Artificial Sequence: Synthetic oligonucleotide
  Target: ATXN1; (-) strand; PAM type: YTN; PAM sequence: CTT
gtcatcacccgatatatatc

SEQ ID NO: 223773 - DNA, 20 bp, Artificial Sequence
  Description of Artificial Sequence: Synthetic oligonucleotide
  Target: ATXN1; (-) strand; PAM type: YTN; PAM sequence: TTG
gtagcatccagacaatcttg

SEQ ID NO: 223774 - DNA, 20 bp, Artificial Sequence
  Description of Artificial Sequence: Synthetic oligonucleotide
  Target: ATXN1; (-) strand; PAM type: YTN; PAM sequence: TTA
ttggtagcatccagacaatc

SEQ ID NO: 223775 - DNA, 20 bp, Artificial Sequence
  Description of Artificial Sequence: Synthetic oligonucleotide
  Target: ATXN1; (-) strand; PAM type: YTN; PAM sequence: TTT
attggtagcatccagacaat

SEQ ID NO: 223776 - DNA, 20 bp, Artificial Sequence
  Description of Artificial Sequence: Synthetic oligonucleotide
  Target: ATXN1; (-) strand; PAM type: YTN; PAM sequence: TTT
tattggtagcatccagacaa

SEQ ID NO: 223777 - DNA, 20 bp, Artificial Sequence
  Description of Artificial Sequence: Synthetic oligonucleotide
  Target: ATXN1; (-) strand; PAM type: YTN; PAM sequence: TTA
gattttattggtagcatcca

SEQ ID NO: 223778 - DNA, 20 bp, Artificial Sequence
  Description of Artificial Sequence: Synthetic oligonucleotide
  Target: ATXN1; (-) strand; PAM type: YTN; PAM sequence: CTT
agattttattggtagcatcc

SEQ ID NO: 223779 - DNA, 20 bp, Artificial Sequence
  Description of Artificial Sequence: Synthetic oligonucleotide
  Target: ATXN1; (-) strand; PAM type: YTN; PAM sequence: TTC
ttagattttattggtagcat

SEQ ID NO: 223780 - DNA, 20 bp, Artificial Sequence
  Description of Artificial Sequence: Synthetic oligonucleotide
  Target: ATXN1; (-) strand; PAM type: YTN; PAM sequence: TTA
gaagattcttagattttatt

SEQ ID NO: 223781 - DNA, 20 bp, Artificial Sequence
  Description of Artificial Sequence: Synthetic oligonucleotide
  Target: ATXN1; (-) strand; PAM type: YTN; PAM sequence: TTA
ggtgcatgtaggtggtatta

SEQ ID NO: 223782 - DNA, 20 bp, Artificial Sequence
  Description of Artificial Sequence: Synthetic oligonucleotide
  Target: ATXN1; (-) strand; PAM type: YTN; PAM sequence: TTT
aggtgcatgtaggtggtatt

SEQ ID NO: 223783 - DNA, 20 bp, Artificial Sequence
  Description of Artificial Sequence: Synthetic oligonucleotide
  Target: ATXN1; (-) strand; PAM type: YTN; PAM sequence: TTA
agtttaggtgcatgtaggtg

SEQ ID NO: 223784 - DNA, 20 bp, Artificial Sequence
  Description of Artificial Sequence: Synthetic oligonucleotide
  Target: ATXN1; (-) strand; PAM type: YTN; PAM sequence: TTT
aagtttaggtgcatgtaggt

SEQ ID NO: 223785 - DNA, 20 bp, Artificial Sequence
  Description of Artificial Sequence: Synthetic oligonucleotide
  Target: ATXN1; (-) strand; PAM type: YTN; PAM sequence: TTC
agagtttaagtttaggtgca

SEQ ID NO: 223786 - DNA, 20 bp, Artificial Sequence
  Description of Artificial Sequence: Synthetic oligonucleotide
  Target: ATXN1; (-) strand; PAM type: YTN; PAM sequence: TTT
cagagtttaagtttaggtgc

SEQ ID NO: 223787 - DNA, 20 bp, Artificial Sequence
  Description of Artificial Sequence: Synthetic oligonucleotide
  Target: ATXN1; (-) strand; PAM type: YTN; PAM sequence: TTT
tcagagtttaagtttaggtg

SEQ ID NO: 223788 - DNA, 20 bp, Artificial Sequence
  Description of Artificial Sequence: Synthetic oligonucleotide
  Target: ATXN1; (-) strand; PAM type: YTN; PAM sequence: CTT
ttcagagtttaagtttaggt

SEQ ID NO: 223789 - DNA, 20 bp, Artificial Sequence
  Description of Artificial Sequence: Synthetic oligonucleotide
  Target: ATXN1; (-) strand; PAM type: YTN; PAM sequence: TTG
tacttttcagagtttaagtt

SEQ ID NO: 223790 - DNA, 20 bp, Artificial Sequence
  Description of Artificial Sequence: Synthetic oligonucleotide
  Target: ATXN1; (-) strand; PAM type: YTN; PAM sequence: TTA
atacattgtacttttcagag

SEQ ID NO: 223791 - DNA, 20 bp, Artificial Sequence
  Description of Artificial Sequence: Synthetic oligonucleotide
  Target: ATXN1; (-) strand; PAM type: YTN; PAM sequence: CTT
aatacattgtacttttcaga

SEQ ID NO: 223792 - DNA, 20 bp, Artificial Sequence
  Description of Artificial Sequence: Synthetic oligonucleotide
  Target: ATXN1; (-) strand; PAM type: YTN; PAM sequence: TTC
ttaatacattgtacttttca

SEQ ID NO: 223793 - DNA, 20 bp, Artificial Sequence
  Description of Artificial Sequence: Synthetic oligonucleotide
  Target: ATXN1; (-) strand; PAM type: YTN; PAM sequence: TTT
cttaatacattgtacttttc

SEQ ID NO: 223794 - DNA, 20 bp, Artificial Sequence
  Description of Artificial Sequence: Synthetic oligonucleotide
  Target: ATXN1; (-) strand; PAM type: YTN; PAM sequence: CTG
tttcttaatacattgtactt

SEQ ID NO: 223795 - DNA, 20 bp, Artificial Sequence
  Description of Artificial Sequence: Synthetic oligonucleotide
  Target: ATXN1; (-) strand; PAM type: YTN; PAM sequence: TTC
ctgtttcttaatacattgta

SEQ ID NO: 223796 - DNA, 20 bp, Artificial Sequence
  Description of Artificial Sequence: Synthetic oligonucleotide
  Target: ATXN1; (-) strand; PAM type: YTN; PAM sequence: TTT
cctgtttcttaatacattgt

SEQ ID NO: 223797 - DNA, 20 bp, Artificial Sequence
  Description of Artificial Sequence: Synthetic oligonucleotide
  Target: ATXN1; (-) strand; PAM type: YTN; PAM sequence: TTT
tcctgtttcttaatacattg

SEQ ID NO: 223798 - DNA, 20 bp, Artificial Sequence
  Description of Artificial Sequence: Synthetic oligonucleotide
  Target: ATXN1; (-) strand; PAM type: YTN; PAM sequence: TTT
ttcctgtttcttaatacatt

SEQ ID NO: 223799 - DNA, 20 bp, Artificial Sequence
  Description of Artificial Sequence: Synthetic oligonucleotide
  Target: ATXN1; (-) strand; PAM type: YTN; PAM sequence: TTT
tttcctgtttcttaatacat

SEQ ID NO: 223800 - DNA, 20 bp, Artificial Sequence
  Description of Artificial Sequence: Synthetic oligonucleotide
  Target: ATXN1; (-) strand; PAM type: YTN; PAM sequence: TTT
ttttcctgtttcttaataca

SEQ ID NO: 223801 - DNA, 20 bp, Artificial Sequence
  Description of Artificial Sequence: Synthetic oligonucleotide
  Target: ATXN1; (-) strand; PAM type: YTN; PAM sequence: TTT
tttttcctgtttcttaatac

SEQ ID NO: 223802 - DNA, 20 bp, Artificial Sequence
  Description of Artificial Sequence: Synthetic oligonucleotide
  Target: ATXN1; (-) strand; PAM type: YTN; PAM sequence: TTG
agcatgattttttttcctgt

SEQ ID NO: 223803 - DNA, 20 bp, Artificial Sequence
  Description of Artificial Sequence: Synthetic oligonucleotide
  Target: ATXN1; (-) strand; PAM type: YTN; PAM sequence: CTT
gagcatgattttttttcctg

SEQ ID NO: 223804 - DNA, 20 bp, Artificial Sequence
  Description of Artificial Sequence: Synthetic oligonucleotide
  Target: ATXN1; (-) strand; PAM type: YTN; PAM sequence: CTC
ttgagcatgattttttttcc

SEQ ID NO: 223805 - DNA, 20 bp, Artificial Sequence
  Description of Artificial Sequence: Synthetic oligonucleotide
  Target: ATXN1; (-) strand; PAM type: YTN; PAM sequence: TTC
aaagggctcttgagcatgat

SEQ ID NO: 223806 - DNA, 20 bp, Artificial Sequence
  Description of Artificial Sequence: Synthetic oligonucleotide
  Target: ATXN1; (-) strand; PAM type: YTN; PAM sequence: TTT
caaagggctcttgagcatga

SEQ ID NO: 223807 - DNA, 20 bp, Artificial Sequence
  Description of Artificial Sequence: Synthetic oligonucleotide
  Target: ATXN1; (-) strand; PAM type: YTN; PAM sequence: TTA
gaagaaatgccagtaatttc

SEQ ID NO: 223808 - DNA, 20 bp, Artificial Sequence
  Description of Artificial Sequence: Synthetic oligonucleotide
  Target: ATXN1; (-) strand; PAM type: YTN; PAM sequence: CTA
gcccccaaaaattagaagaa

SEQ ID NO: 223809 - DNA, 20 bp, Artificial Sequence
  Description of Artificial Sequence: Synthetic oligonucleotide
  Target: ATXN1; (-) strand; PAM type: YTN; PAM sequence: CTA
ataaatgtcagactagcccc

SEQ ID NO: 223810 - DNA, 20 bp, Artificial Sequence
  Description of Artificial Sequence: Synthetic oligonucleotide
  Target: ATXN1; (-) strand; PAM type: YTN; PAM sequence: TTA
tgctaataaatgtcagacta

SEQ ID NO: 223811 - DNA, 20 bp, Artificial Sequence
  Description of Artificial Sequence: Synthetic oligonucleotide
  Target: ATXN1; (-) strand; PAM type: YTN; PAM sequence: TTT
atgctaataaatgtcagact

SEQ ID NO: 223812 - DNA, 20 bp, Artificial Sequence
  Description of Artificial Sequence: Synthetic oligonucleotide
  Target: ATXN1; (-) strand; PAM type: YTN; PAM sequence: TTG
tttatgctaataaatgtcag

SEQ ID NO: 223813 - DNA, 20 bp, Artificial Sequence
  Description of Artificial Sequence: Synthetic oligonucleotide
  Target: ATXN1; (-) strand; PAM type: YTN; PAM sequence: TTT
gtttatgctaataaatgtca

SEQ ID NO: 223814 - DNA, 20 bp, Artificial Sequence
  Description of Artificial Sequence: Synthetic oligonucleotide
  Target: ATXN1; (-) strand; PAM type: YTN; PAM sequence: CTT
tgtttatgctaataaatgtc

SEQ ID NO: 223815 - DNA, 20 bp, Artificial Sequence
  Description of Artificial Sequence: Synthetic oligonucleotide
  Target: ATXN1; (-) strand; PAM type: YTN; PAM sequence: TTG
ctttgtttatgctaataaat

SEQ ID NO: 223816 - DNA, 20 bp, Artificial Sequence
  Description of Artificial Sequence: Synthetic oligonucleotide
  Target: ATXN1; (-) strand; PAM type: YTN; PAM sequence: TTT
gctttgtttatgctaataaa

SEQ ID NO: 223817 - DNA, 20 bp, Artificial Sequence
  Description of Artificial Sequence: Synthetic oligonucleotide
  Target: ATXN1; (-) strand; PAM type: YTN; PAM sequence: CTT
tgctttgtttatgctaataa

SEQ ID NO: 223818 - DNA, 20 bp, Artificial Sequence
  Description of Artificial Sequence: Synthetic oligonucleotide
  Target: ATXN1; (-) strand; PAM type: YTN; PAM sequence: TTG
cggacacaaggcactttgct

SEQ ID NO: 223819 - DNA, 20 bp, Artificial Sequence
  Description of Artificial Sequence: Synthetic oligonucleotide
  Target: ATXN1; (-) strand; PAM type: YTN; PAM sequence: CTT
gcggacacaaggcactttgc

SEQ ID NO: 223820 - DNA, 20 bp, Artificial Sequence
  Description of Artificial Sequence: Synthetic oligonucleotide
  Target: ATXN1; (-) strand; PAM type: YTN; PAM sequence: CTC
ttgcggacacaaggcacttt

SEQ ID NO: 223821 - DNA, 20 bp, Artificial Sequence
  Description of Artificial Sequence: Synthetic oligonucleotide
  Target: ATXN1; (-) strand; PAM type: YTN; PAM sequence: TTC
cctcttgcggacacaaggca

SEQ ID NO: 223822 - DNA, 20 bp, Artificial Sequence
  Description of Artificial Sequence: Synthetic oligonucleotide
  Target: ATXN1; (-) strand; PAM type: YTN; PAM sequence: TTT
ccctcttgcggacacaaggc

SEQ ID NO: 223823 - DNA, 20 bp, Artificial Sequence
  Description of Artificial Sequence: Synthetic oligonucleotide
  Target: ATXN1; (-) strand; PAM type: YTN; PAM sequence: TTT
tccctcttgcggacacaagg

SEQ ID NO: 223824 - DNA, 20 bp, Artificial Sequence
  Description of Artificial Sequence: Synthetic oligonucleotide
  Target: ATXN1; (-) strand; PAM type: YTN; PAM sequence: TTT
ttccctcttgcggacacaag

SEQ ID NO: 223825 - DNA, 20 bp, Artificial Sequence
  Description of Artificial Sequence: Synthetic oligonucleotide
  Target: ATXN1; (-) strand; PAM type: YTN; PAM sequence: TTT
tttccctcttgcggacacaa

SEQ ID NO: 223826 - DNA, 20 bp, Artificial Sequence
  Description of Artificial Sequence: Synthetic oligonucleotide
  Target: ATXN1; (-) strand; PAM type: YTN; PAM sequence: TTT
ttttccctcttgcggacaca

SEQ ID NO: 223827 - DNA, 20 bp, Artificial Sequence
  Description of Artificial Sequence: Synthetic oligonucleotide
  Target: ATXN1; (-) strand; PAM type: YTN; PAM sequence: TTT
tttttccctcttgcggacac

SEQ ID NO: 223828 - DNA, 20 bp, Artificial Sequence
  Description of Artificial Sequence: Synthetic oligonucleotide
  Target: ATXN1; (-) strand; PAM type: YTN; PAM sequence: TTT
ttttttccctcttgcggaca

SEQ ID NO: 223829 - DNA, 20 bp, Artificial Sequence
  Description of Artificial Sequence: Synthetic oligonucleotide
  Target: ATXN1; (-) strand; PAM type: YTN; PAM sequence: TTT
tttttttccctcttgcggac

SEQ ID NO: 223830 - DNA, 20 bp, Artificial Sequence
  Description of Artificial Sequence: Synthetic oligonucleotide
  Target: ATXN1; (-) strand; PAM type: YTN; PAM sequence: TTT
ttttttttccctcttgcgga

SEQ ID NO: 223831 - DNA, 20 bp, Artificial Sequence
  Description of Artificial Sequence: Synthetic oligonucleotide
  Target: ATXN1; (-) strand; PAM type: YTN; PAM sequence: CTA
aagtttttttttttccctct

SEQ ID NO: 223832 - DNA, 20 bp, Artificial Sequence
  Description of Artificial Sequence: Synthetic oligonucleotide
  Target: ATXN1; (-) strand; PAM type: YTN; PAM sequence: CTC
taaagtttttttttttccct

SEQ ID NO: 223833 - DNA, 20 bp, Artificial Sequence
  Description of Artificial Sequence: Synthetic oligonucleotide
  Target: ATXN1; (-) strand; PAM type: YTN; PAM sequence: CTC
tctaaagtttttttttttcc

SEQ ID NO: 223834 - DNA, 20 bp, Artificial Sequence
  Description of Artificial Sequence: Synthetic oligonucleotide
  Target: ATXN1; (-) strand; PAM type: YTN; PAM sequence: TTA
atctctctaaagtttttttt

SEQ ID NO: 223835 - DNA, 20 bp, Artificial Sequence
  Description of Artificial Sequence: Synthetic oligonucleotide
  Target: ATXN1; (-) strand; PAM type: YTN; PAM sequence: TTT
aatctctctaaagttttttt

SEQ ID NO: 223836 - DNA, 20 bp, Artificial Sequence
  Description of Artificial Sequence: Synthetic oligonucleotide
  Target: ATXN1; (-) strand; PAM type: YTN; PAM sequence: CTG
agtttaatctctctaaagtt

SEQ ID NO: 223837 - DNA, 20 bp, Artificial Sequence
  Description of Artificial Sequence: Synthetic oligonucleotide
  Target: ATXN1; (-) strand; PAM type: YTN; PAM sequence: CTC
tgagtttaatctctctaaag

SEQ ID NO: 223838 - DNA, 20 bp, Artificial Sequence
  Description of Artificial Sequence: Synthetic oligonucleotide
  Target: ATXN1; (-) strand; PAM type: YTN; PAM sequence: CTA
caactctgagtttaatctct

SEQ ID NO: 223839 - DNA, 20 bp, Artificial Sequence
  Description of Artificial Sequence: Synthetic oligonucleotide
  Target: ATXN1; (-) strand; PAM type: YTN; PAM sequence: TTC
tacaactctgagtttaatct

SEQ ID NO: 223840 - DNA, 20 bp, Artificial Sequence
  Description of Artificial Sequence: Synthetic oligonucleotide
  Target: ATXN1; (-) strand; PAM type: YTN; PAM sequence: TTT
ctacaactctgagtttaatc

SEQ ID NO: 223841 - DNA, 20 bp, Artificial Sequence
  Description of Artificial Sequence: Synthetic oligonucleotide
  Target: ATXN1; (-) strand; PAM type: YTN; PAM sequence: TTT
tctacaactctgagtttaat

SEQ ID NO: 223842 - DNA, 20 bp, Artificial Sequence
  Description of Artificial Sequence: Synthetic oligonucleotide
  Target: ATXN1; (-) strand; PAM type: YTN; PAM sequence: TTT
ttctacaactctgagtttaa

SEQ ID NO: 223843 - DNA, 20 bp, Artificial Sequence
  Description of Artificial Sequence: Synthetic oligonucleotide
  Target: ATXN1; (-) strand; PAM type: YTN; PAM sequence: CTT
tttctacaactctgagttta

SEQ ID NO: 223844 - DNA, 20 bp, Artificial Sequence
  Description of Artificial Sequence: Synthetic oligonucleotide
  Target: ATXN1; (-) strand; PAM type: YTN; PAM sequence: CTA
aactttttctacaactctga

SEQ ID NO: 223845 - DNA, 20 bp, Artificial Sequence
  Description of Artificial Sequence: Synthetic oligonucleotide
  Target: ATXN1; (-) strand; PAM type: YTN; PAM sequence: TTC
taaactttttctacaactct

SEQ ID NO: 223846 - DNA, 20 bp, Artificial Sequence
  Description of Artificial Sequence: Synthetic oligonucleotide
  Target: ATXN1; (-) strand; PAM type: YTN; PAM sequence: TTT
ctaaactttttctacaactc

SEQ ID NO: 223847 - DNA, 20 bp, Artificial Sequence
  Description of Artificial Sequence: Synthetic oligonucleotide
  Target: ATXN1; (-) strand; PAM type: YTN; PAM sequence: CTA
aatccgtttctaaacttttt

SEQ ID NO: 223848 - DNA, 20 bp, Artificial Sequence
  Description of Artificial Sequence: Synthetic oligonucleotide
  Target: ATXN1; (-) strand; PAM type: YTN; PAM sequence: TTC
taaatccgtttctaaacttt

SEQ ID NO: 223849 - DNA, 20 bp, Artificial Sequence
  Description of Artificial Sequence: Synthetic oligonucleotide
  Target: ATXN1; (-) strand; PAM type: YTN; PAM sequence: CTG
cgaaattctaaatccgtttc

SEQ ID NO: 223850 - DNA, 20 bp, Artificial Sequence
  Description of Artificial Sequence: Synthetic oligonucleotide
  Target: ATXN1; (-) strand; PAM type: YTN; PAM sequence: TTC
ctgcgaaattctaaatccgt

SEQ ID NO: 223851 - DNA, 20 bp, Artificial Sequence
  Description of Artificial Sequence: Synthetic oligonucleotide
  Target: ATXN1; (-) strand; PAM type: YTN; PAM sequence: TTT
cctgcgaaattctaaatccg

SEQ ID NO: 223852 - DNA, 20 bp, Artificial Sequence
  Description of Artificial Sequence: Synthetic oligonucleotide
  Target: ATXN1; (-) strand; PAM type: YTN; PAM sequence: TTT
tcctgcgaaattctaaatcc

SEQ ID NO: 223853 - DNA, 20 bp, Artificial Sequence
  Description of Artificial Sequence: Synthetic oligonucleotide
  Target: ATXN1; (-) strand; PAM type: YTN; PAM sequence: TTT
ttcctgcgaaattctaaatc

SEQ ID NO: 223854 - DNA, 20 bp, Artificial Sequence
  Description of Artificial Sequence: Synthetic oligonucleotide
  Target: ATXN1; (-) strand; PAM type: YTN; PAM sequence: CTT
tttcctgcgaaattctaaat

SEQ ID NO: 223855 - DNA, 20 bp, Artificial Sequence
  Description of Artificial Sequence: Synthetic oligonucleotide
  Target: ATXN1; (-) strand; PAM type: YTN; PAM sequence: TTC
tttttcctgcgaaattctaa

SEQ ID NO: 223856 - DNA, 20 bp, Artificial Sequence
  Description of Artificial Sequence: Synthetic oligonucleotide
  Target: ATXN1; (-) strand; PAM type: YTN; PAM sequence: TTT
ctttttcctgcgaaattcta

SEQ ID NO: 223857 - DNA, 20 bp, Artificial Sequence
  Description of Artificial Sequence: Synthetic oligonucleotide
  Target: ATXN1; (-) strand; PAM type: YTN; PAM sequence: TTT
tctttttcctgcgaaattct

SEQ ID NO: 223858 - DNA, 20 bp, Artificial Sequence
  Description of Artificial Sequence: Synthetic oligonucleotide
  Target: ATXN1; (-) strand; PAM type: YTN; PAM sequence: CTT
ttctttttcctgcgaaattc

SEQ ID NO: 223859 - DNA, 20 bp, Artificial Sequence
  Description of Artificial Sequence: Synthetic oligonucleotide
  Target: ATXN1; (-) strand; PAM type: YTN; PAM sequence: CTG
tcttttctttttcctgcgaa

SEQ ID NO: 223860 - DNA, 20 bp, Artificial Sequence
  Description of Artificial Sequence: Synthetic oligonucleotide
  Target: ATXN1; (-) strand; PAM type: YTN; PAM sequence: TTC
atagtgtcactgtcttttct

SEQ ID NO: 223861 - DNA, 20 bp, Artificial Sequence
  Description of Artificial Sequence: Synthetic oligonucleotide
  Target: ATXN1; (-) strand; PAM type: YTN; PAM sequence: CTG
attcatagtgtcactgtctt

SEQ ID NO: 223862 - DNA, 20 bp, Artificial Sequence
  Description of Artificial Sequence: Synthetic oligonucleotide
  Target: ATXN1; (-) strand; PAM type: YTN; PAM sequence: TTA
tacgaaaatgctgattcata

SEQ ID NO: 223863 - DNA, 20 bp, Artificial Sequence
  Description of Artificial Sequence: Synthetic oligonucleotide
  Target: ATXN1; (-) strand; PAM type: YTN; PAM sequence: CTT
atacgaaaatgctgattcat

SEQ ID NO: 223864 - DNA, 20 bp, Artificial Sequence
  Description of Artificial Sequence: Synthetic oligonucleotide
  Target: ATXN1; (-) strand; PAM type: YTN; PAM sequence: CTG
cttatacgaaaatgctgatt

SEQ ID NO: 223865 - DNA, 20 bp, Artificial Sequence
  Description of Artificial Sequence: Synthetic oligonucleotide
  Target: ATXN1; (-) strand; PAM type: YTN; PAM sequence: TTC
caggctgcttatacgaaaat

SEQ ID NO: 223866 - DNA, 20 bp, Artificial Sequence
  Description of Artificial Sequence: Synthetic oligonucleotide
  Target: ATXN1; (-) strand; PAM type: YTN; PAM sequence: TTG
attccaggctgcttatacga

SEQ ID NO: 223867 - DNA, 20 bp, Artificial Sequence
  Description of Artificial Sequence: Synthetic oligonucleotide
  Target: ATXN1; (-) strand; PAM type: YTN; PAM sequence: TTT
gattccaggctgcttatacg

SEQ ID NO: 223868 - DNA, 20 bp, Artificial Sequence
  Description of Artificial Sequence: Synthetic oligonucleotide
  Target: ATXN1; (-) strand; PAM type: YTN; PAM sequence: CTT
tgattccaggctgcttatac

SEQ ID NO: 223869 - DNA, 20 bp, Artificial Sequence
  Description of Artificial Sequence: Synthetic oligonucleotide
  Target: ATXN1; (-) strand; PAM type: YTN; PAM sequence: TTC
tttgattccaggctgcttat

SEQ ID NO: 223870 - DNA, 20 bp, Artificial Sequence
  Description of Artificial Sequence: Synthetic oligonucleotide
  Target: ATXN1; (-) strand; PAM type: YTN; PAM sequence: CTT
ctttgattccaggctgctta

SEQ ID NO: 223871 - DNA, 20 bp, Artificial Sequence
  Description of Artificial Sequence: Synthetic oligonucleotide
  Target: ATXN1; (-) strand; PAM type: YTN; PAM sequence: TTC
ttctttgattccaggctgct

SEQ ID NO: 223872 - DNA, 20 bp, Artificial Sequence
  Description of Artificial Sequence: Synthetic oligonucleotide
  Target: ATXN1; (-) strand; PAM type: YTN; PAM sequence: TTT
cttctttgattccaggctgc

SEQ ID NO: 223873 - DNA, 20 bp, Artificial Sequence
  Description of Artificial Sequence: Synthetic oligonucleotide
  Target: ATXN1; (-) strand; PAM type: YTN; PAM sequence: CTC
cgtgtgtgtgtgtgtgtgtg

SEQ ID NO: 223874 - DNA, 20 bp, Artificial Sequence
  Description of Artificial Sequence: Synthetic oligonucleotide
  Target: ATXN1; (-) strand; PAM type: YTN; PAM sequence: CTG
tatcctccgtgtgtgtgtgt

SEQ ID NO: 223875 - DNA, 20 bp, Artificial Sequence
  Description of Artificial Sequence: Synthetic oligonucleotide
  Target: ATXN1; (-) strand; PAM type: YTN; PAM sequence: TTC
acggtgctgtatcctccgtg

SEQ ID NO: 223876 - DNA, 20 bp, Artificial Sequence
  Description of Artificial Sequence: Synthetic oligonucleotide
  Target: ATXN1; (-) strand; PAM type: YTN; PAM sequence: CTT
cacggtgctgtatcctccgt

SEQ ID NO: 223877 - DNA, 20 bp, Artificial Sequence
  Description of Artificial Sequence: Synthetic oligonucleotide
  Target: ATXN1; (-) strand; PAM type: YTN; PAM sequence: TTC
ttcacggtgctgtatcctcc

SEQ ID NO: 223878 - DNA, 20 bp, Artificial Sequence
  Description of Artificial Sequence: Synthetic oligonucleotide
  Target: ATXN1; (-) strand; PAM type: YTN; PAM sequence: TTC
attcttcacggtgctgtatc

SEQ ID NO: 223879 - DNA, 20 bp, Artificial Sequence
  Description of Artificial Sequence: Synthetic oligonucleotide
  Target: ATXN1; (-) strand; PAM type: YTN; PAM sequence: CTT
cattcttcacggtgctgtat

SEQ ID NO: 223880 - DNA, 20 bp, Artificial Sequence
  Description of Artificial Sequence: Synthetic oligonucleotide
  Target: ATXN1; (-) strand; PAM type: YTN; PAM sequence: TTG
tgtcttcattcttcacggtg

SEQ ID NO: 223881 - DNA, 20 bp, Artificial Sequence
  Description of Artificial Sequence: Synthetic oligonucleotide
  Target: ATXN1; (-) strand; PAM type: YTN; PAM sequence: TTT
gtgtcttcattcttcacggt

SEQ ID NO: 223882 - DNA, 20 bp, Artificial Sequence
  Description of Artificial Sequence: Synthetic oligonucleotide
  Target: ATXN1; (-) strand; PAM type: YTN; PAM sequence: TTG
tatgcatttgtgtcttcatt

SEQ ID NO: 223883 - DNA, 20 bp, Artificial Sequence
  Description of Artificial Sequence: Synthetic oligonucleotide
  Target: ATXN1; (-) strand; PAM type: YTN; PAM sequence: TTT
gtatgcatttgtgtcttcat

SEQ ID NO: 223884 - DNA, 20 bp, Artificial Sequence
  Description of Artificial Sequence: Synthetic oligonucleotide
  Target: ATXN1; (-) strand; PAM type: YTN; PAM sequence: CTA
aatttgtatgcatttgtgtc

SEQ ID NO: 223885 - DNA, 20 bp, Artificial Sequence
  Description of Artificial Sequence: Synthetic oligonucleotide
  Target: ATXN1; (-) strand; PAM type: YTN; PAM sequence: CTA
aatataaatatacagactaa

SEQ ID NO: 223886 - DNA, 20 bp, Artificial Sequence
  Description of Artificial Sequence: Synthetic oligonucleotide
  Target: ATXN1; (-) strand; PAM type: YTN; PAM sequence: TTC
taaatataaatatacagact

SEQ ID NO: 223887 - DNA, 20 bp, Artificial Sequence
  Description of Artificial Sequence: Synthetic oligonucleotide
  Target: ATXN1; (-) strand; PAM type: YTN; PAM sequence: TTG
tattctaaatataaatatac

SEQ ID NO: 223888 - DNA, 20 bp, Artificial Sequence
  Description of Artificial Sequence: Synthetic oligonucleotide
  Target: ATXN1; (-) strand; PAM type: YTN; PAM sequence: TTT
gtattctaaatataaatata

SEQ ID NO: 223889 - DNA, 20 bp, Artificial Sequence
  Description of Artificial Sequence: Synthetic oligonucleotide
  Target: ATXN1; (-) strand; PAM type: YTN; PAM sequence: TTA
ggtatgataaaggcacaaaa

SEQ ID NO: 223890 - DNA, 20 bp, Artificial Sequence
  Description of Artificial Sequence: Synthetic oligonucleotide
  Target: ATXN1; (-) strand; PAM type: YTN; PAM sequence: CTA
tgagtaccagataaagttag

SEQ ID NO: 223891 - DNA, 20 bp, Artificial Sequence
  Description of Artificial Sequence: Synthetic oligonucleotide
  Target: ATXN1; (-) strand; PAM type: YTN; PAM sequence: CTC
tatgagtaccagataaagtt

SEQ ID NO: 223892 - DNA, 20 bp, Artificial Sequence
  Description of Artificial Sequence: Synthetic oligonucleotide
  Target: ATXN1; (-) strand; PAM type: YTN; PAM sequence: TTG
gtgacctctatgagtaccag

SEQ ID NO: 223893 - DNA, 20 bp, Artificial Sequence
  Description of Artificial Sequence: Synthetic oligonucleotide
  Target: ATXN1; (-) strand; PAM type: YTN; PAM sequence: TTT
ggtgacctctatgagtacca

SEQ ID NO: 223894 - DNA, 20 bp, Artificial Sequence
  Description of Artificial Sequence: Synthetic oligonucleotide
  Target: ATXN1; (-) strand; PAM type: YTN; PAM sequence: CTT
tggtgacctctatgagtacc

SEQ ID NO: 223895 - DNA, 20 bp, Artificial Sequence
  Description of Artificial Sequence: Synthetic oligonucleotide
  Target: ATXN1; (-) strand; PAM type: YTN; PAM sequence: TTA
tacagctttggtgacctcta

SEQ ID NO: 223896 - DNA, 20 bp, Artificial Sequence
  Description of Artificial Sequence: Synthetic oligonucleotide
  Target: ATXN1; (-) strand; PAM type: YTN; PAM sequence: TTT
atacagctttggtgacctct

SEQ ID NO: 223897 - DNA, 20 bp, Artificial Sequence
  Description of Artificial Sequence: Synthetic oligonucleotide
  Target: ATXN1; (-) strand; PAM type: YTN; PAM sequence: TTT
tatacagctttggtgacctc

SEQ ID NO: 223898 - DNA, 20 bp, Artificial Sequence
  Description of Artificial Sequence: Synthetic oligonucleotide
  Target: ATXN1; (-) strand; PAM type: YTN; PAM sequence: CTA
tgattttatacagctttggt

SEQ ID NO: 223899 - DNA, 20 bp, Artificial Sequence
  Description of Artificial Sequence: Synthetic oligonucleotide
  Target: ATXN1; (-) strand; PAM type: YTN; PAM sequence: TTG
ctatgattttatacagcttt

SEQ ID NO: 223900 - DNA, 20 bp, Artificial Sequence
  Description of Artificial Sequence: Synthetic oligonucleotide
  Target: ATXN1; (-) strand; PAM type: YTN; PAM sequence: CTG
gttgctatgattttatacag

SEQ ID NO: 223901 - DNA, 20 bp, Artificial Sequence
  Description of Artificial Sequence: Synthetic oligonucleotide
  Target: ATXN1; (-) strand; PAM type: YTN; PAM sequence: TTC
tggttgctatgattttatac

SEQ ID NO: 223902 - DNA, 20 bp, Artificial Sequence
  Description of Artificial Sequence: Synthetic oligonucleotide
  Target: ATXN1; (-) strand; PAM type: YTN; PAM sequence: TTT
ctggttgctatgattttata

SEQ ID NO: 223903 - DNA, 20 bp, Artificial Sequence
  Description of Artificial Sequence: Synthetic oligonucleotide
  Target: ATXN1; (-) strand; PAM type: YTN; PAM sequence: TTT
tctggttgctatgattttat

SEQ ID NO: 223904 - DNA, 20 bp, Artificial Sequence
  Description of Artificial Sequence: Synthetic oligonucleotide
  Target: ATXN1; (-) strand; PAM type: YTN; PAM sequence: TTA
gttttctggttgctatgatt

SEQ ID NO: 223905 - DNA, 20 bp, Artificial Sequence
  Description of Artificial Sequence: Synthetic oligonucleotide
  Target: ATXN1; (-) strand; PAM type: YTN; PAM sequence: TTT
agttttctggttgctatgat

SEQ ID NO: 223906 - DNA, 20 bp, Artificial Sequence
  Description of Artificial Sequence: Synthetic oligonucleotide
  Target: ATXN1; (-) strand; PAM type: YTN; PAM sequence: CTT
tagttttctggttgctatga

SEQ ID NO: 223907 - DNA, 20 bp, Artificial Sequence
  Description of Artificial Sequence: Synthetic oligonucleotide
  Target: ATXN1; (-) strand; PAM type: YTN; PAM sequence: TTC
ctttagttttctggttgcta

SEQ ID NO: 223908 - DNA, 20 bp, Artificial Sequence
  Description of Artificial Sequence: Synthetic oligonucleotide
  Target: ATXN1; (-) strand; PAM type: YTN; PAM sequence: TTT
cctttagttttctggttgct

SEQ ID NO: 223909 - DNA, 20 bp, Artificial Sequence
  Description of Artificial Sequence: Synthetic oligonucleotide
  Target: ATXN1; (-) strand; PAM type: YTN; PAM sequence: TTG
tttcctttagttttctggtt

SEQ ID NO: 223910 - DNA, 20 bp, Artificial Sequence
  Description of Artificial Sequence: Synthetic oligonucleotide
  Target: ATXN1; (-) strand; PAM type: YTN; PAM sequence: TTT
gtttcctttagttttctggt

SEQ ID NO: 223911 - DNA, 20 bp, Artificial Sequence
  Description of Artificial Sequence: Synthetic oligonucleotide
  Target: ATXN1; (-) strand; PAM type: YTN; PAM sequence: CTG
ccagaggtgtttgtttcctt

SEQ ID NO: 223912 - DNA, 20 bp, Artificial Sequence
  Description of Artificial Sequence: Synthetic oligonucleotide
  Target: ATXN1; (-) strand; PAM type: YTN; PAM sequence: TTC
tgccagaggtgtttgtttcc

SEQ ID NO: 223913 - DNA, 20 bp, Artificial Sequence
  Description of Artificial Sequence: Synthetic oligonucleotide
  Target: ATXN1; (-) strand; PAM type: YTN; PAM sequence: TTT
ctgccagaggtgtttgtttc

SEQ ID NO: 223914 - DNA, 20 bp, Artificial Sequence
  Description of Artificial Sequence: Synthetic oligonucleotide
  Target: ATXN1; (-) strand; PAM type: YTN; PAM sequence: TTG
gtgaggatttctgccagagg

SEQ ID NO: 223915 - DNA, 20 bp, Artificial Sequence
  Description of Artificial Sequence: Synthetic oligonucleotide
  Target: ATXN1; (-) strand; PAM type: YTN; PAM sequence: TTT
ggtgaggatttctgccagag

SEQ ID NO: 223916 - DNA, 20 bp, Artificial Sequence
  Description of Artificial Sequence: Synthetic oligonucleotide
  Target: ATXN1; (-) strand; PAM type: YTN; PAM sequence: TTG
tttggtgaggatttctgcca

SEQ ID NO: 223917 - DNA, 20 bp, Artificial Sequence
  Description of Artificial Sequence: Synthetic oligonucleotide
  Target: ATXN1; (-) strand; PAM type: YTN; PAM sequence: TTT
gtttggtgaggatttctgcc

SEQ ID NO: 223918 - DNA, 20 bp, Artificial Sequence
  Description of Artificial Sequence: Synthetic oligonucleotide
  Target: ATXN1; (-) strand; PAM type: YTN; PAM sequence: CTT
tgtttggtgaggatttctgc

SEQ ID NO: 223919 - DNA, 20 bp, Artificial Sequence
  Description of Artificial Sequence: Synthetic oligonucleotide
  Target: ATXN1; (-) strand; PAM type: YTN; PAM sequence: TTA
tactttgtttggtgaggatt

SEQ ID NO: 223920 - DNA, 20 bp, Artificial Sequence
  Description of Artificial Sequence: Synthetic oligonucleotide
  Target: ATXN1; (-) strand; PAM type: YTN; PAM sequence: CTT
atactttgtttggtgaggat

SEQ ID NO: 223921 - DNA, 20 bp, Artificial Sequence
  Description of Artificial Sequence: Synthetic oligonucleotide
  Target: ATXN1; (-) strand; PAM type: YTN; PAM sequence: TTA
tgccttatactttgtttggt

SEQ ID NO: 223922 - DNA, 20 bp, Artificial Sequence
  Description of Artificial Sequence: Synthetic oligonucleotide
  Target: ATXN1; (-) strand; PAM type: YTN; PAM sequence: TTT
atgccttatactttgtttgg

SEQ ID NO: 223923 - DNA, 20 bp, Artificial Sequence
  Description of Artificial Sequence: Synthetic oligonucleotide
  Target: ATXN1; (-) strand; PAM type: YTN; PAM sequence: CTT
tatgccttatactttgtttg

SEQ ID NO: 223924 - DNA, 20 bp, Artificial Sequence
  Description of Artificial Sequence: Synthetic oligonucleotide
  Target: ATXN1; (-) strand; PAM type: YTN; PAM sequence: TTC
tttatgccttatactttgtt

SEQ ID NO: 223925 - DNA, 20 bp, Artificial Sequence
  Description of Artificial Sequence: Synthetic oligonucleotide
  Target: ATXN1; (-) strand; PAM type: YTN; PAM sequence: TTT
ctttatgccttatactttgt

SEQ ID NO: 223926 - DNA, 20 bp, Artificial Sequence
  Description of Artificial Sequence: Synthetic oligonucleotide
  Target: ATXN1; (-) strand; PAM type: YTN; PAM sequence: TTA
aaagtggccaatgaaagtat

SEQ ID NO: 223927 - DNA, 20 bp, Artificial Sequence
  Description of Artificial Sequence: Synthetic oligonucleotide
  Target: ATXN1; (-) strand; PAM type: YTN; PAM sequence: CTA
tgttaaaagtggccaatgaa

SEQ ID NO: 223928 - DNA, 20 bp, Artificial Sequence
  Description of Artificial Sequence: Synthetic oligonucleotide
  Target: ATXN1; (-) strand; PAM type: YTN; PAM sequence: TTC
acaggtagaagcatggctat

SEQ ID NO: 223929 - DNA, 20 bp, Artificial Sequence
  Description of Artificial Sequence: Synthetic oligonucleotide
  Target: ATXN1; (-) strand; PAM type: YTN; PAM sequence: CTT
cacaggtagaagcatggcta

SEQ ID NO: 223930 - DNA, 20 bp, Artificial Sequence
  Description of Artificial Sequence: Synthetic oligonucleotide
  Target: ATXN1; (-) strand; PAM type: YTN; PAM sequence: TTG
tcccataccttcacaggtag

SEQ ID NO: 223931 - DNA, 20 bp, Artificial Sequence
  Description of Artificial Sequence: Synthetic oligonucleotide
  Target: ATXN1; (-) strand; PAM type: YTN; PAM sequence: TTC
atggaattgtcccatacctt

SEQ ID NO: 223932 - DNA, 20 bp, Artificial Sequence
  Description of Artificial Sequence: Synthetic oligonucleotide
  Target: ATXN1; (-) strand; PAM type: YTN; PAM sequence: TTT
catggaattgtcccatacct

SEQ ID NO: 223933 - DNA, 20 bp, Artificial Sequence
  Description of Artificial Sequence: Synthetic oligonucleotide
  Target: ATXN1; (-) strand; PAM type: YTN; PAM sequence: TTT
tcatggaattgtcccatacc

SEQ ID NO: 223934 - DNA, 20 bp, Artificial Sequence
  Description of Artificial Sequence: Synthetic oligonucleotide
  Target: ATXN1; (-) strand; PAM type: YTN; PAM sequence: CTC
agttttcatggaattgtccc

SEQ ID NO: 223935 - DNA, 20 bp, Artificial Sequence
  Description of Artificial Sequence: Synthetic oligonucleotide
  Target: ATXN1; (-) strand; PAM type: YTN; PAM sequence: CTC
cgtgaactcagttttcatgg

SEQ ID NO: 223936 - DNA, 20 bp, Artificial Sequence
  Description of Artificial Sequence: Synthetic oligonucleotide
  Target: ATXN1; (-) strand; PAM type: YTN; PAM sequence: CTG
gaacccaggatacataaccc

SEQ ID NO: 223937 - DNA, 20 bp, Artificial Sequence
  Description of Artificial Sequence: Synthetic oligonucleotide
  Target: ATXN1; (-) strand; PAM type: YTN; PAM sequence: TTA
tgctggaacccaggatacat

SEQ ID NO: 223938 - DNA, 20 bp, Artificial Sequence
  Description of Artificial Sequence: Synthetic oligonucleotide
  Target: ATXN1; (-) strand; PAM type: YTN; PAM sequence: CTC
aaccaggggttatgctggaa

SEQ ID NO: 223939 - DNA, 20 bp, Artificial Sequence
  Description of Artificial Sequence: Synthetic oligonucleotide
  Target: ATXN1; (-) strand; PAM type: YTN; PAM sequence: TTC
tcaaccaggggttatgctgg

SEQ ID NO: 223940 - DNA, 20 bp, Artificial Sequence
  Description of Artificial Sequence: Synthetic oligonucleotide
  Target: ATXN1; (-) strand; PAM type: YTN; PAM sequence: TTA
atagtaagttctcaaccagg

SEQ ID NO: 223941 - DNA, 20 bp, Artificial Sequence
  Description of Artificial Sequence: Synthetic oligonucleotide
  Target: ATXN1; (-) strand; PAM type: YTN; PAM sequence: CTA
atgttaatagtaagttctca

SEQ ID NO: 223942 - DNA, 20 bp, Artificial Sequence
  Description of Artificial Sequence: Synthetic oligonucleotide
  Target: ATXN1; (-) strand; PAM type: YTN; PAM sequence: TTG
aagagctaatgttaatagta

SEQ ID NO: 223943 - DNA, 20 bp, Artificial Sequence
  Description of Artificial Sequence: Synthetic oligonucleotide
  Target: ATXN1; (-) strand; PAM type: YTN; PAM sequence: CTG
gatcatgaaaataaattgaa

SEQ ID NO: 223944 - DNA, 20 bp, Artificial Sequence
  Description of Artificial Sequence: Synthetic oligonucleotide
  Target: ATXN1; (-) strand; PAM type: YTN; PAM sequence: CTG
tgatacaatatacacaagtc

SEQ ID NO: 223945 - DNA, 20 bp, Artificial Sequence
  Description of Artificial Sequence: Synthetic oligonucleotide
  Target: ATXN1; (-) strand; PAM type: YTN; PAM sequence: TTA
ggtaaccactgtgatacaat

SEQ ID NO: 223946 - DNA, 20 bp, Artificial Sequence
  Description of Artificial Sequence: Synthetic oligonucleotide
  Target: ATXN1; (-) strand; PAM type: YTN; PAM sequence: TTT
aggtaaccactgtgatacaa

SEQ ID NO: 223947 - DNA, 20 bp, Artificial Sequence
  Description of Artificial Sequence: Synthetic oligonucleotide
  Target: ATXN1; (-) strand; PAM type: YTN; PAM sequence: TTT
taggtaaccactgtgataca

SEQ ID NO: 223948 - DNA, 20 bp, Artificial Sequence
  Description of Artificial Sequence: Synthetic oligonucleotide
  Target: ATXN1; (-) strand; PAM type: YTN; PAM sequence: TTA
ttttaggtaaccactgtgat

SEQ ID NO: 223949 - DNA, 20 bp, Artificial Sequence
  Description of Artificial Sequence: Synthetic oligonucleotide
  Target: ATXN1; (-) strand; PAM type: YTN; PAM sequence: TTT
attttaggtaaccactgtga

SEQ ID NO: 223950 - DNA, 20 bp, Artificial Sequence
  Description of Artificial Sequence: Synthetic oligonucleotide
  Target: ATXN1; (-) strand; PAM type: YTN; PAM sequence: TTT
tattttaggtaaccactgtg

SEQ ID NO: 223951 - DNA, 20 bp, Artificial Sequence
  Description of Artificial Sequence: Synthetic oligonucleotide
  Target: ATXN1; (-) strand; PAM type: YTN; PAM sequence: TTT
ttattttaggtaaccactgt

SEQ ID NO: 223952 - DNA, 20 bp, Artificial Sequence
  Description of Artificial Sequence: Synthetic oligonucleotide
  Target: ATXN1; (-) strand; PAM type: YTN; PAM sequence: CTT
tttattttaggtaaccactg

SEQ ID NO: 223953 - DNA, 20 bp, Artificial Sequence
  Description of Artificial Sequence: Synthetic oligonucleotide
  Target: ATXN1; (-) strand; PAM type: YTN; PAM sequence: TTA
ctttttattttaggtaacca

SEQ ID NO: 223954 - DNA, 20 bp, Artificial Sequence
  Description of Artificial Sequence: Synthetic oligonucleotide
  Target: ATXN1; (-) strand; PAM type: YTN; PAM sequence: CTG
gttactttttattttaggta

SEQ ID NO: 223955 - DNA, 20 bp, Artificial Sequence
  Description of Artificial Sequence: Synthetic oligonucleotide
  Target: ATXN1; (-) strand; PAM type: YTN; PAM sequence: CTA
tctggttactttttatttta

SEQ ID NO: 223956 - DNA, 20 bp, Artificial Sequence
  Description of Artificial Sequence: Synthetic oligonucleotide
  Target: ATXN1; (-) strand; PAM type: YTN; PAM sequence: CTC
ctatctggttactttttatt

SEQ ID NO: 223957 - DNA, 20 bp, Artificial Sequence
  Description of Artificial Sequence: Synthetic oligonucleotide
  Target: ATXN1; (-) strand; PAM type: YTN; PAM sequence: CTG
tctcctatctggttactttt

SEQ ID NO: 223958 - DNA, 20 bp, Artificial Sequence
  Description of Artificial Sequence: Synthetic oligonucleotide
  Target: ATXN1; (-) strand; PAM type: YTN; PAM sequence: TTA
ctgtctcctatctggttact

SEQ ID NO: 223959 - DNA, 20 bp, Artificial Sequence
  Description of Artificial Sequence: Synthetic oligonucleotide
  Target: ATXN1; (-) strand; PAM type: YTN; PAM sequence: TTT
actgtctcctatctggttac

SEQ ID NO: 223960 - DNA, 20 bp, Artificial Sequence
  Description of Artificial Sequence: Synthetic oligonucleotide
  Target: ATXN1; (-) strand; PAM type: YTN; PAM sequence: TTT
tactgtctcctatctggtta

SEQ ID NO: 223961 - DNA, 20 bp, Artificial Sequence
  Description of Artificial Sequence: Synthetic oligonucleotide
  Target: ATXN1; (-) strand; PAM type: YTN; PAM sequence: TTG
ttttactgtctcctatctgg

SEQ ID NO: 223962 - DNA, 20 bp, Artificial Sequence
  Description of Artificial Sequence: Synthetic oligonucleotide
  Target: ATXN1; (-) strand; PAM type: YTN; PAM sequence: TTC
atcaatattgttttactgtc

SEQ ID NO: 223963 - DNA, 20 bp, Artificial Sequence
  Description of Artificial Sequence: Synthetic oligonucleotide
  Target: ATXN1; (-) strand; PAM type: YTN; PAM sequence: CTC
atggaaattcatcaatattg

SEQ ID NO: 223964 - DNA, 20 bp, Artificial Sequence
  Description of Artificial Sequence: Synthetic oligonucleotide
  Target: ATXN1; (-) strand; PAM type: YTN; PAM sequence: TTC
tcatggaaattcatcaatat

SEQ ID NO: 223965 - DNA, 20 bp, Artificial Sequence
  Description of Artificial Sequence: Synthetic oligonucleotide
  Target: ATXN1; (-) strand; PAM type: YTN; PAM sequence: CTC
attctcatggaaattcatca

SEQ ID NO: 223966 - DNA, 20 bp, Artificial Sequence
  Description of Artificial Sequence: Synthetic oligonucleotide
  Target: ATXN1; (-) strand; PAM type: YTN; PAM sequence: CTA
aatgatatgtctcattctca

SEQ ID NO: 223967 - DNA, 20 bp, Artificial Sequence
  Description of Artificial Sequence: Synthetic oligonucleotide
  Target: ATXN1; (-) strand; PAM type: YTN; PAM sequence: CTC
ctaaatgatatgtctcattc

SEQ ID NO: 223968 - DNA, 20 bp, Artificial Sequence
  Description of Artificial Sequence: Synthetic oligonucleotide
  Target: ATXN1; (-) strand; PAM type: YTN; PAM sequence: TTA
agtaaagctcctaaatgata

SEQ ID NO: 223969 - DNA, 20 bp, Artificial Sequence
  Description of Artificial Sequence: Synthetic oligonucleotide
  Target: ATXN1; (-) strand; PAM type: YTN; PAM sequence: TTT
aagtaaagctcctaaatgat

SEQ ID NO: 223970 - DNA, 20 bp, Artificial Sequence
  Description of Artificial Sequence: Synthetic oligonucleotide
  Target: ATXN1; (-) strand; PAM type: YTN; PAM sequence: TTT
taagtaaagctcctaaatga

SEQ ID NO: 223971 - DNA, 20 bp, Artificial Sequence
  Description of Artificial Sequence: Synthetic oligonucleotide
  Target: ATXN1; (-) strand; PAM type: YTN; PAM sequence: TTT
ttaagtaaagctcctaaatg

SEQ ID NO: 223972 - DNA, 20 bp, Artificial Sequence
  Description of Artificial Sequence: Synthetic oligonucleotide
  Target: ATXN1; (-) strand; PAM type: YTN; PAM sequence: TTA
gcaggaaggtttttaagtaa

SEQ ID NO: 223973 - DNA, 20 bp, Artificial Sequence
  Description of Artificial Sequence: Synthetic oligonucleotide
  Target: ATXN1; (-) strand; PAM type: YTN; PAM sequence: TTT
agcaggaaggtttttaagta

SEQ ID NO: 223974 - DNA, 20 bp, Artificial Sequence
  Description of Artificial Sequence: Synthetic oligonucleotide
  Target: ATXN1; (-) strand; PAM type: YTN; PAM sequence: TTG
tttagcaggaaggtttttaa

SEQ ID NO: 223975 - DNA, 20 bp, Artificial Sequence
  Description of Artificial Sequence: Synthetic oligonucleotide
  Target: ATXN1; (-) strand; PAM type: YTN; PAM sequence: TTT
gtttagcaggaaggttttta

SEQ ID NO: 223976 - DNA, 20 bp, Artificial Sequence
  Description of Artificial Sequence: Synthetic oligonucleotide
  Target: ATXN1; (-) strand; PAM type: YTN; PAM sequence: TTG
tttgtttagcaggaaggttt

SEQ ID NO: 223977 - DNA, 20 bp, Artificial Sequence
  Description of Artificial Sequence: Synthetic oligonucleotide
  Target: ATXN1; (-) strand; PAM type: YTN; PAM sequence: TTT
gtttgtttagcaggaaggtt

SEQ ID NO: 223978 - DNA, 20 bp, Artificial Sequence
  Description of Artificial Sequence: Synthetic oligonucleotide
  Target: ATXN1; (-) strand; PAM type: YTN; PAM sequence: TTT
tgtttgtttagcaggaaggt

SEQ ID NO: 223979 - DNA, 20 bp, Artificial Sequence
  Description of Artificial Sequence: Synthetic oligonucleotide
  Target: ATXN1; (-) strand; PAM type: YTN; PAM sequence: TTT
ttgtttgtttagcaggaagg

SEQ ID NO: 223980 - DNA, 20 bp, Artificial Sequence
  Description of Artificial Sequence: Synthetic oligonucleotide
  Target: ATXN1; (-) strand; PAM type: YTN; PAM sequence: TTT
tttgtttgtttagcaggaag

SEQ ID NO: 223981 - DNA, 20 bp, Artificial Sequence
  Description of Artificial Sequence: Synthetic oligonucleotide
  Target: ATXN1; (-) strand; PAM type: YTN; PAM sequence: CTT
ttttgtttgtttagcaggaa

SEQ ID NO: 223982 - DNA, 20 bp, Artificial Sequence
  Description of Artificial Sequence: Synthetic oligonucleotide
  Target: ATXN1; (-) strand; PAM type: YTN; PAM sequence: TTA
gtccttttttgtttgtttag

SEQ ID NO: 223983 - DNA, 20 bp, Artificial Sequence
  Description of Artificial Sequence: Synthetic oligonucleotide
  Target: ATXN1; (-) strand; PAM type: YTN; PAM sequence: TTC
ataagcatgggagaccccaa

SEQ ID NO: 223984 - DNA, 20 bp, Artificial Sequence
  Description of Artificial Sequence: Synthetic oligonucleotide
  Target: ATXN1; (-) strand; PAM type: YTN; PAM sequence: CTC
aattcataagcatgggagac

SEQ ID NO: 223985 - DNA, 20 bp, Artificial Sequence
  Description of Artificial Sequence: Synthetic oligonucleotide
  Target: ATXN1; (-) strand; PAM type: YTN; PAM sequence: TTC
tcaattcataagcatgggag

SEQ ID NO: 223986 - DNA, 20 bp, Artificial Sequence
  Description of Artificial Sequence: Synthetic oligonucleotide
  Target: ATXN1; (-) strand; PAM type: YTN; PAM sequence: TTT
ctcaattcataagcatggga

SEQ ID NO: 223987 - DNA, 20 bp, Artificial Sequence
  Description of Artificial Sequence: Synthetic oligonucleotide
  Target: ATXN1; (-) strand; PAM type: YTN; PAM sequence: TTT
tctcaattcataagcatggg

SEQ ID NO: 223988 - DNA, 20 bp, Artificial Sequence
  Description of Artificial Sequence: Synthetic oligonucleotide
  Target: ATXN1; (-) strand; PAM type: YTN; PAM sequence: TTA
tatcaagtgtgttttctcaa

SEQ ID NO: 223989 - DNA, 20 bp, Artificial Sequence
  Description of Artificial Sequence: Synthetic oligonucleotide
  Target: ATXN1; (-) strand; PAM type: YTN; PAM sequence: CTT
atatcaagtgtgttttctca

SEQ ID NO: 223990 - DNA, 20 bp, Artificial Sequence
  Description of Artificial Sequence: Synthetic oligonucleotide
  Target: ATXN1; (-) strand; PAM type: YTN; PAM sequence: TTA
cttatatcaagtgtgttttc

SEQ ID NO: 223991 - DNA, 20 bp, Artificial Sequence
  Description of Artificial Sequence: Synthetic oligonucleotide
  Target: ATXN1; (-) strand; PAM type: YTN; PAM sequence: TTT
acttatatcaagtgtgtttt

SEQ ID NO: 223992 - DNA, 20 bp, Artificial Sequence
  Description of Artificial Sequence: Synthetic oligonucleotide
  Target: ATXN1; (-) strand; PAM type: YTN; PAM sequence: TTC
atttacttatatcaagtgtg

SEQ ID NO: 223993 - DNA, 20 bp, Artificial Sequence
  Description of Artificial Sequence: Synthetic oligonucleotide
  Target: ATXN1; (-) strand; PAM type: YTN; PAM sequence: CTT
catttacttatatcaagtgt

SEQ ID NO: 223994 - DNA, 20 bp, Artificial Sequence
  Description of Artificial Sequence: Synthetic oligonucleotide
  Target: ATXN1; (-) strand; PAM type: YTN; PAM sequence: TTC
ttcatttacttatatcaagt

SEQ ID NO: 223995 - DNA, 20 bp, Artificial Sequence
  Description of Artificial Sequence: Synthetic oligonucleotide
  Target: ATXN1; (-) strand; PAM type: YTN; PAM sequence: TTT
cttcatttacttatatcaag

SEQ ID NO: 223996 - DNA, 20 bp, Artificial Sequence
  Description of Artificial Sequence: Synthetic oligonucleotide
  Target: ATXN1; (-) strand; PAM type: YTN; PAM sequence: TTG
tttcttcatttacttatatc

SEQ ID NO: 223997 - DNA, 20 bp, Artificial Sequence
  Description of Artificial Sequence: Synthetic oligonucleotide
  Target: ATXN1; (-) strand; PAM type: YTN; PAM sequence: CTA
ttgtttcttcatttacttat

SEQ ID NO: 223998 - DNA, 20 bp, Artificial Sequence
  Description of Artificial Sequence: Synthetic oligonucleotide
  Target: ATXN1; (-) strand; PAM type: YTN; PAM sequence: TTC
aactattgtttcttcattta

SEQ ID NO: 223999 - DNA, 20 bp, Artificial Sequence
  Description of Artificial Sequence: Synthetic oligonucleotide
  Target: ATXN1; (-) strand; PAM type: YTN; PAM sequence: TTT
caactattgtttcttcattt

SEQ ID NO: 224000 - DNA, 20 bp, Artificial Sequence
  Description of Artificial Sequence: Synthetic oligonucleotide
  Target: ATXN1; (-) strand; PAM type: YTN; PAM sequence: CTG
tttcaactattgtttcttca

SEQ ID NO: 224001 - DNA, 20 bp, Artificial Sequence
  Description of Artificial Sequence: Synthetic oligonucleotide
  Target: ATXN1; (-) strand; PAM type: YTN; PAM sequence: TTC
agggctgtttcaactattgt

SEQ ID NO: 224002 - DNA, 20 bp, Artificial Sequence
  Description of Artificial Sequence: Synthetic oligonucleotide
  Target: ATXN1; (-) strand; PAM type: YTN; PAM sequence: CTT
cagggctgtttcaactattg

SEQ ID NO: 224003 - DNA, 20 bp, Artificial Sequence
  Description of Artificial Sequence: Synthetic oligonucleotide
  Target: ATXN1; (-) strand; PAM type: YTN; PAM sequence: CTG
tcacttcagggctgtttcaa

SEQ ID NO: 224004 - DNA, 20 bp, Artificial Sequence
  Description of Artificial Sequence: Synthetic oligonucleotide
  Target: ATXN1; (-) strand; PAM type: YTN; PAM sequence: TTC
tgtcacttcagggctgtttc

SEQ ID NO: 224005 - DNA, 20 bp, Artificial Sequence
  Description of Artificial Sequence: Synthetic oligonucleotide
  Target: ATXN1; (-) strand; PAM type: YTN; PAM sequence: TTT
ctgtcacttcagggctgttt

SEQ ID NO: 224006 - DNA, 20 bp, Artificial Sequence
  Description of Artificial Sequence: Synthetic oligonucleotide
  Target: ATXN1; (-) strand; PAM type: YTN; PAM sequence: TTT
tctgtcacttcagggctgtt

SEQ ID NO: 224007 - DNA, 20 bp, Artificial Sequence
  Description of Artificial Sequence: Synthetic oligonucleotide
  Target: ATXN1; (-) strand; PAM type: YTN; PAM sequence: TTT
ttctgtcacttcagggctgt

SEQ ID NO: 224008 - DNA, 20 bp, Artificial Sequence
  Description of Artificial Sequence: Synthetic oligonucleotide
  Target: ATXN1; (-) strand; PAM type: YTN; PAM sequence: TTT
tttctgtcacttcagggctg

SEQ ID NO: 224009 - DNA, 20 bp, Artificial Sequence
  Description of Artificial Sequence: Synthetic oligonucleotide
  Target: ATXN1; (-) strand; PAM type: YTN; PAM sequence: TTC
cattttttctgtcacttcag

SEQ ID NO: 224010 - DNA, 20 bp, Artificial Sequence
  Description of Artificial Sequence: Synthetic oligonucleotide
  Target: ATXN1; (-) strand; PAM type: YTN; PAM sequence: CTT
ccattttttctgtcacttca

SEQ ID NO: 224011 - DNA, 20 bp, Artificial Sequence
  Description of Artificial Sequence: Synthetic oligonucleotide
  Target: ATXN1; (-) strand; PAM type: YTN; PAM sequence: CTA
cttccattttttctgtcact

SEQ ID NO: 224012 - DNA, 20 bp, Artificial Sequence
  Description of Artificial Sequence: Synthetic oligonucleotide
  Target: ATXN1; (-) strand; PAM type: YTN; PAM sequence: TTA
gaaccctacttccatttttt

SEQ ID NO: 224013 - DNA, 20 bp, Artificial Sequence
  Description of Artificial Sequence: Synthetic oligonucleotide
  Target: ATXN1; (-) strand; PAM type: YTN; PAM sequence: CTT
agaaccctacttccattttt

SEQ ID NO: 224014 - DNA, 20 bp, Artificial Sequence
  Description of Artificial Sequence: Synthetic oligonucleotide
  Target: ATXN1; (-) strand; PAM type: YTN; PAM sequence: TTG
agcttagaaccctacttcca

SEQ ID NO: 224015 - DNA, 20 bp, Artificial Sequence
  Description of Artificial Sequence: Synthetic oligonucleotide
  Target: ATXN1; (-) strand; PAM type: YTN; PAM sequence: CTG
gagttgagcttagaacccta

SEQ ID NO: 224016 - DNA, 20 bp, Artificial Sequence
  Description of Artificial Sequence: Synthetic oligonucleotide
  Target: ATXN1; (-) strand; PAM type: YTN; PAM sequence: CTC
tggagttgagcttagaaccc

SEQ ID NO: 224017 - DNA, 20 bp, Artificial Sequence
  Description of Artificial Sequence: Synthetic oligonucleotide
  Target: ATXN1; (-) strand; PAM type: YTN; PAM sequence: TTG
cctctggagttgagcttaga

SEQ ID NO: 224018 - DNA, 20 bp, Artificial Sequence
  Description of Artificial Sequence: Synthetic oligonucleotide
  Target: ATXN1; (-) strand; PAM type: YTN; PAM sequence: CTT
gcctctggagttgagcttag

SEQ ID NO: 224019 - DNA, 20 bp, Artificial Sequence
  Description of Artificial Sequence: Synthetic oligonucleotide
  Target: ATXN1; (-) strand; PAM type: YTN; PAM sequence: CTG
taccaccttgcctctggagt

SEQ ID NO: 224020 - DNA, 20 bp, Artificial Sequence
  Description of Artificial Sequence: Synthetic oligonucleotide
  Target: ATXN1; (-) strand; PAM type: YTN; PAM sequence: TTC
tgtaccaccttgcctctgga

SEQ ID NO: 224021 - DNA, 20 bp, Artificial Sequence
  Description of Artificial Sequence: Synthetic oligonucleotide
  Target: ATXN1; (-) strand; PAM type: YTN; PAM sequence: CTG
gtattctgtaccaccttgcc

SEQ ID NO: 224022 - DNA, 20 bp, Artificial Sequence
  Description of Artificial Sequence: Synthetic oligonucleotide
  Target: ATXN1; (-) strand; PAM type: YTN; PAM sequence: TTC
atccagctggtattctgtac

SEQ ID NO: 224023 - DNA, 20 bp, Artificial Sequence
  Description of Artificial Sequence: Synthetic oligonucleotide
  Target: ATXN1; (-) strand; PAM type: YTN; PAM sequence: CTG
ttcatccagctggtattctg

SEQ ID NO: 224024 - DNA, 20 bp, Artificial Sequence
  Description of Artificial Sequence: Synthetic oligonucleotide
  Target: ATXN1; (-) strand; PAM type: YTN; PAM sequence: TTG
aactgttcatccagctggta

SEQ ID NO: 224025 - DNA, 20 bp, Artificial Sequence
  Description of Artificial Sequence: Synthetic oligonucleotide
  Target: ATXN1; (-) strand; PAM type: YTN; PAM sequence: TTT
gaactgttcatccagctggt

SEQ ID NO: 224026 - DNA, 20 bp, Artificial Sequence
  Description of Artificial Sequence: Synthetic oligonucleotide
  Target: ATXN1; (-) strand; PAM type: YTN; PAM sequence: CTT
tgaactgttcatccagctgg

SEQ ID NO: 224027 - DNA, 20 bp, Artificial Sequence
  Description of Artificial Sequence: Synthetic oligonucleotide
  Target: ATXN1; (-) strand; PAM type: YTN; PAM sequence: CTA
gggaagctttgaactgttca

SEQ ID NO: 224028 - DNA, 20 bp, Artificial Sequence
  Description of Artificial Sequence: Synthetic oligonucleotide
  Target: ATXN1; (-) strand; PAM type: YTN; PAM sequence: CTC
aactagggaagctttgaact

SEQ ID NO: 224029 - DNA, 20 bp, Artificial Sequence
  Description of Artificial Sequence: Synthetic oligonucleotide
  Target: ATXN1; (-) strand; PAM type: YTN; PAM sequence: TTG
aggtagagaccctcaactag

SEQ ID NO: 224030 - DNA, 20 bp, Artificial Sequence
  Description of Artificial Sequence: Synthetic oligonucleotide
  Target: ATXN1; (-) strand; PAM type: YTN; PAM sequence: CTG
tcattgaggtagagaccctc

SEQ ID NO: 224031 - DNA, 20 bp, Artificial Sequence
  Description of Artificial Sequence: Synthetic oligonucleotide
  Target: ATXN1; (-) strand; PAM type: YTN; PAM sequence: TTG
tctgtcattgaggtagagac

SEQ ID NO: 224032 - DNA, 20 bp, Artificial Sequence
  Description of Artificial Sequence: Synthetic oligonucleotide
  Target: ATXN1; (-) strand; PAM type: YTN; PAM sequence: TTT
gtctgtcattgaggtagaga

SEQ ID NO: 224033 - DNA, 20 bp, Artificial Sequence
  Description of Artificial Sequence: Synthetic oligonucleotide
  Target: ATXN1; (-) strand; PAM type: YTN; PAM sequence: TTT
tgtctgtcattgaggtagag

SEQ ID NO: 224034 - DNA, 20 bp, Artificial Sequence
  Description of Artificial Sequence: Synthetic oligonucleotide
  Target: ATXN1; (-) strand; PAM type: YTN; PAM sequence: TTA
ggagttttgtctgtcattga

SEQ ID NO: 224035 - DNA, 20 bp, Artificial Sequence
  Description of Artificial Sequence: Synthetic oligonucleotide
  Target: ATXN1; (-) strand; PAM type: YTN; PAM sequence: CTA
tggagaaagccaaagttagg

SEQ ID NO: 224036 - DNA, 20 bp, Artificial Sequence
  Description of Artificial Sequence: Synthetic oligonucleotide
  Target: ATXN1; (-) strand; PAM type: YTN; PAM sequence: CTC
tatggagaaagccaaagtta

SEQ ID NO: 224037 - DNA, 20 bp, Artificial Sequence
  Description of Artificial Sequence: Synthetic oligonucleotide
  Target: ATXN1; (-) strand; PAM type: YTN; PAM sequence: TTG
atgctctatggagaaagcca

SEQ ID NO: 224038 - DNA, 20 bp, Artificial Sequence
  Description of Artificial Sequence: Synthetic oligonucleotide
  Target: ATXN1; (-) strand; PAM type: YTN; PAM sequence: TTG
gttgatgctctatggagaaa

SEQ ID NO: 224039 - DNA, 20 bp, Artificial Sequence
  Description of Artificial Sequence: Synthetic oligonucleotide
  Target: ATXN1; (-) strand; PAM type: YTN; PAM sequence: TTT
ggttgatgctctatggagaa

SEQ ID NO: 224040 - DNA, 20 bp, Artificial Sequence
  Description of Artificial Sequence: Synthetic oligonucleotide
  Target: ATXN1; (-) strand; PAM type: YTN; PAM sequence: CTG
aatttggttgatgctctatg

SEQ ID NO: 224041 - DNA, 20 bp, Artificial Sequence
  Description of Artificial Sequence: Synthetic oligonucleotide
  Target: ATXN1; (-) strand; PAM type: YTN; PAM sequence: TTA
ctgaatttggttgatgctct

SEQ ID NO: 224042 - DNA, 20 bp, Artificial Sequence
  Description of Artificial Sequence: Synthetic oligonucleotide
  Target: ATXN1; (-) strand; PAM type: YTN; PAM sequence: TTC
atcattactgaatttggttg

SEQ ID NO: 224043 - DNA, 20 bp, Artificial Sequence
  Description of Artificial Sequence: Synthetic oligonucleotide
  Target: ATXN1; (-) strand; PAM type: YTN; PAM sequence: CTT
catcattactgaatttggtt

SEQ ID NO: 224044 - DNA, 20 bp, Artificial Sequence
  Description of Artificial Sequence: Synthetic oligonucleotide
  Target: ATXN1; (-) strand; PAM type: YTN; PAM sequence: TTA
agcaggtacttcatcattac

SEQ ID NO: 224045 - DNA, 20 bp, Artificial Sequence
  Description of Artificial Sequence: Synthetic oligonucleotide
  Target: ATXN1; (-) strand; PAM type: YTN; PAM sequence: CTA
tagtgttaagcaggtacttc

SEQ ID NO: 224046 - DNA, 20 bp, Artificial Sequence
  Description of Artificial Sequence: Synthetic oligonucleotide
  Target: ATXN1; (-) strand; PAM type: YTN; PAM sequence: TTC
aacctatagtgttaagcagg

SEQ ID NO: 224047 - DNA, 20 bp, Artificial Sequence
  Description of Artificial Sequence: Synthetic oligonucleotide
  Target: ATXN1; (-) strand; PAM type: YTN; PAM sequence: TTA
ttcaacctatagtgttaagc

SEQ ID NO: 224048 - DNA, 20 bp, Artificial Sequence
  Description of Artificial Sequence: Synthetic oligonucleotide
  Target: ATXN1; (-) strand; PAM type: YTN; PAM sequence: TTG
tcaaaagttattcaacctat

SEQ ID NO: 224049 - DNA, 20 bp, Artificial Sequence
  Description of Artificial Sequence: Synthetic oligonucleotide
  Target: ATXN1; (-) strand; PAM type: YTN; PAM sequence: CTT
gtcaaaagttattcaaccta

SEQ ID NO: 224050 - DNA, 20 bp, Artificial Sequence
  Description of Artificial Sequence: Synthetic oligonucleotide
  Target: ATXN1; (-) strand; PAM type: YTN; PAM sequence: TTA
cagcttgtcaaaagttattc

SEQ ID NO: 224051 - DNA, 20 bp, Artificial Sequence
  Description of Artificial Sequence: Synthetic oligonucleotide
  Target: ATXN1; (-) strand; PAM type: YTN; PAM sequence: TTC
caccaacaggatgttacagc

SEQ ID NO: 224052 - DNA, 20 bp, Artificial Sequence
  Description of Artificial Sequence: Synthetic oligonucleotide
  Target: ATXN1; (-) strand; PAM type: YTN; PAM sequence: TTT
ccaccaacaggatgttacag

SEQ ID NO: 224053 - DNA, 20 bp, Artificial Sequence
  Description of Artificial Sequence: Synthetic oligonucleotide
  Target: ATXN1; (-) strand; PAM type: YTN; PAM sequence: TTT
tccaccaacaggatgttaca

SEQ ID NO: 224054 - DNA, 20 bp, Artificial Sequence
  Description of Artificial Sequence: Synthetic oligonucleotide
  Target: ATXN1; (-) strand; PAM type: YTN; PAM sequence: CTA
ttttccaccaacaggatgtt

SEQ ID NO: 224055 - DNA, 20 bp, Artificial Sequence
  Description of Artificial Sequence: Synthetic oligonucleotide
  Target: ATXN1; (-) strand; PAM type: YTN; PAM sequence: CTG
gctattttccaccaacagga

SEQ ID NO: 224056 - DNA, 20 bp, Artificial Sequence
  Description of Artificial Sequence: Synthetic oligonucleotide
  Target: ATXN1; (-) strand; PAM type: YTN; PAM sequence: TTG
agcaaggctggctattttcc

SEQ ID NO: 224057 - DNA, 20 bp, Artificial Sequence
  Description of Artificial Sequence: Synthetic oligonucleotide
  Target: ATXN1; (-) strand; PAM type: YTN; PAM sequence: TTA
tgttgagcaaggctggctat

SEQ ID NO: 224058 - DNA, 20 bp, Artificial Sequence
  Description of Artificial Sequence: Synthetic oligonucleotide
  Target: ATXN1; (-) strand; PAM type: YTN; PAM sequence: TTG
caatattatgttgagcaagg

SEQ ID NO: 224059 - DNA, 20 bp, Artificial Sequence
  Description of Artificial Sequence: Synthetic oligonucleotide
  Target: ATXN1; (-) strand; PAM type: YTN; PAM sequence: TTT
gcaatattatgttgagcaag

SEQ ID NO: 224060 - DNA, 20 bp, Artificial Sequence
  Description of Artificial Sequence: Synthetic oligonucleotide
  Target: ATXN1; (-) strand; PAM type: YTN; PAM sequence: TTG
ggtttgcaatattatgttga

SEQ ID NO: 224061 - DNA, 20 bp, Artificial Sequence
  Description of Artificial Sequence: Synthetic oligonucleotide
  Target: ATXN1; (-) strand; PAM type: YTN; PAM sequence: TTT
gggtttgcaatattatgttg

SEQ ID NO: 224062 - DNA, 20 bp, Artificial Sequence
  Description of Artificial Sequence: Synthetic oligonucleotide
  Target: ATXN1; (-) strand; PAM type: YTN; PAM sequence: TTT
tgggtttgcaatattatgtt

SEQ ID NO: 224063 - DNA, 20 bp, Artificial Sequence
  Description of Artificial Sequence: Synthetic oligonucleotide
  Target: ATXN1; (-) strand; PAM type: YTN; PAM sequence: CTG
ttttgggtttgcaatattat

SEQ ID NO: 224064 - DNA, 20 bp, Artificial Sequence
  Description of Artificial Sequence: Synthetic oligonucleotide
  Target: ATXN1; (-) strand; PAM type: YTN; PAM sequence: TTA
ccctgttttgggtttgcaat

SEQ ID NO: 224065 - DNA, 20 bp, Artificial Sequence
  Description of Artificial Sequence: Synthetic oligonucleotide
  Target: ATXN1; (-) strand; PAM type: YTN; PAM sequence: TTG
cacaattaccctgttttggg

SEQ ID NO: 224066 - DNA, 20 bp, Artificial Sequence
  Description of Artificial Sequence: Synthetic oligonucleotide
  Target: ATXN1; (-) strand; PAM type: YTN; PAM sequence: TTT
gcacaattaccctgttttgg

SEQ ID NO: 224067 - DNA, 20 bp, Artificial Sequence
  Description of Artificial Sequence: Synthetic oligonucleotide
  Target: ATXN1; (-) strand; PAM type: YTN; PAM sequence: CTT
tgcacaattaccctgttttg

SEQ ID NO: 224068 - DNA, 20 bp, Artificial Sequence
  Description of Artificial Sequence: Synthetic oligonucleotide
  Target: ATXN1; (-) strand; PAM type: YTN; PAM sequence: CTC
tttgcacaattaccctgttt

SEQ ID NO: 224069 - DNA, 20 bp, Artificial Sequence
  Description of Artificial Sequence: Synthetic oligonucleotide
  Target: ATXN1; (-) strand; PAM type: YTN; PAM sequence: CTC
tctttgcacaattaccctgt

SEQ ID NO: 224070 - DNA, 20 bp, Artificial Sequence
  Description of Artificial Sequence: Synthetic oligonucleotide
  Target: ATXN1; (-) strand; PAM type: YTN; PAM sequence: TTC
tctctttgcacaattaccct

SEQ ID NO: 224071 - DNA, 20 bp, Artificial Sequence
  Description of Artificial Sequence: Synthetic oligonucleotide
  Target: ATXN1; (-) strand; PAM type: YTN; PAM sequence: CTG
gaaaggggacatacacaaaa

SEQ ID NO: 224072 - DNA, 20 bp, Artificial Sequence
  Description of Artificial Sequence: Synthetic oligonucleotide
  Target: ATXN1; (-) strand; PAM type: YTN; PAM sequence: TTC
tggaaaggggacatacacaa

SEQ ID NO: 224073 - DNA, 20 bp, Artificial Sequence
  Description of Artificial Sequence: Synthetic oligonucleotide
  Target: ATXN1; (-) strand; PAM type: YTN; PAM sequence: TTT
ctggaaaggggacatacaca

SEQ ID NO: 224074 - DNA, 20 bp, Artificial Sequence
  Description of Artificial Sequence: Synthetic oligonucleotide
  Target: ATXN1; (-) strand; PAM type: YTN; PAM sequence: TTT
tctggaaaggggacatacac

SEQ ID NO: 224075 - DNA, 20 bp, Artificial Sequence
  Description of Artificial Sequence: Synthetic oligonucleotide
  Target: ATXN1; (-) strand; PAM type: YTN; PAM sequence: TTG
gatgtcacccagaatatttt

SEQ ID NO: 224076 - DNA, 20 bp, Artificial Sequence
  Description of Artificial Sequence: Synthetic oligonucleotide
  Target: ATXN1; (-) strand; PAM type: YTN; PAM sequence: TTG
taaataagtgagccgggtaa

SEQ ID NO: 224077 - DNA, 20 bp, Artificial Sequence
  Description of Artificial Sequence: Synthetic oligonucleotide
  Target: ATXN1; (-) strand; PAM type: YTN; PAM sequence: TTA
ggcagccccaattgtaaata

SEQ ID NO: 224078 - DNA, 20 bp, Artificial Sequence
  Description of Artificial Sequence: Synthetic oligonucleotide
  Target: ATXN1; (-) strand; PAM type: YTN; PAM sequence: TTT
aggcagccccaattgtaaat

SEQ ID NO: 224079 - DNA, 20 bp, Artificial Sequence
  Description of Artificial Sequence: Synthetic oligonucleotide
  Target: ATXN1; (-) strand; PAM type: YTN; PAM sequence: TTT
taggcagccccaattgtaaa

SEQ ID NO: 224080 - DNA, 20 bp, Artificial Sequence
  Description of Artificial Sequence: Synthetic oligonucleotide
  Target: ATXN1; (-) strand; PAM type: YTN; PAM sequence: TTG
cattttaggcagccccaatt

SEQ ID NO: 224081 - DNA, 20 bp, Artificial Sequence
  Description of Artificial Sequence: Synthetic oligonucleotide
  Target: ATXN1; (-) strand; PAM type: YTN; PAM sequence: TTA
gaatggcattgcattttagg

SEQ ID NO: 224082 - DNA, 20 bp, Artificial Sequence
  Description of Artificial Sequence: Synthetic oligonucleotide
  Target: ATXN1; (-) strand; PAM type: YTN; PAM sequence: TTT
agaatggcattgcattttag

SEQ ID NO: 224083 - DNA, 20 bp, Artificial Sequence
  Description of Artificial Sequence: Synthetic oligonucleotide
  Target: ATXN1; (-) strand; PAM type: YTN; PAM sequence: TTT
tagaatggcattgcatttta

SEQ ID NO: 224084 - DNA, 20 bp, Artificial Sequence
  Description of Artificial Sequence: Synthetic oligonucleotide
  Target: ATXN1; (-) strand; PAM type: YTN; PAM sequence: TTG
gtagttttagaatggcattg

SEQ ID NO: 224085 - DNA, 20 bp, Artificial Sequence
  Description of Artificial Sequence: Synthetic oligonucleotide
  Target: ATXN1; (-) strand; PAM type: YTN; PAM sequence: TTA
ttggtagttttagaatggca

SEQ ID NO: 224086 - DNA, 20 bp, Artificial Sequence
  Description of Artificial Sequence: Synthetic oligonucleotide
  Target: ATXN1; (-) strand; PAM type: YTN; PAM sequence: TTT
attggtagttttagaatggc

SEQ ID NO: 224087 - DNA, 20 bp, Artificial Sequence
  Description of Artificial Sequence: Synthetic oligonucleotide
  Target: ATXN1; (-) strand; PAM type: YTN; PAM sequence: TTC
acaaaatagtttattggtag

SEQ ID NO: 224088 - DNA, 20 bp, Artificial Sequence
  Description of Artificial Sequence: Synthetic oligonucleotide
  Target: ATXN1; (-) strand; PAM type: YTN; PAM sequence: TTT
cacaaaatagtttattggta

SEQ ID NO: 224089 - DNA, 20 bp, Artificial Sequence
  Description of Artificial Sequence: Synthetic oligonucleotide
  Target: ATXN1; (-) strand; PAM type: YTN; PAM sequence: TTG
atttcacaaaatagtttatt

SEQ ID NO: 224090 - DNA, 20 bp, Artificial Sequence
  Description of Artificial Sequence: Synthetic oligonucleotide
  Target: ATXN1; (-) strand; PAM type: YTN; PAM sequence: CTT
gatttcacaaaatagtttat

SEQ ID NO: 224091 - DNA, 20 bp, Artificial Sequence
  Description of Artificial Sequence: Synthetic oligonucleotide
  Target: ATXN1; (-) strand; PAM type: YTN; PAM sequence: CTA
aacttgatttcacaaaatag

SEQ ID NO: 224092 - DNA, 20 bp, Artificial Sequence
  Description of Artificial Sequence: Synthetic oligonucleotide
  Target: ATXN1; (-) strand; PAM type: YTN; PAM sequence: TTA
ctaaacttgatttcacaaaa

SEQ ID NO: 224093 - DNA, 20 bp, Artificial Sequence
  Description of Artificial Sequence: Synthetic oligonucleotide
  Target: ATXN1; (-) strand; PAM type: YTN; PAM sequence: CTC
aagttactaaacttgatttc

SEQ ID NO: 224094 - DNA, 20 bp, Artificial Sequence
  Description of Artificial Sequence: Synthetic oligonucleotide
  Target: ATXN1; (-) strand; PAM type: YTN; PAM sequence: TTG
tcagggatatcataaatgag

SEQ ID NO: 224095 - DNA, 20 bp, Artificial Sequence
  Description of Artificial Sequence: Synthetic oligonucleotide
  Target: ATXN1; (-) strand; PAM type: YTN; PAM sequence: TTG
gtggttgtcagggatatcat

SEQ ID NO: 224096 - DNA, 20 bp, Artificial Sequence
  Description of Artificial Sequence: Synthetic oligonucleotide
  Target: ATXN1; (-) strand; PAM type: YTN; PAM sequence: TTT
ggtggttgtcagggatatca

SEQ ID NO: 224097 - DNA, 20 bp, Artificial Sequence
  Description of Artificial Sequence: Synthetic oligonucleotide
  Target: ATXN1; (-) strand; PAM type: YTN; PAM sequence: TTT
tggtggttgtcagggatatc

SEQ ID NO: 224098 - DNA, 20 bp, Artificial Sequence
  Description of Artificial Sequence: Synthetic oligonucleotide
  Target: ATXN1; (-) strand; PAM type: YTN; PAM sequence: CTA
atcaggttttggtggttgtc

SEQ ID NO: 224099 - DNA, 20 bp, Artificial Sequence
  Description of Artificial Sequence: Synthetic oligonucleotide
  Target: ATXN1; (-) strand; PAM type: YTN; PAM sequence: CTA
gacaaaggagagagatgtct

SEQ ID NO: 224100 - DNA, 20 bp, Artificial Sequence
  Description of Artificial Sequence: Synthetic oligonucleotide
  Target: ATXN1; (-) strand; PAM type: YTN; PAM sequence: TTC
agtaaagcacctagacaaag

SEQ ID NO: 224101 - DNA, 20 bp, Artificial Sequence
  Description of Artificial Sequence: Synthetic oligonucleotide
  Target: ATXN1; (-) strand; PAM type: YTN; PAM sequence: TTT
cagtaaagcacctagacaaa

SEQ ID NO: 224102 - DNA, 20 bp, Artificial Sequence
  Description of Artificial Sequence: Synthetic oligonucleotide
  Target: ATXN1; (-) strand; PAM type: YTN; PAM sequence: TTT
tcagtaaagcacctagacaa

SEQ ID NO: 224103 - DNA, 20 bp, Artificial Sequence
  Description of Artificial Sequence: Synthetic oligonucleotide
  Target: ATXN1; (-) strand; PAM type: YTN; PAM sequence: TTT
ttcagtaaagcacctagaca

SEQ ID NO: 224104 - DNA, 20 bp, Artificial Sequence
  Description of Artificial Sequence: Synthetic oligonucleotide
  Target: ATXN1; (-) strand; PAM type: YTN; PAM sequence: TTT
tttcagtaaagcacctagac

SEQ ID NO: 224105 - DNA, 20 bp, Artificial Sequence
  Description of Artificial Sequence: Synthetic oligonucleotide
  Target: ATXN1; (-) strand; PAM type: YTN; PAM sequence: TTT
ttttcagtaaagcacctaga

SEQ ID NO: 224106 - DNA, 20 bp, Artificial Sequence
  Description of Artificial Sequence: Synthetic oligonucleotide
  Target: ATXN1; (-) strand; PAM type: YTN; PAM sequence: CTT
tttttcagtaaagcacctag

SEQ ID NO: 224107 - DNA, 20 bp, Artificial Sequence
  Description of Artificial Sequence: Synthetic oligonucleotide
  Target: ATXN1; (-) strand; PAM type: YTN; PAM sequence: TTC
catgctttttttcagtaaag

SEQ ID NO: 224108 - DNA, 20 bp, Artificial Sequence
  Description of Artificial Sequence: Synthetic oligonucleotide
  Target: ATXN1; (-) strand; PAM type: YTN; PAM sequence: TTT
ccatgctttttttcagtaaa

SEQ ID NO: 224109 - DNA, 20 bp, Artificial Sequence
  Description of Artificial Sequence: Synthetic oligonucleotide
  Target: ATXN1; (-) strand; PAM type: YTN; PAM sequence: CTA
tttccatgctttttttcagt

SEQ ID NO: 224110 - DNA, 20 bp, Artificial Sequence
  Description of Artificial Sequence: Synthetic oligonucleotide
  Target: ATXN1; (-) strand; PAM type: YTN; PAM sequence: CTC
caagtctatttccatgcttt

SEQ ID NO: 224111 - DNA, 20 bp, Artificial Sequence
  Description of Artificial Sequence: Synthetic oligonucleotide
  Target: ATXN1; (-) strand; PAM type: YTN; PAM sequence: CTA
tatatgtacatacacatgca

SEQ ID NO: 224112 - DNA, 20 bp, Artificial Sequence
  Description of Artificial Sequence: Synthetic oligonucleotide
  Target: ATXN1; (-) strand; PAM type: YTN; PAM sequence: TTC
atactatatatgtacataca

SEQ ID NO: 224113 - DNA, 20 bp, Artificial Sequence
  Description of Artificial Sequence: Synthetic oligonucleotide
  Target: ATXN1; (-) strand; PAM type: YTN; PAM sequence: CTG
catatacacgtacacatatg

SEQ ID NO: 224114 - DNA, 20 bp, Artificial Sequence
  Description of Artificial Sequence: Synthetic oligonucleotide
  Target: ATXN1; (-) strand; PAM type: YTN; PAM sequence: TTA
aatacatggacacacacaca

SEQ ID NO: 224115 - DNA, 20 bp, Artificial Sequence
  Description of Artificial Sequence: Synthetic oligonucleotide
  Target: ATXN1; (-) strand; PAM type: YTN; PAM sequence: TTT
aaatacatggacacacacac

SEQ ID NO: 224116 - DNA, 20 bp, Artificial Sequence
  Description of Artificial Sequence: Synthetic oligonucleotide
  Target: ATXN1; (-) strand; PAM type: YTN; PAM sequence: CTG
catataggaaaagcagtgtg

SEQ ID NO: 224117 - DNA, 20 bp, Artificial Sequence
  Description of Artificial Sequence: Synthetic oligonucleotide
  Target: ATXN1; (-) strand; PAM type: YTN; PAM sequence: CTG
ctgcatataggaaaagcagt

SEQ ID NO: 224118 - DNA, 20 bp, Artificial Sequence
  Description of Artificial Sequence: Synthetic oligonucleotide
  Target: ATXN1; (-) strand; PAM type: YTN; PAM sequence: TTC
ctgctgcatataggaaaagc

SEQ ID NO: 224119 - DNA, 20 bp, Artificial Sequence
  Description of Artificial Sequence: Synthetic oligonucleotide
  Target: ATXN1; (-) strand; PAM type: YTN; PAM sequence: TTC
atatgccagataggaaattc

SEQ ID NO: 224120 - DNA, 20 bp, Artificial Sequence
  Description of Artificial Sequence: Synthetic oligonucleotide
  Target: ATXN1; (-) strand; PAM type: YTN; PAM sequence: CTT
catatgccagataggaaatt

SEQ ID NO: 224121 - DNA, 20 bp, Artificial Sequence
  Description of Artificial Sequence: Synthetic oligonucleotide
  Target: ATXN1; (-) strand; PAM type: YTN; PAM sequence: TTG
tcttcatatgccagatagga

SEQ ID NO: 224122 - DNA, 20 bp, Artificial Sequence
  Description of Artificial Sequence: Synthetic oligonucleotide
  Target: ATXN1; (-) strand; PAM type: YTN; PAM sequence: CTC
catccaaaagagtatgtatt

SEQ ID NO: 224123 - DNA, 20 bp, Artificial Sequence
  Description of Artificial Sequence: Synthetic oligonucleotide
  Target: ATXN1; (-) strand; PAM type: YTN; PAM sequence: CTC
accagctccatccaaaagag

SEQ ID NO: 224124 - DNA, 20 bp, Artificial Sequence
  Description of Artificial Sequence: Synthetic oligonucleotide
  Target: ATXN1; (-) strand; PAM type: YTN; PAM sequence: CTG
actcaccagctccatccaaa

SEQ ID NO: 224125 - DNA, 20 bp, Artificial Sequence
  Description of Artificial Sequence: Synthetic oligonucleotide
  Target: ATXN1; (-) strand; PAM type: YTN; PAM sequence: CTG
cctgactcaccagctccatc

SEQ ID NO: 224126 - DNA, 20 bp, Artificial Sequence
  Description of Artificial Sequence: Synthetic oligonucleotide
  Target: ATXN1; (-) strand; PAM type: YTN; PAM sequence: TTC
caaaacactgcctgactcac

SEQ ID NO: 224127 - DNA, 20 bp, Artificial Sequence
  Description of Artificial Sequence: Synthetic oligonucleotide
  Target: ATXN1; (-) strand; PAM type: YTN; PAM sequence: TTG
cagttccaaaacactgcctg

SEQ ID NO: 224128 - DNA, 20 bp, Artificial Sequence
  Description of Artificial Sequence: Synthetic oligonucleotide
  Target: ATXN1; (-) strand; PAM type: YTN; PAM sequence: CTC
aagtattgcagttccaaaac

SEQ ID NO: 224129 - DNA, 20 bp, Artificial Sequence
  Description of Artificial Sequence: Synthetic oligonucleotide
  Target: ATXN1; (-) strand; PAM type: YTN; PAM sequence: CTC
atgagtcatgcagactcaag

SEQ ID NO: 224130 - DNA, 20 bp, Artificial Sequence
  Description of Artificial Sequence: Synthetic oligonucleotide
  Target: ATXN1; (-) strand; PAM type: YTN; PAM sequence: TTC
ctcatgagtcatgcagactc

SEQ ID NO: 224131 - DNA, 20 bp, Artificial Sequence
  Description of Artificial Sequence: Synthetic oligonucleotide
  Target: ATXN1; (-) strand; PAM type: YTN; PAM sequence: TTT
cctcatgagtcatgcagact

SEQ ID NO: 224132 - DNA, 20 bp, Artificial Sequence
  Description of Artificial Sequence: Synthetic oligonucleotide
  Target: ATXN1; (-) strand; PAM type: YTN; PAM sequence: CTT
tcctcatgagtcatgcagac

SEQ ID NO: 224133 - DNA, 20 bp, Artificial Sequence
  Description of Artificial Sequence: Synthetic oligonucleotide
  Target: ATXN1; (-) strand; PAM type: YTN; PAM sequence: TTG
ctttcctcatgagtcatgca

SEQ ID NO: 224134 - DNA, 20 bp, Artificial Sequence
  Description of Artificial Sequence: Synthetic oligonucleotide
  Target: ATXN1; (-) strand; PAM type: YTN; PAM sequence: CTT
gctttcctcatgagtcatgc

SEQ ID NO: 224135 - DNA, 20 bp, Artificial Sequence
  Description of Artificial Sequence: Synthetic oligonucleotide
  Target: ATXN1; (-) strand; PAM type: YTN; PAM sequence: TTG
atacaacagtcccagacccc

SEQ ID NO: 224136 - DNA, 20 bp, Artificial Sequence
  Description of Artificial Sequence: Synthetic oligonucleotide
  Target: ATXN1; (-) strand; PAM type: YTN; PAM sequence: TTT
gatacaacagtcccagaccc

SEQ ID NO: 224137 - DNA, 20 bp, Artificial Sequence
  Description of Artificial Sequence: Synthetic oligonucleotide
  Target: ATXN1; (-) strand; PAM type: YTN; PAM sequence: TTT
tgatacaacagtcccagacc

SEQ ID NO: 224138 - DNA, 20 bp, Artificial Sequence
  Description of Artificial Sequence: Synthetic oligonucleotide
  Target: ATXN1; (-) strand; PAM type: YTN; PAM sequence: TTC
ccattttgatacaacagtcc

SEQ ID NO: 224139 - DNA, 20 bp, Artificial Sequence
  Description of Artificial Sequence: Synthetic oligonucleotide
  Target: ATXN1; (-) strand; PAM type: YTN; PAM sequence: CTT
cccattttgatacaacagtc

SEQ ID NO: 224140 - DNA, 20 bp, Artificial Sequence
  Description of Artificial Sequence: Synthetic oligonucleotide
  Target: ATXN1; (-) strand; PAM type: YTN; PAM sequence: CTC
cttcccattttgatacaaca

SEQ ID NO: 224141 - DNA, 20 bp, Artificial Sequence
  Description of Artificial Sequence: Synthetic oligonucleotide
  Target: ATXN1; (-) strand; PAM type: YTN; PAM sequence: TTC
ccactccttcccattttgat

SEQ ID NO: 224142 - DNA, 20 bp, Artificial Sequence
  Description of Artificial Sequence: Synthetic oligonucleotide
  Target: ATXN1; (-) strand; PAM type: YTN; PAM sequence: TTT
cccactccttcccattttga

SEQ ID NO: 224143 - DNA, 20 bp, Artificial Sequence
  Description of Artificial Sequence: Synthetic oligonucleotide
  Target: ATXN1; (-) strand; PAM type: YTN; PAM sequence: CTT
tcccactccttcccattttg

SEQ ID NO: 224144 - DNA, 20 bp, Artificial Sequence
  Description of Artificial Sequence: Synthetic oligonucleotide
  Target: ATXN1; (-) strand; PAM type: YTN; PAM sequence: TTC
tttcccactccttcccattt

SEQ ID NO: 224145 - DNA, 20 bp, Artificial Sequence
  Description of Artificial Sequence: Synthetic oligonucleotide
  Target: ATXN1; (-) strand; PAM type: YTN; PAM sequence: CTT
ctttcccactccttcccatt

SEQ ID NO: 224146 - DNA, 20 bp, Artificial Sequence
  Description of Artificial Sequence: Synthetic oligonucleotide
  Target: ATXN1; (-) strand; PAM type: YTN; PAM sequence: TTA
taaaaagccatcttctttcc

SEQ ID NO: 224147 - DNA, 20 bp, Artificial Sequence
  Description of Artificial Sequence: Synthetic oligonucleotide
  Target: ATXN1; (-) strand; PAM type: YTN; PAM sequence: TTA
aattataaaaagccatcttc

SEQ ID NO: 224148 - DNA, 20 bp, Artificial Sequence
  Description of Artificial Sequence: Synthetic oligonucleotide
  Target: ATXN1; (-) strand; PAM type: YTN; PAM sequence: TTT
aaattataaaaagccatctt

SEQ ID NO: 224149 - DNA, 20 bp, Artificial Sequence
  Description of Artificial Sequence: Synthetic oligonucleotide
  Target: ATXN1; (-) strand; PAM type: YTN; PAM sequence: TTA
caacaatataaaaaataaaa

SEQ ID NO: 224150 - DNA, 20 bp, Artificial Sequence
  Description of Artificial Sequence: Synthetic oligonucleotide
  Target: ATXN1; (-) strand; PAM type: YTN; PAM sequence: CTT
acaacaatataaaaaataaa

SEQ ID NO: 224151 - DNA, 20 bp, Artificial Sequence
  Description of Artificial Sequence: Synthetic oligonucleotide
  Target: ATXN1; (-) strand; PAM type: YTN; PAM sequence: CTC
aaaagtaaaaacttacaaca

SEQ ID NO: 224152 - DNA, 20 bp, Artificial Sequence
  Description of Artificial Sequence: Synthetic oligonucleotide
  Target: ATXN1; (-) strand; PAM type: YTN; PAM sequence: CTG
tctcaaaagtaaaaacttac

SEQ ID NO: 224153 - DNA, 20 bp, Artificial Sequence
  Description of Artificial Sequence: Synthetic oligonucleotide
  Target: ATXN1; (-) strand; PAM type: YTN; PAM sequence: CTG
agcaagagagtgataccctg

SEQ ID NO: 224154 - DNA, 20 bp, Artificial Sequence
  Description of Artificial Sequence: Synthetic oligonucleotide
  Target: ATXN1; (-) strand; PAM type: YTN; PAM sequence: CTA
gcctgagcaagagagtgata

SEQ ID NO: 224155 - DNA, 20 bp, Artificial Sequence
  Description of Artificial Sequence: Synthetic oligonucleotide
  Target: ATXN1; (-) strand; PAM type: YTN; PAM sequence: CTC
tagcctgagcaagagagtga

SEQ ID NO: 224156 - DNA, 20 bp, Artificial Sequence
  Description of Artificial Sequence: Synthetic oligonucleotide
  Target: ATXN1; (-) strand; PAM type: YTN; PAM sequence: CTG
cgctctagcctgagcaagag

SEQ ID NO: 224157 - DNA, 20 bp, Artificial Sequence
  Description of Artificial Sequence: Synthetic oligonucleotide
  Target: ATXN1; (-) strand; PAM type: YTN; PAM sequence: CTA
tgatcatgccactgcgctct

SEQ ID NO: 224158 - DNA, 20 bp, Artificial Sequence
  Description of Artificial Sequence: Synthetic oligonucleotide
  Target: ATXN1; (-) strand; PAM type: YTN; PAM sequence: CTG
tagtgagctatgatcatgcc

SEQ ID NO: 224159 - DNA, 20 bp, Artificial Sequence
  Description of Artificial Sequence: Synthetic oligonucleotide
  Target: ATXN1; (-) strand; PAM type: YTN; PAM sequence: TTG
tggctgtagtgagctatgat

SEQ ID NO: 224160 - DNA, 20 bp, Artificial Sequence
  Description of Artificial Sequence: Synthetic oligonucleotide
  Target: ATXN1; (-) strand; PAM type: YTN; PAM sequence: TTT
gtggctgtagtgagctatga

SEQ ID NO: 224161 - DNA, 20 bp, Artificial Sequence
  Description of Artificial Sequence: Synthetic oligonucleotide
  Target: ATXN1; (-) strand; PAM type: YTN; PAM sequence: CTG
aggtgggaggatcccatggg

SEQ ID NO: 224162 - DNA, 20 bp, Artificial Sequence
  Description of Artificial Sequence: Synthetic oligonucleotide
  Target: ATXN1; (-) strand; PAM type: YTN; PAM sequence: CTC
gggagctgaggtgggaggat

SEQ ID NO: 224163 - DNA, 20 bp, Artificial Sequence
  Description of Artificial Sequence: Synthetic oligonucleotide
  Target: ATXN1; (-) strand; PAM type: YTN; PAM sequence: CTG
ctcgggagctgaggtgggag

SEQ ID NO: 224164 - DNA, 20 bp, Artificial Sequence
  Description of Artificial Sequence: Synthetic oligonucleotide
  Target: ATXN1; (-) strand; PAM type: YTN; PAM sequence: CTC
agctgctcgggagctgaggt

SEQ ID NO: 224165 - DNA, 20 bp, Artificial Sequence
  Description of Artificial Sequence: Synthetic oligonucleotide
  Target: ATXN1; (-) strand; PAM type: YTN; PAM sequence: CTG
tagtctcagctgctcgggag

SEQ ID NO: 224166 - DNA, 20 bp, Artificial Sequence
  Description of Artificial Sequence: Synthetic oligonucleotide
  Target: ATXN1; (-) strand; PAM type: YTN; PAM sequence: TTG
cctgtagtctcagctgctcg

SEQ ID NO: 224167 - DNA, 20 bp, Artificial Sequence
  Description of Artificial Sequence: Synthetic oligonucleotide
  Target: ATXN1; (-) strand; PAM type: YTN; PAM sequence: CTT
gcctgtagtctcagctgctc

SEQ ID NO: 224168 - DNA, 20 bp, Artificial Sequence
  Description of Artificial Sequence: Synthetic oligonucleotide
  Target: ATXN1; (-) strand; PAM type: YTN; PAM sequence: CTC
ttgcctgtagtctcagctgc

SEQ ID NO: 224169 - DNA, 20 bp, Artificial Sequence
  Description of Artificial Sequence: Synthetic oligonucleotide
  Target: ATXN1; (-) strand; PAM type: YTN; PAM sequence: CTG
ggtgtggtggctcttgcctg

SEQ ID NO: 224170 - DNA, 20 bp, Artificial Sequence
  Description of Artificial Sequence: Synthetic oligonucleotide
  Target: ATXN1; (-) strand; PAM type: YTN; PAM sequence: TTG
actgggtgtggtggctcttg

SEQ ID NO: 224171 - DNA, 20 bp, Artificial Sequence
  Description of Artificial Sequence: Synthetic oligonucleotide
  Target: ATXN1; (-) strand; PAM type: YTN; PAM sequence: CTA
caaaaaaaaaaaaaagaaaa

SEQ ID NO: 224172 - DNA, 20 bp, Artificial Sequence
  Description of Artificial Sequence: Synthetic oligonucleotide
  Target: ATXN1; (-) strand; PAM type: YTN; PAM sequence: CTC
tacaaaaaaaaaaaaaagaa

SEQ ID NO: 224173 - DNA, 20 bp, Artificial Sequence
  Description of Artificial Sequence: Synthetic oligonucleotide
  Target: ATXN1; (-) strand; PAM type: YTN; PAM sequence: CTC
catctctacaaaaaaaaaaa

SEQ ID NO: 224174 - DNA, 20 bp, Artificial Sequence
  Description of Artificial Sequence: Synthetic oligonucleotide
  Target: ATXN1; (-) strand; PAM type: YTN; PAM sequence: TTG
ggcaacatagggagactcca

SEQ ID NO: 224175 - DNA, 20 bp, Artificial Sequence
  Description of Artificial Sequence: Synthetic oligonucleotide
  Target: ATXN1; (-) strand; PAM type: YTN; PAM sequence: CTT
gggcaacatagggagactcc

SEQ ID NO: 224176 - DNA, 20 bp, Artificial Sequence
  Description of Artificial Sequence: Synthetic oligonucleotide
  Target: ATXN1; (-) strand; PAM type: YTN; PAM sequence: TTG
acagcagcttgggcaacata

SEQ ID NO: 224177 - DNA, 20 bp, Artificial Sequence
  Description of Artificial Sequence: Synthetic oligonucleotide
  Target: ATXN1; (-) strand; PAM type: YTN; PAM sequence: TTT
gacagcagcttgggcaacat

SEQ ID NO: 224178 - DNA, 20 bp, Artificial Sequence
  Description of Artificial Sequence: Synthetic oligonucleotide
  Target: ATXN1; (-) strand; PAM type: YTN; PAM sequence: TTG
agcccaggagtttgacagca

SEQ ID NO: 224179 - DNA, 20 bp, Artificial Sequence
  Description of Artificial Sequence: Synthetic oligonucleotide
  Target: ATXN1; (-) strand; PAM type: YTN; PAM sequence: CTT
gagcccaggagtttgacagc

SEQ ID NO: 224180 - DNA, 20 bp, Artificial Sequence
  Description of Artificial Sequence: Synthetic oligonucleotide
  Target: ATXN1; (-) strand; PAM type: YTN; PAM sequence: CTA
ggccaaggtgggaggatccc

SEQ ID NO: 224181 - DNA, 20 bp, Artificial Sequence
  Description of Artificial Sequence: Synthetic oligonucleotide
  Target: ATXN1; (-) strand; PAM type: YTN; PAM sequence: TTA
aaaatacaaatctaggccaa

SEQ ID NO: 224182 - DNA, 20 bp, Artificial Sequence
  Description of Artificial Sequence: Synthetic oligonucleotide
  Target: ATXN1; (-) strand; PAM type: YTN; PAM sequence: TTG
tcaattaaaaatacaaatct

SEQ ID NO: 224183 - DNA, 20 bp, Artificial Sequence
  Description of Artificial Sequence: Synthetic oligonucleotide
  Target: ATXN1; (-) strand; PAM type: YTN; PAM sequence: TTT
gtcaattaaaaatacaaatc

SEQ ID NO: 224184 - DNA, 20 bp, Artificial Sequence
  Description of Artificial Sequence: Synthetic oligonucleotide
  Target: ATXN1; (-) strand; PAM type: YTN; PAM sequence: TTA
tttgtcaattaaaaatacaa

SEQ ID NO: 224185 - DNA, 20 bp, Artificial Sequence
  Description of Artificial Sequence: Synthetic oligonucleotide
  Target: ATXN1; (-) strand; PAM type: YTN; PAM sequence: TTA
ttatttgtcaattaaaaata

SEQ ID NO: 224186 - DNA, 20 bp, Artificial Sequence
  Description of Artificial Sequence: Synthetic oligonucleotide
  Target: ATXN1; (-) strand; PAM type: YTN; PAM sequence: CTA
catgcaattattatttgtca

SEQ ID NO: 224187 - DNA, 20 bp, Artificial Sequence
  Description of Artificial Sequence: Synthetic oligonucleotide
  Target: ATXN1; (-) strand; PAM type: YTN; PAM sequence: TTA
taacccataactacatgcaa

SEQ ID NO: 224188 - DNA, 20 bp, Artificial Sequence
  Description of Artificial Sequence: Synthetic oligonucleotide
  Target: ATXN1; (-) strand; PAM type: YTN; PAM sequence: CTA
tatcaaaacatcacattata

SEQ ID NO: 224189 - DNA, 20 bp, Artificial Sequence
  Description of Artificial Sequence: Synthetic oligonucleotide
  Target: ATXN1; (-) strand; PAM type: YTN; PAM sequence: TTA
tagtatatgtagctatatca

SEQ ID NO: 224190 - DNA, 20 bp, Artificial Sequence
  Description of Artificial Sequence: Synthetic oligonucleotide
  Target: ATXN1; (-) strand; PAM type: YTN; PAM sequence: TTT
atagtatatgtagctatatc

SEQ ID NO: 224191 - DNA, 20 bp, Artificial Sequence
  Description of Artificial Sequence: Synthetic oligonucleotide
  Target: ATXN1; (-) strand; PAM type: YTN; PAM sequence: TTT
tatagtatatgtagctatat

SEQ ID NO: 224192 - DNA, 20 bp, Artificial Sequence
  Description of Artificial Sequence: Synthetic oligonucleotide
  Target: ATXN1; (-) strand; PAM type: YTN; PAM sequence: TTA
atataatcattttatagtat

SEQ ID NO: 224193 - DNA, 20 bp, Artificial Sequence
  Description of Artificial Sequence: Synthetic oligonucleotide
  Target: ATXN1; (-) strand; PAM type: YTN; PAM sequence: CTT
aatataatcattttatagta

SEQ ID NO: 224194 - DNA, 20 bp, Artificial Sequence
  Description of Artificial Sequence: Synthetic oligonucleotide
  Target: ATXN1; (-) strand; PAM type: YTN; PAM sequence: TTA
atcagcttaatataatcatt

SEQ ID NO: 224195 - DNA, 20 bp, Artificial Sequence
  Description of Artificial Sequence: Synthetic oligonucleotide
  Target: ATXN1; (-) strand; PAM type: YTN; PAM sequence: TTA
taaaaaataagtatgtgagg

SEQ ID NO: 224196 - DNA, 20 bp, Artificial Sequence
  Description of Artificial Sequence: Synthetic oligonucleotide
  Target: ATXN1; (-) strand; PAM type: YTN; PAM sequence: TTC
attataaaaaataagtatgt

SEQ ID NO: 224197 - DNA, 20 bp, Artificial Sequence
  Description of Artificial Sequence: Synthetic oligonucleotide
  Target: ATXN1; (-) strand; PAM type: YTN; PAM sequence: CTT
cattataaaaaataagtatg

SEQ ID NO: 224198 - DNA, 20 bp, Artificial Sequence
  Description of Artificial Sequence: Synthetic oligonucleotide
  Target: ATXN1; (-) strand; PAM type: YTN; PAM sequence: TTA
aatgtcttcattataaaaaa

SEQ ID NO: 224199 - DNA, 20 bp, Artificial Sequence
  Description of Artificial Sequence: Synthetic oligonucleotide
  Target: ATXN1; (-) strand; PAM type: YTN; PAM sequence: TTT
aaatgtcttcattataaaaa

SEQ ID NO: 224200 - DNA, 20 bp, Artificial Sequence
  Description of Artificial Sequence: Synthetic oligonucleotide
  Target: ATXN1; (-) strand; PAM type: YTN; PAM sequence: TTT
taaatgtcttcattataaaa

SEQ ID NO: 224201 - DNA, 20 bp, Artificial Sequence
  Description of Artificial Sequence: Synthetic oligonucleotide
  Target: ATXN1; (-) strand; PAM type: YTN; PAM sequence: TTT
ttaaatgtcttcattataaa

SEQ ID NO: 224202 - DNA, 20 bp, Artificial Sequence
  Description of Artificial Sequence: Synthetic oligonucleotide
  Target: ATXN1; (-) strand; PAM type: YTN; PAM sequence: CTA
aaagaatacgtttttaaatg

SEQ ID NO: 224203 - DNA, 20 bp, Artificial Sequence
  Description of Artificial Sequence: Synthetic oligonucleotide
  Target: ATXN1; (-) strand; PAM type: YTN; PAM sequence: TTG
ctaaaagaatacgtttttaa

SEQ ID NO: 224204 - DNA, 20 bp, Artificial Sequence
  Description of Artificial Sequence: Synthetic oligonucleotide
  Target: ATXN1; (-) strand; PAM type: YTN; PAM sequence: TTA
taaatgtcaagattgctaaa

SEQ ID NO: 224205 - DNA, 20 bp, Artificial Sequence
  Description of Artificial Sequence: Synthetic oligonucleotide
  Target: ATXN1; (-) strand; PAM type: YTN; PAM sequence: CTC
ataataaggtattataaatg

SEQ ID NO: 224206 - DNA, 20 bp, Artificial Sequence
  Description of Artificial Sequence: Synthetic oligonucleotide
  Target: ATXN1; (-) strand; PAM type: YTN; PAM sequence: TTA
gccctcataataaggtatta

SEQ ID NO: 224207 - DNA, 20 bp, Artificial Sequence
  Description of Artificial Sequence: Synthetic oligonucleotide
  Target: ATXN1; (-) strand; PAM type: YTN; PAM sequence: TTT
agccctcataataaggtatt

SEQ ID NO: 224208 - DNA, 20 bp, Artificial Sequence
  Description of Artificial Sequence: Synthetic oligonucleotide
  Target: ATXN1; (-) strand; PAM type: YTN; PAM sequence: TTT
tagccctcataataaggtat

SEQ ID NO: 224209 - DNA, 20 bp, Artificial Sequence
  Description of Artificial Sequence: Synthetic oligonucleotide
  Target: ATXN1; (-) strand; PAM type: YTN; PAM sequence: TTT
ttagccctcataataaggta

SEQ ID NO: 224210 - DNA, 20 bp, Artificial Sequence
  Description of Artificial Sequence: Synthetic oligonucleotide
  Target: ATXN1; (-) strand; PAM type: YTN; PAM sequence: TTC
atttttagccctcataataa

SEQ ID NO: 224211 - DNA, 20 bp, Artificial Sequence
  Description of Artificial Sequence: Synthetic oligonucleotide
  Target: ATXN1; (-) strand; PAM type: YTN; PAM sequence: TTA
ttcatttttagccctcataa

SEQ ID NO: 224212 - DNA, 20 bp, Artificial Sequence
  Description of Artificial Sequence: Synthetic oligonucleotide
  Target: ATXN1; (-) strand; PAM type: YTN; PAM sequence: TTA
atattattcatttttagccc

SEQ ID NO: 224213 - DNA, 20 bp, Artificial Sequence
  Description of Artificial Sequence: Synthetic oligonucleotide
  Target: ATXN1; (-) strand; PAM type: YTN; PAM sequence: TTA
ttaatattattcatttttag

SEQ ID NO: 224214 - DNA, 20 bp, Artificial Sequence
  Description of Artificial Sequence: Synthetic oligonucleotide
  Target: ATXN1; (-) strand; PAM type: YTN; PAM sequence: TTG
tacaggattattaatattat

SEQ ID NO: 224215 - DNA, 20 bp, Artificial Sequence
  Description of Artificial Sequence: Synthetic oligonucleotide
  Target: ATXN1; (-) strand; PAM type: YTN; PAM sequence: CTG
agacccattgtacaggatta

SEQ ID NO: 224216 - DNA, 20 bp, Artificial Sequence
  Description of Artificial Sequence: Synthetic oligonucleotide
  Target: ATXN1; (-) strand; PAM type: YTN; PAM sequence: TTC
tgagacccattgtacaggat

SEQ ID NO: 224217 - DNA, 20 bp, Artificial Sequence
  Description of Artificial Sequence: Synthetic oligonucleotide
  Target: ATXN1; (-) strand; PAM type: YTN; PAM sequence: TTT
ctgagacccattgtacagga

SEQ ID NO: 224218 - DNA, 20 bp, Artificial Sequence
  Description of Artificial Sequence: Synthetic oligonucleotide
  Target: ATXN1; (-) strand; PAM type: YTN; PAM sequence: CTA
agtttctgagacccattgta

SEQ ID NO: 224219 - DNA, 20 bp, Artificial Sequence
  Description of Artificial Sequence: Synthetic oligonucleotide
  Target: ATXN1; (-) strand; PAM type: YTN; PAM sequence: TTA
gacaagagggctaagtttct

SEQ ID NO: 224220 - DNA, 20 bp, Artificial Sequence
  Description of Artificial Sequence: Synthetic oligonucleotide
  Target: ATXN1; (-) strand; PAM type: YTN; PAM sequence: TTC
agttagacaagagggctaag

SEQ ID NO: 224221 - DNA, 20 bp, Artificial Sequence
  Description of Artificial Sequence: Synthetic oligonucleotide
  Target: ATXN1; (-) strand; PAM type: YTN; PAM sequence: TTT
cagttagacaagagggctaa

SEQ ID NO: 224222 - DNA, 20 bp, Artificial Sequence
  Description of Artificial Sequence: Synthetic oligonucleotide
  Target: ATXN1; (-) strand; PAM type: YTN; PAM sequence: TTG
atcaaacggtacagacgttt

SEQ ID NO: 224223 - DNA, 20 bp, Artificial Sequence
  Description of Artificial Sequence: Synthetic oligonucleotide
  Target: ATXN1; (-) strand; PAM type: YTN; PAM sequence: TTG
gttgatcaaacggtacagac

SEQ ID NO: 224224 - DNA, 20 bp, Artificial Sequence
  Description of Artificial Sequence: Synthetic oligonucleotide
  Target: ATXN1; (-) strand; PAM type: YTN; PAM sequence: TTT
ggttgatcaaacggtacaga

SEQ ID NO: 224225 - DNA, 20 bp, Artificial Sequence
  Description of Artificial Sequence: Synthetic oligonucleotide
  Target: ATXN1; (-) strand; PAM type: YTN; PAM sequence: CTT
tggttgatcaaacggtacag

SEQ ID NO: 224226 - DNA, 20 bp, Artificial Sequence
  Description of Artificial Sequence: Synthetic oligonucleotide
  Target: ATXN1; (-) strand; PAM type: YTN; PAM sequence: TTG
ccaacaaaagccatctttgg

SEQ ID NO: 224227 - DNA, 20 bp, Artificial Sequence
  Description of Artificial Sequence: Synthetic oligonucleotide
  Target: ATXN1; (-) strand; PAM type: YTN; PAM sequence: TTG
aattgccaacaaaagccatc

SEQ ID NO: 224228 - DNA, 20 bp, Artificial Sequence
  Description of Artificial Sequence: Synthetic oligonucleotide
  Target: ATXN1; (-) strand; PAM type: YTN; PAM sequence: TTG
tcaaaaaaattgaattgcca

SEQ ID NO: 224229 - DNA, 20 bp, Artificial Sequence
  Description of Artificial Sequence: Synthetic oligonucleotide
  Target: ATXN1; (-) strand; PAM type: YTN; PAM sequence: TTT
gtcaaaaaaattgaattgcc

SEQ ID NO: 224230 - DNA, 20 bp, Artificial Sequence
  Description of Artificial Sequence: Synthetic oligonucleotide
  Target: ATXN1; (-) strand; PAM type: YTN; PAM sequence: CTC
caaatgaagacaaaaatgag

SEQ ID NO: 224231 - DNA, 20 bp, Artificial Sequence
  Description of Artificial Sequence: Synthetic oligonucleotide
  Target: ATXN1; (-) strand; PAM type: YTN; PAM sequence: TTG
taatggataaaaactccaaa

SEQ ID NO: 224232 - DNA, 20 bp, Artificial Sequence
  Description of Artificial Sequence: Synthetic oligonucleotide
  Target: ATXN1; (-) strand; PAM type: YTN; PAM sequence: CTT
gtaatggataaaaactccaa

SEQ ID NO: 224233 - DNA, 20 bp, Artificial Sequence
  Description of Artificial Sequence: Synthetic oligonucleotide
  Target: ATXN1; (-) strand; PAM type: YTN; PAM sequence: CTC
ttgtaatggataaaaactcc

SEQ ID NO: 224234 - DNA, 20 bp, Artificial Sequence
  Description of Artificial Sequence: Synthetic oligonucleotide
  Target: ATXN1; (-) strand; PAM type: YTN; PAM sequence: CTC
tcttgtaatggataaaaact

SEQ ID NO: 224235 - DNA, 20 bp, Artificial Sequence
  Description of Artificial Sequence: Synthetic oligonucleotide
  Target: ATXN1; (-) strand; PAM type: YTN; PAM sequence: TTC
ctctcttgtaatggataaaa

SEQ ID NO: 224236 - DNA, 20 bp, Artificial Sequence
  Description of Artificial Sequence: Synthetic oligonucleotide
  Target: ATXN1; (-) strand; PAM type: YTN; PAM sequence: CTT
cctctcttgtaatggataaa

SEQ ID NO: 224237 - DNA, 20 bp, Artificial Sequence
  Description of Artificial Sequence: Synthetic oligonucleotide
  Target: ATXN1; (-) strand; PAM type: YTN; PAM sequence: TTG
tgtcatcttcctctcttgta

SEQ ID NO: 224238 - DNA, 20 bp, Artificial Sequence
  Description of Artificial Sequence: Synthetic oligonucleotide
  Target: ATXN1; (-) strand; PAM type: YTN; PAM sequence: CTT
gtgtcatcttcctctcttgt

SEQ ID NO: 224239 - DNA, 20 bp, Artificial Sequence
  Description of Artificial Sequence: Synthetic oligonucleotide
  Target: ATXN1; (-) strand; PAM type: YTN; PAM sequence: CTG
gcttgtgtcatcttcctctc

SEQ ID NO: 224240 - DNA, 20 bp, Artificial Sequence
  Description of Artificial Sequence: Synthetic oligonucleotide
  Target: ATXN1; (-) strand; PAM type: YTN; PAM sequence: TTC
tggcttgtgtcatcttcctc

SEQ ID NO: 224241 - DNA, 20 bp, Artificial Sequence
  Description of Artificial Sequence: Synthetic oligonucleotide
  Target: ATXN1; (-) strand; PAM type: YTN; PAM sequence: CTA
ttctggcttgtgtcatcttc

SEQ ID NO: 224242 - DNA, 20 bp, Artificial Sequence
  Description of Artificial Sequence: Synthetic oligonucleotide
  Target: ATXN1; (-) strand; PAM type: YTN; PAM sequence: CTC
tattctggcttgtgtcatct

SEQ ID NO: 224243 - DNA, 20 bp, Artificial Sequence
  Description of Artificial Sequence: Synthetic oligonucleotide
  Target: ATXN1; (-) strand; PAM type: YTN; PAM sequence: TTC
ctctattctggcttgtgtca

SEQ ID NO: 224244 - DNA, 20 bp, Artificial Sequence
  Description of Artificial Sequence: Synthetic oligonucleotide
  Target: ATXN1; (-) strand; PAM type: YTN; PAM sequence: CTT
cctctattctggcttgtgtc

SEQ ID NO: 224245 - DNA, 20 bp, Artificial Sequence
  Description of Artificial Sequence: Synthetic oligonucleotide
  Target: ATXN1; (-) strand; PAM type: YTN; PAM sequence: TTC
atcttcctctattctggctt

SEQ ID NO: 224246 - DNA, 20 bp, Artificial Sequence
  Description of Artificial Sequence: Synthetic oligonucleotide
  Target: ATXN1; (-) strand; PAM type: YTN; PAM sequence: TTT
catcttcctctattctggct

SEQ ID NO: 224247 - DNA, 20 bp, Artificial Sequence
  Description of Artificial Sequence: Synthetic oligonucleotide
  Target: ATXN1; (-) strand; PAM type: YTN; PAM sequence: TTG
tttcatcttcctctattctg

SEQ ID NO: 224248 - DNA, 20 bp, Artificial Sequence
  Description of Artificial Sequence: Synthetic oligonucleotide
  Target: ATXN1; (-) strand; PAM type: YTN; PAM sequence: TTT
gtttcatcttcctctattct

SEQ ID NO: 224249 - DNA, 20 bp, Artificial Sequence
  Description of Artificial Sequence: Synthetic oligonucleotide
  Target: ATXN1; (-) strand; PAM type: YTN; PAM sequence: CTG
agtggtttgtttcatcttcc

SEQ ID NO: 224250 - DNA, 20 bp, Artificial Sequence
  Description of Artificial Sequence: Synthetic oligonucleotide
  Target: ATXN1; (-) strand; PAM type: YTN; PAM sequence: TTC
agaatcctgagtggtttgtt

SEQ ID NO: 224251 - DNA, 20 bp, Artificial Sequence
  Description of Artificial Sequence: Synthetic oligonucleotide
  Target: ATXN1; (-) strand; PAM type: YTN; PAM sequence: CTT
cagaatcctgagtggtttgt

SEQ ID NO: 224252 - DNA, 20 bp, Artificial Sequence
  Description of Artificial Sequence: Synthetic oligonucleotide
  Target: ATXN1; (-) strand; PAM type: YTN; PAM sequence: TTC
ccttcagaatcctgagtggt

SEQ ID NO: 224253 - DNA, 20 bp, Artificial Sequence
  Description of Artificial Sequence: Synthetic oligonucleotide
  Target: ATXN1; (-) strand; PAM type: YTN; PAM sequence: TTA
aaaaaaacccaacccagtgt

SEQ ID NO: 224254 - DNA, 20 bp, Artificial Sequence
  Description of Artificial Sequence: Synthetic oligonucleotide
  Target: ATXN1; (-) strand; PAM type: YTN; PAM sequence: TTA
aaattaaaaaaaacccaacc

SEQ ID NO: 224255 - DNA, 20 bp, Artificial Sequence
  Description of Artificial Sequence: Synthetic oligonucleotide
  Target: ATXN1; (-) strand; PAM type: YTN; PAM sequence: CTA
agacaaataataaacatcaa

SEQ ID NO: 224256 - DNA, 20 bp, Artificial Sequence
  Description of Artificial Sequence: Synthetic oligonucleotide
  Target: ATXN1; (-) strand; PAM type: YTN; PAM sequence: CTC
taagacaaataataaacatc

SEQ ID NO: 224257 - DNA, 20 bp, Artificial Sequence
  Description of Artificial Sequence: Synthetic oligonucleotide
  Target: ATXN1; (-) strand; PAM type: YTN; PAM sequence: TTG
ggcaacatagtgagaccccg

SEQ ID NO: 224258 - DNA, 20 bp, Artificial Sequence
  Description of Artificial Sequence: Synthetic oligonucleotide
  Target: ATXN1; (-) strand; PAM type: YTN; PAM sequence: CTT
gggcaacatagtgagacccc

SEQ ID NO: 224259 - DNA, 20 bp, Artificial Sequence
  Description of Artificial Sequence: Synthetic oligonucleotide
  Target: ATXN1; (-) strand; PAM type: YTN; PAM sequence: TTC
aaggccaacttgggcaacat

SEQ ID NO: 224260 - DNA, 20 bp, Artificial Sequence
  Description of Artificial Sequence: Synthetic oligonucleotide
  Target: ATXN1; (-) strand; PAM type: YTN; PAM sequence: TTG
agcagaggagttcaaggcca

SEQ ID NO: 224261 - DNA, 20 bp, Artificial Sequence
  Description of Artificial Sequence: Synthetic oligonucleotide
  Target: ATXN1; (-) strand; PAM type: YTN; PAM sequence: CTT
gagcagaggagttcaaggcc

SEQ ID NO: 224262 - DNA, 20 bp, Artificial Sequence
  Description of Artificial Sequence: Synthetic oligonucleotide
  Target: ATXN1; (-) strand; PAM type: YTN; PAM sequence: CTC
atgcagtcccagccaaaggg

SEQ ID NO: 224263 - DNA, 20 bp, Artificial Sequence
  Description of Artificial Sequence: Synthetic oligonucleotide
  Target: ATXN1; (-) strand; PAM type: YTN; PAM sequence: CTG
atgcagtggtgtgctcatgc

SEQ ID NO: 224264 - DNA, 20 bp, Artificial Sequence
  Description of Artificial Sequence: Synthetic oligonucleotide
  Target: ATXN1; (-) strand; PAM type: YTN; PAM sequence: CTG
gatgagcctgatgcagtggt

SEQ ID NO: 224265 - DNA, 20 bp, Artificial Sequence
  Description of Artificial Sequence: Synthetic oligonucleotide
  Target: ATXN1; (-) strand; PAM type: YTN; PAM sequence: CTC
aactggatgagcctgatgca

SEQ ID NO: 224266 - DNA, 20 bp, Artificial Sequence
  Description of Artificial Sequence: Synthetic oligonucleotide
  Target: ATXN1; (-) strand; PAM type: YTN; PAM sequence: TTA
aaaaacctcaactggatgag

SEQ ID NO: 224267 - DNA, 20 bp, Artificial Sequence
  Description of Artificial Sequence: Synthetic oligonucleotide
  Target: ATXN1; (-) strand; PAM type: YTN; PAM sequence: TTT
aaaaaacctcaactggatga

SEQ ID NO: 224268 - DNA, 20 bp, Artificial Sequence
  Description of Artificial Sequence: Synthetic oligonucleotide
  Target: ATXN1; (-) strand; PAM type: YTN; PAM sequence: TTT
taaaaaacctcaactggatg

SEQ ID NO: 224269 - DNA, 20 bp, Artificial Sequence
  Description of Artificial Sequence: Synthetic oligonucleotide
  Target: ATXN1; (-) strand; PAM type: YTN; PAM sequence: CTA
cccaatcagagcaaaaacag

SEQ ID NO: 224270 - DNA, 20 bp, Artificial Sequence
  Description of Artificial Sequence: Synthetic oligonucleotide
  Target: ATXN1; (-) strand; PAM type: YTN; PAM sequence: TTG
aggctacccaatcagagcaa

SEQ ID NO: 224271 - DNA, 20 bp, Artificial Sequence
  Description of Artificial Sequence: Synthetic oligonucleotide
  Target: ATXN1; (-) strand; PAM type: YTN; PAM sequence: TTT
gaggctacccaatcagagca

SEQ ID NO: 224272 - DNA, 20 bp, Artificial Sequence
  Description of Artificial Sequence: Synthetic oligonucleotide
  Target: ATXN1; (-) strand; PAM type: YTN; PAM sequence: CTT
tgaggctacccaatcagagc

SEQ ID NO: 224273 - DNA, 20 bp, Artificial Sequence
  Description of Artificial Sequence: Synthetic oligonucleotide
  Target: ATXN1; (-) strand; PAM type: YTN; PAM sequence: CTC
tttgaggctacccaatcaga

SEQ ID NO: 224274 - DNA, 20 bp, Artificial Sequence
  Description of Artificial Sequence: Synthetic oligonucleotide
  Target: ATXN1; (-) strand; PAM type: YTN; PAM sequence: CTC
ctctttgaggctacccaatc

SEQ ID NO: 224275 - DNA, 20 bp, Artificial Sequence
  Description of Artificial Sequence: Synthetic oligonucleotide
  Target: ATXN1; (-) strand; PAM type: YTN; PAM sequence: TTC
ctcctctttgaggctaccca

SEQ ID NO: 224276 - DNA, 20 bp, Artificial Sequence
  Description of Artificial Sequence: Synthetic oligonucleotide
  Target: ATXN1; (-) strand; PAM type: YTN; PAM sequence: CTT
cctcctctttgaggctaccc

SEQ ID NO: 224277 - DNA, 20 bp, Artificial Sequence
  Description of Artificial Sequence: Synthetic oligonucleotide
  Target: ATXN1; (-) strand; PAM type: YTN; PAM sequence: CTC
ttcctcctctttgaggctac

SEQ ID NO: 224278 - DNA, 20 bp, Artificial Sequence
  Description of Artificial Sequence: Synthetic oligonucleotide
  Target: ATXN1; (-) strand; PAM type: YTN; PAM sequence: CTC
tcttcctcctctttgaggct

SEQ ID NO: 224279 - DNA, 20 bp, Artificial Sequence
  Description of Artificial Sequence: Synthetic oligonucleotide
  Target: ATXN1; (-) strand; PAM type: YTN; PAM sequence: CTC
atcatgactctcttcctcct

SEQ ID NO: 224280 - DNA, 20 bp, Artificial Sequence
  Description of Artificial Sequence: Synthetic oligonucleotide
  Target: ATXN1; (-) strand; PAM type: YTN; PAM sequence: CTG
aatcaagctcatcatgactc

SEQ ID NO: 224281 - DNA, 20 bp, Artificial Sequence
  Description of Artificial Sequence: Synthetic oligonucleotide
  Target: ATXN1; (-) strand; PAM type: YTN; PAM sequence: TTC
tgaatcaagctcatcatgac

SEQ ID NO: 224282 - DNA, 20 bp, Artificial Sequence
  Description of Artificial Sequence: Synthetic oligonucleotide
  Target: ATXN1; (-) strand; PAM type: YTN; PAM sequence: CTG
aagattctgaatcaagctca

SEQ ID NO: 224283 - DNA, 20 bp, Artificial Sequence
  Description of Artificial Sequence: Synthetic oligonucleotide
  Target: ATXN1; (-) strand; PAM type: YTN; PAM sequence: CTG
atagagtggagagctgaaga

SEQ ID NO: 224284 - DNA, 20 bp, Artificial Sequence
  Description of Artificial Sequence: Synthetic oligonucleotide
  Target: ATXN1; (-) strand; PAM type: YTN; PAM sequence: TTG
ctgatagagtggagagctga

SEQ ID NO: 224285 - DNA, 20 bp, Artificial Sequence
  Description of Artificial Sequence: Synthetic oligonucleotide
  Target: ATXN1; (-) strand; PAM type: YTN; PAM sequence: TTG
aaggaaggcaggttgctgat

SEQ ID NO: 224286 - DNA, 20 bp, Artificial Sequence
  Description of Artificial Sequence: Synthetic oligonucleotide
  Target: ATXN1; (-) strand; PAM type: YTN; PAM sequence: CTT
gaaggaaggcaggttgctga

SEQ ID NO: 224287 - DNA, 20 bp, Artificial Sequence
  Description of Artificial Sequence: Synthetic oligonucleotide
  Target: ATXN1; (-) strand; PAM type: YTN; PAM sequence: CTG
ggccaagtagacttgaagga

SEQ ID NO: 224288 - DNA, 20 bp, Artificial Sequence
  Description of Artificial Sequence: Synthetic oligonucleotide
  Target: ATXN1; (-) strand; PAM type: YTN; PAM sequence: TTG
ccagtggaggaggaataaca

SEQ ID NO: 224289 - DNA, 20 bp, Artificial Sequence
  Description of Artificial Sequence: Synthetic oligonucleotide
  Target: ATXN1; (-) strand; PAM type: YTN; PAM sequence: CTA
gttgccagtggaggaggaat

SEQ ID NO: 224290 - DNA, 20 bp, Artificial Sequence
  Description of Artificial Sequence: Synthetic oligonucleotide
  Target: ATXN1; (-) strand; PAM type: YTN; PAM sequence: CTC
acacatctagttgccagtgg

SEQ ID NO: 224291 - DNA, 20 bp, Artificial Sequence
  Description of Artificial Sequence: Synthetic oligonucleotide
  Target: ATXN1; (-) strand; PAM type: YTN; PAM sequence: CTG
gtaataggaatcaatgtcac

SEQ ID NO: 224292 - DNA, 20 bp, Artificial Sequence
  Description of Artificial Sequence: Synthetic oligonucleotide
  Target: ATXN1; (-) strand; PAM type: YTN; PAM sequence: CTC
tggtaataggaatcaatgtc

SEQ ID NO: 224293 - DNA, 20 bp, Artificial Sequence
  Description of Artificial Sequence: Synthetic oligonucleotide
  Target: ATXN1; (-) strand; PAM type: YTN; PAM sequence: TTA
atccctctggtaataggaat

SEQ ID NO: 224294 - DNA, 20 bp, Artificial Sequence
  Description of Artificial Sequence: Synthetic oligonucleotide
  Target: ATXN1; (-) strand; PAM type: YTN; PAM sequence: TTG
gagttaatccctctggtaat

SEQ ID NO: 224295 - DNA, 20 bp, Artificial Sequence
  Description of Artificial Sequence: Synthetic oligonucleotide
  Target: ATXN1; (-) strand; PAM type: YTN; PAM sequence: TTT
ggagttaatccctctggtaa

SEQ ID NO: 224296 - DNA, 20 bp, Artificial Sequence
  Description of Artificial Sequence: Synthetic oligonucleotide
  Target: ATXN1; (-) strand; PAM type: YTN; PAM sequence: CTT
tggagttaatccctctggta

SEQ ID NO: 224297 - DNA, 20 bp, Artificial Sequence
  Description of Artificial Sequence: Synthetic oligonucleotide
  Target: ATXN1; (-) strand; PAM type: YTN; PAM sequence: TTC
aagagaactttggagttaat

SEQ ID NO: 224298 - DNA, 20 bp, Artificial Sequence
  Description of Artificial Sequence: Synthetic oligonucleotide
  Target: ATXN1; (-) strand; PAM type: YTN; PAM sequence: CTT
caagagaactttggagttaa

SEQ ID NO: 224299 - DNA, 20 bp, Artificial Sequence
  Description of Artificial Sequence: Synthetic oligonucleotide
  Target: ATXN1; (-) strand; PAM type: YTN; PAM sequence: CTG
taaaaccttcaagagaactt

SEQ ID NO: 224300 - DNA, 20 bp, Artificial Sequence
  Description of Artificial Sequence: Synthetic oligonucleotide
  Target: ATXN1; (-) strand; PAM type: YTN; PAM sequence: CTG
gaaaagaactgtaaaacctt

SEQ ID NO: 224301 - DNA, 20 bp, Artificial Sequence
  Description of Artificial Sequence: Synthetic oligonucleotide
  Target: ATXN1; (-) strand; PAM type: YTN; PAM sequence: CTG
ctggaaaagaactgtaaaac

SEQ ID NO: 224302 - DNA, 20 bp, Artificial Sequence
  Description of Artificial Sequence: Synthetic oligonucleotide
  Target: ATXN1; (-) strand; PAM type: YTN; PAM sequence: TTG
aagaatgaggaactgctgga

SEQ ID NO: 224303 - DNA, 20 bp, Artificial Sequence
  Description of Artificial Sequence: Synthetic oligonucleotide
  Target: ATXN1; (-) strand; PAM type: YTN; PAM sequence: TTT
gaagaatgaggaactgctgg

SEQ ID NO: 224304 - DNA, 20 bp, Artificial Sequence
  Description of Artificial Sequence: Synthetic oligonucleotide
  Target: ATXN1; (-) strand; PAM type: YTN; PAM sequence: CTT
tgaagaatgaggaactgctg

SEQ ID NO: 224305 - DNA, 20 bp, Artificial Sequence
  Description of Artificial Sequence: Synthetic oligonucleotide
  Target: ATXN1; (-) strand; PAM type: YTN; PAM sequence: TTA
cctttgaagaatgaggaact

SEQ ID NO: 224306 - DNA, 20 bp, Artificial Sequence
  Description of Artificial Sequence: Synthetic oligonucleotide
  Target: ATXN1; (-) strand; PAM type: YTN; PAM sequence: TTA
attacctttgaagaatgagg

SEQ ID NO: 224307 - DNA, 20 bp, Artificial Sequence
  Description of Artificial Sequence: Synthetic oligonucleotide
  Target: ATXN1; (-) strand; PAM type: YTN; PAM sequence: CTG
taagcccatcaagaggttaa

SEQ ID NO: 224308 - DNA, 20 bp, Artificial Sequence
  Description of Artificial Sequence: Synthetic oligonucleotide
  Target: ATXN1; (-) strand; PAM type: YTN; PAM sequence: CTG
ctgtaagcccatcaagaggt

SEQ ID NO: 224309 - DNA, 20 bp, Artificial Sequence
  Description of Artificial Sequence: Synthetic oligonucleotide
  Target: ATXN1; (-) strand; PAM type: YTN; PAM sequence: TTC
tgctgtaagcccatcaagag

SEQ ID NO: 224310 - DNA, 20 bp, Artificial Sequence
  Description of Artificial Sequence: Synthetic oligonucleotide
  Target: ATXN1; (-) strand; PAM type: YTN; PAM sequence: CTT
ctgctgtaagcccatcaaga

SEQ ID NO: 224311 - DNA, 20 bp, Artificial Sequence
  Description of Artificial Sequence: Synthetic oligonucleotide
  Target: ATXN1; (-) strand; PAM type: YTN; PAM sequence: CTG
cttctgctgtaagcccatca

SEQ ID NO: 224312 - DNA, 20 bp, Artificial Sequence
  Description of Artificial Sequence: Synthetic oligonucleotide
  Target: ATXN1; (-) strand; PAM type: YTN; PAM sequence: CTA
acactgcttctgctgtaagc

SEQ ID NO: 224313 - DNA, 20 bp, Artificial Sequence
  Description of Artificial Sequence: Synthetic oligonucleotide
  Target: ATXN1; (-) strand; PAM type: YTN; PAM sequence: TTC
taacactgcttctgctgtaa

SEQ ID NO: 224314 - DNA, 20 bp, Artificial Sequence
  Description of Artificial Sequence: Synthetic oligonucleotide
  Target: ATXN1; (-) strand; PAM type: YTN; PAM sequence: CTT
ctaacactgcttctgctgta

SEQ ID NO: 224315 - DNA, 20 bp, Artificial Sequence
  Description of Artificial Sequence: Synthetic oligonucleotide
  Target: ATXN1; (-) strand; PAM type: YTN; PAM sequence: TTG
ggacttctaacactgcttct

SEQ ID NO: 224316 - DNA, 20 bp, Artificial Sequence
  Description of Artificial Sequence: Synthetic oligonucleotide
  Target: ATXN1; (-) strand; PAM type: YTN; PAM sequence: TTA
taacatatcatcaatgtgtt

SEQ ID NO: 224317 - DNA, 20 bp, Artificial Sequence
  Description of Artificial Sequence: Synthetic oligonucleotide
  Target: ATXN1; (-) strand; PAM type: YTN; PAM sequence: TTT
ataacatatcatcaatgtgt

SEQ ID NO: 224318 - DNA, 20 bp, Artificial Sequence
  Description of Artificial Sequence: Synthetic oligonucleotide
  Target: ATXN1; (-) strand; PAM type: YTN; PAM sequence: CTG
gtttataacatatcatcaat

SEQ ID NO: 224319 - DNA, 20 bp, Artificial Sequence
  Description of Artificial Sequence: Synthetic oligonucleotide
  Target: ATXN1; (-) strand; PAM type: YTN; PAM sequence: CTC
ccctggtttataacatatca

SEQ ID NO: 224320 - DNA, 20 bp, Artificial Sequence
  Description of Artificial Sequence: Synthetic oligonucleotide
  Target: ATXN1; (-) strand; PAM type: YTN; PAM sequence: CTC
tcccctggtttataacatat

SEQ ID NO: 224321 - DNA, 20 bp, Artificial Sequence
  Description of Artificial Sequence: Synthetic oligonucleotide
  Target: ATXN1; (-) strand; PAM type: YTN; PAM sequence: TTA
tcctctcccctggtttataa

SEQ ID NO: 224322 - DNA, 20 bp, Artificial Sequence
  Description of Artificial Sequence: Synthetic oligonucleotide
  Target: ATXN1; (-) strand; PAM type: YTN; PAM sequence: TTC
caattatcctctcccctggt

SEQ ID NO: 224323 - DNA, 20 bp, Artificial Sequence
  Description of Artificial Sequence: Synthetic oligonucleotide
  Target: ATXN1; (-) strand; PAM type: YTN; PAM sequence: TTT
ccaattatcctctcccctgg

SEQ ID NO: 224324 - DNA, 20 bp, Artificial Sequence
  Description of Artificial Sequence: Synthetic oligonucleotide
  Target: ATXN1; (-) strand; PAM type: YTN; PAM sequence: TTT
tccaattatcctctcccctg

SEQ ID NO: 224325 - DNA, 20 bp, Artificial Sequence
  Description of Artificial Sequence: Synthetic oligonucleotide
  Target: ATXN1; (-) strand; PAM type: YTN; PAM sequence: CTG
gaaatacattttccaattat

SEQ ID NO: 224326 - DNA, 20 bp, Artificial Sequence
  Description of Artificial Sequence: Synthetic oligonucleotide
  Target: ATXN1; (-) strand; PAM type: YTN; PAM sequence: TTC
caatgaggctggaaatacat

SEQ ID NO: 224327 - DNA, 20 bp, Artificial Sequence
  Description of Artificial Sequence: Synthetic oligonucleotide
  Target: ATXN1; (-) strand; PAM type: YTN; PAM sequence: TTT
ccaatgaggctggaaataca

SEQ ID NO: 224328 - DNA, 20 bp, Artificial Sequence
  Description of Artificial Sequence: Synthetic oligonucleotide
  Target: ATXN1; (-) strand; PAM type: YTN; PAM sequence: TTT
tccaatgaggctggaaatac

SEQ ID NO: 224329 - DNA, 20 bp, Artificial Sequence
  Description of Artificial Sequence: Synthetic oligonucleotide
  Target: ATXN1; (-) strand; PAM type: YTN; PAM sequence: CTC
aataaatggaaatatatttt

SEQ ID NO: 224330 - DNA, 20 bp, Artificial Sequence
  Description of Artificial Sequence: Synthetic oligonucleotide
  Target: ATXN1; (-) strand; PAM type: YTN; PAM sequence: TTC
tcaataaatggaaatatatt

SEQ ID NO: 224331 - DNA, 20 bp, Artificial Sequence
  Description of Artificial Sequence: Synthetic oligonucleotide
  Target: ATXN1; (-) strand; PAM type: YTN; PAM sequence: TTT
ctcaataaatggaaatatat

SEQ ID NO: 224332 - DNA, 20 bp, Artificial Sequence
  Description of Artificial Sequence: Synthetic oligonucleotide
  Target: ATXN1; (-) strand; PAM type: YTN; PAM sequence: TTT
tctcaataaatggaaatata

SEQ ID NO: 224333 - DNA, 20 bp, Artificial Sequence
  Description of Artificial Sequence: Synthetic oligonucleotide
  Target: ATXN1; (-) strand; PAM type: YTN; PAM sequence: TTT
ttctcaataaatggaaatat

SEQ ID NO: 224334 - DNA, 20 bp, Artificial Sequence
  Description of Artificial Sequence: Synthetic oligonucleotide
  Target: ATXN1; (-) strand; PAM type: YTN; PAM sequence: CTT
tttctcaataaatggaaata

SEQ ID NO: 224335 - DNA, 20 bp, Artificial Sequence
  Description of Artificial Sequence: Synthetic oligonucleotide
  Target: ATXN1; (-) strand; PAM type: YTN; PAM sequence: TTA
ctttttctcaataaatggaa

SEQ ID NO: 224336 - DNA, 20 bp, Artificial Sequence
  Description of Artificial Sequence: Synthetic oligonucleotide
  Target: ATXN1; (-) strand; PAM type: YTN; PAM sequence: TTG
agttactttttctcaataaa

SEQ ID NO: 224337 - DNA, 20 bp, Artificial Sequence
  Description of Artificial Sequence: Synthetic oligonucleotide
  Target: ATXN1; (-) strand; PAM type: YTN; PAM sequence: CTT
gagttactttttctcaataa

SEQ ID NO: 224338 - DNA, 20 bp, Artificial Sequence
  Description of Artificial Sequence: Synthetic oligonucleotide
  Target: ATXN1; (-) strand; PAM type: YTN; PAM sequence: CTA
aacacttgagttactttttc

SEQ ID NO: 224339 - DNA, 20 bp, Artificial Sequence
  Description of Artificial Sequence: Synthetic oligonucleotide
  Target: ATXN1; (-) strand; PAM type: YTN; PAM sequence: TTC
ctaaacacttgagttacttt

SEQ ID NO: 224340 - DNA, 20 bp, Artificial Sequence
  Description of Artificial Sequence: Synthetic oligonucleotide
  Target: ATXN1; (-) strand; PAM type: YTN; PAM sequence: TTC
atatgttcctaaacacttga

SEQ ID NO: 224341 - DNA, 20 bp, Artificial Sequence
  Description of Artificial Sequence: Synthetic oligonucleotide
  Target: ATXN1; (-) strand; PAM type: YTN; PAM sequence: CTG
tgattcatatgttcctaaac

SEQ ID NO: 224342 - DNA, 20 bp, Artificial Sequence
  Description of Artificial Sequence: Synthetic oligonucleotide
  Target: ATXN1; (-) strand; PAM type: YTN; PAM sequence: TTC
tgtgattcatatgttcctaa

SEQ ID NO: 224343 - DNA, 20 bp, Artificial Sequence
  Description of Artificial Sequence: Synthetic oligonucleotide
  Target: ATXN1; (-) strand; PAM type: YTN; PAM sequence: CTA
caattctgtgattcatatgt

SEQ ID NO: 224344 - DNA, 20 bp, Artificial Sequence
  Description of Artificial Sequence: Synthetic oligonucleotide
  Target: ATXN1; (-) strand; PAM type: YTN; PAM sequence: CTG
ccaatctacaattctgtgat

SEQ ID NO: 224345 - DNA, 20 bp, Artificial Sequence
  Description of Artificial Sequence: Synthetic oligonucleotide
  Target: ATXN1; (-) strand; PAM type: YTN; PAM sequence: CTC
tgccaatctacaattctgtg

SEQ ID NO: 224346 - DNA, 20 bp, Artificial Sequence
  Description of Artificial Sequence: Synthetic oligonucleotide
  Target: ATXN1; (-) strand; PAM type: YTN; PAM sequence: CTA
aggcctctgccaatctacaa

SEQ ID NO: 224347 - DNA, 20 bp, Artificial Sequence
  Description of Artificial Sequence: Synthetic oligonucleotide
  Target: ATXN1; (-) strand; PAM type: YTN; PAM sequence: TTC
taaggcctctgccaatctac

SEQ ID NO: 224348 - DNA, 20 bp, Artificial Sequence
  Description of Artificial Sequence: Synthetic oligonucleotide
  Target: ATXN1; (-) strand; PAM type: YTN; PAM sequence: TTT
ctaaggcctctgccaatcta

SEQ ID NO: 224349 - DNA, 20 bp, Artificial Sequence
  Description of Artificial Sequence: Synthetic oligonucleotide
  Target: ATXN1; (-) strand; PAM type: YTN; PAM sequence: TTT
tctaaggcctctgccaatct

SEQ ID NO: 224350 - DNA, 20 bp, Artificial Sequence
  Description of Artificial Sequence: Synthetic oligonucleotide
  Target: ATXN1; (-) strand; PAM type: YTN; PAM sequence: TTA
gtagaagtcgaaatagcatg

SEQ ID NO: 224351 - DNA, 20 bp, Artificial Sequence
  Description of Artificial Sequence: Synthetic oligonucleotide
  Target: ATXN1; (-) strand; PAM type: YTN; PAM sequence: TTA
ttagtagaagtcgaaatagc

SEQ ID NO: 224352 - DNA, 20 bp, Artificial Sequence
  Description of Artificial Sequence: Synthetic oligonucleotide
  Target: ATXN1; (-) strand; PAM type: YTN; PAM sequence: CTC
attattagtagaagtcgaaa

SEQ ID NO: 224353 - DNA, 20 bp, Artificial Sequence
  Description of Artificial Sequence: Synthetic oligonucleotide
  Target: ATXN1; (-) strand; PAM type: YTN; PAM sequence: TTC
tcattattagtagaagtcga

SEQ ID NO: 224354 - DNA, 20 bp, Artificial Sequence
  Description of Artificial Sequence: Synthetic oligonucleotide
  Target: ATXN1; (-) strand; PAM type: YTN; PAM sequence: TTT
ctcattattagtagaagtcg

SEQ ID NO: 224355 - DNA, 20 bp, Artificial Sequence
  Description of Artificial Sequence: Synthetic oligonucleotide
  Target: ATXN1; (-) strand; PAM type: YTN; PAM sequence: TTT
tctcattattagtagaagtc

SEQ ID NO: 224356 - DNA, 20 bp, Artificial Sequence
  Description of Artificial Sequence: Synthetic oligonucleotide
  Target: ATXN1; (-) strand; PAM type: YTN; PAM sequence: CTC
cgttttctcattattagtag

SEQ ID NO: 224357 - DNA, 20 bp, Artificial Sequence
  Description of Artificial Sequence: Synthetic oligonucleotide
  Target: ATXN1; (-) strand; PAM type: YTN; PAM sequence: TTC
cacctccgttttctcattat

SEQ ID NO: 224358 - DNA, 20 bp, Artificial Sequence
  Description of Artificial Sequence: Synthetic oligonucleotide
  Target: ATXN1; (-) strand; PAM type: YTN; PAM sequence: TTT
ccacctccgttttctcatta

SEQ ID NO: 224359 - DNA, 20 bp, Artificial Sequence
  Description of Artificial Sequence: Synthetic oligonucleotide
  Target: ATXN1; (-) strand; PAM type: YTN; PAM sequence: CTT
tccacctccgttttctcatt

SEQ ID NO: 224360 - DNA, 20 bp, Artificial Sequence
  Description of Artificial Sequence: Synthetic oligonucleotide
  Target: ATXN1; (-) strand; PAM type: YTN; PAM sequence: CTC
tttccacctccgttttctca

SEQ ID NO: 224361 - DNA, 20 bp, Artificial Sequence
  Description of Artificial Sequence: Synthetic oligonucleotide
  Target: ATXN1; (-) strand; PAM type: YTN; PAM sequence: CTC
cctctttccacctccgtttt

SEQ ID NO: 224362 - DNA, 20 bp, Artificial Sequence
  Description of Artificial Sequence: Synthetic oligonucleotide
  Target: ATXN1; (-) strand; PAM type: YTN; PAM sequence: CTC
tccctctttccacctccgtt

SEQ ID NO: 224363 - DNA, 20 bp, Artificial Sequence
  Description of Artificial Sequence: Synthetic oligonucleotide
  Target: ATXN1; (-) strand; PAM type: YTN; PAM sequence: CTC
ggcaggtcactctccctctt

SEQ ID NO: 224364 - DNA, 20 bp, Artificial Sequence
  Description of Artificial Sequence: Synthetic oligonucleotide
  Target: ATXN1; (-) strand; PAM type: YTN; PAM sequence: CTG
tggctcggcaggtcactctc

SEQ ID NO: 224365 - DNA, 20 bp, Artificial Sequence
  Description of Artificial Sequence: Synthetic oligonucleotide
  Target: ATXN1; (-) strand; PAM type: YTN; PAM sequence: TTG
ggtaactgtggctcggcagg

SEQ ID NO: 224366 - DNA, 20 bp, Artificial Sequence
  Description of Artificial Sequence: Synthetic oligonucleotide
  Target: ATXN1; (-) strand; PAM type: YTN; PAM sequence: CTG
gttgggtaactgtggctcgg

SEQ ID NO: 224367 - DNA, 20 bp, Artificial Sequence
  Description of Artificial Sequence: Synthetic oligonucleotide
  Target: ATXN1; (-) strand; PAM type: YTN; PAM sequence: TTG
gtgctggttgggtaactgtg

SEQ ID NO: 224368 - DNA, 20 bp, Artificial Sequence
  Description of Artificial Sequence: Synthetic oligonucleotide
  Target: ATXN1; (-) strand; PAM type: YTN; PAM sequence: CTA
cattggtgctggttgggtaa

SEQ ID NO: 224369 - DNA, 20 bp, Artificial Sequence
  Description of Artificial Sequence: Synthetic oligonucleotide
  Target: ATXN1; (-) strand; PAM type: YTN; PAM sequence: CTG
actacattggtgctggttgg

SEQ ID NO: 224370 - DNA, 20 bp, Artificial Sequence
  Description of Artificial Sequence: Synthetic oligonucleotide
  Target: ATXN1; (-) strand; PAM type: YTN; PAM sequence: CTC
caggcagcactgactacatt

SEQ ID NO: 224371 - DNA, 20 bp, Artificial Sequence
  Description of Artificial Sequence: Synthetic oligonucleotide
  Target: ATXN1; (-) strand; PAM type: YTN; PAM sequence: CTC
gctccaggcagcactgacta

SEQ ID NO: 224372 - DNA, 20 bp, Artificial Sequence
  Description of Artificial Sequence: Synthetic oligonucleotide
  Target: ATXN1; (-) strand; PAM type: YTN; PAM sequence: CTG
ccccacagtatggtcaggtc

SEQ ID NO: 224373 - DNA, 20 bp, Artificial Sequence
  Description of Artificial Sequence: Synthetic oligonucleotide
  Target: ATXN1; (-) strand; PAM type: YTN; PAM sequence: TTC
tgccccacagtatggtcagg

SEQ ID NO: 224374 - DNA, 20 bp, Artificial Sequence
  Description of Artificial Sequence: Synthetic oligonucleotide
  Target: ATXN1; (-) strand; PAM type: YTN; PAM sequence: TTG
gaggggagattctgccccac

SEQ ID NO: 224375 - DNA, 20 bp, Artificial Sequence
  Description of Artificial Sequence: Synthetic oligonucleotide
  Target: ATXN1; (-) strand; PAM type: YTN; PAM sequence: TTA
tgaaggggattggaggggag

SEQ ID NO: 224376 - DNA, 20 bp, Artificial Sequence
  Description of Artificial Sequence: Synthetic oligonucleotide
  Target: ATXN1; (-) strand; PAM type: YTN; PAM sequence: TTT
atgaaggggattggagggga

SEQ ID NO: 224377 - DNA, 20 bp, Artificial Sequence
  Description of Artificial Sequence: Synthetic oligonucleotide
  Target: ATXN1; (-) strand; PAM type: YTN; PAM sequence: CTT
tatgaaggggattggagggg

SEQ ID NO: 224378 - DNA, 20 bp, Artificial Sequence
  Description of Artificial Sequence: Synthetic oligonucleotide
  Target: ATXN1; (-) strand; PAM type: YTN; PAM sequence: TTG
aacagcatcatcgtgcttta

SEQ ID NO: 224379 - DNA, 20 bp, Artificial Sequence
  Description of Artificial Sequence: Synthetic oligonucleotide
  Target: ATXN1; (-) strand; PAM type: YTN; PAM sequence: TTT
gaacagcatcatcgtgcttt

SEQ ID NO: 224380 - DNA, 20 bp, Artificial Sequence
  Description of Artificial Sequence: Synthetic oligonucleotide
  Target: ATXN1; (-) strand; PAM type: YTN; PAM sequence: TTG
tgtttgaacagcatcatcgt

SEQ ID NO: 224381 - DNA, 20 bp, Artificial Sequence
  Description of Artificial Sequence: Synthetic oligonucleotide
  Target: ATXN1; (-) strand; PAM type: YTN; PAM sequence: CTA
aggacaggaggcacaggttg

SEQ ID NO: 224382 - DNA, 20 bp, Artificial Sequence
  Description of Artificial Sequence: Synthetic oligonucleotide
  Target: ATXN1; (-) strand; PAM type: YTN; PAM sequence: CTC
taaggacaggaggcacaggt

SEQ ID NO: 224383 - DNA, 20 bp, Artificial Sequence
  Description of Artificial Sequence: Synthetic oligonucleotide
  Target: ATXN1; (-) strand; PAM type: YTN; PAM sequence: CTG
gggctctaaggacaggaggc

SEQ ID NO: 224384 - DNA, 20 bp, Artificial Sequence
  Description of Artificial Sequence: Synthetic oligonucleotide
  Target: ATXN1; (-) strand; PAM type: YTN; PAM sequence: CTA
aaatgaaatctggggctcta

SEQ ID NO: 224385 - DNA, 20 bp, Artificial Sequence
  Description of Artificial Sequence: Synthetic oligonucleotide
  Target: ATXN1; (-) strand; PAM type: YTN; PAM sequence: CTC
ctaaaatgaaatctggggct

SEQ ID NO: 224386 - DNA, 20 bp, Artificial Sequence
  Description of Artificial Sequence: Synthetic oligonucleotide
  Target: ATXN1; (-) strand; PAM type: YTN; PAM sequence: CTC
tcctaaaatgaaatctgggg

SEQ ID NO: 224387 - DNA, 20 bp, Artificial Sequence
  Description of Artificial Sequence: Synthetic oligonucleotide
  Target: ATXN1; (-) strand; PAM type: YTN; PAM sequence: TTC
gtaatcctctcctaaaatga

SEQ ID NO: 224388 - DNA, 20 bp, Artificial Sequence
  Description of Artificial Sequence: Synthetic oligonucleotide
  Target: ATXN1; (-) strand; PAM type: YTN; PAM sequence: TTT
cgtaatcctctcctaaaatg

SEQ ID NO: 224389 - DNA, 20 bp, Artificial Sequence
  Description of Artificial Sequence: Synthetic oligonucleotide
  Target: ATXN1; (-) strand; PAM type: YTN; PAM sequence: TTA
tttcgtaatcctctcctaaa

SEQ ID NO: 224390 - DNA, 20 bp, Artificial Sequence
  Description of Artificial Sequence: Synthetic oligonucleotide
  Target: ATXN1; (-) strand; PAM type: YTN; PAM sequence: TTA
gtcattatttcgtaatcctc

SEQ ID NO: 224391 - DNA, 20 bp, Artificial Sequence
  Description of Artificial Sequence: Synthetic oligonucleotide
  Target: ATXN1; (-) strand; PAM type: YTN; PAM sequence: CTT
agtcattatttcgtaatcct

SEQ ID NO: 224392 - DNA, 20 bp, Artificial Sequence
  Description of Artificial Sequence: Synthetic oligonucleotide
  Target: ATXN1; (-) strand; PAM type: YTN; PAM sequence: TTC
agagcttagtcattatttcg

SEQ ID NO: 224393 - DNA, 20 bp, Artificial Sequence
  Description of Artificial Sequence: Synthetic oligonucleotide
  Target: ATXN1; (-) strand; PAM type: YTN; PAM sequence: TTT
cagagcttagtcattatttc

SEQ ID NO: 224394 - DNA, 20 bp, Artificial Sequence
  Description of Artificial Sequence: Synthetic oligonucleotide
  Target: ATXN1; (-) strand; PAM type: YTN; PAM sequence: TTT
tcagagcttagtcattattt

SEQ ID NO: 224395 - DNA, 20 bp, Artificial Sequence
  Description of Artificial Sequence: Synthetic oligonucleotide
  Target: ATXN1; (-) strand; PAM type: YTN; PAM sequence: CTC
agttttcagagcttagtcat

SEQ ID NO: 224396 - DNA, 20 bp, Artificial Sequence
  Description of Artificial Sequence: Synthetic oligonucleotide
  Target: ATXN1; (-) strand; PAM type: YTN; PAM sequence: TTC
tcagttttcagagcttagtc

SEQ ID NO: 224397 - DNA, 20 bp, Artificial Sequence
  Description of Artificial Sequence: Synthetic oligonucleotide
  Target: ATXN1; (-) strand; PAM type: YTN; PAM sequence: CTC
attctcagttttcagagctt

SEQ ID NO: 224398 - DNA, 20 bp, Artificial Sequence
  Description of Artificial Sequence: Synthetic oligonucleotide
  Target: ATXN1; (-) strand; PAM type: YTN; PAM sequence: TTG
tctcattctcagttttcaga

SEQ ID NO: 224399 - DNA, 20 bp, Artificial Sequence
  Description of Artificial Sequence: Synthetic oligonucleotide
  Target: ATXN1; (-) strand; PAM type: YTN; PAM sequence: TTT
gtctcattctcagttttcag

SEQ ID NO: 224400 - DNA, 20 bp, Artificial Sequence
  Description of Artificial Sequence: Synthetic oligonucleotide
  Target: ATXN1; (-) strand; PAM type: YTN; PAM sequence: CTT
tgtctcattctcagttttca

SEQ ID NO: 224401 - DNA, 20 bp, Artificial Sequence
  Description of Artificial Sequence: Synthetic oligonucleotide
  Target: ATXN1; (-) strand; PAM type: YTN; PAM sequence: TTC
ctttgtctcattctcagttt

SEQ ID NO: 224402 - DNA, 20 bp, Artificial Sequence
  Description of Artificial Sequence: Synthetic oligonucleotide
  Target: ATXN1; (-) strand; PAM type: YTN; PAM sequence: CTT
cctttgtctcattctcagtt

SEQ ID NO: 224403 - DNA, 20 bp, Artificial Sequence
  Description of Artificial Sequence: Synthetic oligonucleotide
  Target: ATXN1; (-) strand; PAM type: YTN; PAM sequence: TTC
ttcctttgtctcattctcag

SEQ ID NO: 224404 - DNA, 20 bp, Artificial Sequence
  Description of Artificial Sequence: Synthetic oligonucleotide
  Target: ATXN1; (-) strand; PAM type: YTN; PAM sequence: TTT
cttcctttgtctcattctca

SEQ ID NO: 224405 - DNA, 20 bp, Artificial Sequence
  Description of Artificial Sequence: Synthetic oligonucleotide
  Target: ATXN1; (-) strand; PAM type: YTN; PAM sequence: CTT
tcttcctttgtctcattctc

SEQ ID NO: 224406 - DNA, 20 bp, Artificial Sequence
  Description of Artificial Sequence: Synthetic oligonucleotide
  Target: ATXN1; (-) strand; PAM type: YTN; PAM sequence: CTC
cctttcttcctttgtctcat

SEQ ID NO: 224407 - DNA, 20 bp, Artificial Sequence
  Description of Artificial Sequence: Synthetic oligonucleotide
  Target: ATXN1; (-) strand; PAM type: YTN; PAM sequence: TTA
tctccctttcttcctttgtc

SEQ ID NO: 224408 - DNA, 20 bp, Artificial Sequence
  Description of Artificial Sequence: Synthetic oligonucleotide
  Target: ATXN1; (-) strand; PAM type: YTN; PAM sequence: CTT
atctccctttcttcctttgt

SEQ ID NO: 224409 - DNA, 20 bp, Artificial Sequence
  Description of Artificial Sequence: Synthetic oligonucleotide
  Target: ATXN1; (-) strand; PAM type: YTN; PAM sequence: TTC
ttatctccctttcttccttt

SEQ ID NO: 224410 - DNA, 20 bp, Artificial Sequence
  Description of Artificial Sequence: Synthetic oligonucleotide
  Target: ATXN1; (-) strand; PAM type: YTN; PAM sequence: CTT
cttatctccctttcttcctt

SEQ ID NO: 224411 - DNA, 20 bp, Artificial Sequence
  Description of Artificial Sequence: Synthetic oligonucleotide
  Target: ATXN1; (-) strand; PAM type: YTN; PAM sequence: TTC
cttcttatctccctttcttc

SEQ ID NO: 224412 - DNA, 20 bp, Artificial Sequence
  Description of Artificial Sequence: Synthetic oligonucleotide
  Target: ATXN1; (-) strand; PAM type: YTN; PAM sequence: CTT
ccttcttatctccctttctt

SEQ ID NO: 224413 - DNA, 20 bp, Artificial Sequence
  Description of Artificial Sequence: Synthetic oligonucleotide
  Target: ATXN1; (-) strand; PAM type: YTN; PAM sequence: CTG
tcttccttcttatctccctt

SEQ ID NO: 224414 - DNA, 20 bp, Artificial Sequence
  Description of Artificial Sequence: Synthetic oligonucleotide
  Target: ATXN1; (-) strand; PAM type: YTN; PAM sequence: TTA
ctgtcttccttcttatctcc

SEQ ID NO: 224415 - DNA, 20 bp, Artificial Sequence
  Description of Artificial Sequence: Synthetic oligonucleotide
  Target: ATXN1; (-) strand; PAM type: YTN; PAM sequence: CTT
actgtcttccttcttatctc

SEQ ID NO: 224416 - DNA, 20 bp, Artificial Sequence
  Description of Artificial Sequence: Synthetic oligonucleotide
  Target: ATXN1; (-) strand; PAM type: YTN; PAM sequence: CTC
ttactgtcttccttcttatc

SEQ ID NO: 224417 - DNA, 20 bp, Artificial Sequence
  Description of Artificial Sequence: Synthetic oligonucleotide
  Target: ATXN1; (-) strand; PAM type: YTN; PAM sequence: CTC
tcttactgtcttccttctta

SEQ ID NO: 224418 - DNA, 20 bp, Artificial Sequence
  Description of Artificial Sequence: Synthetic oligonucleotide
  Target: ATXN1; (-) strand; PAM type: YTN; PAM sequence: TTG
actctcttactgtcttcctt

SEQ ID NO: 224419 - DNA, 20 bp, Artificial Sequence
  Description of Artificial Sequence: Synthetic oligonucleotide
  Target: ATXN1; (-) strand; PAM type: YTN; PAM sequence: TTG
ttgactctcttactgtcttc

SEQ ID NO: 224420 - DNA, 20 bp, Artificial Sequence
  Description of Artificial Sequence: Synthetic oligonucleotide
  Target: ATXN1; (-) strand; PAM type: YTN; PAM sequence: CTT
gttgactctcttactgtctt

SEQ ID NO: 224421 - DNA, 20 bp, Artificial Sequence
  Description of Artificial Sequence: Synthetic oligonucleotide
  Target: ATXN1; (-) strand; PAM type: YTN; PAM sequence: TTG
cttgttgactctcttactgt

SEQ ID NO: 224422 - DNA, 20 bp, Artificial Sequence
  Description of Artificial Sequence: Synthetic oligonucleotide
  Target: ATXN1; (-) strand; PAM type: YTN; PAM sequence: CTA
caataagttgcttgttgact

SEQ ID NO: 224423 - DNA, 20 bp, Artificial Sequence
  Description of Artificial Sequence: Synthetic oligonucleotide
  Target: ATXN1; (-) strand; PAM type: YTN; PAM sequence: TTG
caaacactacaataagttgc

SEQ ID NO: 224424 - DNA, 20 bp, Artificial Sequence
  Description of Artificial Sequence: Synthetic oligonucleotide
  Target: ATXN1; (-) strand; PAM type: YTN; PAM sequence: TTA
aatgtaatgaaaggcacaag

SEQ ID NO: 224425 - DNA, 20 bp, Artificial Sequence
  Description of Artificial Sequence: Synthetic oligonucleotide
  Target: ATXN1; (-) strand; PAM type: YTN; PAM sequence: TTT
aaatgtaatgaaaggcacaa

SEQ ID NO: 224426 - DNA, 20 bp, Artificial Sequence
  Description of Artificial Sequence: Synthetic oligonucleotide
  Target: ATXN1; (-) strand; PAM type: YTN; PAM sequence: TTC
gacatgcatttaaatgtaat

SEQ ID NO: 224427 - DNA, 20 bp, Artificial Sequence
  Description of Artificial Sequence: Synthetic oligonucleotide
  Target: ATXN1; (-) strand; PAM type: YTN; PAM sequence: TTT
cgacatgcatttaaatgtaa

SEQ ID NO: 224428 - DNA, 20 bp, Artificial Sequence
  Description of Artificial Sequence: Synthetic oligonucleotide
  Target: ATXN1; (-) strand; PAM type: YTN; PAM sequence: TTG
catcatgtcatttcgacatg

SEQ ID NO: 224429 - DNA, 20 bp, Artificial Sequence
  Description of Artificial Sequence: Synthetic oligonucleotide
  Target: ATXN1; (-) strand; PAM type: YTN; PAM sequence: CTG
cagaatgcatgaaggtggtt

SEQ ID NO: 224430 - DNA, 20 bp, Artificial Sequence
  Description of Artificial Sequence: Synthetic oligonucleotide
  Target: ATXN1; (-) strand; PAM type: YTN; PAM sequence: TTC
actgcagaatgcatgaaggt

SEQ ID NO: 224431 - DNA, 20 bp, Artificial Sequence
  Description of Artificial Sequence: Synthetic oligonucleotide
  Target: ATXN1; (-) strand; PAM type: YTN; PAM sequence: TTT
cactgcagaatgcatgaagg

SEQ ID NO: 224432 - DNA, 20 bp, Artificial Sequence
  Description of Artificial Sequence: Synthetic oligonucleotide
  Target: ATXN1; (-) strand; PAM type: YTN; PAM sequence: TTT
tcactgcagaatgcatgaag

SEQ ID NO: 224433 - DNA, 20 bp, Artificial Sequence
  Description of Artificial Sequence: Synthetic oligonucleotide
  Target: ATXN1; (-) strand; PAM type: YTN; PAM sequence: TTT
ttcactgcagaatgcatgaa

SEQ ID NO: 224434 - DNA, 20 bp, Artificial Sequence
  Description of Artificial Sequence: Synthetic oligonucleotide
  Target: ATXN1; (-) strand; PAM type: YTN; PAM sequence: CTT
tttcactgcagaatgcatga

SEQ ID NO: 224435 - DNA, 20 bp, Artificial Sequence
  Description of Artificial Sequence: Synthetic oligonucleotide
  Target: ATXN1; (-) strand; PAM type: YTN; PAM sequence: CTG
gcaccatctttttcactgca

SEQ ID NO: 224436 - DNA, 20 bp, Artificial Sequence
  Description of Artificial Sequence: Synthetic oligonucleotide
  Target: ATXN1; (-) strand; PAM type: YTN; PAM sequence: TTC
caacctggcaccatcttttt

SEQ ID NO: 224437 - DNA, 20 bp, Artificial Sequence
  Description of Artificial Sequence: Synthetic oligonucleotide
  Target: ATXN1; (-) strand; PAM type: YTN; PAM sequence: TTA
caatgaaattccaacctggc

SEQ ID NO: 224438 - DNA, 20 bp, Artificial Sequence
  Description of Artificial Sequence: Synthetic oligonucleotide
  Target: ATXN1; (-) strand; PAM type: YTN; PAM sequence: CTT
acaatgaaattccaacctgg

SEQ ID NO: 224439 - DNA, 20 bp, Artificial Sequence
  Description of Artificial Sequence: Synthetic oligonucleotide
  Target: ATXN1; (-) strand; PAM type: YTN; PAM sequence: CTG
cgacacttacaatgaaattc

SEQ ID NO: 224440 - DNA, 20 bp, Artificial Sequence
  Description of Artificial Sequence: Synthetic oligonucleotide
  Target: ATXN1; (-) strand; PAM type: YTN; PAM sequence: TTC
tgcgacacttacaatgaaat

SEQ ID NO: 224441 - DNA, 20 bp, Artificial Sequence
  Description of Artificial Sequence: Synthetic oligonucleotide
  Target: ATXN1; (-) strand; PAM type: YTN; PAM sequence: TTT
ctgcgacacttacaatgaaa

SEQ ID NO: 224442 - DNA, 20 bp, Artificial Sequence
  Description of Artificial Sequence: Synthetic oligonucleotide
  Target: ATXN1; (-) strand; PAM type: YTN; PAM sequence: TTC
caaagggatatttctgcgac

SEQ ID NO: 224443 - DNA, 20 bp, Artificial Sequence
  Description of Artificial Sequence: Synthetic oligonucleotide
  Target: ATXN1; (-) strand; PAM type: YTN; PAM sequence: CTG
attccaaagggatatttctg

SEQ ID NO: 224444 - DNA, 20 bp, Artificial Sequence
  Description of Artificial Sequence: Synthetic oligonucleotide
  Target: ATXN1; (-) strand; PAM type: YTN; PAM sequence: TTG
ggacctgattccaaagggat

SEQ ID NO: 224445 - DNA, 20 bp, Artificial Sequence
  Description of Artificial Sequence: Synthetic oligonucleotide
  Target: ATXN1; (-) strand; PAM type: YTN; PAM sequence: TTT
gggacctgattccaaaggga

SEQ ID NO: 224446 - DNA, 20 bp, Artificial Sequence
  Description of Artificial Sequence: Synthetic oligonucleotide
  Target: ATXN1; (-) strand; PAM type: YTN; PAM sequence: TTG
ccatgatacacgatgatgac

SEQ ID NO: 224447 - DNA, 20 bp, Artificial Sequence
  Description of Artificial Sequence: Synthetic oligonucleotide
  Target: ATXN1; (-) strand; PAM type: YTN; PAM sequence: TTT
gccatgatacacgatgatga

SEQ ID NO: 224448 - DNA, 20 bp, Artificial Sequence
  Description of Artificial Sequence: Synthetic oligonucleotide
  Target: ATXN1; (-) strand; PAM type: YTN; PAM sequence: CTT
tgccatgatacacgatgatg

SEQ ID NO: 224449 - DNA, 20 bp, Artificial Sequence
  Description of Artificial Sequence: Synthetic oligonucleotide
  Target: ATXN1; (-) strand; PAM type: YTN; PAM sequence: CTC
agggagctttgccatgatac

SEQ ID NO: 224450 - DNA, 20 bp, Artificial Sequence
  Description of Artificial Sequence: Synthetic oligonucleotide
  Target: ATXN1; (-) strand; PAM type: YTN; PAM sequence: CTC
ccctcagggagctttgccat

SEQ ID NO: 224451 - DNA, 20 bp, Artificial Sequence
  Description of Artificial Sequence: Synthetic oligonucleotide
  Target: ATXN1; (-) strand; PAM type: YTN; PAM sequence: CTC
ctcccctcagggagctttgc

SEQ ID NO: 224452 - DNA, 20 bp, Artificial Sequence
  Description of Artificial Sequence: Synthetic oligonucleotide
  Target: ATXN1; (-) strand; PAM type: YTN; PAM sequence: TTG
tcccatggatgccgtaggtg

SEQ ID NO: 224453 - DNA, 20 bp, Artificial Sequence
  Description of Artificial Sequence: Synthetic oligonucleotide
  Target: ATXN1; (-) strand; PAM type: YTN; PAM sequence: CTT
gtcccatggatgccgtaggt

SEQ ID NO: 224454 - DNA, 20 bp, Artificial Sequence
  Description of Artificial Sequence: Synthetic oligonucleotide
  Target: ATXN1; (-) strand; PAM type: YTN; PAM sequence: TTA
gcttgtcccatggatgccgt

SEQ ID NO: 224455 - DNA, 20 bp, Artificial Sequence
  Description of Artificial Sequence: Synthetic oligonucleotide
  Target: ATXN1; (-) strand; PAM type: YTN; PAM sequence: CTT
agcttgtcccatggatgccg

SEQ ID NO: 224456 - DNA, 20 bp, Artificial Sequence
  Description of Artificial Sequence: Synthetic oligonucleotide
  Target: ATXN1; (-) strand; PAM type: YTN; PAM sequence: TTA
cttagcttgtcccatggatg

SEQ ID NO: 224457 - DNA, 20 bp, Artificial Sequence
  Description of Artificial Sequence: Synthetic oligonucleotide
  Target: ATXN1; (-) strand; PAM type: YTN; PAM sequence: TTT
acttagcttgtcccatggat

SEQ ID NO: 224458 - DNA, 20 bp, Artificial Sequence
  Description of Artificial Sequence: Synthetic oligonucleotide
  Target: ATXN1; (-) strand; PAM type: YTN; PAM sequence: TTT
tacttagcttgtcccatgga

SEQ ID NO: 224459 - DNA, 20 bp, Artificial Sequence
  Description of Artificial Sequence: Synthetic oligonucleotide
  Target: ATXN1; (-) strand; PAM type: YTN; PAM sequence: TTC
agtaaattttacttagcttg

SEQ ID NO: 224460 - DNA, 20 bp, Artificial Sequence
  Description of Artificial Sequence: Synthetic oligonucleotide
  Target: ATXN1; (-) strand; PAM type: YTN; PAM sequence: TTT
cagtaaattttacttagctt

SEQ ID NO: 224461 - DNA, 20 bp, Artificial Sequence
  Description of Artificial Sequence: Synthetic oligonucleotide
  Target: ATXN1; (-) strand; PAM type: YTN; PAM sequence: CTT
tcagtaaattttacttagct

SEQ ID NO: 224462 - DNA, 20 bp, Artificial Sequence
  Description of Artificial Sequence: Synthetic oligonucleotide
  Target: ATXN1; (-) strand; PAM type: YTN; PAM sequence: TTC
agcctttcagtaaattttac

SEQ ID NO: 224463 - DNA, 20 bp, Artificial Sequence
  Description of Artificial Sequence: Synthetic oligonucleotide
  Target: ATXN1; (-) strand; PAM type: YTN; PAM sequence: TTA
ttcagcctttcagtaaattt

SEQ ID NO: 224464 - DNA, 20 bp, Artificial Sequence
  Description of Artificial Sequence: Synthetic oligonucleotide
  Target: ATXN1; (-) strand; PAM type: YTN; PAM sequence: TTT
attcagcctttcagtaaatt

SEQ ID NO: 224465 - DNA, 20 bp, Artificial Sequence
  Description of Artificial Sequence: Synthetic oligonucleotide
  Target: ATXN1; (-) strand; PAM type: YTN; PAM sequence: TTT
tattcagcctttcagtaaat

SEQ ID NO: 224466 - DNA, 20 bp, Artificial Sequence
  Description of Artificial Sequence: Synthetic oligonucleotide
  Target: ATXN1; (-) strand; PAM type: YTN; PAM sequence: TTT
ttattcagcctttcagtaaa

SEQ ID NO: 224467 - DNA, 20 bp, Artificial Sequence
  Description of Artificial Sequence: Synthetic oligonucleotide
  Target: ATXN1; (-) strand; PAM type: YTN; PAM sequence: TTC
catgtggaagtttttattca

SEQ ID NO: 224468 - DNA, 20 bp, Artificial Sequence
  Description of Artificial Sequence: Synthetic oligonucleotide
  Target: ATXN1; (-) strand; PAM type: YTN; PAM sequence: TTC
attccatgtggaagttttta

SEQ ID NO: 224469 - DNA, 20 bp, Artificial Sequence
  Description of Artificial Sequence: Synthetic oligonucleotide
  Target: ATXN1; (-) strand; PAM type: YTN; PAM sequence: CTT
cattccatgtggaagttttt

SEQ ID NO: 224470 - DNA, 20 bp, Artificial Sequence
  Description of Artificial Sequence: Synthetic oligonucleotide
  Target: ATXN1; (-) strand; PAM type: YTN; PAM sequence: TTC
ttcattccatgtggaagttt

SEQ ID NO: 224471 - DNA, 20 bp, Artificial Sequence
  Description of Artificial Sequence: Synthetic oligonucleotide
  Target: ATXN1; (-) strand; PAM type: YTN; PAM sequence: CTT
cttcattccatgtggaagtt

SEQ ID NO: 224472 - DNA, 20 bp, Artificial Sequence
  Description of Artificial Sequence: Synthetic oligonucleotide
  Target: ATXN1; (-) strand; PAM type: YTN; PAM sequence: TTC
ttcttcattccatgtggaag

SEQ ID NO: 224473 - DNA, 20 bp, Artificial Sequence
  Description of Artificial Sequence: Synthetic oligonucleotide
  Target: ATXN1; (-) strand; PAM type: YTN; PAM sequence: TTT
cttcttcattccatgtggaa

SEQ ID NO: 224474 - DNA, 20 bp, Artificial Sequence
  Description of Artificial Sequence: Synthetic oligonucleotide
  Target: ATXN1; (-) strand; PAM type: YTN; PAM sequence: CTA
tgcatatttcttcttcattc

SEQ ID NO: 224475 - DNA, 20 bp, Artificial Sequence
  Description of Artificial Sequence: Synthetic oligonucleotide
  Target: ATXN1; (-) strand; PAM type: YTN; PAM sequence: TTC
aaactatgcatatttcttct

SEQ ID NO: 224476 - DNA, 20 bp, Artificial Sequence
  Description of Artificial Sequence: Synthetic oligonucleotide
  Target: ATXN1; (-) strand; PAM type: YTN; PAM sequence: TTT
caaactatgcatatttcttc

SEQ ID NO: 224477 - DNA, 20 bp, Artificial Sequence
  Description of Artificial Sequence: Synthetic oligonucleotide
  Target: ATXN1; (-) strand; PAM type: YTN; PAM sequence: TTT
tcaaactatgcatatttctt

SEQ ID NO: 224478 - DNA, 20 bp, Artificial Sequence
  Description of Artificial Sequence: Synthetic oligonucleotide
  Target: ATXN1; (-) strand; PAM type: YTN; PAM sequence: CTG
catatgcattttcaaactat

SEQ ID NO: 224479 - DNA, 20 bp, Artificial Sequence
  Description of Artificial Sequence: Synthetic oligonucleotide
  Target: ATXN1; (-) strand; PAM type: YTN; PAM sequence: CTG
taatactgcatatgcatttt

SEQ ID NO: 224480 - DNA, 20 bp, Artificial Sequence
  Description of Artificial Sequence: Synthetic oligonucleotide
  Target: ATXN1; (-) strand; PAM type: YTN; PAM sequence: TTA
cagaaaactgtaatactgca

SEQ ID NO: 224481 - DNA, 20 bp, Artificial Sequence
  Description of Artificial Sequence: Synthetic oligonucleotide
  Target: ATXN1; (-) strand; PAM type: YTN; PAM sequence: TTT
acagaaaactgtaatactgc

SEQ ID NO: 224482 - DNA, 20 bp, Artificial Sequence
  Description of Artificial Sequence: Synthetic oligonucleotide
  Target: ATXN1; (-) strand; PAM type: YTN; PAM sequence: CTT
tacagaaaactgtaatactg

SEQ ID NO: 224483 - DNA, 20 bp, Artificial Sequence
  Description of Artificial Sequence: Synthetic oligonucleotide
  Target: ATXN1; (-) strand; PAM type: YTN; PAM sequence: TTC
ctttacagaaaactgtaata

SEQ ID NO: 224484 - DNA, 20 bp, Artificial Sequence
  Description of Artificial Sequence: Synthetic oligonucleotide
  Target: ATXN1; (-) strand; PAM type: YTN; PAM sequence: TTT
cctttacagaaaactgtaat

SEQ ID NO: 224485 - DNA, 20 bp, Artificial Sequence
  Description of Artificial Sequence: Synthetic oligonucleotide
  Target: ATXN1; (-) strand; PAM type: YTN; PAM sequence: TTT
tcctttacagaaaactgtaa

SEQ ID NO: 224486 - DNA, 20 bp, Artificial Sequence
  Description of Artificial Sequence: Synthetic oligonucleotide
  Target: ATXN1; (-) strand; PAM type: YTN; PAM sequence: TTC
attttcctttacagaaaact

SEQ ID NO: 224487 - DNA, 20 bp, Artificial Sequence
  Description of Artificial Sequence: Synthetic oligonucleotide
  Target: ATXN1; (-) strand; PAM type: YTN; PAM sequence: TTT
cattttcctttacagaaaac

SEQ ID NO: 224488 - DNA, 20 bp, Artificial Sequence
  Description of Artificial Sequence: Synthetic oligonucleotide
  Target: ATXN1; (-) strand; PAM type: YTN; PAM sequence: CTT
tcattttcctttacagaaaa

SEQ ID NO: 224489 - DNA, 20 bp, Artificial Sequence
  Description of Artificial Sequence: Synthetic oligonucleotide
  Target: ATXN1; (-) strand; PAM type: YTN; PAM sequence: TTC
tttcattttcctttacagaa

SEQ ID NO: 224490 - DNA, 20 bp, Artificial Sequence
  Description of Artificial Sequence: Synthetic oligonucleotide
  Target: ATXN1; (-) strand; PAM type: YTN; PAM sequence: CTT
ctttcattttcctttacaga

SEQ ID NO: 224491 - DNA, 20 bp, Artificial Sequence
  Description of Artificial Sequence: Synthetic oligonucleotide
  Target: ATXN1; (-) strand; PAM type: YTN; PAM sequence: TTA
aacaggtcttctttcatttt

SEQ ID NO: 224492 - DNA, 20 bp, Artificial Sequence
  Description of Artificial Sequence: Synthetic oligonucleotide
  Target: ATXN1; (-) strand; PAM type: YTN; PAM sequence: TTT
aaacaggtcttctttcattt

SEQ ID NO: 224493 - DNA, 20 bp, Artificial Sequence
  Description of Artificial Sequence: Synthetic oligonucleotide
  Target: ATXN1; (-) strand; PAM type: YTN; PAM sequence: TTT
taaacaggtcttctttcatt

SEQ ID NO: 224494 - DNA, 20 bp, Artificial Sequence
  Description of Artificial Sequence: Synthetic oligonucleotide
  Target: ATXN1; (-) strand; PAM type: YTN; PAM sequence: TTA
aattttaaacaggtcttctt

SEQ ID NO: 224495 - DNA, 20 bp, Artificial Sequence
  Description of Artificial Sequence: Synthetic oligonucleotide
  Target: ATXN1; (-) strand; PAM type: YTN; PAM sequence: TTT
aaattttaaacaggtcttct

SEQ ID NO: 224496 - DNA, 20 bp, Artificial Sequence
  Description of Artificial Sequence: Synthetic oligonucleotide
  Target: ATXN1; (-) strand; PAM type: YTN; PAM sequence: TTT
taaattttaaacaggtcttc

SEQ ID NO: 224497 - DNA, 20 bp, Artificial Sequence
  Description of Artificial Sequence: Synthetic oligonucleotide
  Target: ATXN1; (-) strand; PAM type: YTN; PAM sequence: TTA
atgtggttttaaattttaaa

SEQ ID NO: 224498 - DNA, 20 bp, Artificial Sequence
  Description of Artificial Sequence: Synthetic oligonucleotide
  Target: ATXN1; (-) strand; PAM type: YTN; PAM sequence: TTT
aatgtggttttaaattttaa

SEQ ID NO: 224499 - DNA, 20 bp, Artificial Sequence
  Description of Artificial Sequence: Synthetic oligonucleotide
  Target: ATXN1; (-) strand; PAM type: YTN; PAM sequence: TTT
taatgtggttttaaatttta

SEQ ID NO: 224500 - DNA, 20 bp, Artificial Sequence
  Description of Artificial Sequence: Synthetic oligonucleotide
  Target: ATXN1; (-) strand; PAM type: YTN; PAM sequence: CTT
ttaatgtggttttaaatttt

SEQ ID NO: 224501 - DNA, 20 bp, Artificial Sequence
  Description of Artificial Sequence: Synthetic oligonucleotide
  Target: ATXN1; (-) strand; PAM type: YTN; PAM sequence: CTC
aatcttttaatgtggtttta

SEQ ID NO: 224502 - DNA, 20 bp, Artificial Sequence
  Description of Artificial Sequence: Synthetic oligonucleotide
  Target: ATXN1; (-) strand; PAM type: YTN; PAM sequence: CTC
tcaatcttttaatgtggttt

SEQ ID NO: 224503 - DNA, 20 bp, Artificial Sequence
  Description of Artificial Sequence: Synthetic oligonucleotide
  Target: ATXN1; (-) strand; PAM type: YTN; PAM sequence: TTA
taaatacaaaaaactctcaa

SEQ ID NO: 224504 - DNA, 20 bp, Artificial Sequence
  Description of Artificial Sequence: Synthetic oligonucleotide
  Target: ATXN1; (-) strand; PAM type: YTN; PAM sequence: TTT
ataaatacaaaaaactctca

SEQ ID NO: 224505 - DNA, 20 bp, Artificial Sequence
  Description of Artificial Sequence: Synthetic oligonucleotide
  Target: ATXN1; (-) strand; PAM type: YTN; PAM sequence: TTT
tataaatacaaaaaactctc

SEQ ID NO: 224506 - DNA, 20 bp, Artificial Sequence
  Description of Artificial Sequence: Synthetic oligonucleotide
  Target: ATXN1; (-) strand; PAM type: YTN; PAM sequence: TTT
ttataaatacaaaaaactct

SEQ ID NO: 224507 - DNA, 20 bp, Artificial Sequence
  Description of Artificial Sequence: Synthetic oligonucleotide
  Target: ATXN1; (-) strand; PAM type: YTN; PAM sequence: CTT
tttataaatacaaaaaactc

SEQ ID NO: 224508 - DNA, 20 bp, Artificial Sequence
  Description of Artificial Sequence: Synthetic oligonucleotide
  Target: ATXN1; (-) strand; PAM type: YTN; PAM sequence: CTC
agctttttataaatacaaaa

SEQ ID NO: 224509 - DNA, 20 bp, Artificial Sequence
  Description of Artificial Sequence: Synthetic oligonucleotide
  Target: ATXN1; (-) strand; PAM type: YTN; PAM sequence: TTA
acatacctcagctttttata

SEQ ID NO: 224510 - DNA, 20 bp, Artificial Sequence
  Description of Artificial Sequence: Synthetic oligonucleotide
  Target: ATXN1; (-) strand; PAM type: YTN; PAM sequence: TTT
aacatacctcagctttttat

SEQ ID NO: 224511 - DNA, 20 bp, Artificial Sequence
  Description of Artificial Sequence: Synthetic oligonucleotide
  Target: ATXN1; (-) strand; PAM type: YTN; PAM sequence: TTT
taacatacctcagcttttta

SEQ ID NO: 224512 - DNA, 20 bp, Artificial Sequence
  Description of Artificial Sequence: Synthetic oligonucleotide
  Target: ATXN1; (-) strand; PAM type: YTN; PAM sequence: TTT
ttaacatacctcagcttttt

SEQ ID NO: 224513 - DNA, 20 bp, Artificial Sequence
  Description of Artificial Sequence: Synthetic oligonucleotide
  Target: ATXN1; (-) strand; PAM type: YTN; PAM sequence: TTC
catttttaacatacctcagc

SEQ ID NO: 224514 - DNA, 20 bp, Artificial Sequence
  Description of Artificial Sequence: Synthetic oligonucleotide
  Target: ATXN1; (-) strand; PAM type: YTN; PAM sequence: TTT
ccatttttaacatacctcag

SEQ ID NO: 224515 - DNA, 20 bp, Artificial Sequence
  Description of Artificial Sequence: Synthetic oligonucleotide
  Target: ATXN1; (-) strand; PAM type: YTN; PAM sequence: CTT
tccatttttaacatacctca

SEQ ID NO: 224516 - DNA, 20 bp, Artificial Sequence
  Description of Artificial Sequence: Synthetic oligonucleotide
  Target: ATXN1; (-) strand; PAM type: YTN; PAM sequence: TTA
ataggtgctttccattttta

SEQ ID NO: 224517 - DNA, 20 bp, Artificial Sequence
  Description of Artificial Sequence: Synthetic oligonucleotide
  Target: ATXN1; (-) strand; PAM type: YTN; PAM sequence: CTT
aataggtgctttccattttt

SEQ ID NO: 224518 - DNA, 20 bp, Artificial Sequence
  Description of Artificial Sequence: Synthetic oligonucleotide
  Target: ATXN1; (-) strand; PAM type: YTN; PAM sequence: CTG
acagtaacagcttaataggt

SEQ ID NO: 224519 - DNA, 20 bp, Artificial Sequence
  Description of Artificial Sequence: Synthetic oligonucleotide
  Target: ATXN1; (-) strand; PAM type: YTN; PAM sequence: TTA
acaggtgaaactgacagtaa

SEQ ID NO: 224520 - DNA, 20 bp, Artificial Sequence
  Description of Artificial Sequence: Synthetic oligonucleotide
  Target: ATXN1; (-) strand; PAM type: YTN; PAM sequence: CTT
aacaggtgaaactgacagta

SEQ ID NO: 224521 - DNA, 20 bp, Artificial Sequence
  Description of Artificial Sequence: Synthetic oligonucleotide
  Target: ATXN1; (-) strand; PAM type: YTN; PAM sequence: CTA
cttaacaggtgaaactgaca

SEQ ID NO: 224522 - DNA, 20 bp, Artificial Sequence
  Description of Artificial Sequence: Synthetic oligonucleotide
  Target: ATXN1; (-) strand; PAM type: YTN; PAM sequence: CTA
atagtacctacttaacaggt

SEQ ID NO: 224523 - DNA, 20 bp, Artificial Sequence
  Description of Artificial Sequence: Synthetic oligonucleotide
  Target: ATXN1; (-) strand; PAM type: YTN; PAM sequence: TTA
actaatagtacctacttaac

SEQ ID NO: 224524 - DNA, 20 bp, Artificial Sequence
  Description of Artificial Sequence: Synthetic oligonucleotide
  Target: ATXN1; (-) strand; PAM type: YTN; PAM sequence: CTT
aactaatagtacctacttaa

SEQ ID NO: 224525 - DNA, 20 bp, Artificial Sequence
  Description of Artificial Sequence: Synthetic oligonucleotide
  Target: ATXN1; (-) strand; PAM type: YTN; PAM sequence: CTG
gcttaactaatagtacctac

SEQ ID NO: 224526 - DNA, 20 bp, Artificial Sequence
  Description of Artificial Sequence: Synthetic oligonucleotide
  Target: ATXN1; (-) strand; PAM type: YTN; PAM sequence: CTA
tgctggcttaactaatagta

SEQ ID NO: 224527 - DNA, 20 bp, Artificial Sequence
  Description of Artificial Sequence: Synthetic oligonucleotide
  Target: ATXN1; (-) strand; PAM type: YTN; PAM sequence: CTC
aggaactatgctggcttaac

SEQ ID NO: 224528 - DNA, 20 bp, Artificial Sequence
  Description of Artificial Sequence: Synthetic oligonucleotide
  Target: ATXN1; (-) strand; PAM type: YTN; PAM sequence: TTG
caactcaggaactatgctgg

SEQ ID NO: 224529 - DNA, 20 bp, Artificial Sequence
  Description of Artificial Sequence: Synthetic oligonucleotide
  Target: ATXN1; (-) strand; PAM type: YTN; PAM sequence: TTT
gcaactcaggaactatgctg

SEQ ID NO: 224530 - DNA, 20 bp, Artificial Sequence
  Description of Artificial Sequence: Synthetic oligonucleotide
  Target: ATXN1; (-) strand; PAM type: YTN; PAM sequence: CTT
tgcaactcaggaactatgct

SEQ ID NO: 224531 - DNA, 20 bp, Artificial Sequence
  Description of Artificial Sequence: Synthetic oligonucleotide
  Target: ATXN1; (-) strand; PAM type: YTN; PAM sequence: CTG
tatatgctttgcaactcagg

SEQ ID NO: 224532 - DNA, 20 bp, Artificial Sequence
  Description of Artificial Sequence: Synthetic oligonucleotide
  Target: ATXN1; (-) strand; PAM type: YTN; PAM sequence: TTC
agcctgtatatgctttgcaa

SEQ ID NO: 224533 - DNA, 20 bp, Artificial Sequence
  Description of Artificial Sequence: Synthetic oligonucleotide
  Target: ATXN1; (-) strand; PAM type: YTN; PAM sequence: CTT
cagcctgtatatgctttgca

SEQ ID NO: 224534 - DNA, 20 bp, Artificial Sequence
  Description of Artificial Sequence: Synthetic oligonucleotide
  Target: ATXN1; (-) strand; PAM type: YTN; PAM sequence: TTG
tacttcagcctgtatatgct

SEQ ID NO: 224535 - DNA, 20 bp, Artificial Sequence
  Description of Artificial Sequence: Synthetic oligonucleotide
  Target: ATXN1; (-) strand; PAM type: YTN; PAM sequence: TTG
acattgtacttcagcctgta

SEQ ID NO: 224536 - DNA, 20 bp, Artificial Sequence
  Description of Artificial Sequence: Synthetic oligonucleotide
  Target: ATXN1; (-) strand; PAM type: YTN; PAM sequence: CTT
gacattgtacttcagcctgt

SEQ ID NO: 224537 - DNA, 20 bp, Artificial Sequence
  Description of Artificial Sequence: Synthetic oligonucleotide
  Target: ATXN1; (-) strand; PAM type: YTN; PAM sequence: TTC
ttgacattgtacttcagcct

SEQ ID NO: 224538 - DNA, 20 bp, Artificial Sequence
  Description of Artificial Sequence: Synthetic oligonucleotide
  Target: ATXN1; (-) strand; PAM type: YTN; PAM sequence: TTT
cttgacattgtacttcagcc

SEQ ID NO: 224539 - DNA, 20 bp, Artificial Sequence
  Description of Artificial Sequence: Synthetic oligonucleotide
  Target: ATXN1; (-) strand; PAM type: YTN; PAM sequence: TTT
tcttgacattgtacttcagc

SEQ ID NO: 224540 - DNA, 20 bp, Artificial Sequence
  Description of Artificial Sequence: Synthetic oligonucleotide
  Target: ATXN1; (-) strand; PAM type: YTN; PAM sequence: TTA
acatgttttcttgacattgt

SEQ ID NO: 224541 - DNA, 20 bp, Artificial Sequence
  Description of Artificial Sequence: Synthetic oligonucleotide
  Target: ATXN1; (-) strand; PAM type: YTN; PAM sequence: TTT
aacatgttttcttgacattg

SEQ ID NO: 224542 - DNA, 20 bp, Artificial Sequence
  Description of Artificial Sequence: Synthetic oligonucleotide
  Target: ATXN1; (-) strand; PAM type: YTN; PAM sequence: CTT
taacatgttttcttgacatt

SEQ ID NO: 224543 - DNA, 20 bp, Artificial Sequence
  Description of Artificial Sequence: Synthetic oligonucleotide
  Target: ATXN1; (-) strand; PAM type: YTN; PAM sequence: TTA
ccaccctttaacatgttttc

SEQ ID NO: 224544 - DNA, 20 bp, Artificial Sequence
  Description of Artificial Sequence: Synthetic oligonucleotide
  Target: ATXN1; (-) strand; PAM type: YTN; PAM sequence: TTT
accaccctttaacatgtttt

SEQ ID NO: 224545 - DNA, 20 bp, Artificial Sequence
  Description of Artificial Sequence: Synthetic oligonucleotide
  Target: ATXN1; (-) strand; PAM type: YTN; PAM sequence: TTA
tttaccaccctttaacatgt

SEQ ID NO: 224546 - DNA, 20 bp, Artificial Sequence
  Description of Artificial Sequence: Synthetic oligonucleotide
  Target: ATXN1; (-) strand; PAM type: YTN; PAM sequence: TTT
atttaccaccctttaacatg

SEQ ID NO: 224547 - DNA, 20 bp, Artificial Sequence
  Description of Artificial Sequence: Synthetic oligonucleotide
  Target: ATXN1; (-) strand; PAM type: YTN; PAM sequence: CTA
tttatttaccaccctttaac

SEQ ID NO: 224548 - DNA, 20 bp, Artificial Sequence
  Description of Artificial Sequence: Synthetic oligonucleotide
  Target: ATXN1; (-) strand; PAM type: YTN; PAM sequence: CTC
agtggctatttatttaccac

SEQ ID NO: 224549 - DNA, 20 bp, Artificial Sequence
  Description of Artificial Sequence: Synthetic oligonucleotide
  Target: ATXN1; (-) strand; PAM type: YTN; PAM sequence: TTC
tcagtggctatttatttacc

SEQ ID NO: 224550 - DNA, 20 bp, Artificial Sequence
  Description of Artificial Sequence: Synthetic oligonucleotide
  Target: ATXN1; (-) strand; PAM type: YTN; PAM sequence: CTT
ctcagtggctatttatttac

SEQ ID NO: 224551 - DNA, 20 bp, Artificial Sequence
  Description of Artificial Sequence: Synthetic oligonucleotide
  Target: ATXN1; (-) strand; PAM type: YTN; PAM sequence: TTC
agagtatcttctcagtggct

SEQ ID NO: 224552 - DNA, 20 bp, Artificial Sequence
  Description of Artificial Sequence: Synthetic oligonucleotide
  Target: ATXN1; (-) strand; PAM type: YTN; PAM sequence: CTG
ttcagagtatcttctcagtg

SEQ ID NO: 224553 - DNA, 20 bp, Artificial Sequence
  Description of Artificial Sequence: Synthetic oligonucleotide
  Target: ATXN1; (-) strand; PAM type: YTN; PAM sequence: TTA
tctgttcagagtatcttctc

SEQ ID NO: 224554 - DNA, 20 bp, Artificial Sequence
  Description of Artificial Sequence: Synthetic oligonucleotide
  Target: ATXN1; (-) strand; PAM type: YTN; PAM sequence: TTT
atctgttcagagtatcttct

SEQ ID NO: 224555 - DNA, 20 bp, Artificial Sequence
  Description of Artificial Sequence: Synthetic oligonucleotide
  Target: ATXN1; (-) strand; PAM type: YTN; PAM sequence: TTA
tttatctgttcagagtatct

SEQ ID NO: 224556 - DNA, 20 bp, Artificial Sequence
  Description of Artificial Sequence: Synthetic oligonucleotide
  Target: ATXN1; (-) strand; PAM type: YTN; PAM sequence: CTT
atttatctgttcagagtatc

SEQ ID NO: 224557 - DNA, 20 bp, Artificial Sequence
  Description of Artificial Sequence: Synthetic oligonucleotide
  Target: ATXN1; (-) strand; PAM type: YTN; PAM sequence: TTC
ttatttatctgttcagagta

SEQ ID NO: 224558 - DNA, 20 bp, Artificial Sequence
  Description of Artificial Sequence: Synthetic oligonucleotide
  Target: ATXN1; (-) strand; PAM type: YTN; PAM sequence: TTT
cttatttatctgttcagagt

SEQ ID NO: 224559 - DNA, 20 bp, Artificial Sequence
  Description of Artificial Sequence: Synthetic oligonucleotide
  Target: ATXN1; (-) strand; PAM type: YTN; PAM sequence: TTT
tcttatttatctgttcagag

SEQ ID NO: 224560 - DNA, 20 bp, Artificial Sequence
  Description of Artificial Sequence: Synthetic oligonucleotide
  Target: ATXN1; (-) strand; PAM type: YTN; PAM sequence: TTT
ttcttatttatctgttcaga

SEQ ID NO: 224561 - DNA, 20 bp, Artificial Sequence
  Description of Artificial Sequence: Synthetic oligonucleotide
  Target: ATXN1; (-) strand; PAM type: YTN; PAM sequence: TTT
tttcttatttatctgttcag

SEQ ID NO: 224562 - DNA, 20 bp, Artificial Sequence
  Description of Artificial Sequence: Synthetic oligonucleotide
  Target: ATXN1; (-) strand; PAM type: YTN; PAM sequence: CTT
ttttcttatttatctgttca

SEQ ID NO: 224563 - DNA, 20 bp, Artificial Sequence
  Description of Artificial Sequence: Synthetic oligonucleotide
  Target: ATXN1; (-) strand; PAM type: YTN; PAM sequence: TTG
cttttttcttatttatctgt

SEQ ID NO: 224564 - DNA, 20 bp, Artificial Sequence
  Description of Artificial Sequence: Synthetic oligonucleotide
  Target: ATXN1; (-) strand; PAM type: YTN; PAM sequence: TTT
gcttttttcttatttatctg

SEQ ID NO: 224565 - DNA, 20 bp, Artificial Sequence
  Description of Artificial Sequence: Synthetic oligonucleotide
  Target: ATXN1; (-) strand; PAM type: YTN; PAM sequence: CTA
catttgcttttttcttattt

SEQ ID NO: 224566 - DNA, 20 bp, Artificial Sequence
  Description of Artificial Sequence: Synthetic oligonucleotide
  Target: ATXN1; (-) strand; PAM type: YTN; PAM sequence: TTC
aactacatttgcttttttct

SEQ ID NO: 224567 - DNA, 20 bp, Artificial Sequence
  Description of Artificial Sequence: Synthetic oligonucleotide
  Target: ATXN1; (-) strand; PAM type: YTN; PAM sequence: TTT
caactacatttgcttttttc

SEQ ID NO: 224568 - DNA, 20 bp, Artificial Sequence
  Description of Artificial Sequence: Synthetic oligonucleotide
  Target: ATXN1; (-) strand; PAM type: YTN; PAM sequence: TTA
tttcaactacatttgctttt

SEQ ID NO: 224569 - DNA, 20 bp, Artificial Sequence
  Description of Artificial Sequence: Synthetic oligonucleotide
  Target: ATXN1; (-) strand; PAM type: YTN; PAM sequence: TTT
atttcaactacatttgcttt

SEQ ID NO: 224570 - DNA, 20 bp, Artificial Sequence
  Description of Artificial Sequence: Synthetic oligonucleotide
  Target: ATXN1; (-) strand; PAM type: YTN; PAM sequence: TTC
catttatttcaactacattt

SEQ ID NO: 224571 - DNA, 20 bp, Artificial Sequence
  Description of Artificial Sequence: Synthetic oligonucleotide
  Target: ATXN1; (-) strand; PAM type: YTN; PAM sequence: CTT
ccatttatttcaactacatt

SEQ ID NO: 224572 - DNA, 20 bp, Artificial Sequence
  Description of Artificial Sequence: Synthetic oligonucleotide
  Target: ATXN1; (-) strand; PAM type: YTN; PAM sequence: CTA
gagcttccatttatttcaac

SEQ ID NO: 224573 - DNA, 20 bp, Artificial Sequence
  Description of Artificial Sequence: Synthetic oligonucleotide
  Target: ATXN1; (-) strand; PAM type: YTN; PAM sequence: CTG
cctagagcttccatttattt

SEQ ID NO: 224574 - DNA, 20 bp, Artificial Sequence
  Description of Artificial Sequence: Synthetic oligonucleotide
  Target: ATXN1; (-) strand; PAM type: YTN; PAM sequence: CTG
tccacacactgcctagagct

SEQ ID NO: 224575 - DNA, 20 bp, Artificial Sequence
  Description of Artificial Sequence: Synthetic oligonucleotide
  Target: ATXN1; (-) strand; PAM type: YTN; PAM sequence: CTG
tctgtccacacactgcctag

SEQ ID NO: 224576 - DNA, 20 bp, Artificial Sequence
  Description of Artificial Sequence: Synthetic oligonucleotide
  Target: ATXN1; (-) strand; PAM type: YTN; PAM sequence: TTC
tgtctgtccacacactgcct

SEQ ID NO: 224577 - DNA, 20 bp, Artificial Sequence
  Description of Artificial Sequence: Synthetic oligonucleotide
  Target: ATXN1; (-) strand; PAM type: YTN; PAM sequence: TTG
ttctgtctgtccacacactg

SEQ ID NO: 224578 - DNA, 20 bp, Artificial Sequence
  Description of Artificial Sequence: Synthetic oligonucleotide
  Target: ATXN1; (-) strand; PAM type: YTN; PAM sequence: TTT
gttctgtctgtccacacact

SEQ ID NO: 224579 - DNA, 20 bp, Artificial Sequence
  Description of Artificial Sequence: Synthetic oligonucleotide
  Target: ATXN1; (-) strand; PAM type: YTN; PAM sequence: TTT
tgttctgtctgtccacacac

SEQ ID NO: 224580 - DNA, 20 bp, Artificial Sequence
  Description of Artificial Sequence: Synthetic oligonucleotide
  Target: ATXN1; (-) strand; PAM type: YTN; PAM sequence: CTT
ttgttctgtctgtccacaca

SEQ ID NO: 224581 - DNA, 20 bp, Artificial Sequence
  Description of Artificial Sequence: Synthetic oligonucleotide
  Target: ATXN1; (-) strand; PAM type: YTN; PAM sequence: TTC
aggccaaggcataaacagtg

SEQ ID NO: 224582 - DNA, 20 bp, Artificial Sequence
  Description of Artificial Sequence: Synthetic oligonucleotide
  Target: ATXN1; (-) strand; PAM type: YTN; PAM sequence: TTG
gaggcacacagacattcagg

SEQ ID NO: 224583 - DNA, 20 bp, Artificial Sequence
  Description of Artificial Sequence: Synthetic oligonucleotide
  Target: ATXN1; (-) strand; PAM type: YTN; PAM sequence: TTT
ggaggcacacagacattcag

SEQ ID NO: 224584 - DNA, 20 bp, Artificial Sequence
  Description of Artificial Sequence: Synthetic oligonucleotide
  Target: ATXN1; (-) strand; PAM type: YTN; PAM sequence: TTT
tggaggcacacagacattca

SEQ ID NO: 224585 - DNA, 20 bp, Artificial Sequence
  Description of Artificial Sequence: Synthetic oligonucleotide
  Target: ATXN1; (-) strand; PAM type: YTN; PAM sequence: TTC
gacatgtgaattttggaggc

SEQ ID NO: 224586 - DNA, 20 bp, Artificial Sequence
  Description of Artificial Sequence: Synthetic oligonucleotide
  Target: ATXN1; (-) strand; PAM type: YTN; PAM sequence: TTA
ggattcgacatgtgaatttt

SEQ ID NO: 224587 - DNA, 20 bp, Artificial Sequence
  Description of Artificial Sequence: Synthetic oligonucleotide
  Target: ATXN1; (-) strand; PAM type: YTN; PAM sequence: CTA
tcacgtggggagttaggatt

SEQ ID NO: 224588 - DNA, 20 bp, Artificial Sequence
  Description of Artificial Sequence: Synthetic oligonucleotide
  Target: ATXN1; (-) strand; PAM type: YTN; PAM sequence: CTA
atactatcacgtggggagtt

SEQ ID NO: 224589 - DNA, 20 bp, Artificial Sequence
  Description of Artificial Sequence: Synthetic oligonucleotide
  Target: ATXN1; (-) strand; PAM type: YTN; PAM sequence: CTC
cctaatactatcacgtgggg

SEQ ID NO: 224590 - DNA, 20 bp, Artificial Sequence
  Description of Artificial Sequence: Synthetic oligonucleotide
  Target: ATXN1; (-) strand; PAM type: YTN; PAM sequence: CTC
cactccctaatactatcacg

SEQ ID NO: 224591 - DNA, 20 bp, Artificial Sequence
  Description of Artificial Sequence: Synthetic oligonucleotide
  Target: ATXN1; (-) strand; PAM type: YTN; PAM sequence: CTC
ccaagggctccactccctaa

SEQ ID NO: 224592 - DNA, 20 bp, Artificial Sequence
  Description of Artificial Sequence: Synthetic oligonucleotide
  Target: ATXN1; (-) strand; PAM type: YTN; PAM sequence: TTC
aagagggcacctcccaaggg

SEQ ID NO: 224593 - DNA, 20 bp, Artificial Sequence
  Description of Artificial Sequence: Synthetic oligonucleotide
  Target: ATXN1; (-) strand; PAM type: YTN; PAM sequence: TTC
cattcaagagggcacctccc

SEQ ID NO: 224594 - DNA, 20 bp, Artificial Sequence
  Description of Artificial Sequence: Synthetic oligonucleotide
  Target: ATXN1; (-) strand; PAM type: YTN; PAM sequence: CTA
attccattcaagagggcacc

SEQ ID NO: 224595 - DNA, 20 bp, Artificial Sequence
  Description of Artificial Sequence: Synthetic oligonucleotide
  Target: ATXN1; (-) strand; PAM type: YTN; PAM sequence: TTG
ataaaggtgctaattccatt

SEQ ID NO: 224596 - DNA, 20 bp, Artificial Sequence
  Description of Artificial Sequence: Synthetic oligonucleotide
  Target: ATXN1; (-) strand; PAM type: YTN; PAM sequence: TTT
gataaaggtgctaattccat

SEQ ID NO: 224597 - DNA, 20 bp, Artificial Sequence
  Description of Artificial Sequence: Synthetic oligonucleotide
  Target: ATXN1; (-) strand; PAM type: YTN; PAM sequence: CTT
tgataaaggtgctaattcca

SEQ ID NO: 224598 - DNA, 20 bp, Artificial Sequence
  Description of Artificial Sequence: Synthetic oligonucleotide
  Target: ATXN1; (-) strand; PAM type: YTN; PAM sequence: TTC
tttgataaaggtgctaattc

SEQ ID NO: 224599 - DNA, 20 bp, Artificial Sequence
  Description of Artificial Sequence: Synthetic oligonucleotide
  Target: ATXN1; (-) strand; PAM type: YTN; PAM sequence: CTG
ggggagttctttgataaagg

SEQ ID NO: 224600 - DNA, 20 bp, Artificial Sequence
  Description of Artificial Sequence: Synthetic oligonucleotide
  Target: ATXN1; (-) strand; PAM type: YTN; PAM sequence: TTC
ctgggggagttctttgataa

SEQ ID NO: 224601 - DNA, 20 bp, Artificial Sequence
  Description of Artificial Sequence: Synthetic oligonucleotide
  Target: ATXN1; (-) strand; PAM type: YTN; PAM sequence: CTC
acatggtggaagaggcaaag

SEQ ID NO: 224602 - DNA, 20 bp, Artificial Sequence
  Description of Artificial Sequence: Synthetic oligonucleotide
  Target: ATXN1; (-) strand; PAM type: YTN; PAM sequence: CTG
tgtatcctcacatggtggaa

SEQ ID NO: 224603 - DNA, 20 bp, Artificial Sequence
  Description of Artificial Sequence: Synthetic oligonucleotide
  Target: ATXN1; (-) strand; PAM type: YTN; PAM sequence: CTC
tgtgtatcctcacatggtgg

SEQ ID NO: 224604 - DNA, 20 bp, Artificial Sequence
  Description of Artificial Sequence: Synthetic oligonucleotide
  Target: ATXN1; (-) strand; PAM type: YTN; PAM sequence: TTC
tctgtgtatcctcacatggt

SEQ ID NO: 224605 - DNA, 20 bp, Artificial Sequence
  Description of Artificial Sequence: Synthetic oligonucleotide
  Target: ATXN1; (-) strand; PAM type: YTN; PAM sequence: CTT
ctctgtgtatcctcacatgg

SEQ ID NO: 224606 - DNA, 20 bp, Artificial Sequence
  Description of Artificial Sequence: Synthetic oligonucleotide
  Target: ATXN1; (-) strand; PAM type: YTN; PAM sequence: CTC
acagatggcaccttctctgt

SEQ ID NO: 224607 - DNA, 20 bp, Artificial Sequence
  Description of Artificial Sequence: Synthetic oligonucleotide
  Target: ATXN1; (-) strand; PAM type: YTN; PAM sequence: CTA
aggctcacagatggcacctt

SEQ ID NO: 224608 - DNA, 20 bp, Artificial Sequence
  Description of Artificial Sequence: Synthetic oligonucleotide
  Target: ATXN1; (-) strand; PAM type: YTN; PAM sequence: TTC
taaggctcacagatggcacc

SEQ ID NO: 224609 - DNA, 20 bp, Artificial Sequence
  Description of Artificial Sequence: Synthetic oligonucleotide
  Target: ATXN1; (-) strand; PAM type: YTN; PAM sequence: TTG
ttctaaggctcacagatggc

SEQ ID NO: 224610 - DNA, 20 bp, Artificial Sequence
  Description of Artificial Sequence: Synthetic oligonucleotide
  Target: ATXN1; (-) strand; PAM type: YTN; PAM sequence: CTT
gttctaaggctcacagatgg

SEQ ID NO: 224611 - DNA, 20 bp, Artificial Sequence
  Description of Artificial Sequence: Synthetic oligonucleotide
  Target: ATXN1; (-) strand; PAM type: YTN; PAM sequence: CTA
aggcttgttctaaggctcac

SEQ ID NO: 224612 - DNA, 20 bp, Artificial Sequence
  Description of Artificial Sequence: Synthetic oligonucleotide
  Target: ATXN1; (-) strand; PAM type: YTN; PAM sequence: TTC
taaggcttgttctaaggctc

SEQ ID NO: 224613 - DNA, 20 bp, Artificial Sequence
  Description of Artificial Sequence: Synthetic oligonucleotide
  Target: ATXN1; (-) strand; PAM type: YTN; PAM sequence: CTA
ttctaaggcttgttctaagg

SEQ ID NO: 224614 - DNA, 20 bp, Artificial Sequence
  Description of Artificial Sequence: Synthetic oligonucleotide
  Target: ATXN1; (-) strand; PAM type: YTN; PAM sequence: TTG
agccaccacacccggcctat

SEQ ID NO: 224615 - DNA, 20 bp, Artificial Sequence
  Description of Artificial Sequence: Synthetic oligonucleotide
  Target: ATXN1; (-) strand; PAM type: YTN; PAM sequence: CTT
gagccaccacacccggccta

SEQ ID NO: 224616 - DNA, 20 bp, Artificial Sequence
  Description of Artificial Sequence: Synthetic oligonucleotide
  Target: ATXN1; (-) strand; PAM type: YTN; PAM sequence: TTA
caggcttgagccaccacacc

SEQ ID NO: 224617 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcttgagccac

SEQ ID NO: 224618 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 224619 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 224620 - DNA, 20 bp, Artificial Sequence
  Description of Artificial Sequence: Synthetic oligonucleotide
  Target: ATXN1; (-) strand; PAM type: YTN; PAM sequence: CTG
cccgcctcggcctcccaaag

SEQ ID NO: 224621 - DNA, 20 bp, Artificial Sequence
  Description of Artificial Sequence: Synthetic oligonucleotide
  Target: ATXN1; (-) strand; PAM type: YTN; PAM sequence: CTG
atgtcaggtgatctgcccgc

SEQ ID NO: 224622 - DNA, 20 bp, Artificial Sequence
  Description of Artificial Sequence: Synthetic oligonucleotide
  Target: ATXN1; (-) strand; PAM type: YTN; PAM sequence: CTC
ctgatgtcaggtgatctgcc

SEQ ID NO: 224623 - DNA, 20 bp, Artificial Sequence
  Description of Artificial Sequence: Synthetic oligonucleotide
  Target: ATXN1; (-) strand; PAM type: YTN; PAM sequence: CTC
gaactcctgatgtcaggtga

SEQ ID NO: 224624 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgatgtca

SEQ ID NO: 224625 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtctcgaactc

SEQ ID NO: 224626 - DNA, 20 bp, Artificial Sequence
  Description of Artificial Sequence: Synthetic oligonucleotide
  Target: ATXN1; (-) strand; PAM type: YTN; PAM sequence: TTC
accatattggccaggctggt

SEQ ID NO: 224627 - DNA, 20 bp, Artificial Sequence
  Description of Artificial Sequence: Synthetic oligonucleotide
  Target: ATXN1; (-) strand; PAM type: YTN; PAM sequence: TTT
caccatattggccaggctgg

SEQ ID NO: 224628 - DNA, 20 bp, Artificial Sequence
  Description of Artificial Sequence: Synthetic oligonucleotide
  Target: ATXN1; (-) strand; PAM type: YTN; PAM sequence: TTA
gtagagatgaggtttcacca

SEQ ID NO: 224629 - DNA, 20 bp, Artificial Sequence
  Description of Artificial Sequence: Synthetic oligonucleotide
  Target: ATXN1; (-) strand; PAM type: YTN; PAM sequence: TTT
agtagagatgaggtttcacc

SEQ ID NO: 224630 - DNA, 20 bp, Artificial Sequence
  Description of Artificial Sequence: Synthetic oligonucleotide
  Target: ATXN1; (-) strand; PAM type: YTN; PAM sequence: TTT
tagtagagatgaggtttcac

SEQ ID NO: 224631 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatgaggtttca

SEQ ID NO: 224632 - DNA, 20 bp, Artificial Sequence
  Description of Artificial Sequence: Synthetic oligonucleotide
  Target: ATXN1; (-) strand; PAM type: YTN; PAM sequence: CTA
caggtgcgtgccaccacgcc

SEQ ID NO: 224633 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgcgtgccac

SEQ ID NO: 224634 - DNA, 20 bp, Artificial Sequence
  Description of Artificial Sequence: Synthetic oligonucleotide
  Target: ATXN1; (-) strand; PAM type: YTN; PAM sequence: CTG
agtagctgggactacaggtg

SEQ ID NO: 224635 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggactacag

SEQ ID NO: 224636 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctggga

SEQ ID NO: 224637 - DNA, 20 bp, Artificial Sequence
  Description of Artificial Sequence: Synthetic oligonucleotide
  Target: ATXN1; (-) strand; PAM type: YTN; PAM sequence: CTG
tctcagcctcctgagtagct

SEQ ID NO: 224638 - DNA, 20 bp, Artificial Sequence
  Description of Artificial Sequence: Synthetic oligonucleotide
  Target: ATXN1; (-) strand; PAM type: YTN; PAM sequence: CTA
ctgtctcagcctcctgagta

SEQ ID NO: 224639 - DNA, 20 bp, Artificial Sequence
  Description of Artificial Sequence: Synthetic oligonucleotide
  Target: ATXN1; (-) strand; PAM type: YTN; PAM sequence: TTC
tactgtctcagcctcctgag

SEQ ID NO: 224640 - DNA, 20 bp, Artificial Sequence
  Description of Artificial Sequence: Synthetic oligonucleotide
  Target: ATXN1; (-) strand; PAM type: YTN; PAM sequence: TTC
aagcaattctactgtctcag

SEQ ID NO: 224641 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcaattctac

SEQ ID NO: 224642 - DNA, 20 bp, Artificial Sequence
  Description of Artificial Sequence: Synthetic oligonucleotide
  Target: ATXN1; (-) strand; PAM type: YTN; PAM sequence: CTC
cgcctcccaggttcaagcaa

SEQ ID NO: 224643 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctcccaggtt

SEQ ID NO: 224644 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcctccca

SEQ ID NO: 224645 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctccgcc

SEQ ID NO: 224646 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcatgatctc

SEQ ID NO: 224647 - DNA, 20 bp, Artificial Sequence
  Description of Artificial Sequence: Synthetic oligonucleotide
  Target: ATXN1; (-) strand; PAM type: YTN; PAM sequence: CTC
agtcgcccaggctggagtgc

SEQ ID NO: 224648 - DNA, 20 bp, Artificial Sequence
  Description of Artificial Sequence: Synthetic oligonucleotide
  Target: ATXN1; (-) strand; PAM type: YTN; PAM sequence: CTC
gctcagtcgcccaggctgga

SEQ ID NO: 224649 - DNA, 20 bp, Artificial Sequence
  Description of Artificial Sequence: Synthetic oligonucleotide
  Target: ATXN1; (-) strand; PAM type: YTN; PAM sequence: TTG
cagagtctcgctcagtcgcc

SEQ ID NO: 224650 - DNA, 20 bp, Artificial Sequence
  Description of Artificial Sequence: Synthetic oligonucleotide
  Target: ATXN1; (-) strand; PAM type: YTN; PAM sequence: TTT
gcagagtctcgctcagtcgc

SEQ ID NO: 224651 - DNA, 20 bp, Artificial Sequence
  Description of Artificial Sequence: Synthetic oligonucleotide
  Target: ATXN1; (-) strand; PAM type: YTN; PAM sequence: TTA
atcatataaagtacatattt

SEQ ID NO: 224652 - DNA, 20 bp, Artificial Sequence
  Description of Artificial Sequence: Synthetic oligonucleotide
  Target: ATXN1; (-) strand; PAM type: YTN; PAM sequence: TTA
caaatagattaatcatataa

SEQ ID NO: 224653 - DNA, 20 bp, Artificial Sequence
  Description of Artificial Sequence: Synthetic oligonucleotide
  Target: ATXN1; (-) strand; PAM type: YTN; PAM sequence: TTC
aatggttacaaatagattaa

SEQ ID NO: 224654 - DNA, 20 bp, Artificial Sequence
  Description of Artificial Sequence: Synthetic oligonucleotide
  Target: ATXN1; (-) strand; PAM type: YTN; PAM sequence: CTT
caatggttacaaatagatta

SEQ ID NO: 224655 - DNA, 20 bp, Artificial Sequence
  Description of Artificial Sequence: Synthetic oligonucleotide
  Target: ATXN1; (-) strand; PAM type: YTN; PAM sequence: TTA
cttcaatggttacaaataga

SEQ ID NO: 224656 - DNA, 20 bp, Artificial Sequence
  Description of Artificial Sequence: Synthetic oligonucleotide
  Target: ATXN1; (-) strand; PAM type: YTN; PAM sequence: TTT
acttcaatggttacaaatag

SEQ ID NO: 224657 - DNA, 20 bp, Artificial Sequence
  Description of Artificial Sequence: Synthetic oligonucleotide
  Target: ATXN1; (-) strand; PAM type: YTN; PAM sequence: TTA
aaagcacaaagaaaaatgtt

SEQ ID NO: 224658 - DNA, 20 bp, Artificial Sequence
  Description of Artificial Sequence: Synthetic oligonucleotide
  Target: ATXN1; (-) strand; PAM type: YTN; PAM sequence: TTT
aaaagcacaaagaaaaatgt

SEQ ID NO: 224659 - DNA, 20 bp, Artificial Sequence
  Description of Artificial Sequence: Synthetic oligonucleotide
  Target: ATXN1; (-) strand; PAM type: YTN; PAM sequence: TTG
aatttaaaagcacaaagaaa

SEQ ID NO: 224660 - DNA, 20 bp, Artificial Sequence
  Description of Artificial Sequence: Synthetic oligonucleotide
  Target: ATXN1; (-) strand; PAM type: YTN; PAM sequence: TTT
gaatttaaaagcacaaagaa

SEQ ID NO: 224661 - DNA, 20 bp, Artificial Sequence
  Description of Artificial Sequence: Synthetic oligonucleotide
  Target: ATXN1; (-) strand; PAM type: YTN; PAM sequence: CTA
aggtagaggtttgaatttaa

SEQ ID NO: 224662 - DNA, 20 bp, Artificial Sequence
  Description of Artificial Sequence: Synthetic oligonucleotide
  Target: ATXN1; (-) strand; PAM type: YTN; PAM sequence: CTG
ctaaggtagaggtttgaatt

SEQ ID NO: 224663 - DNA, 20 bp, Artificial Sequence
  Description of Artificial Sequence: Synthetic oligonucleotide
  Target: ATXN1; (-) strand; PAM type: YTN; PAM sequence: CTG
tgatatggctgctaaggtag

SEQ ID NO: 224664 - DNA, 20 bp, Artificial Sequence
  Description of Artificial Sequence: Synthetic oligonucleotide
  Target: ATXN1; (-) strand; PAM type: YTN; PAM sequence: TTG
tgactgtgatatggctgcta

SEQ ID NO: 224665 - DNA, 20 bp, Artificial Sequence
  Description of Artificial Sequence: Synthetic oligonucleotide
  Target: ATXN1; (-) strand; PAM type: YTN; PAM sequence: TTT
gtgactgtgatatggctgct

SEQ ID NO: 224666 - DNA, 20 bp, Artificial Sequence
  Description of Artificial Sequence: Synthetic oligonucleotide
  Target: ATXN1; (-) strand; PAM type: YTN; PAM sequence: TTA
atttgtgactgtgatatggc

SEQ ID NO: 224667 - DNA, 20 bp, Artificial Sequence
  Description of Artificial Sequence: Synthetic oligonucleotide
  Target: ATXN1; (-) strand; PAM type: YTN; PAM sequence: TTG
ccatatagttaatttgtgac

SEQ ID NO: 224668 - DNA, 20 bp, Artificial Sequence
  Description of Artificial Sequence: Synthetic oligonucleotide
  Target: ATXN1; (-) strand; PAM type: YTN; PAM sequence: CTT
gccatatagttaatttgtga

SEQ ID NO: 224669 - DNA, 20 bp, Artificial Sequence
  Description of Artificial Sequence: Synthetic oligonucleotide
  Target: ATXN1; (-) strand; PAM type: YTN; PAM sequence: TTA
cttgccatatagttaatttg

SEQ ID NO: 224670 - DNA, 20 bp, Artificial Sequence
  Description of Artificial Sequence: Synthetic oligonucleotide
  Target: ATXN1; (-) strand; PAM type: YTN; PAM sequence: CTG
agaacccaaagtaatcatac

SEQ ID NO: 224671 - DNA, 20 bp, Artificial Sequence
  Description of Artificial Sequence: Synthetic oligonucleotide
  Target: ATXN1; (-) strand; PAM type: YTN; PAM sequence: TTA
aatacatagcaagtcatctg

SEQ ID NO: 224672 - DNA, 20 bp, Artificial Sequence
  Description of Artificial Sequence: Synthetic oligonucleotide
  Target: ATXN1; (-) strand; PAM type: YTN; PAM sequence: TTC
attaaatacatagcaagtca

SEQ ID NO: 224673 - DNA, 20 bp, Artificial Sequence
  Description of Artificial Sequence: Synthetic oligonucleotide
  Target: ATXN1; (-) strand; PAM type: YTN; PAM sequence: CTT
cattaaatacatagcaagtc

SEQ ID NO: 224674 - DNA, 20 bp, Artificial Sequence
  Description of Artificial Sequence: Synthetic oligonucleotide
  Target: ATXN1; (-) strand; PAM type: YTN; PAM sequence: TTA
cttcattaaatacatagcaa

SEQ ID NO: 224675 - DNA, 20 bp, Artificial Sequence
  Description of Artificial Sequence: Synthetic oligonucleotide
  Target: ATXN1; (-) strand; PAM type: YTN; PAM sequence: TTT
acttcattaaatacatagca

SEQ ID NO: 224676 - DNA, 20 bp, Artificial Sequence
  Description of Artificial Sequence: Synthetic oligonucleotide
  Target: ATXN1; (-) strand; PAM type: YTN; PAM sequence: TTT
tacttcattaaatacatagc

SEQ ID NO: 224677 - DNA, 20 bp, Artificial Sequence
  Description of Artificial Sequence: Synthetic oligonucleotide
  Target: ATXN1; (-) strand; PAM type: YTN; PAM sequence: TTA
caattttacttcattaaata

SEQ ID NO: 224678 - DNA, 20 bp, Artificial Sequence
  Description of Artificial Sequence: Synthetic oligonucleotide
  Target: ATXN1; (-) strand; PAM type: YTN; PAM sequence: CTT
acaattttacttcattaaat

SEQ ID NO: 224679 - DNA, 20 bp, Artificial Sequence
  Description of Artificial Sequence: Synthetic oligonucleotide
  Target: ATXN1; (-) strand; PAM type: YTN; PAM sequence: TTG
acttacaattttacttcatt

SEQ ID NO: 224680 - DNA, 20 bp, Artificial Sequence
  Description of Artificial Sequence: Synthetic oligonucleotide
  Target: ATXN1; (-) strand; PAM type: YTN; PAM sequence: CTT
gacttacaattttacttcat

SEQ ID NO: 224681 - DNA, 20 bp, Artificial Sequence
  Description of Artificial Sequence: Synthetic oligonucleotide
  Target: ATXN1; (-) strand; PAM type: YTN; PAM sequence: CTG
acttgacttacaattttact

SEQ ID NO: 224682 - DNA, 20 bp, Artificial Sequence
  Description of Artificial Sequence: Synthetic oligonucleotide
  Target: ATXN1; (-) strand; PAM type: YTN; PAM sequence: CTA
tatctgacttgacttacaat

SEQ ID NO: 224683 - DNA, 20 bp, Artificial Sequence
  Description of Artificial Sequence: Synthetic oligonucleotide
  Target: ATXN1; (-) strand; PAM type: YTN; PAM sequence: CTA
cctatatctgacttgactta

SEQ ID NO: 224684 - DNA, 20 bp, Artificial Sequence
  Description of Artificial Sequence: Synthetic oligonucleotide
  Target: ATXN1; (-) strand; PAM type: YTN; PAM sequence: TTG
tacctacctatatctgactt

SEQ ID NO: 224685 - DNA, 20 bp, Artificial Sequence
  Description of Artificial Sequence: Synthetic oligonucleotide
  Target: ATXN1; (-) strand; PAM type: YTN; PAM sequence: TTA
ttgtacctacctatatctga

SEQ ID NO: 224686 - DNA, 20 bp, Artificial Sequence
  Description of Artificial Sequence: Synthetic oligonucleotide
  Target: ATXN1; (-) strand; PAM type: YTN; PAM sequence: TTA
atattattgtacctacctat

SEQ ID NO: 224687 - DNA, 20 bp, Artificial Sequence
  Description of Artificial Sequence: Synthetic oligonucleotide
  Target: ATXN1; (-) strand; PAM type: YTN; PAM sequence: TTG
ttaatattattgtacctacc

SEQ ID NO: 224688 - DNA, 20 bp, Artificial Sequence
  Description of Artificial Sequence: Synthetic oligonucleotide
  Target: ATXN1; (-) strand; PAM type: YTN; PAM sequence: TTT
gttaatattattgtacctac

SEQ ID NO: 224689 - DNA, 20 bp, Artificial Sequence
  Description of Artificial Sequence: Synthetic oligonucleotide
  Target: ATXN1; (-) strand; PAM type: YTN; PAM sequence: TTA
catttgttaatattattgta

SEQ ID NO: 224690 - DNA, 20 bp, Artificial Sequence
  Description of Artificial Sequence: Synthetic oligonucleotide
  Target: ATXN1; (-) strand; PAM type: YTN; PAM sequence: TTG
attacatttgttaatattat

SEQ ID NO: 224691 - DNA, 20 bp, Artificial Sequence
  Description of Artificial Sequence: Synthetic oligonucleotide
  Target: ATXN1; (-) strand; PAM type: YTN; PAM sequence: TTT
gattacatttgttaatatta

SEQ ID NO: 224692 - DNA, 20 bp, Artificial Sequence
  Description of Artificial Sequence: Synthetic oligonucleotide
  Target: ATXN1; (-) strand; PAM type: YTN; PAM sequence: TTT
tgattacatttgttaatatt

SEQ ID NO: 224693 - DNA, 20 bp, Artificial Sequence
  Description of Artificial Sequence: Synthetic oligonucleotide
  Target: ATXN1; (-) strand; PAM type: YTN; PAM sequence: CTT
ttgattacatttgttaatat

SEQ ID NO: 224694 - DNA, 20 bp, Artificial Sequence
  Description of Artificial Sequence: Synthetic oligonucleotide
  Target: ATXN1; (-) strand; PAM type: YTN; PAM sequence: TTA
aaatagacaaatcttttgat

SEQ ID NO: 224695 - DNA, 20 bp, Artificial Sequence
  Description of Artificial Sequence: Synthetic oligonucleotide
  Target: ATXN1; (-) strand; PAM type: YTN; PAM sequence: TTT
aaaatagacaaatcttttga

SEQ ID NO: 224696 - DNA, 20 bp, Artificial Sequence
  Description of Artificial Sequence: Synthetic oligonucleotide
  Target: ATXN1; (-) strand; PAM type: YTN; PAM sequence: CTT
taaaatagacaaatcttttg

SEQ ID NO: 224697 - DNA, 20 bp, Artificial Sequence
  Description of Artificial Sequence: Synthetic oligonucleotide
  Target: ATXN1; (-) strand; PAM type: YTN; PAM sequence: TTG
agtctttaaaatagacaaat

SEQ ID NO: 224698 - DNA, 20 bp, Artificial Sequence
  Description of Artificial Sequence: Synthetic oligonucleotide
  Target: ATXN1; (-) strand; PAM type: YTN; PAM sequence: CTT
gagtctttaaaatagacaaa

SEQ ID NO: 224699 - DNA, 20 bp, Artificial Sequence
  Description of Artificial Sequence: Synthetic oligonucleotide
  Target: ATXN1; (-) strand; PAM type: YTN; PAM sequence: TTC
ttgagtctttaaaatagaca

SEQ ID NO: 224700 - DNA, 20 bp, Artificial Sequence
  Description of Artificial Sequence: Synthetic oligonucleotide
  Target: ATXN1; (-) strand; PAM type: YTN; PAM sequence: TTT
cttgagtctttaaaatagac

SEQ ID NO: 224701 - DNA, 20 bp, Artificial Sequence
  Description of Artificial Sequence: Synthetic oligonucleotide
  Target: ATXN1; (-) strand; PAM type: YTN; PAM sequence: CTT
tcttgagtctttaaaataga

SEQ ID NO: 224702 - DNA, 20 bp, Artificial Sequence
  Description of Artificial Sequence: Synthetic oligonucleotide
  Target: ATXN1; (-) strand; PAM type: YTN; PAM sequence: TTG
tctttcttgagtctttaaaa

SEQ ID NO: 224703 - DNA, 20 bp, Artificial Sequence
  Description of Artificial Sequence: Synthetic oligonucleotide
  Target: ATXN1; (-) strand; PAM type: YTN; PAM sequence: TTG
ggtataattgtctttcttga

SEQ ID NO: 224704 - DNA, 20 bp, Artificial Sequence
  Description of Artificial Sequence: Synthetic oligonucleotide
  Target: ATXN1; (-) strand; PAM type: YTN; PAM sequence: TTA
attgggtataattgtctttc

SEQ ID NO: 224705 - DNA, 20 bp, Artificial Sequence
  Description of Artificial Sequence: Synthetic oligonucleotide
  Target: ATXN1; (-) strand; PAM type: YTN; PAM sequence: TTC
atatgaatgtgtgtgttaat

SEQ ID NO: 224706 - DNA, 20 bp, Artificial Sequence
  Description of Artificial Sequence: Synthetic oligonucleotide
  Target: ATXN1; (-) strand; PAM type: YTN; PAM sequence: CTT
catatgaatgtgtgtgttaa

SEQ ID NO: 224707 - DNA, 20 bp, Artificial Sequence
  Description of Artificial Sequence: Synthetic oligonucleotide
  Target: ATXN1; (-) strand; PAM type: YTN; PAM sequence: TTG
tacccttcatatgaatgtgt

SEQ ID NO: 224708 - DNA, 20 bp, Artificial Sequence
  Description of Artificial Sequence: Synthetic oligonucleotide
  Target: ATXN1; (-) strand; PAM type: YTN; PAM sequence: TTT
gtacccttcatatgaatgtg

SEQ ID NO: 224709 - DNA, 20 bp, Artificial Sequence
  Description of Artificial Sequence: Synthetic oligonucleotide
  Target: ATXN1; (-) strand; PAM type: YTN; PAM sequence: TTA
ggtatttgtacccttcatat

SEQ ID NO: 224710 - DNA, 20 bp, Artificial Sequence
  Description of Artificial Sequence: Synthetic oligonucleotide
  Target: ATXN1; (-) strand; PAM type: YTN; PAM sequence: TTC
caaaaattaggtatttgtac

SEQ ID NO: 224711 - DNA, 20 bp, Artificial Sequence
  Description of Artificial Sequence: Synthetic oligonucleotide
  Target: ATXN1; (-) strand; PAM type: YTN; PAM sequence: TTT
ccaaaaattaggtatttgta

SEQ ID NO: 224712 - DNA, 20 bp, Artificial Sequence
  Description of Artificial Sequence: Synthetic oligonucleotide
  Target: ATXN1; (-) strand; PAM type: YTN; PAM sequence: TTT
tccaaaaattaggtatttgt

SEQ ID NO: 224713 - DNA, 20 bp, Artificial Sequence
  Description of Artificial Sequence: Synthetic oligonucleotide
  Target: ATXN1; (-) strand; PAM type: YTN; PAM sequence: TTA
tatgaaatgttttccaaaaa

SEQ ID NO: 224714 - DNA, 20 bp, Artificial Sequence
  Description of Artificial Sequence: Synthetic oligonucleotide
  Target: ATXN1; (-) strand; PAM type: YTN; PAM sequence: TTA
caatggccaaaattatatga

SEQ ID NO: 224715 - DNA, 20 bp, Artificial Sequence
  Description of Artificial Sequence: Synthetic oligonucleotide
  Target: ATXN1; (-) strand; PAM type: YTN; PAM sequence: TTT
acaatggccaaaattatatg

SEQ ID NO: 224716 - DNA, 20 bp, Artificial Sequence
  Description of Artificial Sequence: Synthetic oligonucleotide
  Target: ATXN1; (-) strand; PAM type: YTN; PAM sequence: TTA
tatatttacaatggccaaaa

SEQ ID NO: 224717 - DNA, 20 bp, Artificial Sequence
  Description of Artificial Sequence: Synthetic oligonucleotide
  Target: ATXN1; (-) strand; PAM type: YTN; PAM sequence: TTT
atatatttacaatggccaaa

SEQ ID NO: 224718 - DNA, 20 bp, Artificial Sequence
  Description of Artificial Sequence: Synthetic oligonucleotide
  Target: ATXN1; (-) strand; PAM type: YTN; PAM sequence: TTA
tttatatatttacaatggcc

SEQ ID NO: 224719 - DNA, 20 bp, Artificial Sequence
  Description of Artificial Sequence: Synthetic oligonucleotide
  Target: ATXN1; (-) strand; PAM type: YTN; PAM sequence: TTA
ttatttatatatttacaatg

SEQ ID NO: 224720 - DNA, 20 bp, Artificial Sequence
  Description of Artificial Sequence: Synthetic oligonucleotide
  Target: ATXN1; (-) strand; PAM type: YTN; PAM sequence: TTA
ttattatttatatatttaca

SEQ ID NO: 224721 - DNA, 20 bp, Artificial Sequence
  Description of Artificial Sequence: Synthetic oligonucleotide
  Target: ATXN1; (-) strand; PAM type: YTN; PAM sequence: CTT
attattatttatatatttac

SEQ ID NO: 224722 - DNA, 20 bp, Artificial Sequence
  Description of Artificial Sequence: Synthetic oligonucleotide
  Target: ATXN1; (-) strand; PAM type: YTN; PAM sequence: TTC
ttattattatttatatattt

SEQ ID NO: 224723 - DNA, 20 bp, Artificial Sequence
  Description of Artificial Sequence: Synthetic oligonucleotide
  Target: ATXN1; (-) strand; PAM type: YTN; PAM sequence: CTT
cttattattatttatatatt

SEQ ID NO: 224724 - DNA, 20 bp, Artificial Sequence
  Description of Artificial Sequence: Synthetic oligonucleotide
  Target: ATXN1; (-) strand; PAM type: YTN; PAM sequence: TTC
ttcttattattatttatata

SEQ ID NO: 224725 - DNA, 20 bp, Artificial Sequence
  Description of Artificial Sequence: Synthetic oligonucleotide
  Target: ATXN1; (-) strand; PAM type: YTN; PAM sequence: CTT
cttcttattattatttatat

SEQ ID NO: 224726 - DNA, 20 bp, Artificial Sequence
  Description of Artificial Sequence: Synthetic oligonucleotide
  Target: ATXN1; (-) strand; PAM type: YTN; PAM sequence: TTG
gtggtggcggtagtggtctt

SEQ ID NO: 224727 - DNA, 20 bp, Artificial Sequence
  Description of Artificial Sequence: Synthetic oligonucleotide
  Target: ATXN1; (-) strand; PAM type: YTN; PAM sequence: TTG
ttggtggtggcggtagtggt

SEQ ID NO: 224728 - DNA, 20 bp, Artificial Sequence
  Description of Artificial Sequence: Synthetic oligonucleotide
  Target: ATXN1; (-) strand; PAM type: YTN; PAM sequence: TTG
ttgttggtggtggcggtagt

SEQ ID NO: 224729 - DNA, 20 bp, Artificial Sequence
  Description of Artificial Sequence: Synthetic oligonucleotide
  Target: ATXN1; (-) strand; PAM type: YTN; PAM sequence: TTT
gttgttggtggtggcggtag

SEQ ID NO: 224730 - DNA, 20 bp, Artificial Sequence
  Description of Artificial Sequence: Synthetic oligonucleotide
  Target: ATXN1; (-) strand; PAM type: YTN; PAM sequence: TTT
tgttgttggtggtggcggta

SEQ ID NO: 224731 - DNA, 20 bp, Artificial Sequence
  Description of Artificial Sequence: Synthetic oligonucleotide
  Target: ATXN1; (-) strand; PAM type: YTN; PAM sequence: TTT
ttgttgttggtggtggcggt

SEQ ID NO: 224732 - DNA, 20 bp, Artificial Sequence
  Description of Artificial Sequence: Synthetic oligonucleotide
  Target: ATXN1; (-) strand; PAM type: YTN; PAM sequence: TTG
tttttgttgttggtggtggc

SEQ ID NO: 224733 - DNA, 20 bp, Artificial Sequence
  Description of Artificial Sequence: Synthetic oligonucleotide
  Target: ATXN1; (-) strand; PAM type: YTN; PAM sequence: CTA
ttgtttttgttgttggtggt

SEQ ID NO: 224734 - DNA, 20 bp, Artificial Sequence
  Description of Artificial Sequence: Synthetic oligonucleotide
  Target: ATXN1; (-) strand; PAM type: YTN; PAM sequence: TTG
ctattgtttttgttgttggt

SEQ ID NO: 224735 - DNA, 20 bp, Artificial Sequence
  Description of Artificial Sequence: Synthetic oligonucleotide
  Target: ATXN1; (-) strand; PAM type: YTN; PAM sequence: TTA
gaaagtggttgctattgttt

SEQ ID NO: 224736 - DNA, 20 bp, Artificial Sequence
  Description of Artificial Sequence: Synthetic oligonucleotide
  Target: ATXN1; (-) strand; PAM type: YTN; PAM sequence: TTT
agaaagtggttgctattgtt

SEQ ID NO: 224737 - DNA, 20 bp, Artificial Sequence
  Description of Artificial Sequence: Synthetic oligonucleotide
  Target: ATXN1; (-) strand; PAM type: YTN; PAM sequence: TTT
tagaaagtggttgctattgt

SEQ ID NO: 224738 - DNA, 20 bp, Artificial Sequence
  Description of Artificial Sequence: Synthetic oligonucleotide
  Target: ATXN1; (-) strand; PAM type: YTN; PAM sequence: TTC
atgttttagaaagtggttgc

SEQ ID NO: 224739 - DNA, 20 bp, Artificial Sequence
  Description of Artificial Sequence: Synthetic oligonucleotide
  Target: ATXN1; (-) strand; PAM type: YTN; PAM sequence: CTT
catgttttagaaagtggttg

SEQ ID NO: 224740 - DNA, 20 bp, Artificial Sequence
  Description of Artificial Sequence: Synthetic oligonucleotide
  Target: ATXN1; (-) strand; PAM type: YTN; PAM sequence: TTA
gccttcatgttttagaaagt

SEQ ID NO: 224741 - DNA, 20 bp, Artificial Sequence
  Description of Artificial Sequence: Synthetic oligonucleotide
  Target: ATXN1; (-) strand; PAM type: YTN; PAM sequence: CTT
agccttcatgttttagaaag

SEQ ID NO: 224742 - DNA, 20 bp, Artificial Sequence
  Description of Artificial Sequence: Synthetic oligonucleotide
  Target: ATXN1; (-) strand; PAM type: YTN; PAM sequence: TTC
cttagccttcatgttttaga

SEQ ID NO: 224743 - DNA, 20 bp, Artificial Sequence
  Description of Artificial Sequence: Synthetic oligonucleotide
  Target: ATXN1; (-) strand; PAM type: YTN; PAM sequence: TTA
ttccttagccttcatgtttt

SEQ ID NO: 224744 - DNA, 20 bp, Artificial Sequence
  Description of Artificial Sequence: Synthetic oligonucleotide
  Target: ATXN1; (-) strand; PAM type: YTN; PAM sequence: CTT
attccttagccttcatgttt

SEQ ID NO: 224745 - DNA, 20 bp, Artificial Sequence
  Description of Artificial Sequence: Synthetic oligonucleotide
  Target: ATXN1; (-) strand; PAM type: YTN; PAM sequence: CTG
cttattccttagccttcatg

SEQ ID NO: 224746 - DNA, 20 bp, Artificial Sequence
  Description of Artificial Sequence: Synthetic oligonucleotide
  Target: ATXN1; (-) strand; PAM type: YTN; PAM sequence: CTG
taagaacacaatggaataca

SEQ ID NO: 224747 - DNA, 20 bp, Artificial Sequence
  Description of Artificial Sequence: Synthetic oligonucleotide
  Target: ATXN1; (-) strand; PAM type: YTN; PAM sequence: CTA
aagtgaaaatatagaacatg

SEQ ID NO: 224748 - DNA, 20 bp, Artificial Sequence
  Description of Artificial Sequence: Synthetic oligonucleotide
  Target: ATXN1; (-) strand; PAM type: YTN; PAM sequence: CTC
taaagtgaaaatatagaaca

SEQ ID NO: 224749 - DNA, 20 bp, Artificial Sequence
  Description of Artificial Sequence: Synthetic oligonucleotide
  Target: ATXN1; (-) strand; PAM type: YTN; PAM sequence: TTC
cacatctctaaagtgaaaat

SEQ ID NO: 224750 - DNA, 20 bp, Artificial Sequence
  Description of Artificial Sequence: Synthetic oligonucleotide
  Target: ATXN1; (-) strand; PAM type: YTN; PAM sequence: TTT
ccacatctctaaagtgaaaa

SEQ ID NO: 224751 - DNA, 20 bp, Artificial Sequence
  Description of Artificial Sequence: Synthetic oligonucleotide
  Target: ATXN1; (-) strand; PAM type: YTN; PAM sequence: TTC
agtttccacatctctaaagt

SEQ ID NO: 224752 - DNA, 20 bp, Artificial Sequence
  Description of Artificial Sequence: Synthetic oligonucleotide
  Target: ATXN1; (-) strand; PAM type: YTN; PAM sequence: CTT
cagtttccacatctctaaag

SEQ ID NO: 224753 - DNA, 20 bp, Artificial Sequence
  Description of Artificial Sequence: Synthetic oligonucleotide
  Target: ATXN1; (-) strand; PAM type: YTN; PAM sequence: CTG
agcttcagtttccacatctc

SEQ ID NO: 224754 - DNA, 20 bp, Artificial Sequence
  Description of Artificial Sequence: Synthetic oligonucleotide
  Target: ATXN1; (-) strand; PAM type: YTN; PAM sequence: TTA
gcctgagcttcagtttccac

SEQ ID NO: 224755 - DNA, 20 bp, Artificial Sequence
  Description of Artificial Sequence: Synthetic oligonucleotide
  Target: ATXN1; (-) strand; PAM type: YTN; PAM sequence: CTT
agcctgagcttcagtttcca

SEQ ID NO: 224756 - DNA, 20 bp, Artificial Sequence
  Description of Artificial Sequence: Synthetic oligonucleotide
  Target: ATXN1; (-) strand; PAM type: YTN; PAM sequence: TTA
cttagcctgagcttcagttt

SEQ ID NO: 224757 - DNA, 20 bp, Artificial Sequence
  Description of Artificial Sequence: Synthetic oligonucleotide
  Target: ATXN1; (-) strand; PAM type: YTN; PAM sequence: TTG
ggcccattacttagcctgag

SEQ ID NO: 224758 - DNA, 20 bp, Artificial Sequence
  Description of Artificial Sequence: Synthetic oligonucleotide
  Target: ATXN1; (-) strand; PAM type: YTN; PAM sequence: CTT
gggcccattacttagcctga

SEQ ID NO: 224759 - DNA, 20 bp, Artificial Sequence
  Description of Artificial Sequence: Synthetic oligonucleotide
  Target: ATXN1; (-) strand; PAM type: YTN; PAM sequence: TTG
agatcttgggcccattactt

SEQ ID NO: 224760 - DNA, 20 bp, Artificial Sequence
  Description of Artificial Sequence: Synthetic oligonucleotide
  Target: ATXN1; (-) strand; PAM type: YTN; PAM sequence: TTT
gagatcttgggcccattact

SEQ ID NO: 224761 - DNA, 20 bp, Artificial Sequence
  Description of Artificial Sequence: Synthetic oligonucleotide
  Target: ATXN1; (-) strand; PAM type: YTN; PAM sequence: CTG
ccaatttgagatcttgggcc

SEQ ID NO: 224762 - DNA, 20 bp, Artificial Sequence
  Description of Artificial Sequence: Synthetic oligonucleotide
  Target: ATXN1; (-) strand; PAM type: YTN; PAM sequence: TTG
aacccagatctgccaatttg

SEQ ID NO: 224763 - DNA, 20 bp, Artificial Sequence
  Description of Artificial Sequence: Synthetic oligonucleotide
  Target: ATXN1; (-) strand; PAM type: YTN; PAM sequence: TTT
gaacccagatctgccaattt

SEQ ID NO: 224764 - DNA, 20 bp, Artificial Sequence
  Description of Artificial Sequence: Synthetic oligonucleotide
  Target: ATXN1; (-) strand; PAM type: YTN; PAM sequence: TTT
tgaacccagatctgccaatt

SEQ ID NO: 224765 - DNA, 20 bp, Artificial Sequence
  Description of Artificial Sequence: Synthetic oligonucleotide
  Target: ATXN1; (-) strand; PAM type: YTN; PAM sequence: CTA
aggttttgaacccagatctg

SEQ ID NO: 224766 - DNA, 20 bp, Artificial Sequence
  Description of Artificial Sequence: Synthetic oligonucleotide
  Target: ATXN1; (-) strand; PAM type: YTN; PAM sequence: CTG
actaaggttttgaacccaga

SEQ ID NO: 224767 - DNA, 20 bp, Artificial Sequence
  Description of Artificial Sequence: Synthetic oligonucleotide
  Target: ATXN1; (-) strand; PAM type: YTN; PAM sequence: TTC
tgactaaggttttgaaccca

SEQ ID NO: 224768 - DNA, 20 bp, Artificial Sequence
  Description of Artificial Sequence: Synthetic oligonucleotide
  Target: ATXN1; (-) strand; PAM type: YTN; PAM sequence: CTC
gttctgactaaggttttgaa

SEQ ID NO: 224769 - DNA, 20 bp, Artificial Sequence
  Description of Artificial Sequence: Synthetic oligonucleotide
  Target: ATXN1; (-) strand; PAM type: YTN; PAM sequence: CTG
ggctcgttctgactaaggtt

SEQ ID NO: 224770 - DNA, 20 bp, Artificial Sequence
  Description of Artificial Sequence: Synthetic oligonucleotide
  Target: ATXN1; (-) strand; PAM type: YTN; PAM sequence: CTG
tatgggaggtctgggctcgt

SEQ ID NO: 224771 - DNA, 20 bp, Artificial Sequence
  Description of Artificial Sequence: Synthetic oligonucleotide
  Target: ATXN1; (-) strand; PAM type: YTN; PAM sequence: CTG
cctgtatgggaggtctgggc

SEQ ID NO: 224772 - DNA, 20 bp, Artificial Sequence
  Description of Artificial Sequence: Synthetic oligonucleotide
  Target: ATXN1; (-) strand; PAM type: YTN; PAM sequence: CTC
tgcctgtatgggaggtctgg

SEQ ID NO: 224773 - DNA, 20 bp, Artificial Sequence
  Description of Artificial Sequence: Synthetic oligonucleotide
  Target: ATXN1; (-) strand; PAM type: YTN; PAM sequence: CTG
caaagacctctgcctgtatg

SEQ ID NO: 224774 - DNA, 20 bp, Artificial Sequence
  Description of Artificial Sequence: Synthetic oligonucleotide
  Target: ATXN1; (-) strand; PAM type: YTN; PAM sequence: TTC
ccatctgcaaagacctctgc

SEQ ID NO: 224775 - DNA, 20 bp, Artificial Sequence
  Description of Artificial Sequence: Synthetic oligonucleotide
  Target: ATXN1; (-) strand; PAM type: YTN; PAM sequence: CTT
cccatctgcaaagacctctg

SEQ ID NO: 224776 - DNA, 20 bp, Artificial Sequence
  Description of Artificial Sequence: Synthetic oligonucleotide
  Target: ATXN1; (-) strand; PAM type: YTN; PAM sequence: CTA
tccatatcttcccatctgca

SEQ ID NO: 224777 - DNA, 20 bp, Artificial Sequence
  Description of Artificial Sequence: Synthetic oligonucleotide
  Target: ATXN1; (-) strand; PAM type: YTN; PAM sequence: TTA
tctatccatatcttcccatc

SEQ ID NO: 224778 - DNA, 20 bp, Artificial Sequence
  Description of Artificial Sequence: Synthetic oligonucleotide
  Target: ATXN1; (-) strand; PAM type: YTN; PAM sequence: CTT
atctatccatatcttcccat

SEQ ID NO: 224779 - DNA, 20 bp, Artificial Sequence
  Description of Artificial Sequence: Synthetic oligonucleotide
  Target: ATXN1; (-) strand; PAM type: YTN; PAM sequence: TTA
agtagaggagaaagcttatc

SEQ ID NO: 224780 - DNA, 20 bp, Artificial Sequence
  Description of Artificial Sequence: Synthetic oligonucleotide
  Target: ATXN1; (-) strand; PAM type: YTN; PAM sequence: CTT
aagtagaggagaaagcttat

SEQ ID NO: 224781 - DNA, 20 bp, Artificial Sequence
  Description of Artificial Sequence: Synthetic oligonucleotide
  Target: ATXN1; (-) strand; PAM type: YTN; PAM sequence: CTG
agcttaagtagaggagaaag

SEQ ID NO: 224782 - DNA, 20 bp, Artificial Sequence
  Description of Artificial Sequence: Synthetic oligonucleotide
  Target: ATXN1; (-) strand; PAM type: YTN; PAM sequence: CTC
agtgtacagatacactgagc

SEQ ID NO: 224783 - DNA, 20 bp, Artificial Sequence
  Description of Artificial Sequence: Synthetic oligonucleotide
  Target: ATXN1; (-) strand; PAM type: YTN; PAM sequence: CTA
ctcagtgtacagatacactg

SEQ ID NO: 224784 - DNA, 20 bp, Artificial Sequence
  Description of Artificial Sequence: Synthetic oligonucleotide
  Target: ATXN1; (-) strand; PAM type: YTN; PAM sequence: CTA
catggctactcagtgtacag

SEQ ID NO: 224785 - DNA, 20 bp, Artificial Sequence
  Description of Artificial Sequence: Synthetic oligonucleotide
  Target: ATXN1; (-) strand; PAM type: YTN; PAM sequence: TTA
tgctacatggctactcagtg

SEQ ID NO: 224786 - DNA, 20 bp, Artificial Sequence
  Description of Artificial Sequence: Synthetic oligonucleotide
  Target: ATXN1; (-) strand; PAM type: YTN; PAM sequence: CTC
caccattatgctacatggct

SEQ ID NO: 224787 - DNA, 20 bp, Artificial Sequence
  Description of Artificial Sequence: Synthetic oligonucleotide
  Target: ATXN1; (-) strand; PAM type: YTN; PAM sequence: CTC
cagagcccatgcactccacc

SEQ ID NO: 224788 - DNA, 20 bp, Artificial Sequence
  Description of Artificial Sequence: Synthetic oligonucleotide
  Target: ATXN1; (-) strand; PAM type: YTN; PAM sequence: TTG
gctccagagcccatgcactc

SEQ ID NO: 224789 - DNA, 20 bp, Artificial Sequence
  Description of Artificial Sequence: Synthetic oligonucleotide
  Target: ATXN1; (-) strand; PAM type: YTN; PAM sequence: TTT
ggctccagagcccatgcact

SEQ ID NO: 224790 - DNA, 20 bp, Artificial Sequence
  Description of Artificial Sequence: Synthetic oligonucleotide
  Target: ATXN1; (-) strand; PAM type: YTN; PAM sequence: CTT
tggctccagagcccatgcac

SEQ ID NO: 224791 - DNA, 20 bp, Artificial Sequence
  Description of Artificial Sequence: Synthetic oligonucleotide
  Target: ATXN1; (-) strand; PAM type: YTN; PAM sequence: TTA
gagctttggctccagagccc

SEQ ID NO: 224792 - DNA, 20 bp, Artificial Sequence
  Description of Artificial Sequence: Synthetic oligonucleotide
  Target: ATXN1; (-) strand; PAM type: YTN; PAM sequence: CTT
agagctttggctccagagcc

SEQ ID NO: 224793 - DNA, 20 bp, Artificial Sequence
  Description of Artificial Sequence: Synthetic oligonucleotide
  Target: ATXN1; (-) strand; PAM type: YTN; PAM sequence: CTG
aacttagagctttggctcca

SEQ ID NO: 224794 - DNA, 20 bp, Artificial Sequence
  Description of Artificial Sequence: Synthetic oligonucleotide
  Target: ATXN1; (-) strand; PAM type: YTN; PAM sequence: CTG
aaatctgaacttagagcttt

SEQ ID NO: 224795 - DNA, 20 bp, Artificial Sequence
  Description of Artificial Sequence: Synthetic oligonucleotide
  Target: ATXN1; (-) strand; PAM type: YTN; PAM sequence: CTA
gtgagtggcggagctgaaat

SEQ ID NO: 224796 - DNA, 20 bp, Artificial Sequence
  Description of Artificial Sequence: Synthetic oligonucleotide
  Target: ATXN1; (-) strand; PAM type: YTN; PAM sequence: TTA
gggcatgcactagtgagtgg

SEQ ID NO: 224797 - DNA, 20 bp, Artificial Sequence
  Description of Artificial Sequence: Synthetic oligonucleotide
  Target: ATXN1; (-) strand; PAM type: YTN; PAM sequence: CTG
agaggcacagagaagttagg

SEQ ID NO: 224798 - DNA, 20 bp, Artificial Sequence
  Description of Artificial Sequence: Synthetic oligonucleotide
  Target: ATXN1; (-) strand; PAM type: YTN; PAM sequence: CTG
aggccactgagaggcacaga

SEQ ID NO: 224799 - DNA, 20 bp, Artificial Sequence
  Description of Artificial Sequence: Synthetic oligonucleotide
  Target: ATXN1; (-) strand; PAM type: YTN; PAM sequence: TTC
agagctgaggccactgagag

SEQ ID NO: 224800 - DNA, 20 bp, Artificial Sequence
  Description of Artificial Sequence: Synthetic oligonucleotide
  Target: ATXN1; (-) strand; PAM type: YTN; PAM sequence: CTT
cagagctgaggccactgaga

SEQ ID NO: 224801 - DNA, 20 bp, Artificial Sequence
  Description of Artificial Sequence: Synthetic oligonucleotide
  Target: ATXN1; (-) strand; PAM type: YTN; PAM sequence: CTC
atcttcagagctgaggccac

SEQ ID NO: 224802 - DNA, 20 bp, Artificial Sequence
  Description of Artificial Sequence: Synthetic oligonucleotide
  Target: ATXN1; (-) strand; PAM type: YTN; PAM sequence: TTC
tcatcttcagagctgaggcc

SEQ ID NO: 224803 - DNA, 20 bp, Artificial Sequence
  Description of Artificial Sequence: Synthetic oligonucleotide
  Target: ATXN1; (-) strand; PAM type: YTN; PAM sequence: TTA
cgattctcatcttcagagct

SEQ ID NO: 224804 - DNA, 20 bp, Artificial Sequence
  Description of Artificial Sequence: Synthetic oligonucleotide
  Target: ATXN1; (-) strand; PAM type: YTN; PAM sequence: CTA
ttacgattctcatcttcaga

SEQ ID NO: 224805 - DNA, 20 bp, Artificial Sequence
  Description of Artificial Sequence: Synthetic oligonucleotide
  Target: ATXN1; (-) strand; PAM type: YTN; PAM sequence: CTG
gtactattacgattctcatc

SEQ ID NO: 224806 - DNA, 20 bp, Artificial Sequence
  Description of Artificial Sequence: Synthetic oligonucleotide
  Target: ATXN1; (-) strand; PAM type: YTN; PAM sequence: TTC
tggtactattacgattctca

SEQ ID NO: 224807 - DNA, 20 bp, Artificial Sequence
  Description of Artificial Sequence: Synthetic oligonucleotide
  Target: ATXN1; (-) strand; PAM type: YTN; PAM sequence: CTT
ctggtactattacgattctc

SEQ ID NO: 224808 - DNA, 20 bp, Artificial Sequence
  Description of Artificial Sequence: Synthetic oligonucleotide
  Target: ATXN1; (-) strand; PAM type: YTN; PAM sequence: TTC
ttctggtactattacgattc

SEQ ID NO: 224809 - DNA, 20 bp, Artificial Sequence
  Description of Artificial Sequence: Synthetic oligonucleotide
  Target: ATXN1; (-) strand; PAM type: YTN; PAM sequence: TTA
gtaggtagatatcagttctt

SEQ ID NO: 224810 - DNA, 20 bp, Artificial Sequence
  Description of Artificial Sequence: Synthetic oligonucleotide
  Target: ATXN1; (-) strand; PAM type: YTN; PAM sequence: CTG
ttagtaggtagatatcagtt

SEQ ID NO: 224811 - DNA, 20 bp, Artificial Sequence
  Description of Artificial Sequence: Synthetic oligonucleotide
  Target: ATXN1; (-) strand; PAM type: YTN; PAM sequence: CTC
acagtggccctgttagtagg

SEQ ID NO: 224812 - DNA, 20 bp, Artificial Sequence
  Description of Artificial Sequence: Synthetic oligonucleotide
  Target: ATXN1; (-) strand; PAM type: YTN; PAM sequence: TTA
atcctcacagtggccctgtt

SEQ ID NO: 224813 - DNA, 20 bp, Artificial Sequence
  Description of Artificial Sequence: Synthetic oligonucleotide
  Target: ATXN1; (-) strand; PAM type: YTN; PAM sequence: TTT
aatcctcacagtggccctgt

SEQ ID NO: 224814 - DNA, 20 bp, Artificial Sequence
  Description of Artificial Sequence: Synthetic oligonucleotide
  Target: ATXN1; (-) strand; PAM type: YTN; PAM sequence: CTC
atttaatcctcacagtggcc

SEQ ID NO: 224815 - DNA, 20 bp, Artificial Sequence
  Description of Artificial Sequence: Synthetic oligonucleotide
  Target: ATXN1; (-) strand; PAM type: YTN; PAM sequence: CTG
tatgtgtagtaactcattta

SEQ ID NO: 224816 - DNA, 20 bp, Artificial Sequence
  Description of Artificial Sequence: Synthetic oligonucleotide
  Target: ATXN1; (-) strand; PAM type: YTN; PAM sequence: TTG
tgctgtatgtgtagtaactc

SEQ ID NO: 224817 - DNA, 20 bp, Artificial Sequence
  Description of Artificial Sequence: Synthetic oligonucleotide
  Target: ATXN1; (-) strand; PAM type: YTN; PAM sequence: TTT
gtgctgtatgtgtagtaact

SEQ ID NO: 224818 - DNA, 20 bp, Artificial Sequence
  Description of Artificial Sequence: Synthetic oligonucleotide
  Target: ATXN1; (-) strand; PAM type: YTN; PAM sequence: CTT
tgtgctgtatgtgtagtaac

SEQ ID NO: 224819 - DNA, 20 bp, Artificial Sequence
  Description of Artificial Sequence: Synthetic oligonucleotide
  Target: ATXN1; (-) strand; PAM type: YTN; PAM sequence: TTC
tttgtgctgtatgtgtagta

SEQ ID NO: 224820 - DNA, 20 bp, Artificial Sequence
  Description of Artificial Sequence: Synthetic oligonucleotide
  Target: ATXN1; (-) strand; PAM type: YTN; PAM sequence: CTG
atgttctttgtgctgtatgt

SEQ ID NO: 224821 - DNA, 20 bp, Artificial Sequence
  Description of Artificial Sequence: Synthetic oligonucleotide
  Target: ATXN1; (-) strand; PAM type: YTN; PAM sequence: CTC
tgatgttctttgtgctgtat

SEQ ID NO: 224822 - DNA, 20 bp, Artificial Sequence
  Description of Artificial Sequence: Synthetic oligonucleotide
  Target: ATXN1; (-) strand; PAM type: YTN; PAM sequence: CTC
acatctctgatgttctttgt

SEQ ID NO: 224823 - DNA, 20 bp, Artificial Sequence
  Description of Artificial Sequence: Synthetic oligonucleotide
  Target: ATXN1; (-) strand; PAM type: YTN; PAM sequence: TTG
ctcacatctctgatgttctt

SEQ ID NO: 224824 - DNA, 20 bp, Artificial Sequence
  Description of Artificial Sequence: Synthetic oligonucleotide
  Target: ATXN1; (-) strand; PAM type: YTN; PAM sequence: TTT
gctcacatctctgatgttct

SEQ ID NO: 224825 - DNA, 20 bp, Artificial Sequence
  Description of Artificial Sequence: Synthetic oligonucleotide
  Target: ATXN1; (-) strand; PAM type: YTN; PAM sequence: CTA
aacatttgctcacatctctg

SEQ ID NO: 224826 - DNA, 20 bp, Artificial Sequence
  Description of Artificial Sequence: Synthetic oligonucleotide
  Target: ATXN1; (-) strand; PAM type: YTN; PAM sequence: TTC
aaaggatactaaacatttgc

SEQ ID NO: 224827 - DNA, 20 bp, Artificial Sequence
  Description of Artificial Sequence: Synthetic oligonucleotide
  Target: ATXN1; (-) strand; PAM type: YTN; PAM sequence: TTT
caaaggatactaaacatttg

SEQ ID NO: 224828 - DNA, 20 bp, Artificial Sequence
  Description of Artificial Sequence: Synthetic oligonucleotide
  Target: ATXN1; (-) strand; PAM type: YTN; PAM sequence: TTA
gtatttcaaaggatactaaa

SEQ ID NO: 224829 - DNA, 20 bp, Artificial Sequence
  Description of Artificial Sequence: Synthetic oligonucleotide
  Target: ATXN1; (-) strand; PAM type: YTN; PAM sequence: TTT
agtatttcaaaggatactaa

SEQ ID NO: 224830 - DNA, 20 bp, Artificial Sequence
  Description of Artificial Sequence: Synthetic oligonucleotide
  Target: ATXN1; (-) strand; PAM type: YTN; PAM sequence: TTT
tagtatttcaaaggatacta

SEQ ID NO: 224831 - DNA, 20 bp, Artificial Sequence
  Description of Artificial Sequence: Synthetic oligonucleotide
  Target: ATXN1; (-) strand; PAM type: YTN; PAM sequence: TTT
ttagtatttcaaaggatact

SEQ ID NO: 224832 - DNA, 20 bp, Artificial Sequence
  Description of Artificial Sequence: Synthetic oligonucleotide
  Target: ATXN1; (-) strand; PAM type: YTN; PAM sequence: CTT
tttagtatttcaaaggatac

SEQ ID NO: 224833 - DNA, 20 bp, Artificial Sequence
  Description of Artificial Sequence: Synthetic oligonucleotide
  Target: ATXN1; (-) strand; PAM type: YTN; PAM sequence: CTC
tttttagtatttcaaaggat

SEQ ID NO: 224834 - DNA, 20 bp, Artificial Sequence
  Description of Artificial Sequence: Synthetic oligonucleotide
  Target: ATXN1; (-) strand; PAM type: YTN; PAM sequence: TTC
agtgctctttttagtatttc

SEQ ID NO: 224835 - DNA, 20 bp, Artificial Sequence
  Description of Artificial Sequence: Synthetic oligonucleotide
  Target: ATXN1; (-) strand; PAM type: YTN; PAM sequence: TTC
aaattcagtgctctttttag

SEQ ID NO: 224836 - DNA, 20 bp, Artificial Sequence
  Description of Artificial Sequence: Synthetic oligonucleotide
  Target: ATXN1; (-) strand; PAM type: YTN; PAM sequence: CTT
caaattcagtgctcttttta

SEQ ID NO: 224837 - DNA, 20 bp, Artificial Sequence
  Description of Artificial Sequence: Synthetic oligonucleotide
  Target: ATXN1; (-) strand; PAM type: YTN; PAM sequence: CTG
gacttcaaattcagtgctct

SEQ ID NO: 224838 - DNA, 20 bp, Artificial Sequence
  Description of Artificial Sequence: Synthetic oligonucleotide
  Target: ATXN1; (-) strand; PAM type: YTN; PAM sequence: CTC
atacagtagatcaatggcgg

SEQ ID NO: 224839 - DNA, 20 bp, Artificial Sequence
  Description of Artificial Sequence: Synthetic oligonucleotide
  Target: ATXN1; (-) strand; PAM type: YTN; PAM sequence: CTA
agctcatacagtagatcaat

SEQ ID NO: 224840 - DNA, 20 bp, Artificial Sequence
  Description of Artificial Sequence: Synthetic oligonucleotide
  Target: ATXN1; (-) strand; PAM type: YTN; PAM sequence: TTG
cctaagctcatacagtagat

SEQ ID NO: 224841 - DNA, 20 bp, Artificial Sequence
  Description of Artificial Sequence: Synthetic oligonucleotide
  Target: ATXN1; (-) strand; PAM type: YTN; PAM sequence: CTT
gcctaagctcatacagtaga

SEQ ID NO: 224842 - DNA, 20 bp, Artificial Sequence
  Description of Artificial Sequence: Synthetic oligonucleotide
  Target: ATXN1; (-) strand; PAM type: YTN; PAM sequence: TTG
agggacttgcctaagctcat

SEQ ID NO: 224843 - DNA, 20 bp, Artificial Sequence
  Description of Artificial Sequence: Synthetic oligonucleotide
  Target: ATXN1; (-) strand; PAM type: YTN; PAM sequence: CTT
gagggacttgcctaagctca

SEQ ID NO: 224844 - DNA, 20 bp, Artificial Sequence
  Description of Artificial Sequence: Synthetic oligonucleotide
  Target: ATXN1; (-) strand; PAM type: YTN; PAM sequence: CTC
aggaagcttgagggacttgc

SEQ ID NO: 224845 - DNA, 20 bp, Artificial Sequence
  Description of Artificial Sequence: Synthetic oligonucleotide
  Target: ATXN1; (-) strand; PAM type: YTN; PAM sequence: TTA
cagatgaggacagtggagct

SEQ ID NO: 224846 - DNA, 20 bp, Artificial Sequence
  Description of Artificial Sequence: Synthetic oligonucleotide
  Target: ATXN1; (-) strand; PAM type: YTN; PAM sequence: TTT
acagatgaggacagtggagc

SEQ ID NO: 224847 - DNA, 20 bp, Artificial Sequence
  Description of Artificial Sequence: Synthetic oligonucleotide
  Target: ATXN1; (-) strand; PAM type: YTN; PAM sequence: TTT
tacagatgaggacagtggag

SEQ ID NO: 224848 - DNA, 20 bp, Artificial Sequence
  Description of Artificial Sequence: Synthetic oligonucleotide
  Target: ATXN1; (-) strand; PAM type: YTN; PAM sequence: TTT
ttacagatgaggacagtgga

SEQ ID NO: 224849 - DNA, 20 bp, Artificial Sequence
  Description of Artificial Sequence: Synthetic oligonucleotide
  Target: ATXN1; (-) strand; PAM type: YTN; PAM sequence: CTG
gtatcccatttttacagatg

SEQ ID NO: 224850 - DNA, 20 bp, Artificial Sequence
  Description of Artificial Sequence: Synthetic oligonucleotide
  Target: ATXN1; (-) strand; PAM type: YTN; PAM sequence: CTG
gaaaggaagcaaggccgctg

SEQ ID NO: 224851 - DNA, 20 bp, Artificial Sequence
  Description of Artificial Sequence: Synthetic oligonucleotide
  Target: ATXN1; (-) strand; PAM type: YTN; PAM sequence: TTC
tggaaaggaagcaaggccgc

SEQ ID NO: 224852 - DNA, 20 bp, Artificial Sequence
  Description of Artificial Sequence: Synthetic oligonucleotide
  Target: ATXN1; (-) strand; PAM type: YTN; PAM sequence: TTG
tgatgttctggaaaggaagc

SEQ ID NO: 224853 - DNA, 20 bp, Artificial Sequence
  Description of Artificial Sequence: Synthetic oligonucleotide
  Target: ATXN1; (-) strand; PAM type: YTN; PAM sequence: CTT
gtgatgttctggaaaggaag

SEQ ID NO: 224854 - DNA, 20 bp, Artificial Sequence
  Description of Artificial Sequence: Synthetic oligonucleotide
  Target: ATXN1; (-) strand; PAM type: YTN; PAM sequence: TTC
ttgtgatgttctggaaagga

SEQ ID NO: 224855 - DNA, 20 bp, Artificial Sequence
  Description of Artificial Sequence: Synthetic oligonucleotide
  Target: ATXN1; (-) strand; PAM type: YTN; PAM sequence: TTT
cttgtgatgttctggaaagg

SEQ ID NO: 224856 - DNA, 20 bp, Artificial Sequence
  Description of Artificial Sequence: Synthetic oligonucleotide
  Target: ATXN1; (-) strand; PAM type: YTN; PAM sequence: TTG
tttcttgtgatgttctggaa

SEQ ID NO: 224857 - DNA, 20 bp, Artificial Sequence
  Description of Artificial Sequence: Synthetic oligonucleotide
  Target: ATXN1; (-) strand; PAM type: YTN; PAM sequence: CTT
gtttcttgtgatgttctgga

SEQ ID NO: 224858 - DNA, 20 bp, Artificial Sequence
  Description of Artificial Sequence: Synthetic oligonucleotide
  Target: ATXN1; (-) strand; PAM type: YTN; PAM sequence: TTG
cttgtttcttgtgatgttct

SEQ ID NO: 224859 - DNA, 20 bp, Artificial Sequence
  Description of Artificial Sequence: Synthetic oligonucleotide
  Target: ATXN1; (-) strand; PAM type: YTN; PAM sequence: TTC
cattgcttgtttcttgtgat

SEQ ID NO: 224860 - DNA, 20 bp, Artificial Sequence
  Description of Artificial Sequence: Synthetic oligonucleotide
  Target: ATXN1; (-) strand; PAM type: YTN; PAM sequence: CTT
ccattgcttgtttcttgtga

SEQ ID NO: 224861 - DNA, 20 bp, Artificial Sequence
  Description of Artificial Sequence: Synthetic oligonucleotide
  Target: ATXN1; (-) strand; PAM type: YTN; PAM sequence: TTG
tcttccattgcttgtttctt

SEQ ID NO: 224862 - DNA, 20 bp, Artificial Sequence
  Description of Artificial Sequence: Synthetic oligonucleotide
  Target: ATXN1; (-) strand; PAM type: YTN; PAM sequence: CTT
gtcttccattgcttgtttct

SEQ ID NO: 224863 - DNA, 20 bp, Artificial Sequence
  Description of Artificial Sequence: Synthetic oligonucleotide
  Target: ATXN1; (-) strand; PAM type: YTN; PAM sequence: TTC
acataccttgtcttccattg

SEQ ID NO: 224864 - DNA, 20 bp, Artificial Sequence
  Description of Artificial Sequence: Synthetic oligonucleotide
  Target: ATXN1; (-) strand; PAM type: YTN; PAM sequence: TTT
cacataccttgtcttccatt

SEQ ID NO: 224865 - DNA, 20 bp, Artificial Sequence
  Description of Artificial Sequence: Synthetic oligonucleotide
  Target: ATXN1; (-) strand; PAM type: YTN; PAM sequence: CTT
tcacataccttgtcttccat

SEQ ID NO: 224866 - DNA, 20 bp, Artificial Sequence
  Description of Artificial Sequence: Synthetic oligonucleotide
  Target: ATXN1; (-) strand; PAM type: YTN; PAM sequence: TTC
caaagccctttcacatacct

SEQ ID NO: 224867 - DNA, 20 bp, Artificial Sequence
  Description of Artificial Sequence: Synthetic oligonucleotide
  Target: ATXN1; (-) strand; PAM type: YTN; PAM sequence: CTT
ccaaagccctttcacatacc

SEQ ID NO: 224868 - DNA, 20 bp, Artificial Sequence
  Description of Artificial Sequence: Synthetic oligonucleotide
  Target: ATXN1; (-) strand; PAM type: YTN; PAM sequence: TTA
gcttccaaagccctttcaca

SEQ ID NO: 224869 - DNA, 20 bp, Artificial Sequence
  Description of Artificial Sequence: Synthetic oligonucleotide
  Target: ATXN1; (-) strand; PAM type: YTN; PAM sequence: TTT
agcttccaaagccctttcac

SEQ ID NO: 224870 - DNA, 20 bp, Artificial Sequence
  Description of Artificial Sequence: Synthetic oligonucleotide
  Target: ATXN1; (-) strand; PAM type: YTN; PAM sequence: TTT
tagcttccaaagccctttca

SEQ ID NO: 224871 - DNA, 20 bp, Artificial Sequence
  Description of Artificial Sequence: Synthetic oligonucleotide
  Target: ATXN1; (-) strand; PAM type: YTN; PAM sequence: TTT
ttagcttccaaagccctttc

SEQ ID NO: 224872 - DNA, 20 bp, Artificial Sequence
  Description of Artificial Sequence: Synthetic oligonucleotide
  Target: ATXN1; (-) strand; PAM type: YTN; PAM sequence: CTT
tttagcttccaaagcccttt

SEQ ID NO: 224873 - DNA, 20 bp, Artificial Sequence
  Description of Artificial Sequence: Synthetic oligonucleotide
  Target: ATXN1; (-) strand; PAM type: YTN; PAM sequence: TTC
acatgtacatggtatatata

SEQ ID NO: 224874 - DNA, 20 bp, Artificial Sequence
  Description of Artificial Sequence: Synthetic oligonucleotide
  Target: ATXN1; (-) strand; PAM type: YTN; PAM sequence: TTG
atgacgataattcacatgta

SEQ ID NO: 224875 - DNA, 20 bp, Artificial Sequence
  Description of Artificial Sequence: Synthetic oligonucleotide
  Target: ATXN1; (-) strand; PAM type: YTN; PAM sequence: CTG
aaagttgatgacgataattc

SEQ ID NO: 224876 - DNA, 20 bp, Artificial Sequence
  Description of Artificial Sequence: Synthetic oligonucleotide
  Target: ATXN1; (-) strand; PAM type: YTN; PAM sequence: TTG
agaggctgaaagttgatgac

SEQ ID NO: 224877 - DNA, 20 bp, Artificial Sequence
  Description of Artificial Sequence: Synthetic oligonucleotide
  Target: ATXN1; (-) strand; PAM type: YTN; PAM sequence: TTT
gagaggctgaaagttgatga

SEQ ID NO: 224878 - DNA, 20 bp, Artificial Sequence
  Description of Artificial Sequence: Synthetic oligonucleotide
  Target: ATXN1; (-) strand; PAM type: YTN; PAM sequence: CTT
tgagaggctgaaagttgatg

SEQ ID NO: 224879 - DNA, 20 bp, Artificial Sequence
  Description of Artificial Sequence: Synthetic oligonucleotide
  Target: ATXN1; (-) strand; PAM type: YTN; PAM sequence: TTG
gctttgagaggctgaaagtt

SEQ ID NO: 224880 - DNA, 20 bp, Artificial Sequence
  Description of Artificial Sequence: Synthetic oligonucleotide
  Target: ATXN1; (-) strand; PAM type: YTN; PAM sequence: TTT
ggctttgagaggctgaaagt

SEQ ID NO: 224881 - DNA, 20 bp, Artificial Sequence
  Description of Artificial Sequence: Synthetic oligonucleotide
  Target: ATXN1; (-) strand; PAM type: YTN; PAM sequence: CTT
tggctttgagaggctgaaag

SEQ ID NO: 224882 - DNA, 20 bp, Artificial Sequence
  Description of Artificial Sequence: Synthetic oligonucleotide
  Target: ATXN1; (-) strand; PAM type: YTN; PAM sequence: CTC
tttggctttgagaggctgaa

SEQ ID NO: 224883 - DNA, 20 bp, Artificial Sequence
  Description of Artificial Sequence: Synthetic oligonucleotide
  Target: ATXN1; (-) strand; PAM type: YTN; PAM sequence: TTG
acctctttggctttgagagg

SEQ ID NO: 224884 - DNA, 20 bp, Artificial Sequence
  Description of Artificial Sequence: Synthetic oligonucleotide
  Target: ATXN1; (-) strand; PAM type: YTN; PAM sequence: CTC
aggcaggagagaatggaata

SEQ ID NO: 224885 - DNA, 20 bp, Artificial Sequence
  Description of Artificial Sequence: Synthetic oligonucleotide
  Target: ATXN1; (-) strand; PAM type: YTN; PAM sequence: TTC
tcaggcaggagagaatggaa

SEQ ID NO: 224886 - DNA, 20 bp, Artificial Sequence
  Description of Artificial Sequence: Synthetic oligonucleotide
  Target: ATXN1; (-) strand; PAM type: YTN; PAM sequence: TTA
aattctcaggcaggagagaa

SEQ ID NO: 224887 - DNA, 20 bp, Artificial Sequence
  Description of Artificial Sequence: Synthetic oligonucleotide
  Target: ATXN1; (-) strand; PAM type: YTN; PAM sequence: TTA
gtattaaattctcaggcagg

SEQ ID NO: 224888 - DNA, 20 bp, Artificial Sequence
  Description of Artificial Sequence: Synthetic oligonucleotide
  Target: ATXN1; (-) strand; PAM type: YTN; PAM sequence: CTT
agtattaaattctcaggcag

SEQ ID NO: 224889 - DNA, 20 bp, Artificial Sequence
  Description of Artificial Sequence: Synthetic oligonucleotide
  Target: ATXN1; (-) strand; PAM type: YTN; PAM sequence: CTG
atgcttagtattaaattctc

SEQ ID NO: 224890 - DNA, 20 bp, Artificial Sequence
  Description of Artificial Sequence: Synthetic oligonucleotide
  Target: ATXN1; (-) strand; PAM type: YTN; PAM sequence: TTG
gaactgatgcttagtattaa

SEQ ID NO: 224891 - DNA, 20 bp, Artificial Sequence
  Description of Artificial Sequence: Synthetic oligonucleotide
  Target: ATXN1; (-) strand; PAM type: YTN; PAM sequence: TTT
ggaactgatgcttagtatta

SEQ ID NO: 224892 - DNA, 20 bp, Artificial Sequence
  Description of Artificial Sequence: Synthetic oligonucleotide
  Target: ATXN1; (-) strand; PAM type: YTN; PAM sequence: TTT
tggaactgatgcttagtatt

SEQ ID NO: 224893 - DNA, 20 bp, Artificial Sequence
  Description of Artificial Sequence: Synthetic oligonucleotide
  Target: ATXN1; (-) strand; PAM type: YTN; PAM sequence: TTC
agtgtccaggttttggaact

SEQ ID NO: 224894 - DNA, 20 bp, Artificial Sequence
  Description of Artificial Sequence: Synthetic oligonucleotide
  Target: ATXN1; (-) strand; PAM type: YTN; PAM sequence: TTA
gcagttcagtgtccaggttt

SEQ ID NO: 224895 - DNA, 20 bp, Artificial Sequence
  Description of Artificial Sequence: Synthetic oligonucleotide
  Target: ATXN1; (-) strand; PAM type: YTN; PAM sequence: TTA
tgattagcagttcagtgtcc

SEQ ID NO: 224896 - DNA, 20 bp, Artificial Sequence
  Description of Artificial Sequence: Synthetic oligonucleotide
  Target: ATXN1; (-) strand; PAM type: YTN; PAM sequence: CTG
ttatgattagcagttcagtg

SEQ ID NO: 224897 - DNA, 20 bp, Artificial Sequence
  Description of Artificial Sequence: Synthetic oligonucleotide
  Target: ATXN1; (-) strand; PAM type: YTN; PAM sequence: TTC
tgttatgattagcagttcag

SEQ ID NO: 224898 - DNA, 20 bp, Artificial Sequence
  Description of Artificial Sequence: Synthetic oligonucleotide
  Target: ATXN1; (-) strand; PAM type: YTN; PAM sequence: CTG
gacatgtgttctgttatgat

SEQ ID NO: 224899 - DNA, 20 bp, Artificial Sequence
  Description of Artificial Sequence: Synthetic oligonucleotide
  Target: ATXN1; (-) strand; PAM type: YTN; PAM sequence: CTG
ggtgactggacatgtgttct

SEQ ID NO: 224900 - DNA, 20 bp, Artificial Sequence
  Description of Artificial Sequence: Synthetic oligonucleotide
  Target: ATXN1; (-) strand; PAM type: YTN; PAM sequence: TTG
atcaagtcctgggtgactgg

SEQ ID NO: 224901 - DNA, 20 bp, Artificial Sequence
  Description of Artificial Sequence: Synthetic oligonucleotide
  Target: ATXN1; (-) strand; PAM type: YTN; PAM sequence: TTT
gatcaagtcctgggtgactg

SEQ ID NO: 224902 - DNA, 20 bp, Artificial Sequence
  Description of Artificial Sequence: Synthetic oligonucleotide
  Target: ATXN1; (-) strand; PAM type: YTN; PAM sequence: CTG
tttgatcaagtcctgggtga

SEQ ID NO: 224903 - DNA, 20 bp, Artificial Sequence
  Description of Artificial Sequence: Synthetic oligonucleotide
  Target: ATXN1; (-) strand; PAM type: YTN; PAM sequence: TTC
tgtttgatcaagtcctgggt

SEQ ID NO: 224904 - DNA, 20 bp, Artificial Sequence
  Description of Artificial Sequence: Synthetic oligonucleotide
  Target: ATXN1; (-) strand; PAM type: YTN; PAM sequence: TTA
atagagttctgtttgatcaa

SEQ ID NO: 224905 - DNA, 20 bp, Artificial Sequence
  Description of Artificial Sequence: Synthetic oligonucleotide
  Target: ATXN1; (-) strand; PAM type: YTN; PAM sequence: CTC
acggtgggtgtgcagaagga

SEQ ID NO: 224906 - DNA, 20 bp, Artificial Sequence
  Description of Artificial Sequence: Synthetic oligonucleotide
  Target: ATXN1; (-) strand; PAM type: YTN; PAM sequence: TTC
tcacggtgggtgtgcagaag

SEQ ID NO: 224907 - DNA, 20 bp, Artificial Sequence
  Description of Artificial Sequence: Synthetic oligonucleotide
  Target: ATXN1; (-) strand; PAM type: YTN; PAM sequence: TTA
tgttctcacggtgggtgtgc

SEQ ID NO: 224908 - DNA, 20 bp, Artificial Sequence
  Description of Artificial Sequence: Synthetic oligonucleotide
  Target: ATXN1; (-) strand; PAM type: YTN; PAM sequence: TTA
gggccatgatgagcatcaat

SEQ ID NO: 224909 - DNA, 20 bp, Artificial Sequence
  Description of Artificial Sequence: Synthetic oligonucleotide
  Target: ATXN1; (-) strand; PAM type: YTN; PAM sequence: TTT
agggccatgatgagcatcaa

SEQ ID NO: 224910 - DNA, 20 bp, Artificial Sequence
  Description of Artificial Sequence: Synthetic oligonucleotide
  Target: ATXN1; (-) strand; PAM type: YTN; PAM sequence: CTT
tagggccatgatgagcatca

SEQ ID NO: 224911 - DNA, 20 bp, Artificial Sequence
  Description of Artificial Sequence: Synthetic oligonucleotide
  Target: ATXN1; (-) strand; PAM type: YTN; PAM sequence: TTG
gagtgctttagggccatgat

SEQ ID NO: 224912 - DNA, 20 bp, Artificial Sequence
  Description of Artificial Sequence: Synthetic oligonucleotide
  Target: ATXN1; (-) strand; PAM type: YTN; PAM sequence: CTT
ggagtgctttagggccatga

SEQ ID NO: 224913 - DNA, 20 bp, Artificial Sequence
  Description of Artificial Sequence: Synthetic oligonucleotide
  Target: ATXN1; (-) strand; PAM type: YTN; PAM sequence: TTC
agagtcttggagtgctttag

SEQ ID NO: 224914 - DNA, 20 bp, Artificial Sequence
  Description of Artificial Sequence: Synthetic oligonucleotide
  Target: ATXN1; (-) strand; PAM type: YTN; PAM sequence: CTT
cagagtcttggagtgcttta

SEQ ID NO: 224915 - DNA, 20 bp, Artificial Sequence
  Description of Artificial Sequence: Synthetic oligonucleotide
  Target: ATXN1; (-) strand; PAM type: YTN; PAM sequence: CTG
aaggtacttcagagtcttgg

SEQ ID NO: 224916 - DNA, 20 bp, Artificial Sequence
  Description of Artificial Sequence: Synthetic oligonucleotide
  Target: ATXN1; (-) strand; PAM type: YTN; PAM sequence: TTC
cctgaaggtacttcagagtc

SEQ ID NO: 224917 - DNA, 20 bp, Artificial Sequence
  Description of Artificial Sequence: Synthetic oligonucleotide
  Target: ATXN1; (-) strand; PAM type: YTN; PAM sequence: TTT
ccctgaaggtacttcagagt

SEQ ID NO: 224918 - DNA, 20 bp, Artificial Sequence
  Description of Artificial Sequence: Synthetic oligonucleotide
  Target: ATXN1; (-) strand; PAM type: YTN; PAM sequence: CTT
tccctgaaggtacttcagag

SEQ ID NO: 224919 - DNA, 20 bp, Artificial Sequence
  Description of Artificial Sequence: Synthetic oligonucleotide
  Target: ATXN1; (-) strand; PAM type: YTN; PAM sequence: TTA
atctttccctgaaggtactt

SEQ ID NO: 224920 - DNA, 20 bp, Artificial Sequence
  Description of Artificial Sequence: Synthetic oligonucleotide
  Target: ATXN1; (-) strand; PAM type: YTN; PAM sequence: TTT
aatctttccctgaaggtact

SEQ ID NO: 224921 - DNA, 20 bp, Artificial Sequence
  Description of Artificial Sequence: Synthetic oligonucleotide
  Target: ATXN1; (-) strand; PAM type: YTN; PAM sequence: CTG
aacataatttaatctttccc

SEQ ID NO: 224922 - DNA, 20 bp, Artificial Sequence
  Description of Artificial Sequence: Synthetic oligonucleotide
  Target: ATXN1; (-) strand; PAM type: YTN; PAM sequence: CTA
ggctgaacataatttaatct

SEQ ID NO: 224923 - DNA, 20 bp, Artificial Sequence
  Description of Artificial Sequence: Synthetic oligonucleotide
  Target: ATXN1; (-) strand; PAM type: YTN; PAM sequence: TTC
ataataaactaggctgaaca

SEQ ID NO: 224924 - DNA, 20 bp, Artificial Sequence
  Description of Artificial Sequence: Synthetic oligonucleotide
  Target: ATXN1; (-) strand; PAM type: YTN; PAM sequence: CTT
cataataaactaggctgaac

SEQ ID NO: 224925 - DNA, 20 bp, Artificial Sequence
  Description of Artificial Sequence: Synthetic oligonucleotide
  Target: ATXN1; (-) strand; PAM type: YTN; PAM sequence: TTA
aatacacttcataataaact

SEQ ID NO: 224926 - DNA, 20 bp, Artificial Sequence
  Description of Artificial Sequence: Synthetic oligonucleotide
  Target: ATXN1; (-) strand; PAM type: YTN; PAM sequence: TTG
agtataattaaatacacttc

SEQ ID NO: 224927 - DNA, 20 bp, Artificial Sequence
  Description of Artificial Sequence: Synthetic oligonucleotide
  Target: ATXN1; (-) strand; PAM type: YTN; PAM sequence: TTT
gagtataattaaatacactt

SEQ ID NO: 224928 - DNA, 20 bp, Artificial Sequence
  Description of Artificial Sequence: Synthetic oligonucleotide
  Target: ATXN1; (-) strand; PAM type: YTN; PAM sequence: TTC
aaagaatttgagtataatta

SEQ ID NO: 224929 - DNA, 20 bp, Artificial Sequence
  Description of Artificial Sequence: Synthetic oligonucleotide
  Target: ATXN1; (-) strand; PAM type: YTN; PAM sequence: TTT
caaagaatttgagtataatt

SEQ ID NO: 224930 - DNA, 20 bp, Artificial Sequence
  Description of Artificial Sequence: Synthetic oligonucleotide
  Target: ATXN1; (-) strand; PAM type: YTN; PAM sequence: TTT
tcaaagaatttgagtataat

SEQ ID NO: 224931 - DNA, 20 bp, Artificial Sequence
  Description of Artificial Sequence: Synthetic oligonucleotide
  Target: ATXN1; (-) strand; PAM type: YTN; PAM sequence: CTA
ggtcaccaattttcaaagaa

SEQ ID NO: 224932 - DNA, 20 bp, Artificial Sequence
  Description of Artificial Sequence: Synthetic oligonucleotide
  Target: ATXN1; (-) strand; PAM type: YTN; PAM sequence: TTC
ctaggtcaccaattttcaaa

SEQ ID NO: 224933 - DNA, 20 bp, Artificial Sequence
  Description of Artificial Sequence: Synthetic oligonucleotide
  Target: ATXN1; (-) strand; PAM type: YTN; PAM sequence: TTT
cctaggtcaccaattttcaa

SEQ ID NO: 224934 - DNA, 20 bp, Artificial Sequence
  Description of Artificial Sequence: Synthetic oligonucleotide
  Target: ATXN1; (-) strand; PAM type: YTN; PAM sequence: TTT
tcctaggtcaccaattttca

SEQ ID NO: 224935 - DNA, 20 bp, Artificial Sequence
  Description of Artificial Sequence: Synthetic oligonucleotide
  Target: ATXN1; (-) strand; PAM type: YTN; PAM sequence: CTT
ttcctaggtcaccaattttc

SEQ ID NO: 224936 - DNA, 20 bp, Artificial Sequence
  Description of Artificial Sequence: Synthetic oligonucleotide
  Target: ATXN1; (-) strand; PAM type: YTN; PAM sequence: CTG
tgcttttcctaggtcaccaa

SEQ ID NO: 224937 - DNA, 20 bp, Artificial Sequence
  Description of Artificial Sequence: Synthetic oligonucleotide
  Target: ATXN1; (-) strand; PAM type: YTN; PAM sequence: CTC
tgtgcttttcctaggtcacc

SEQ ID NO: 224938 - DNA, 20 bp, Artificial Sequence
  Description of Artificial Sequence: Synthetic oligonucleotide
  Target: ATXN1; (-) strand; PAM type: YTN; PAM sequence: CTC
tctgtgcttttcctaggtca

SEQ ID NO: 224939 - DNA, 20 bp, Artificial Sequence
  Description of Artificial Sequence: Synthetic oligonucleotide
  Target: ATXN1; (-) strand; PAM type: YTN; PAM sequence: TTA
ctctctgtgcttttcctagg

SEQ ID NO: 224940 - DNA, 20 bp, Artificial Sequence
  Description of Artificial Sequence: Synthetic oligonucleotide
  Target: ATXN1; (-) strand; PAM type: YTN; PAM sequence: CTT
actctctgtgcttttcctag

SEQ ID NO: 224941 - DNA, 20 bp, Artificial Sequence
  Description of Artificial Sequence: Synthetic oligonucleotide
  Target: ATXN1; (-) strand; PAM type: YTN; PAM sequence: CTG
tgacttactctctgtgcttt

SEQ ID NO: 224942 - DNA, 20 bp, Artificial Sequence
  Description of Artificial Sequence: Synthetic oligonucleotide
  Target: ATXN1; (-) strand; PAM type: YTN; PAM sequence: TTA
ccagagagcctgtgacttac

SEQ ID NO: 224943 - DNA, 20 bp, Artificial Sequence
  Description of Artificial Sequence: Synthetic oligonucleotide
  Target: ATXN1; (-) strand; PAM type: YTN; PAM sequence: TTC
cagttaccagagagcctgtg

SEQ ID NO: 224944 - DNA, 20 bp, Artificial Sequence
  Description of Artificial Sequence: Synthetic oligonucleotide
  Target: ATXN1; (-) strand; PAM type: YTN; PAM sequence: CTT
ccagttaccagagagcctgt

SEQ ID NO: 224945 - DNA, 20 bp, Artificial Sequence
  Description of Artificial Sequence: Synthetic oligonucleotide
  Target: ATXN1; (-) strand; PAM type: YTN; PAM sequence: CTG
gtgaggagaggcttccagtt

SEQ ID NO: 224946 - DNA, 20 bp, Artificial Sequence
  Description of Artificial Sequence: Synthetic oligonucleotide
  Target: ATXN1; (-) strand; PAM type: YTN; PAM sequence: CTG
ggggtggactggtgaggaga

SEQ ID NO: 224947 - DNA, 20 bp, Artificial Sequence
  Description of Artificial Sequence: Synthetic oligonucleotide
  Target: ATXN1; (-) strand; PAM type: YTN; PAM sequence: CTG
tgaagggtgactgggggtgg

SEQ ID NO: 224948 - DNA, 20 bp, Artificial Sequence
  Description of Artificial Sequence: Synthetic oligonucleotide
  Target: ATXN1; (-) strand; PAM type: YTN; PAM sequence: CTC
tgtgaagggtgactgggggt

SEQ ID NO: 224949 - DNA, 20 bp, Artificial Sequence
  Description of Artificial Sequence: Synthetic oligonucleotide
  Target: ATXN1; (-) strand; PAM type: YTN; PAM sequence: TTA
actctgtgaagggtgactgg

SEQ ID NO: 224950 - DNA, 20 bp, Artificial Sequence
  Description of Artificial Sequence: Synthetic oligonucleotide
  Target: ATXN1; (-) strand; PAM type: YTN; PAM sequence: TTA
caattaactctgtgaagggt

SEQ ID NO: 224951 - DNA, 20 bp, Artificial Sequence
  Description of Artificial Sequence: Synthetic oligonucleotide
  Target: ATXN1; (-) strand; PAM type: YTN; PAM sequence: TTT
acaattaactctgtgaaggg

SEQ ID NO: 224952 - DNA, 20 bp, Artificial Sequence
  Description of Artificial Sequence: Synthetic oligonucleotide
  Target: ATXN1; (-) strand; PAM type: YTN; PAM sequence: TTT
tacaattaactctgtgaagg

SEQ ID NO: 224953 - DNA, 20 bp, Artificial Sequence
  Description of Artificial Sequence: Synthetic oligonucleotide
  Target: ATXN1; (-) strand; PAM type: YTN; PAM sequence: TTT
ttacaattaactctgtgaag

SEQ ID NO: 224954 - DNA, 20 bp, Artificial Sequence
  Description of Artificial Sequence: Synthetic oligonucleotide
  Target: ATXN1; (-) strand; PAM type: YTN; PAM sequence: TTT
tttacaattaactctgtgaa

SEQ ID NO: 224955 - DNA, 20 bp, Artificial Sequence
  Description of Artificial Sequence: Synthetic oligonucleotide
  Target: ATXN1; (-) strand; PAM type: YTN; PAM sequence: CTG
tattttttacaattaactct

SEQ ID NO: 224956 - DNA, 20 bp, Artificial Sequence
  Description of Artificial Sequence: Synthetic oligonucleotide
  Target: ATXN1; (-) strand; PAM type: YTN; PAM sequence: CTA
gggtggactgtattttttac

SEQ ID NO: 224957 - DNA, 20 bp, Artificial Sequence
  Description of Artificial Sequence: Synthetic oligonucleotide
  Target: ATXN1; (-) strand; PAM type: YTN; PAM sequence: CTA
ccctagggtggactgtattt

SEQ ID NO: 224958 - DNA, 20 bp, Artificial Sequence
  Description of Artificial Sequence: Synthetic oligonucleotide
  Target: ATXN1; (-) strand; PAM type: YTN; PAM sequence: TTC
ctaccctagggtggactgta

SEQ ID NO: 224959 - DNA, 20 bp, Artificial Sequence
  Description of Artificial Sequence: Synthetic oligonucleotide
  Target: ATXN1; (-) strand; PAM type: YTN; PAM sequence: TTT
cctaccctagggtggactgt

SEQ ID NO: 224960 - DNA, 20 bp, Artificial Sequence
  Description of Artificial Sequence: Synthetic oligonucleotide
  Target: ATXN1; (-) strand; PAM type: YTN; PAM sequence: TTT
tcctaccctagggtggactg

SEQ ID NO: 224961 - DNA, 20 bp, Artificial Sequence
  Description of Artificial Sequence: Synthetic oligonucleotide
  Target: ATXN1; (-) strand; PAM type: YTN; PAM sequence: TTT
ttcctaccctagggtggact

SEQ ID NO: 224962 - DNA, 20 bp, Artificial Sequence
  Description of Artificial Sequence: Synthetic oligonucleotide
  Target: ATXN1; (-) strand; PAM type: YTN; PAM sequence: TTA
gtgtgtcggaatcccagttt

SEQ ID NO: 224963 - DNA, 20 bp, Artificial Sequence
  Description of Artificial Sequence: Synthetic oligonucleotide
  Target: ATXN1; (-) strand; PAM type: YTN; PAM sequence: TTA
taattagtgtgtcggaatcc

SEQ ID NO: 224964 - DNA, 20 bp, Artificial Sequence
  Description of Artificial Sequence: Synthetic oligonucleotide
  Target: ATXN1; (-) strand; PAM type: YTN; PAM sequence: TTT
ataattagtgtgtcggaatc

SEQ ID NO: 224965 - DNA, 20 bp, Artificial Sequence
  Description of Artificial Sequence: Synthetic oligonucleotide
  Target: ATXN1; (-) strand; PAM type: YTN; PAM sequence: TTT
tataattagtgtgtcggaat

SEQ ID NO: 224966 - DNA, 20 bp, Artificial Sequence
  Description of Artificial Sequence: Synthetic oligonucleotide
  Target: ATXN1; (-) strand; PAM type: YTN; PAM sequence: CTT
ttataattagtgtgtcggaa

SEQ ID NO: 224967 - DNA, 20 bp, Artificial Sequence
  Description of Artificial Sequence: Synthetic oligonucleotide
  Target: ATXN1; (-) strand; PAM type: YTN; PAM sequence: TTG
acttttataattagtgtgtc

SEQ ID NO: 224968 - DNA, 20 bp, Artificial Sequence
  Description of Artificial Sequence: Synthetic oligonucleotide
  Target: ATXN1; (-) strand; PAM type: YTN; PAM sequence: TTT
gacttttataattagtgtgt

SEQ ID NO: 224969 - DNA, 20 bp, Artificial Sequence
  Description of Artificial Sequence: Synthetic oligonucleotide
  Target: ATXN1; (-) strand; PAM type: YTN; PAM sequence: TTT
tgacttttataattagtgtg

SEQ ID NO: 224970 - DNA, 20 bp, Artificial Sequence
  Description of Artificial Sequence: Synthetic oligonucleotide
  Target: ATXN1; (-) strand; PAM type: YTN; PAM sequence: CTT
ttgacttttataattagtgt

SEQ ID NO: 224971 - DNA, 20 bp, Artificial Sequence
  Description of Artificial Sequence: Synthetic oligonucleotide
  Target: ATXN1; (-) strand; PAM type: YTN; PAM sequence: TTC
ttttgacttttataattagt

SEQ ID NO: 224972 - DNA, 20 bp, Artificial Sequence
  Description of Artificial Sequence: Synthetic oligonucleotide
  Target: ATXN1; (-) strand; PAM type: YTN; PAM sequence: TTA
ggcaaggccaagttcttttg

SEQ ID NO: 224973 - DNA, 20 bp, Artificial Sequence
  Description of Artificial Sequence: Synthetic oligonucleotide
  Target: ATXN1; (-) strand; PAM type: YTN; PAM sequence: TTG
aagattaggcaaggccaagt

SEQ ID NO: 224974 - DNA, 20 bp, Artificial Sequence
  Description of Artificial Sequence: Synthetic oligonucleotide
  Target: ATXN1; (-) strand; PAM type: YTN; PAM sequence: CTT
gaagattaggcaaggccaag

SEQ ID NO: 224975 - DNA, 20 bp, Artificial Sequence
  Description of Artificial Sequence: Synthetic oligonucleotide
  Target: ATXN1; (-) strand; PAM type: YTN; PAM sequence: TTA
gtgatccttgaagattaggc

SEQ ID NO: 224976 - DNA, 20 bp, Artificial Sequence
  Description of Artificial Sequence: Synthetic oligonucleotide
  Target: ATXN1; (-) strand; PAM type: YTN; PAM sequence: CTG
cacattagtgatccttgaag

SEQ ID NO: 224977 - DNA, 20 bp, Artificial Sequence
  Description of Artificial Sequence: Synthetic oligonucleotide
  Target: ATXN1; (-) strand; PAM type: YTN; PAM sequence: TTC
tgcacattagtgatccttga

SEQ ID NO: 224978 - DNA, 20 bp, Artificial Sequence
  Description of Artificial Sequence: Synthetic oligonucleotide
  Target: ATXN1; (-) strand; PAM type: YTN; PAM sequence: TTT
ctgcacattagtgatccttg

SEQ ID NO: 224979 - DNA, 20 bp, Artificial Sequence
  Description of Artificial Sequence: Synthetic oligonucleotide
  Target: ATXN1; (-) strand; PAM type: YTN; PAM sequence: TTG
tatttctgcacattagtgat

SEQ ID NO: 224980 - DNA, 20 bp, Artificial Sequence
  Description of Artificial Sequence: Synthetic oligonucleotide
  Target: ATXN1; (-) strand; PAM type: YTN; PAM sequence: TTT
gtatttctgcacattagtga

SEQ ID NO: 224981 - DNA, 20 bp, Artificial Sequence
  Description of Artificial Sequence: Synthetic oligonucleotide
  Target: ATXN1; (-) strand; PAM type: YTN; PAM sequence: TTT
tgtatttctgcacattagtg

SEQ ID NO: 224982 - DNA, 20 bp, Artificial Sequence
  Description of Artificial Sequence: Synthetic oligonucleotide
  Target: ATXN1; (-) strand; PAM type: YTN; PAM sequence: CTT
ttgtatttctgcacattagt

SEQ ID NO: 224983 - DNA, 20 bp, Artificial Sequence
  Description of Artificial Sequence: Synthetic oligonucleotide
  Target: ATXN1; (-) strand; PAM type: YTN; PAM sequence: TTG
acttttgtatttctgcacat

SEQ ID NO: 224984 - DNA, 20 bp, Artificial Sequence
  Description of Artificial Sequence: Synthetic oligonucleotide
  Target: ATXN1; (-) strand; PAM type: YTN; PAM sequence: TTT
gacttttgtatttctgcaca

SEQ ID NO: 224985 - DNA, 20 bp, Artificial Sequence
  Description of Artificial Sequence: Synthetic oligonucleotide
  Target: ATXN1; (-) strand; PAM type: YTN; PAM sequence: TTT
tgacttttgtatttctgcac

SEQ ID NO: 224986 - DNA, 20 bp, Artificial Sequence
  Description of Artificial Sequence: Synthetic oligonucleotide
  Target: ATXN1; (-) strand; PAM type: YTN; PAM sequence: TTC
aagttttgacttttgtattt

SEQ ID NO: 224987 - DNA, 20 bp, Artificial Sequence
  Description of Artificial Sequence: Synthetic oligonucleotide
  Target: ATXN1; (-) strand; PAM type: YTN; PAM sequence: TTT
caagttttgacttttgtatt

SEQ ID NO: 224988 - DNA, 20 bp, Artificial Sequence
  Description of Artificial Sequence: Synthetic oligonucleotide
  Target: ATXN1; (-) strand; PAM type: YTN; PAM sequence: TTG
tttcaagttttgacttttgt

SEQ ID NO: 224989 - DNA, 20 bp, Artificial Sequence
  Description of Artificial Sequence: Synthetic oligonucleotide
  Target: ATXN1; (-) strand; PAM type: YTN; PAM sequence: TTC
attgtttcaagttttgactt

SEQ ID NO: 224990 - DNA, 20 bp, Artificial Sequence
  Description of Artificial Sequence: Synthetic oligonucleotide
  Target: ATXN1; (-) strand; PAM type: YTN; PAM sequence: TTT
cattgtttcaagttttgact

SEQ ID NO: 224991 - DNA, 20 bp, Artificial Sequence
  Description of Artificial Sequence: Synthetic oligonucleotide
  Target: ATXN1; (-) strand; PAM type: YTN; PAM sequence: TTT
tcattgtttcaagttttgac

SEQ ID NO: 224992 - DNA, 20 bp, Artificial Sequence
  Description of Artificial Sequence: Synthetic oligonucleotide
  Target: ATXN1; (-) strand; PAM type: YTN; PAM sequence: TTT
ttcattgtttcaagttttga

SEQ ID NO: 224993 - DNA, 20 bp, Artificial Sequence
  Description of Artificial Sequence: Synthetic oligonucleotide
  Target: ATXN1; (-) strand; PAM type: YTN; PAM sequence: TTA
aatttttcattgtttcaagt

SEQ ID NO: 224994 - DNA, 20 bp, Artificial Sequence
  Description of Artificial Sequence: Synthetic oligonucleotide
  Target: ATXN1; (-) strand; PAM type: YTN; PAM sequence: TTA
ggtagattaaatttttcatt

SEQ ID NO: 224995 - DNA, 20 bp, Artificial Sequence
  Description of Artificial Sequence: Synthetic oligonucleotide
  Target: ATXN1; (-) strand; PAM type: YTN; PAM sequence: CTT
aggtagattaaatttttcat

SEQ ID NO: 224996 - DNA, 20 bp, Artificial Sequence
  Description of Artificial Sequence: Synthetic oligonucleotide
  Target: ATXN1; (-) strand; PAM type: YTN; PAM sequence: TTG
aaacatgtaggcatcttagg

SEQ ID NO: 224997 - DNA, 20 bp, Artificial Sequence
  Description of Artificial Sequence: Synthetic oligonucleotide
  Target: ATXN1; (-) strand; PAM type: YTN; PAM sequence: TTT
gaaacatgtaggcatcttag

SEQ ID NO: 224998 - DNA, 20 bp, Artificial Sequence
  Description of Artificial Sequence: Synthetic oligonucleotide
  Target: ATXN1; (-) strand; PAM type: YTN; PAM sequence: CTA
tttgaaacatgtaggcatct

SEQ ID NO: 224999 - DNA, 20 bp, Artificial Sequence
  Description of Artificial Sequence: Synthetic oligonucleotide
  Target: ATXN1; (-) strand; PAM type: YTN; PAM sequence: TTA
gcaagaacaaaagtctattt

SEQ ID NO: 225000 - DNA, 20 bp, Artificial Sequence
  Description of Artificial Sequence: Synthetic oligonucleotide
  Target: ATXN1; (-) strand; PAM type: YTN; PAM sequence: CTT
agcaagaacaaaagtctatt

SEQ ID NO: 225001 - DNA, 20 bp, Artificial Sequence
  Description of Artificial Sequence: Synthetic oligonucleotide
  Target: ATXN1; (-) strand; PAM type: YTN; PAM sequence: TTC
ttagcaagaacaaaagtcta

SEQ ID NO: 225002 - DNA, 20 bp, Artificial Sequence
  Description of Artificial Sequence: Synthetic oligonucleotide
  Target: ATXN1; (-) strand; PAM type: YTN; PAM sequence: TTC
attcttagcaagaacaaaag

SEQ ID NO: 225003 - DNA, 20 bp, Artificial Sequence
  Description of Artificial Sequence: Synthetic oligonucleotide
  Target: ATXN1; (-) strand; PAM type: YTN; PAM sequence: TTG
aattcattcttagcaagaac

SEQ ID NO: 225004 - DNA, 20 bp, Artificial Sequence
  Description of Artificial Sequence: Synthetic oligonucleotide
  Target: ATXN1; (-) strand; PAM type: YTN; PAM sequence: TTC
aaacaattgaattcattctt

SEQ ID NO: 225005 - DNA, 20 bp, Artificial Sequence
  Description of Artificial Sequence: Synthetic oligonucleotide
  Target: ATXN1; (-) strand; PAM type: YTN; PAM sequence: TTG
ttcaaacaattgaattcatt

SEQ ID NO: 225006 - DNA, 20 bp, Artificial Sequence
  Description of Artificial Sequence: Synthetic oligonucleotide
  Target: ATXN1; (-) strand; PAM type: YTN; PAM sequence: TTT
gttcaaacaattgaattcat

SEQ ID NO: 225007 - DNA, 20 bp, Artificial Sequence
  Description of Artificial Sequence: Synthetic oligonucleotide
  Target: ATXN1; (-) strand; PAM type: YTN; PAM sequence: TTT
tgttcaaacaattgaattca

SEQ ID NO: 225008 - DNA, 20 bp, Artificial Sequence
  Description of Artificial Sequence: Synthetic oligonucleotide
  Target: ATXN1; (-) strand; PAM type: YTN; PAM sequence: TTT
ttgttcaaacaattgaattc

SEQ ID NO: 225009 - DNA, 20 bp, Artificial Sequence
  Description of Artificial Sequence: Synthetic oligonucleotide
  Target: ATXN1; (-) strand; PAM type: YTN; PAM sequence: TTT
tttgttcaaacaattgaatt

SEQ ID NO: 225010 - DNA, 20 bp, Artificial Sequence
  Description of Artificial Sequence: Synthetic oligonucleotide
  Target: ATXN1; (-) strand; PAM type: YTN; PAM sequence: TTA
ttttttgttcaaacaattga

SEQ ID NO: 225011 - DNA, 20 bp, Artificial Sequence
  Description of Artificial Sequence: Synthetic oligonucleotide
  Target: ATXN1; (-) strand; PAM type: YTN; PAM sequence: TTG
tgttattttttgttcaaaca

SEQ ID NO: 225012 - DNA, 20 bp, Artificial Sequence
  Description of Artificial Sequence: Synthetic oligonucleotide
  Target: ATXN1; (-) strand; PAM type: YTN; PAM sequence: TTT
gtgttattttttgttcaaac

SEQ ID NO: 225013 - DNA, 20 bp, Artificial Sequence
  Description of Artificial Sequence: Synthetic oligonucleotide
  Target: ATXN1; (-) strand; PAM type: YTN; PAM sequence: CTG
ataatcggatagtgatatat

SEQ ID NO: 225014 - DNA, 20 bp, Artificial Sequence
  Description of Artificial Sequence: Synthetic oligonucleotide
  Target: ATXN1; (-) strand; PAM type: YTN; PAM sequence: TTG
agtactgataatcggatagt

SEQ ID NO: 225015 - DNA, 20 bp, Artificial Sequence
  Description of Artificial Sequence: Synthetic oligonucleotide
  Target: ATXN1; (-) strand; PAM type: YTN; PAM sequence: TTT
gagtactgataatcggatag

SEQ ID NO: 225016 - DNA, 20 bp, Artificial Sequence
  Description of Artificial Sequence: Synthetic oligonucleotide
  Target: ATXN1; (-) strand; PAM type: YTN; PAM sequence: TTT
tgagtactgataatcggata

SEQ ID NO: 225017 - DNA, 20 bp, Artificial Sequence
  Description of Artificial Sequence: Synthetic oligonucleotide
  Target: ATXN1; (-) strand; PAM type: YTN; PAM sequence: TTT
ttgagtactgataatcggat

SEQ ID NO: 225018 - DNA, 20 bp, Artificial Sequence
  Description of Artificial Sequence: Synthetic oligonucleotide
  Target: ATXN1; (-) strand; PAM type: YTN; PAM sequence: TTA
tatttttgagtactgataat

SEQ ID NO: 225019 - DNA, 20 bp, Artificial Sequence
  Description of Artificial Sequence: Synthetic oligonucleotide
  Target: ATXN1; (-) strand; PAM type: YTN; PAM sequence: TTT
atatttttgagtactgataa

SEQ ID NO: 225020 - DNA, 20 bp, Artificial Sequence
  Description of Artificial Sequence: Synthetic oligonucleotide
  Target: ATXN1; (-) strand; PAM type: YTN; PAM sequence: TTT
tatatttttgagtactgata

SEQ ID NO: 225021 - DNA, 20 bp, Artificial Sequence
  Description of Artificial Sequence: Synthetic oligonucleotide
  Target: ATXN1; (-) strand; PAM type: YTN; PAM sequence: TTT
ttatatttttgagtactgat

SEQ ID NO: 225022 - DNA, 20 bp, Artificial Sequence
  Description of Artificial Sequence: Synthetic oligonucleotide
  Target: ATXN1; (-) strand; PAM type: YTN; PAM sequence: CTG
tttttatatttttgagtact

SEQ ID NO: 225023 - DNA, 20 bp, Artificial Sequence
  Description of Artificial Sequence: Synthetic oligonucleotide
  Target: ATXN1; (-) strand; PAM type: YTN; PAM sequence: CTC
tgtttttatatttttgagta

SEQ ID NO: 225024 - DNA, 20 bp, Artificial Sequence
  Description of Artificial Sequence: Synthetic oligonucleotide
  Target: ATXN1; (-) strand; PAM type: YTN; PAM sequence: CTC
ctctgtttttatatttttga

SEQ ID NO: 225025 - DNA, 20 bp, Artificial Sequence
  Description of Artificial Sequence: Synthetic oligonucleotide
  Target: ATXN1; (-) strand; PAM type: YTN; PAM sequence: TTA
ctcctctgtttttatatttt

SEQ ID NO: 225026 - DNA, 20 bp, Artificial Sequence
  Description of Artificial Sequence: Synthetic oligonucleotide
  Target: ATXN1; (-) strand; PAM type: YTN; PAM sequence: CTT
actcctctgtttttatattt

SEQ ID NO: 225027 - DNA, 20 bp, Artificial Sequence
  Description of Artificial Sequence: Synthetic oligonucleotide
  Target: ATXN1; (-) strand; PAM type: YTN; PAM sequence: CTA
acttactcctctgtttttat

SEQ ID NO: 225028 - DNA, 20 bp, Artificial Sequence
  Description of Artificial Sequence: Synthetic oligonucleotide
  Target: ATXN1; (-) strand; PAM type: YTN; PAM sequence: CTC
aggagcataatactaactta

SEQ ID NO: 225029 - DNA, 20 bp, Artificial Sequence
  Description of Artificial Sequence: Synthetic oligonucleotide
  Target: ATXN1; (-) strand; PAM type: YTN; PAM sequence: TTC
tcaggagcataatactaact

SEQ ID NO: 225030 - DNA, 20 bp, Artificial Sequence
  Description of Artificial Sequence: Synthetic oligonucleotide
  Target: ATXN1; (-) strand; PAM type: YTN; PAM sequence: CTT
ctcaggagcataatactaac

SEQ ID NO: 225031 - DNA, 20 bp, Artificial Sequence
  Description of Artificial Sequence: Synthetic oligonucleotide
  Target: ATXN1; (-) strand; PAM type: YTN; PAM sequence: CTC
ttctcaggagcataatacta

SEQ ID NO: 225032 - DNA, 20 bp, Artificial Sequence
  Description of Artificial Sequence: Synthetic oligonucleotide
  Target: ATXN1; (-) strand; PAM type: YTN; PAM sequence: TTC
ctcttctcaggagcataata

SEQ ID NO: 225033 - DNA, 20 bp, Artificial Sequence
  Description of Artificial Sequence: Synthetic oligonucleotide
  Target: ATXN1; (-) strand; PAM type: YTN; PAM sequence: TTT
cctcttctcaggagcataat

SEQ ID NO: 225034 - DNA, 20 bp, Artificial Sequence
  Description of Artificial Sequence: Synthetic oligonucleotide
  Target: ATXN1; (-) strand; PAM type: YTN; PAM sequence: TTA
atttcctcttctcaggagca

SEQ ID NO: 225035 - DNA, 20 bp, Artificial Sequence
  Description of Artificial Sequence: Synthetic oligonucleotide
  Target: ATXN1; (-) strand; PAM type: YTN; PAM sequence: CTA
aatgttaatttcctcttctc

SEQ ID NO: 225036 - DNA, 20 bp, Artificial Sequence
  Description of Artificial Sequence: Synthetic oligonucleotide
  Target: ATXN1; (-) strand; PAM type: YTN; PAM sequence: TTA
cccagtaaactaaatgttaa

SEQ ID NO: 225037 - DNA, 20 bp, Artificial Sequence
  Description of Artificial Sequence: Synthetic oligonucleotide
  Target: ATXN1; (-) strand; PAM type: YTN; PAM sequence: CTT
acccagtaaactaaatgtta

SEQ ID NO: 225038 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaaaaaaaagaaaa

SEQ ID NO: 225039 - DNA, 20 bp, Artificial Sequence
  Description of Artificial Sequence: Synthetic oligonucleotide
  Target: ATXN1; (-) strand; PAM type: YTN; PAM sequence: CTT
aaaaaaaaaaaaaaaagaaa

SEQ ID NO: 225040 - DNA, 20 bp, Artificial Sequence
  Description of Artificial Sequence: Synthetic oligonucleotide
  Target: ATXN1; (-) strand; PAM type: YTN; PAM sequence: CTC
ttaaaaaaaaaaaaaaaaga

SEQ ID NO: 225041 - DNA, 20 bp, Artificial Sequence
  Description of Artificial Sequence: Synthetic oligonucleotide
  Target: ATXN1; (-) strand; PAM type: YTN; PAM sequence: CTC
cgtctcttaaaaaaaaaaaa

SEQ ID NO: 225042 - DNA, 20 bp, Artificial Sequence
  Description of Artificial Sequence: Synthetic oligonucleotide
  Target: ATXN1; (-) strand; PAM type: YTN; PAM sequence: CTG
gcgacagagcgagactccgt

SEQ ID NO: 225043 - DNA, 20 bp, Artificial Sequence
  Description of Artificial Sequence: Synthetic oligonucleotide
  Target: ATXN1; (-) strand; PAM type: YTN; PAM sequence: CTC
cagcctggcgacagagcgag

SEQ ID NO: 225044 - DNA, 20 bp, Artificial Sequence
  Description of Artificial Sequence: Synthetic oligonucleotide
  Target: ATXN1; (-) strand; PAM type: YTN; PAM sequence: CTG
cactccagcctggcgacaga

SEQ ID NO: 225045 - DNA, 20 bp, Artificial Sequence
  Description of Artificial Sequence: Synthetic oligonucleotide
  Target: ATXN1; (-) strand; PAM type: YTN; PAM sequence: TTG
cagtgagccaagatcacacc

SEQ ID NO: 225046 - DNA, 20 bp, Artificial Sequence
  Description of Artificial Sequence: Synthetic oligonucleotide
  Target: ATXN1; (-) strand; PAM type: YTN; PAM sequence: CTT
gcagtgagccaagatcacac

SEQ ID NO: 225047 - DNA, 20 bp, Artificial Sequence
  Description of Artificial Sequence: Synthetic oligonucleotide
  Target: ATXN1; (-) strand; PAM type: YTN; PAM sequence: CTA
gaaccaggaggcggcggagc

SEQ ID NO: 225048 - DNA, 20 bp, Artificial Sequence
  Description of Artificial Sequence: Synthetic oligonucleotide
  Target: ATXN1; (-) strand; PAM type: YTN; PAM sequence: TTG
ctagaaccaggaggcggcgg

SEQ ID NO: 225049 - DNA, 20 bp, Artificial Sequence
  Description of Artificial Sequence: Synthetic oligonucleotide
  Target: ATXN1; (-) strand; PAM type: YTN; PAM sequence: CTG
aggcaggagagttgctagaa

SEQ ID NO: 225050 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagagt

SEQ ID NO: 225051 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagag

SEQ ID NO: 225052 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcagga

SEQ ID NO: 225053 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacttgggag

SEQ ID NO: 225054 - DNA, 20 bp, Artificial Sequence
  Description of Artificial Sequence: Synthetic oligonucleotide
  Target: ATXN1; (-) strand; PAM type: YTN; PAM sequence: CTG
ggcgtggtggcacacacctg

SEQ ID NO: 225055 - DNA, 20 bp, Artificial Sequence
  Description of Artificial Sequence: Synthetic oligonucleotide
  Target: ATXN1; (-) strand; PAM type: YTN; PAM sequence: TTA
gctgggcgtggtggcacaca

SEQ ID NO: 225056 - DNA, 20 bp, Artificial Sequence
  Description of Artificial Sequence: Synthetic oligonucleotide
  Target: ATXN1; (-) strand; PAM type: YTN; PAM sequence: CTA
aaatacaaaaaattagctgg

SEQ ID NO: 225057 - DNA, 20 bp, Artificial Sequence
  Description of Artificial Sequence: Synthetic oligonucleotide
  Target: ATXN1; (-) strand; PAM type: YTN; PAM sequence: CTC
cactaaaatacaaaaaatta

SEQ ID NO: 225058 - DNA, 20 bp, Artificial Sequence
  Description of Artificial Sequence: Synthetic oligonucleotide
  Target: ATXN1; (-) strand; PAM type: YTN; PAM sequence: CTG
ggcaacatggtgaaacccca

SEQ ID NO: 225059 - DNA, 20 bp, Artificial Sequence
  Description of Artificial Sequence: Synthetic oligonucleotide
  Target: ATXN1; (-) strand; PAM type: YTN; PAM sequence: TTG
tgacgagcctgggcaacatg

SEQ ID NO: 225060 - DNA, 20 bp, Artificial Sequence
  Description of Artificial Sequence: Synthetic oligonucleotide
  Target: ATXN1; (-) strand; PAM type: YTN; PAM sequence: TTA
aagaagggacaattgtgacg

SEQ ID NO: 225061 - DNA, 20 bp, Artificial Sequence
  Description of Artificial Sequence: Synthetic oligonucleotide
  Target: ATXN1; (-) strand; PAM type: YTN; PAM sequence: TTT
aaagaagggacaattgtgac

SEQ ID NO: 225062 - DNA, 20 bp, Artificial Sequence
  Description of Artificial Sequence: Synthetic oligonucleotide
  Target: ATXN1; (-) strand; PAM type: YTN; PAM sequence: TTT
taaagaagggacaattgtga

SEQ ID NO: 225063 - DNA, 20 bp, Artificial Sequence
  Description of Artificial Sequence: Synthetic oligonucleotide
  Target: ATXN1; (-) strand; PAM type: YTN; PAM sequence: CTT
ttaaagaagggacaattgtg

SEQ ID NO: 225064 - DNA, 20 bp, Artificial Sequence
  Description of Artificial Sequence: Synthetic oligonucleotide
  Target: ATXN1; (-) strand; PAM type: YTN; PAM sequence: TTC
ttttaaagaagggacaattg

SEQ ID NO: 225065 - DNA, 20 bp, Artificial Sequence
  Description of Artificial Sequence: Synthetic oligonucleotide
  Target: ATXN1; (-) strand; PAM type: YTN; PAM sequence: TTT
cttttaaagaagggacaatt

SEQ ID NO: 225066 - DNA, 20 bp, Artificial Sequence
  Description of Artificial Sequence: Synthetic oligonucleotide
  Target: ATXN1; (-) strand; PAM type: YTN; PAM sequence: TTA
acatagacataatttctttt

SEQ ID NO: 225067 - DNA, 20 bp, Artificial Sequence
  Description of Artificial Sequence: Synthetic oligonucleotide
  Target: ATXN1; (-) strand; PAM type: YTN; PAM sequence: CTC
attaacatagacataatttc

SEQ ID NO: 225068 - DNA, 20 bp, Artificial Sequence
  Description of Artificial Sequence: Synthetic oligonucleotide
  Target: ATXN1; (-) strand; PAM type: YTN; PAM sequence: TTC
ctcattaacatagacataat

SEQ ID NO: 225069 - DNA, 20 bp, Artificial Sequence
  Description of Artificial Sequence: Synthetic oligonucleotide
  Target: ATXN1; (-) strand; PAM type: YTN; PAM sequence: TTA
cgttcctcattaacatagac

SEQ ID NO: 225070 - DNA, 20 bp, Artificial Sequence
  Description of Artificial Sequence: Synthetic oligonucleotide
  Target: ATXN1; (-) strand; PAM type: YTN; PAM sequence: TTG
ttacgttcctcattaacata

SEQ ID NO: 225071 - DNA, 20 bp, Artificial Sequence
  Description of Artificial Sequence: Synthetic oligonucleotide
  Target: ATXN1; (-) strand; PAM type: YTN; PAM sequence: TTT
gttacgttcctcattaacat

SEQ ID NO: 225072 - DNA, 20 bp, Artificial Sequence
  Description of Artificial Sequence: Synthetic oligonucleotide
  Target: ATXN1; (-) strand; PAM type: YTN; PAM sequence: TTT
tgttacgttcctcattaaca

SEQ ID NO: 225073 - DNA, 20 bp, Artificial Sequence
  Description of Artificial Sequence: Synthetic oligonucleotide
  Target: ATXN1; (-) strand; PAM type: YTN; PAM sequence: TTA
ttttgttacgttcctcatta

SEQ ID NO: 225074 - DNA, 20 bp, Artificial Sequence
  Description of Artificial Sequence: Synthetic oligonucleotide
  Target: ATXN1; (-) strand; PAM type: YTN; PAM sequence: TTC
attattttgttacgttcctc

SEQ ID NO: 225075 - DNA, 20 bp, Artificial Sequence
  Description of Artificial Sequence: Synthetic oligonucleotide
  Target: ATXN1; (-) strand; PAM type: YTN; PAM sequence: TTT
cattattttgttacgttcct

SEQ ID NO: 225076 - DNA, 20 bp, Artificial Sequence
  Description of Artificial Sequence: Synthetic oligonucleotide
  Target: ATXN1; (-) strand; PAM type: YTN; PAM sequence: CTT
tcattattttgttacgttcc

SEQ ID NO: 225077 - DNA, 20 bp, Artificial Sequence
  Description of Artificial Sequence: Synthetic oligonucleotide
  Target: ATXN1; (-) strand; PAM type: YTN; PAM sequence: TTA
gcctttcattattttgttac

SEQ ID NO: 225078 - DNA, 20 bp, Artificial Sequence
  Description of Artificial Sequence: Synthetic oligonucleotide
  Target: ATXN1; (-) strand; PAM type: YTN; PAM sequence: TTT
agcctttcattattttgtta

SEQ ID NO: 225079 - DNA, 20 bp, Artificial Sequence
  Description of Artificial Sequence: Synthetic oligonucleotide
  Target: ATXN1; (-) strand; PAM type: YTN; PAM sequence: TTA
caaccataatacggtttagc

SEQ ID NO: 225080 - DNA, 20 bp, Artificial Sequence
  Description of Artificial Sequence: Synthetic oligonucleotide
  Target: ATXN1; (-) strand; PAM type: YTN; PAM sequence: TTT
acaaccataatacggtttag

SEQ ID NO: 225081 - DNA, 20 bp, Artificial Sequence
  Description of Artificial Sequence: Synthetic oligonucleotide
  Target: ATXN1; (-) strand; PAM type: YTN; PAM sequence: TTT
tacaaccataatacggttta

SEQ ID NO: 225082 - DNA, 20 bp, Artificial Sequence
  Description of Artificial Sequence: Synthetic oligonucleotide
  Target: ATXN1; (-) strand; PAM type: YTN; PAM sequence: CTT
ttacaaccataatacggttt

SEQ ID NO: 225083 - DNA, 20 bp, Artificial Sequence
  Description of Artificial Sequence: Synthetic oligonucleotide
  Target: ATXN1; (-) strand; PAM type: YTN; PAM sequence: CTG
tgcttttacaaccataatac

SEQ ID NO: 225084 - DNA, 20 bp, Artificial Sequence
  Description of Artificial Sequence: Synthetic oligonucleotide
  Target: ATXN1; (-) strand; PAM type: YTN; PAM sequence: TTA
aacaaagtaaataactgtgc

SEQ ID NO: 225085 - DNA, 20 bp, Artificial Sequence
  Description of Artificial Sequence: Synthetic oligonucleotide
  Target: ATXN1; (-) strand; PAM type: YTN; PAM sequence: TTT
aaacaaagtaaataactgtg

SEQ ID NO: 225086 - DNA, 20 bp, Artificial Sequence
  Description of Artificial Sequence: Synthetic oligonucleotide
  Target: ATXN1; (-) strand; PAM type: YTN; PAM sequence: TTG
aaataatttaaacaaagtaa

SEQ ID NO: 225087 - DNA, 20 bp, Artificial Sequence
  Description of Artificial Sequence: Synthetic oligonucleotide
  Target: ATXN1; (-) strand; PAM type: YTN; PAM sequence: CTA
cagtgttgaaataatttaaa

SEQ ID NO: 225088 - DNA, 20 bp, Artificial Sequence
  Description of Artificial Sequence: Synthetic oligonucleotide
  Target: ATXN1; (-) strand; PAM type: YTN; PAM sequence: CTA
atcggaaaagataacataat

SEQ ID NO: 225089 - DNA, 20 bp, Artificial Sequence
  Description of Artificial Sequence: Synthetic oligonucleotide
  Target: ATXN1; (-) strand; PAM type: YTN; PAM sequence: TTC
taatcggaaaagataacata

SEQ ID NO: 225090 - DNA, 20 bp, Artificial Sequence
  Description of Artificial Sequence: Synthetic oligonucleotide
  Target: ATXN1; (-) strand; PAM type: YTN; PAM sequence: TTT
ctaatcggaaaagataacat

SEQ ID NO: 225091 - DNA, 20 bp, Artificial Sequence
  Description of Artificial Sequence: Synthetic oligonucleotide
  Target: ATXN1; (-) strand; PAM type: YTN; PAM sequence: TTC
ccagtttctaatcggaaaag

SEQ ID NO: 225092 - DNA, 20 bp, Artificial Sequence
  Description of Artificial Sequence: Synthetic oligonucleotide
  Target: ATXN1; (-) strand; PAM type: YTN; PAM sequence: TTT
cccagtttctaatcggaaaa

SEQ ID NO: 225093 - DNA, 20 bp, Artificial Sequence
  Description of Artificial Sequence: Synthetic oligonucleotide
  Target: ATXN1; (-) strand; PAM type: YTN; PAM sequence: CTG
acgtgtgtttcccagtttct

SEQ ID NO: 225094 - DNA, 20 bp, Artificial Sequence
  Description of Artificial Sequence: Synthetic oligonucleotide
  Target: ATXN1; (-) strand; PAM type: YTN; PAM sequence: TTA
aggctgacgtgtgtttccca

SEQ ID NO: 225095 - DNA, 20 bp, Artificial Sequence
  Description of Artificial Sequence: Synthetic oligonucleotide
  Target: ATXN1; (-) strand; PAM type: YTN; PAM sequence: CTT
aaggctgacgtgtgtttccc

SEQ ID NO: 225096 - DNA, 20 bp, Artificial Sequence
  Description of Artificial Sequence: Synthetic oligonucleotide
  Target: ATXN1; (-) strand; PAM type: YTN; PAM sequence: CTG
aaatgtagtccttaaggctg

SEQ ID NO: 225097 - DNA, 20 bp, Artificial Sequence
  Description of Artificial Sequence: Synthetic oligonucleotide
  Target: ATXN1; (-) strand; PAM type: YTN; PAM sequence: CTC
tgaaatgtagtccttaaggc

SEQ ID NO: 225098 - DNA, 20 bp, Artificial Sequence
  Description of Artificial Sequence: Synthetic oligonucleotide
  Target: ATXN1; (-) strand; PAM type: YTN; PAM sequence: CTC
agctctgaaatgtagtcctt

SEQ ID NO: 225099 - DNA, 20 bp, Artificial Sequence
  Description of Artificial Sequence: Synthetic oligonucleotide
  Target: ATXN1; (-) strand; PAM type: YTN; PAM sequence: CTC
tcagctctgaaatgtagtcc

SEQ ID NO: 225100 - DNA, 20 bp, Artificial Sequence
  Description of Artificial Sequence: Synthetic oligonucleotide
  Target: ATXN1; (-) strand; PAM type: YTN; PAM sequence: CTC
tctcagctctgaaatgtagt

SEQ ID NO: 225101 - DNA, 20 bp, Artificial Sequence
  Description of Artificial Sequence: Synthetic oligonucleotide
  Target: ATXN1; (-) strand; PAM type: YTN; PAM sequence: TTC
tctctcagctctgaaatgta

SEQ ID NO: 225102 - DNA, 20 bp, Artificial Sequence
  Description of Artificial Sequence: Synthetic oligonucleotide
  Target: ATXN1; (-) strand; PAM type: YTN; PAM sequence: TTT
ctctctcagctctgaaatgt

SEQ ID NO: 225103 - DNA, 20 bp, Artificial Sequence
  Description of Artificial Sequence: Synthetic oligonucleotide
  Target: ATXN1; (-) strand; PAM type: YTN; PAM sequence: TTG
tttctctctcagctctgaaa

SEQ ID NO: 225104 - DNA, 20 bp, Artificial Sequence
  Description of Artificial Sequence: Synthetic oligonucleotide
  Target: ATXN1; (-) strand; PAM type: YTN; PAM sequence: CTT
gtttctctctcagctctgaa

SEQ ID NO: 225105 - DNA, 20 bp, Artificial Sequence
  Description of Artificial Sequence: Synthetic oligonucleotide
  Target: ATXN1; (-) strand; PAM type: YTN; PAM sequence: TTG
tagacgaccacttgtttctc

SEQ ID NO: 225106 - DNA, 20 bp, Artificial Sequence
  Description of Artificial Sequence: Synthetic oligonucleotide
  Target: ATXN1; (-) strand; PAM type: YTN; PAM sequence: TTA
ttgtagacgaccacttgttt

SEQ ID NO: 225107 - DNA, 20 bp, Artificial Sequence
  Description of Artificial Sequence: Synthetic oligonucleotide
  Target: ATXN1; (-) strand; PAM type: YTN; PAM sequence: TTG
gatagaaggttattgtagac

SEQ ID NO: 225108 - DNA, 20 bp, Artificial Sequence
  Description of Artificial Sequence: Synthetic oligonucleotide
  Target: ATXN1; (-) strand; PAM type: YTN; PAM sequence: CTC
cagagaggagatgtgagttg

SEQ ID NO: 225109 - DNA, 20 bp, Artificial Sequence
  Description of Artificial Sequence: Synthetic oligonucleotide
  Target: ATXN1; (-) strand; PAM type: YTN; PAM sequence: TTC
tccagagaggagatgtgagt

SEQ ID NO: 225110 - DNA, 20 bp, Artificial Sequence
  Description of Artificial Sequence: Synthetic oligonucleotide
  Target: ATXN1; (-) strand; PAM type: YTN; PAM sequence: TTA
tcaggaattctccagagagg

SEQ ID NO: 225111 - DNA, 20 bp, Artificial Sequence
  Description of Artificial Sequence: Synthetic oligonucleotide
  Target: ATXN1; (-) strand; PAM type: YTN; PAM sequence: CTT
atcaggaattctccagagag

SEQ ID NO: 225112 - DNA, 20 bp, Artificial Sequence
  Description of Artificial Sequence: Synthetic oligonucleotide
  Target: ATXN1; (-) strand; PAM type: YTN; PAM sequence: CTC
ttatcaggaattctccagag

SEQ ID NO: 225113 - DNA, 20 bp, Artificial Sequence
  Description of Artificial Sequence: Synthetic oligonucleotide
  Target: ATXN1; (-) strand; PAM type: YTN; PAM sequence: TTC
aaacagaggtagtaggaccc

SEQ ID NO: 225114 - DNA, 20 bp, Artificial Sequence
  Description of Artificial Sequence: Synthetic oligonucleotide
  Target: ATXN1; (-) strand; PAM type: YTN; PAM sequence: CTG
gagatgttcaaacagaggta

SEQ ID NO: 225115 - DNA, 20 bp, Artificial Sequence
  Description of Artificial Sequence: Synthetic oligonucleotide
  Target: ATXN1; (-) strand; PAM type: YTN; PAM sequence: CTG
tcactggagatgttcaaaca

SEQ ID NO: 225116 - DNA, 20 bp, Artificial Sequence
  Description of Artificial Sequence: Synthetic oligonucleotide
  Target: ATXN1; (-) strand; PAM type: YTN; PAM sequence: CTC
tgtcactggagatgttcaaa

SEQ ID NO: 225117 - DNA, 20 bp, Artificial Sequence
  Description of Artificial Sequence: Synthetic oligonucleotide
  Target: ATXN1; (-) strand; PAM type: YTN; PAM sequence: TTA
gcagtgaaacctctgtcact

SEQ ID NO: 225118 - DNA, 20 bp, Artificial Sequence
  Description of Artificial Sequence: Synthetic oligonucleotide
  Target: ATXN1; (-) strand; PAM type: YTN; PAM sequence: TTT
agcagtgaaacctctgtcac

SEQ ID NO: 225119 - DNA, 20 bp, Artificial Sequence
  Description of Artificial Sequence: Synthetic oligonucleotide
  Target: ATXN1; (-) strand; PAM type: YTN; PAM sequence: TTG
atttagcagtgaaacctctg

SEQ ID NO: 225120 - DNA, 20 bp, Artificial Sequence
  Description of Artificial Sequence: Synthetic oligonucleotide
  Target: ATXN1; (-) strand; PAM type: YTN; PAM sequence: CTG
attgatttagcagtgaaacc

SEQ ID NO: 225121 - DNA, 20 bp, Artificial Sequence
  Description of Artificial Sequence: Synthetic oligonucleotide
  Target: ATXN1; (-) strand; PAM type: YTN; PAM sequence: CTA
aaaatggaacaagctgattg

SEQ ID NO: 225122 - DNA, 20 bp, Artificial Sequence
  Description of Artificial Sequence: Synthetic oligonucleotide
  Target: ATXN1; (-) strand; PAM type: YTN; PAM sequence: CTG
tctaaaaatggaacaagctg

SEQ ID NO: 225123 - DNA, 20 bp, Artificial Sequence
  Description of Artificial Sequence: Synthetic oligonucleotide
  Target: ATXN1; (-) strand; PAM type: YTN; PAM sequence: CTG
gcaatcaggactgtctaaaa

SEQ ID NO: 225124 - DNA, 20 bp, Artificial Sequence
  Description of Artificial Sequence: Synthetic oligonucleotide
  Target: ATXN1; (-) strand; PAM type: YTN; PAM sequence: TTC
tggcaatcaggactgtctaa

SEQ ID NO: 225125 - DNA, 20 bp, Artificial Sequence
  Description of Artificial Sequence: Synthetic oligonucleotide
  Target: ATXN1; (-) strand; PAM type: YTN; PAM sequence: TTG
aggaggaacattctggcaat

SEQ ID NO: 225126 - DNA, 20 bp, Artificial Sequence
  Description of Artificial Sequence: Synthetic oligonucleotide
  Target: ATXN1; (-) strand; PAM type: YTN; PAM sequence: CTT
gaggaggaacattctggcaa

SEQ ID NO: 225127 - DNA, 20 bp, Artificial Sequence
  Description of Artificial Sequence: Synthetic oligonucleotide
  Target: ATXN1; (-) strand; PAM type: YTN; PAM sequence: CTC
cacttgaggaggaacattct

SEQ ID NO: 225128 - DNA, 20 bp, Artificial Sequence
  Description of Artificial Sequence: Synthetic oligonucleotide
  Target: ATXN1; (-) strand; PAM type: YTN; PAM sequence: TTC
gactccacttgaggaggaac

SEQ ID NO: 225129 - DNA, 20 bp, Artificial Sequence
  Description of Artificial Sequence: Synthetic oligonucleotide
  Target: ATXN1; (-) strand; PAM type: YTN; PAM sequence: CTA
gggagagttcgactccactt

SEQ ID NO: 225130 - DNA, 20 bp, Artificial Sequence
  Description of Artificial Sequence: Synthetic oligonucleotide
  Target: ATXN1; (-) strand; PAM type: YTN; PAM sequence: TTA
accctagggagagttcgact

SEQ ID NO: 225131 - DNA, 20 bp, Artificial Sequence
  Description of Artificial Sequence: Synthetic oligonucleotide
  Target: ATXN1; (-) strand; PAM type: YTN; PAM sequence: CTA
agaacaggagggaagttaac

SEQ ID NO: 225132 - DNA, 20 bp, Artificial Sequence
  Description of Artificial Sequence: Synthetic oligonucleotide
  Target: ATXN1; (-) strand; PAM type: YTN; PAM sequence: CTG
aagtggtggtagagtacgca

SEQ ID NO: 225133 - DNA, 20 bp, Artificial Sequence
  Description of Artificial Sequence: Synthetic oligonucleotide
  Target: ATXN1; (-) strand; PAM type: YTN; PAM sequence: TTA
ctgaagtggtggtagagtac

SEQ ID NO: 225134 - DNA, 20 bp, Artificial Sequence
  Description of Artificial Sequence: Synthetic oligonucleotide
  Target: ATXN1; (-) strand; PAM type: YTN; PAM sequence: CTT
actgaagtggtggtagagta

SEQ ID NO: 225135 - DNA, 20 bp, Artificial Sequence
  Description of Artificial Sequence: Synthetic oligonucleotide
  Target: ATXN1; (-) strand; PAM type: YTN; PAM sequence: CTG
acaggaagtgaaatcactta

SEQ ID NO: 225136 - DNA, 20 bp, Artificial Sequence
  Description of Artificial Sequence: Synthetic oligonucleotide
  Target: ATXN1; (-) strand; PAM type: YTN; PAM sequence: CTA
gcaaagggcctgacaggaag

SEQ ID NO: 225137 - DNA, 20 bp, Artificial Sequence
  Description of Artificial Sequence: Synthetic oligonucleotide
  Target: ATXN1; (-) strand; PAM type: YTN; PAM sequence: CTG
ataaaatgagtgaggctagc

SEQ ID NO: 225138 - DNA, 20 bp, Artificial Sequence
  Description of Artificial Sequence: Synthetic oligonucleotide
  Target: ATXN1; (-) strand; PAM type: YTN; PAM sequence: CTA
actgataaaatgagtgaggc

SEQ ID NO: 225139 - DNA, 20 bp, Artificial Sequence
  Description of Artificial Sequence: Synthetic oligonucleotide
  Target: ATXN1; (-) strand; PAM type: YTN; PAM sequence: TTA
cctaactgataaaatgagtg

SEQ ID NO: 225140 - DNA, 20 bp, Artificial Sequence
  Description of Artificial Sequence: Synthetic oligonucleotide
  Target: ATXN1; (-) strand; PAM type: YTN; PAM sequence: TTG
tgaatagaagccagtcatta

SEQ ID NO: 225141 - DNA, 20 bp, Artificial Sequence
  Description of Artificial Sequence: Synthetic oligonucleotide
  Target: ATXN1; (-) strand; PAM type: YTN; PAM sequence: TTC
acagaataacagtgacaatt

SEQ ID NO: 225142 - DNA, 20 bp, Artificial Sequence
  Description of Artificial Sequence: Synthetic oligonucleotide
  Target: ATXN1; (-) strand; PAM type: YTN; PAM sequence: CTG
tggttcacagaataacagtg

SEQ ID NO: 225143 - DNA, 20 bp, Artificial Sequence
  Description of Artificial Sequence: Synthetic oligonucleotide
  Target: ATXN1; (-) strand; PAM type: YTN; PAM sequence: TTG
tgaagaatggtcactgtggt

SEQ ID NO: 225144 - DNA, 20 bp, Artificial Sequence
  Description of Artificial Sequence: Synthetic oligonucleotide
  Target: ATXN1; (-) strand; PAM type: YTN; PAM sequence: TTC
agtgggtggtaggtggttgt

SEQ ID NO: 225145 - DNA, 20 bp, Artificial Sequence
  Description of Artificial Sequence: Synthetic oligonucleotide
  Target: ATXN1; (-) strand; PAM type: YTN; PAM sequence: CTT
cagtgggtggtaggtggttg

SEQ ID NO: 225146 - DNA, 20 bp, Artificial Sequence
  Description of Artificial Sequence: Synthetic oligonucleotide
  Target: ATXN1; (-) strand; PAM type: YTN; PAM sequence: CTC
catagagccatggtccccaa

SEQ ID NO: 225147 - DNA, 20 bp, Artificial Sequence
  Description of Artificial Sequence: Synthetic oligonucleotide
  Target: ATXN1; (-) strand; PAM type: YTN; PAM sequence: TTA
ggaccatgcccatcatagtc

SEQ ID NO: 225148 - DNA, 20 bp, Artificial Sequence
  Description of Artificial Sequence: Synthetic oligonucleotide
  Target: ATXN1; (-) strand; PAM type: YTN; PAM sequence: CTT
aggaccatgcccatcatagt

SEQ ID NO: 225149 - DNA, 20 bp, Artificial Sequence
  Description of Artificial Sequence: Synthetic oligonucleotide
  Target: ATXN1; (-) strand; PAM type: YTN; PAM sequence: CTC
agagaaacagtgtatgtgat

SEQ ID NO: 225150 - DNA, 20 bp, Artificial Sequence
  Description of Artificial Sequence: Synthetic oligonucleotide
  Target: ATXN1; (-) strand; PAM type: YTN; PAM sequence: TTC
tcagagaaacagtgtatgtg

SEQ ID NO: 225151 - DNA, 20 bp, Artificial Sequence
  Description of Artificial Sequence: Synthetic oligonucleotide
  Target: ATXN1; (-) strand; PAM type: YTN; PAM sequence: TTT
ctcagagaaacagtgtatgt

SEQ ID NO: 225152 - DNA, 20 bp, Artificial Sequence
  Description of Artificial Sequence: Synthetic oligonucleotide
  Target: ATXN1; (-) strand; PAM type: YTN; PAM sequence: CTA
agtttctcagagaaacagtg

SEQ ID NO: 225153 - DNA, 20 bp, Artificial Sequence
  Description of Artificial Sequence: Synthetic oligonucleotide
  Target: ATXN1; (-) strand; PAM type: YTN; PAM sequence: TTG
taagtctaagtttctcagag

SEQ ID NO: 225154 - DNA, 20 bp, Artificial Sequence
  Description of Artificial Sequence: Synthetic oligonucleotide
  Target: ATXN1; (-) strand; PAM type: YTN; PAM sequence: TTC
agaaagattgtaagtctaag

SEQ ID NO: 225155 - DNA, 20 bp, Artificial Sequence
  Description of Artificial Sequence: Synthetic oligonucleotide
  Target: ATXN1; (-) strand; PAM type: YTN; PAM sequence: TTT
cagaaagattgtaagtctaa

SEQ ID NO: 225156 - DNA, 20 bp, Artificial Sequence
  Description of Artificial Sequence: Synthetic oligonucleotide
  Target: ATXN1; (-) strand; PAM type: YTN; PAM sequence: TTT
tcagaaagattgtaagtcta

SEQ ID NO: 225157 - DNA, 20 bp, Artificial Sequence
  Description of Artificial Sequence: Synthetic oligonucleotide
  Target: ATXN1; (-) strand; PAM type: YTN; PAM sequence: CTT
ttcagaaagattgtaagtct

SEQ ID NO: 225158 - DNA, 20 bp, Artificial Sequence
  Description of Artificial Sequence: Synthetic oligonucleotide
  Target: ATXN1; (-) strand; PAM type: YTN; PAM sequence: TTA
taatgtatccttttcagaaa

SEQ ID NO: 225159 - DNA, 20 bp, Artificial Sequence
  Description of Artificial Sequence: Synthetic oligonucleotide
  Target: ATXN1; (-) strand; PAM type: YTN; PAM sequence: TTT
ataatgtatccttttcagaa

SEQ ID NO: 225160 - DNA, 20 bp, Artificial Sequence
  Description of Artificial Sequence: Synthetic oligonucleotide
  Target: ATXN1; (-) strand; PAM type: YTN; PAM sequence: CTA
atttataatgtatccttttc

SEQ ID NO: 225161 - DNA, 20 bp, Artificial Sequence
  Description of Artificial Sequence: Synthetic oligonucleotide
  Target: ATXN1; (-) strand; PAM type: YTN; PAM sequence: TTC
ccaaaagtagaaatactaat

SEQ ID NO: 225162 - DNA, 20 bp, Artificial Sequence
  Description of Artificial Sequence: Synthetic oligonucleotide
  Target: ATXN1; (-) strand; PAM type: YTN; PAM sequence: TTT
cccaaaagtagaaatactaa

SEQ ID NO: 225163 - DNA, 20 bp, Artificial Sequence
  Description of Artificial Sequence: Synthetic oligonucleotide
  Target: ATXN1; (-) strand; PAM type: YTN; PAM sequence: TTT
tcccaaaagtagaaatacta

SEQ ID NO: 225164 - DNA, 20 bp, Artificial Sequence
  Description of Artificial Sequence: Synthetic oligonucleotide
  Target: ATXN1; (-) strand; PAM type: YTN; PAM sequence: TTT
ttcccaaaagtagaaatact

SEQ ID NO: 225165 - DNA, 20 bp, Artificial Sequence
  Description of Artificial Sequence: Synthetic oligonucleotide
  Target: ATXN1; (-) strand; PAM type: YTN; PAM sequence: CTC
atgaaacagatttttcccaa

SEQ ID NO: 225166 - DNA, 20 bp, Artificial Sequence
  Description of Artificial Sequence: Synthetic oligonucleotide
  Target: ATXN1; (-) strand; PAM type: YTN; PAM sequence: TTC
tcatgaaacagatttttccc

SEQ ID NO: 225167 - DNA, 20 bp, Artificial Sequence
  Description of Artificial Sequence: Synthetic oligonucleotide
  Target: ATXN1; (-) strand; PAM type: YTN; PAM sequence: TTT
ctcatgaaacagatttttcc

SEQ ID NO: 225168 - DNA, 20 bp, Artificial Sequence
  Description of Artificial Sequence: Synthetic oligonucleotide
  Target: ATXN1; (-) strand; PAM type: YTN; PAM sequence: TTG
tttctcatgaaacagatttt

SEQ ID NO: 225169 - DNA, 20 bp, Artificial Sequence
  Description of Artificial Sequence: Synthetic oligonucleotide
  Target: ATXN1; (-) strand; PAM type: YTN; PAM sequence: CTT
gtttctcatgaaacagattt

SEQ ID NO: 225170 - DNA, 20 bp, Artificial Sequence
  Description of Artificial Sequence: Synthetic oligonucleotide
  Target: ATXN1; (-) strand; PAM type: YTN; PAM sequence: TTA
cgccttgtttctcatgaaac

SEQ ID NO: 225171 - DNA, 20 bp, Artificial Sequence
  Description of Artificial Sequence: Synthetic oligonucleotide
  Target: ATXN1; (-) strand; PAM type: YTN; PAM sequence: TTA
aaagacagagtgataaatta

SEQ ID NO: 225172 - DNA, 20 bp, Artificial Sequence
  Description of Artificial Sequence: Synthetic oligonucleotide
  Target: ATXN1; (-) strand; PAM type: YTN; PAM sequence: CTT
aaaagacagagtgataaatt

SEQ ID NO: 225173 - DNA, 20 bp, Artificial Sequence
  Description of Artificial Sequence: Synthetic oligonucleotide
  Target: ATXN1; (-) strand; PAM type: YTN; PAM sequence: CTG
cttaaaagacagagtgataa

SEQ ID NO: 225174 - DNA, 20 bp, Artificial Sequence
  Description of Artificial Sequence: Synthetic oligonucleotide
  Target: ATXN1; (-) strand; PAM type: YTN; PAM sequence: CTC
ataagactgcttaaaagaca

SEQ ID NO: 225175 - DNA, 20 bp, Artificial Sequence
  Description of Artificial Sequence: Synthetic oligonucleotide
  Target: ATXN1; (-) strand; PAM type: YTN; PAM sequence: TTG
gctcataagactgcttaaaa

SEQ ID NO: 225176 - DNA, 20 bp, Artificial Sequence
  Description of Artificial Sequence: Synthetic oligonucleotide
  Target: ATXN1; (-) strand; PAM type: YTN; PAM sequence: CTT
ggctcataagactgcttaaa

SEQ ID NO: 225177 - DNA, 20 bp, Artificial Sequence
  Description of Artificial Sequence: Synthetic oligonucleotide
  Target: ATXN1; (-) strand; PAM type: YTN; PAM sequence: CTG
acttggctcataagactgct

SEQ ID NO: 225178 - DNA, 20 bp, Artificial Sequence
  Description of Artificial Sequence: Synthetic oligonucleotide
  Target: ATXN1; (-) strand; PAM type: YTN; PAM sequence: TTA
tgcatgcatcaaaacactga

SEQ ID NO: 225179 - DNA, 20 bp, Artificial Sequence
  Description of Artificial Sequence: Synthetic oligonucleotide
  Target: ATXN1; (-) strand; PAM type: YTN; PAM sequence: TTT
atgcatgcatcaaaacactg

SEQ ID NO: 225180 - DNA, 20 bp, Artificial Sequence
  Description of Artificial Sequence: Synthetic oligonucleotide
  Target: ATXN1; (-) strand; PAM type: YTN; PAM sequence: TTT
tatgcatgcatcaaaacact

SEQ ID NO: 225181 - DNA, 20 bp, Artificial Sequence
  Description of Artificial Sequence: Synthetic oligonucleotide
  Target: ATXN1; (-) strand; PAM type: YTN; PAM sequence: TTT
ttatgcatgcatcaaaacac

SEQ ID NO: 225182 - DNA, 20 bp, Artificial Sequence
  Description of Artificial Sequence: Synthetic oligonucleotide
  Target: ATXN1; (-) strand; PAM type: YTN; PAM sequence: CTA
tggaatttttatgcatgcat

SEQ ID NO: 225183 - DNA, 20 bp, Artificial Sequence
  Description of Artificial Sequence: Synthetic oligonucleotide
  Target: ATXN1; (-) strand; PAM type: YTN; PAM sequence: CTG
caggaggaggagctatggaa

SEQ ID NO: 225184 - DNA, 20 bp, Artificial Sequence
  Description of Artificial Sequence: Synthetic oligonucleotide
  Target: ATXN1; (-) strand; PAM type: YTN; PAM sequence: CTA
ctgcaggaggaggagctatg

SEQ ID NO: 225185 - DNA, 20 bp, Artificial Sequence
  Description of Artificial Sequence: Synthetic oligonucleotide
  Target: ATXN1; (-) strand; PAM type: YTN; PAM sequence: TTC
tactgcaggaggaggagcta

SEQ ID NO: 225186 - DNA, 20 bp, Artificial Sequence
  Description of Artificial Sequence: Synthetic oligonucleotide
  Target: ATXN1; (-) strand; PAM type: YTN; PAM sequence: CTT
ctactgcaggaggaggagct

SEQ ID NO: 225187 - DNA, 20 bp, Artificial Sequence
  Description of Artificial Sequence: Synthetic oligonucleotide
  Target: ATXN1; (-) strand; PAM type: YTN; PAM sequence: CTG
cttctactgcaggaggagga

SEQ ID NO: 225188 - DNA, 20 bp, Artificial Sequence
  Description of Artificial Sequence: Synthetic oligonucleotide
  Target: ATXN1; (-) strand; PAM type: YTN; PAM sequence: TTC
tgcttctactgcaggaggag

SEQ ID NO: 225189 - DNA, 20 bp, Artificial Sequence
  Description of Artificial Sequence: Synthetic oligonucleotide
  Target: ATXN1; (-) strand; PAM type: YTN; PAM sequence: CTT
ctgcttctactgcaggagga

SEQ ID NO: 225190 - DNA, 20 bp, Artificial Sequence
  Description of Artificial Sequence: Synthetic oligonucleotide
  Target: ATXN1; (-) strand; PAM type: YTN; PAM sequence: CTA
cttctgcttctactgcagga

SEQ ID NO: 225191 - DNA, 20 bp, Artificial Sequence
  Description of Artificial Sequence: Synthetic oligonucleotide
  Target: ATXN1; (-) strand; PAM type: YTN; PAM sequence: CTG
ctacttctgcttctactgca

SEQ ID NO: 225192 - DNA, 20 bp, Artificial Sequence
  Description of Artificial Sequence: Synthetic oligonucleotide
  Target: ATXN1; (-) strand; PAM type: YTN; PAM sequence: CTC
tgctacttctgcttctactg

SEQ ID NO: 225193 - DNA, 20 bp, Artificial Sequence
  Description of Artificial Sequence: Synthetic oligonucleotide
  Target: ATXN1; (-) strand; PAM type: YTN; PAM sequence: TTG
ccagctctgctacttctgct

SEQ ID NO: 225194 - DNA, 20 bp, Artificial Sequence
  Description of Artificial Sequence: Synthetic oligonucleotide
  Target: ATXN1; (-) strand; PAM type: YTN; PAM sequence: TTT
gccagctctgctacttctgc

SEQ ID NO: 225195 - DNA, 20 bp, Artificial Sequence
  Description of Artificial Sequence: Synthetic oligonucleotide
  Target: ATXN1; (-) strand; PAM type: YTN; PAM sequence: CTA
caggtttgccagctctgcta

SEQ ID NO: 225196 - DNA, 20 bp, Artificial Sequence
  Description of Artificial Sequence: Synthetic oligonucleotide
  Target: ATXN1; (-) strand; PAM type: YTN; PAM sequence: CTG
gatactacaggtttgccagc

SEQ ID NO: 225197 - DNA, 20 bp, Artificial Sequence
  Description of Artificial Sequence: Synthetic oligonucleotide
  Target: ATXN1; (-) strand; PAM type: YTN; PAM sequence: TTC
caggaaacagaggtagtcat

SEQ ID NO: 225198 - DNA, 20 bp, Artificial Sequence
  Description of Artificial Sequence: Synthetic oligonucleotide
  Target: ATXN1; (-) strand; PAM type: YTN; PAM sequence: TTA
ttccaggaaacagaggtagt

SEQ ID NO: 225199 - DNA, 20 bp, Artificial Sequence
  Description of Artificial Sequence: Synthetic oligonucleotide
  Target: ATXN1; (-) strand; PAM type: YTN; PAM sequence: CTG
ttattccaggaaacagaggt

SEQ ID NO: 225200 - DNA, 20 bp, Artificial Sequence
  Description of Artificial Sequence: Synthetic oligonucleotide
  Target: ATXN1; (-) strand; PAM type: YTN; PAM sequence: TTC
tgttattccaggaaacagag

SEQ ID NO: 225201 - DNA, 20 bp, Artificial Sequence
  Description of Artificial Sequence: Synthetic oligonucleotide
  Target: ATXN1; (-) strand; PAM type: YTN; PAM sequence: CTT
ctgttattccaggaaacaga

SEQ ID NO: 225202 - DNA, 20 bp, Artificial Sequence
  Description of Artificial Sequence: Synthetic oligonucleotide
  Target: ATXN1; (-) strand; PAM type: YTN; PAM sequence: TTC
agcttctgttattccaggaa

SEQ ID NO: 225203 - DNA, 20 bp, Artificial Sequence
  Description of Artificial Sequence: Synthetic oligonucleotide
  Target: ATXN1; (-) strand; PAM type: YTN; PAM sequence: CTT
cagcttctgttattccagga

SEQ ID NO: 225204 - DNA, 20 bp, Artificial Sequence
  Description of Artificial Sequence: Synthetic oligonucleotide
  Target: ATXN1; (-) strand; PAM type: YTN; PAM sequence: TTC
atcttcagcttctgttattc

SEQ ID NO: 225205 - DNA, 20 bp, Artificial Sequence
  Description of Artificial Sequence: Synthetic oligonucleotide
  Target: ATXN1; (-) strand; PAM type: YTN; PAM sequence: CTG
ttcatcttcagcttctgtta

SEQ ID NO: 225206 - DNA, 20 bp, Artificial Sequence
  Description of Artificial Sequence: Synthetic oligonucleotide
  Target: ATXN1; (-) strand; PAM type: YTN; PAM sequence: CTG
ggagatgatgacctgttcat

SEQ ID NO: 225207 - DNA, 20 bp, Artificial Sequence
  Description of Artificial Sequence: Synthetic oligonucleotide
  Target: ATXN1; (-) strand; PAM type: YTN; PAM sequence: TTG
ggtggtacctgggagatgat

SEQ ID NO: 225208 - DNA, 20 bp, Artificial Sequence
  Description of Artificial Sequence: Synthetic oligonucleotide
  Target: ATXN1; (-) strand; PAM type: YTN; PAM sequence: CTT
gggtggtacctgggagatga

SEQ ID NO: 225209 - DNA, 20 bp, Artificial Sequence
  Description of Artificial Sequence: Synthetic oligonucleotide
  Target: ATXN1; (-) strand; PAM type: YTN; PAM sequence: TTG
ggtacttgggtggtacctgg

SEQ ID NO: 225210 - DNA, 20 bp, Artificial Sequence
  Description of Artificial Sequence: Synthetic oligonucleotide
  Target: ATXN1; (-) strand; PAM type: YTN; PAM sequence: CTT
gggtacttgggtggtacctg

SEQ ID NO: 225211 - DNA, 20 bp, Artificial Sequence
  Description of Artificial Sequence: Synthetic oligonucleotide
  Target: ATXN1; (-) strand; PAM type: YTN; PAM sequence: TTG
cttgggtacttgggtggtac

SEQ ID NO: 225212 - DNA, 20 bp, Artificial Sequence
  Description of Artificial Sequence: Synthetic oligonucleotide
  Target: ATXN1; (-) strand; PAM type: YTN; PAM sequence: CTT
gcttgggtacttgggtggta

SEQ ID NO: 225213 - DNA, 20 bp, Artificial Sequence
  Description of Artificial Sequence: Synthetic oligonucleotide
  Target: ATXN1; (-) strand; PAM type: YTN; PAM sequence: CTG
gtgggcttgcttgggtactt

SEQ ID NO: 225214 - DNA, 20 bp, Artificial Sequence
  Description of Artificial Sequence: Synthetic oligonucleotide
  Target: ATXN1; (-) strand; PAM type: YTN; PAM sequence: TTG
tcccacacacctggtgggct

SEQ ID NO: 225215 - DNA, 20 bp, Artificial Sequence
  Description of Artificial Sequence: Synthetic oligonucleotide
  Target: ATXN1; (-) strand; PAM type: YTN; PAM sequence: CTA
gaattgtcccacacacctgg

SEQ ID NO: 225216 - DNA, 20 bp, Artificial Sequence
  Description of Artificial Sequence: Synthetic oligonucleotide
  Target: ATXN1; (-) strand; PAM type: YTN; PAM sequence: CTC
tagaattgtcccacacacct

SEQ ID NO: 225217 - DNA, 20 bp, Artificial Sequence
  Description of Artificial Sequence: Synthetic oligonucleotide
  Target: ATXN1; (-) strand; PAM type: YTN; PAM sequence: CTG
ggcccagggctctagaattg

SEQ ID NO: 225218 - DNA, 20 bp, Artificial Sequence
  Description of Artificial Sequence: Synthetic oligonucleotide
  Target: ATXN1; (-) strand; PAM type: YTN; PAM sequence: CTA
ggctgggcccagggctctag

SEQ ID NO: 225219 - DNA, 20 bp, Artificial Sequence
  Description of Artificial Sequence: Synthetic oligonucleotide
  Target: ATXN1; (-) strand; PAM type: YTN; PAM sequence: CTC
cgtcctaggctgggcccagg

SEQ ID NO: 225220 - DNA, 20 bp, Artificial Sequence
  Description of Artificial Sequence: Synthetic oligonucleotide
  Target: ATXN1; (-) strand; PAM type: YTN; PAM sequence: CTG
tctccgtcctaggctgggcc

SEQ ID NO: 225221 - DNA, 20 bp, Artificial Sequence
  Description of Artificial Sequence: Synthetic oligonucleotide
  Target: ATXN1; (-) strand; PAM type: YTN; PAM sequence: TTC
agaagctgtctccgtcctag

SEQ ID NO: 225222 - DNA, 20 bp, Artificial Sequence
  Description of Artificial Sequence: Synthetic oligonucleotide
  Target: ATXN1; (-) strand; PAM type: YTN; PAM sequence: CTT
cagaagctgtctccgtccta

SEQ ID NO: 225223 - DNA, 20 bp, Artificial Sequence
  Description of Artificial Sequence: Synthetic oligonucleotide
  Target: ATXN1; (-) strand; PAM type: YTN; PAM sequence: CTA
agaacttcagaagctgtctc

SEQ ID NO: 225224 - DNA, 20 bp, Artificial Sequence
  Description of Artificial Sequence: Synthetic oligonucleotide
  Target: ATXN1; (-) strand; PAM type: YTN; PAM sequence: TTA
gatgtagactaagaacttca

SEQ ID NO: 225225 - DNA, 20 bp, Artificial Sequence
  Description of Artificial Sequence: Synthetic oligonucleotide
  Target: ATXN1; (-) strand; PAM type: YTN; PAM sequence: CTG
ttagatgtagactaagaact

SEQ ID NO: 225226 - DNA, 20 bp, Artificial Sequence
  Description of Artificial Sequence: Synthetic oligonucleotide
  Target: ATXN1; (-) strand; PAM type: YTN; PAM sequence: TTA
accacagcaaggaggaaaga

SEQ ID NO: 225227 - DNA, 20 bp, Artificial Sequence
  Description of Artificial Sequence: Synthetic oligonucleotide
  Target: ATXN1; (-) strand; PAM type: YTN; PAM sequence: TTC
agtgttaaccacagcaagga

SEQ ID NO: 225228 - DNA, 20 bp, Artificial Sequence
  Description of Artificial Sequence: Synthetic oligonucleotide
  Target: ATXN1; (-) strand; PAM type: YTN; PAM sequence: CTT
cagtgttaaccacagcaagg

SEQ ID NO: 225229 - DNA, 20 bp, Artificial Sequence
  Description of Artificial Sequence: Synthetic oligonucleotide
  Target: ATXN1; (-) strand; PAM type: YTN; PAM sequence: CTA
gaacttcagtgttaaccaca

SEQ ID NO: 225230 - DNA, 20 bp, Artificial Sequence
  Description of Artificial Sequence: Synthetic oligonucleotide
  Target: ATXN1; (-) strand; PAM type: YTN; PAM sequence: TTC
tagaacttcagtgttaacca

SEQ ID NO: 225231 - DNA, 20 bp, Artificial Sequence
  Description of Artificial Sequence: Synthetic oligonucleotide
  Target: ATXN1; (-) strand; PAM type: YTN; PAM sequence: TTT
ctagaacttcagtgttaacc

SEQ ID NO: 225232 - DNA, 20 bp, Artificial Sequence
  Description of Artificial Sequence: Synthetic oligonucleotide
  Target: ATXN1; (-) strand; PAM type: YTN; PAM sequence: TTT
tctagaacttcagtgttaac

SEQ ID NO: 225233 - DNA, 20 bp, Artificial Sequence
  Description of Artificial Sequence: Synthetic oligonucleotide
  Target: ATXN1; (-) strand; PAM type: YTN; PAM sequence: CTA
ataggacattttctagaact

SEQ ID NO: 225234 - DNA, 20 bp, Artificial Sequence
  Description of Artificial Sequence: Synthetic oligonucleotide
  Target: ATXN1; (-) strand; PAM type: YTN; PAM sequence: CTC
aagatgaaggtactaatagg

SEQ ID NO: 225235 - DNA, 20 bp, Artificial Sequence
  Description of Artificial Sequence: Synthetic oligonucleotide
  Target: ATXN1; (-) strand; PAM type: YTN; PAM sequence: CTC
tcaagatgaaggtactaata

SEQ ID NO: 225236 - DNA, 20 bp, Artificial Sequence
  Description of Artificial Sequence: Synthetic oligonucleotide
  Target: ATXN1; (-) strand; PAM type: YTN; PAM sequence: TTC
acctctcaagatgaaggtac

SEQ ID NO: 225237 - DNA, 20 bp, Artificial Sequence
  Description of Artificial Sequence: Synthetic oligonucleotide
  Target: ATXN1; (-) strand; PAM type: YTN; PAM sequence: TTA
aatcattcacctctcaagat

SEQ ID NO: 225238 - DNA, 20 bp, Artificial Sequence
  Description of Artificial Sequence: Synthetic oligonucleotide
  Target: ATXN1; (-) strand; PAM type: YTN; PAM sequence: CTT
aaatcattcacctctcaaga

SEQ ID NO: 225239 - DNA, 20 bp, Artificial Sequence
  Description of Artificial Sequence: Synthetic oligonucleotide
  Target: ATXN1; (-) strand; PAM type: YTN; PAM sequence: TTC
ttaaatcattcacctctcaa

SEQ ID NO: 225240 - DNA, 20 bp, Artificial Sequence
  Description of Artificial Sequence: Synthetic oligonucleotide
  Target: ATXN1; (-) strand; PAM type: YTN; PAM sequence: CTT
cttaaatcattcacctctca

SEQ ID NO: 225241 - DNA, 20 bp, Artificial Sequence
  Description of Artificial Sequence: Synthetic oligonucleotide
  Target: ATXN1; (-) strand; PAM type: YTN; PAM sequence: CTC
ttcttaaatcattcacctct

SEQ ID NO: 225242 - DNA, 20 bp, Artificial Sequence
  Description of Artificial Sequence: Synthetic oligonucleotide
  Target: ATXN1; (-) strand; PAM type: YTN; PAM sequence: TTC
tcttcttaaatcattcacct

SEQ ID NO: 225243 - DNA, 20 bp, Artificial Sequence
  Description of Artificial Sequence: Synthetic oligonucleotide
  Target: ATXN1; (-) strand; PAM type: YTN; PAM sequence: CTT
ctcttcttaaatcattcacc

SEQ ID NO: 225244 - DNA, 20 bp, Artificial Sequence
  Description of Artificial Sequence: Synthetic oligonucleotide
  Target: ATXN1; (-) strand; PAM type: YTN; PAM sequence: TTG
ggtaaaataaaaataaatac

SEQ ID NO: 225245 - DNA, 20 bp, Artificial Sequence
  Description of Artificial Sequence: Synthetic oligonucleotide
  Target: ATXN1; (-) strand; PAM type: YTN; PAM sequence: CTG
cccaaatggacattgggtaa

SEQ ID NO: 225246 - DNA, 20 bp, Artificial Sequence
  Description of Artificial Sequence: Synthetic oligonucleotide
  Target: ATXN1; (-) strand; PAM type: YTN; PAM sequence: TTA
gtaactgcccaaatggacat

SEQ ID NO: 225247 - DNA, 20 bp, Artificial Sequence
  Description of Artificial Sequence: Synthetic oligonucleotide
  Target: ATXN1; (-) strand; PAM type: YTN; PAM sequence: TTT
agtaactgcccaaatggaca

SEQ ID NO: 225248 - DNA, 20 bp, Artificial Sequence
  Description of Artificial Sequence: Synthetic oligonucleotide
  Target: ATXN1; (-) strand; PAM type: YTN; PAM sequence: TTA
agtttagtaactgcccaaat

SEQ ID NO: 225249 - DNA, 20 bp, Artificial Sequence
  Description of Artificial Sequence: Synthetic oligonucleotide
  Target: ATXN1; (-) strand; PAM type: YTN; PAM sequence: TTT
aagtttagtaactgcccaaa

SEQ ID NO: 225250 - DNA, 20 bp, Artificial Sequence
  Description of Artificial Sequence: Synthetic oligonucleotide
  Target: ATXN1; (-) strand; PAM type: YTN; PAM sequence: TTT
taagtttagtaactgcccaa

SEQ ID NO: 225251 - DNA, 20 bp, Artificial Sequence
  Description of Artificial Sequence: Synthetic oligonucleotide
  Target: ATXN1; (-) strand; PAM type: YTN; PAM sequence: TTT
ttaagtttagtaactgccca

SEQ ID NO: 225252 - DNA, 20 bp, Artificial Sequence
  Description of Artificial Sequence: Synthetic oligonucleotide
  Target: ATXN1; (-) strand; PAM type: YTN; PAM sequence: CTG
catttttaagtttagtaact

SEQ ID NO: 225253 - DNA, 20 bp, Artificial Sequence
  Description of Artificial Sequence: Synthetic oligonucleotide
  Target: ATXN1; (-) strand; PAM type: YTN; PAM sequence: TTG
cccaggctgcatttttaagt

SEQ ID NO: 225254 - DNA, 20 bp, Artificial Sequence
  Description of Artificial Sequence: Synthetic oligonucleotide
  Target: ATXN1; (-) strand; PAM type: YTN; PAM sequence: TTC
cattgcccaggctgcatttt

SEQ ID NO: 225255 - DNA, 20 bp, Artificial Sequence
  Description of Artificial Sequence: Synthetic oligonucleotide
  Target: ATXN1; (-) strand; PAM type: YTN; PAM sequence: CTC
attccattgcccaggctgca

SEQ ID NO: 225256 - DNA, 20 bp, Artificial Sequence
  Description of Artificial Sequence: Synthetic oligonucleotide
  Target: ATXN1; (-) strand; PAM type: YTN; PAM sequence: TTG
taaagacagggtctcattcc

SEQ ID NO: 225257 - DNA, 20 bp, Artificial Sequence
  Description of Artificial Sequence: Synthetic oligonucleotide
  Target: ATXN1; (-) strand; PAM type: YTN; PAM sequence: TTT
gtaaagacagggtctcattc

SEQ ID NO: 225258 - DNA, 20 bp, Artificial Sequence
  Description of Artificial Sequence: Synthetic oligonucleotide
  Target: ATXN1; (-) strand; PAM type: YTN; PAM sequence: TTT
tgtaaagacagggtctcatt

SEQ ID NO: 225259 - DNA, 20 bp, Artificial Sequence
  Description of Artificial Sequence: Synthetic oligonucleotide
  Target: ATXN1; (-) strand; PAM type: YTN; PAM sequence: TTT
ttgtaaagacagggtctcat

SEQ ID NO: 225260 - DNA, 20 bp, Artificial Sequence
  Description of Artificial Sequence: Synthetic oligonucleotide
  Target: ATXN1; (-) strand; PAM type: YTN; PAM sequence: TTT
tttgtaaagacagggtctca

SEQ ID NO: 225261 - DNA, 20 bp, Artificial Sequence
  Description of Artificial Sequence: Synthetic oligonucleotide
  Target: ATXN1; (-) strand; PAM type: YTN; PAM sequence: TTA
ttttttgtaaagacagggtc

SEQ ID NO: 225262 - DNA, 20 bp, Artificial Sequence
  Description of Artificial Sequence: Synthetic oligonucleotide
  Target: ATXN1; (-) strand; PAM type: YTN; PAM sequence: TTT
attttttgtaaagacagggt

SEQ ID NO: 225263 - DNA, 20 bp, Artificial Sequence
  Description of Artificial Sequence: Synthetic oligonucleotide
  Target: ATXN1; (-) strand; PAM type: YTN; PAM sequence: TTA
atttattttttgtaaagaca

SEQ ID NO: 225264 - DNA, 20 bp, Artificial Sequence
  Description of Artificial Sequence: Synthetic oligonucleotide
  Target: ATXN1; (-) strand; PAM type: YTN; PAM sequence: TTT
aatttattttttgtaaagac

SEQ ID NO: 225265 - DNA, 20 bp, Artificial Sequence
  Description of Artificial Sequence: Synthetic oligonucleotide
  Target: ATXN1; (-) strand; PAM type: YTN; PAM sequence: TTT
taatttattttttgtaaaga

SEQ ID NO: 225266 - DNA, 20 bp, Artificial Sequence
  Description of Artificial Sequence: Synthetic oligonucleotide
  Target: ATXN1; (-) strand; PAM type: YTN; PAM sequence: TTT
ttaatttattttttgtaaag

SEQ ID NO: 225267 - DNA, 20 bp, Artificial Sequence
  Description of Artificial Sequence: Synthetic oligonucleotide
  Target: ATXN1; (-) strand; PAM type: YTN; PAM sequence: TTG
tttttaatttattttttgta

SEQ ID NO: 225268 - DNA, 20 bp, Artificial Sequence
  Description of Artificial Sequence: Synthetic oligonucleotide
  Target: ATXN1; (-) strand; PAM type: YTN; PAM sequence: TTT
gtttttaatttattttttgt

SEQ ID NO: 225269 - DNA, 20 bp, Artificial Sequence
  Description of Artificial Sequence: Synthetic oligonucleotide
  Target: ATXN1; (-) strand; PAM type: YTN; PAM sequence: TTT
tgtttttaatttattttttg

SEQ ID NO: 225270 - DNA, 20 bp, Artificial Sequence
  Description of Artificial Sequence: Synthetic oligonucleotide
  Target: ATXN1; (-) strand; PAM type: YTN; PAM sequence: TTT
ttgtttttaatttatttttt

SEQ ID NO: 225271 - DNA, 20 bp, Artificial Sequence
  Description of Artificial Sequence: Synthetic oligonucleotide
  Target: ATXN1; (-) strand; PAM type: YTN; PAM sequence: TTT
tttgtttttaatttattttt

SEQ ID NO: 225272 - DNA, 20 bp, Artificial Sequence
  Description of Artificial Sequence: Synthetic oligonucleotide
  Target: ATXN1; (-) strand; PAM type: YTN; PAM sequence: TTA
ttttttgtttttaatttatt

SEQ ID NO: 225273 - DNA, 20 bp, Artificial Sequence
  Description of Artificial Sequence: Synthetic oligonucleotide
  Target: ATXN1; (-) strand; PAM type: YTN; PAM sequence: CTT
attttttgtttttaatttat

SEQ ID NO: 225274 - DNA, 20 bp, Artificial Sequence
  Description of Artificial Sequence: Synthetic oligonucleotide
  Target: ATXN1; (-) strand; PAM type: YTN; PAM sequence: TTG
tgcgaccacacttatttttt

SEQ ID NO: 225275 - DNA, 20 bp, Artificial Sequence
  Description of Artificial Sequence: Synthetic oligonucleotide
  Target: ATXN1; (-) strand; PAM type: YTN; PAM sequence: CTT
gtgcgaccacacttattttt

SEQ ID NO: 225276 - DNA, 20 bp, Artificial Sequence
  Description of Artificial Sequence: Synthetic oligonucleotide
  Target: ATXN1; (-) strand; PAM type: YTN; PAM sequence: CTA
cagacttgtgcgaccacact

SEQ ID NO: 225277 - DNA, 20 bp, Artificial Sequence
  Description of Artificial Sequence: Synthetic oligonucleotide
  Target: ATXN1; (-) strand; PAM type: YTN; PAM sequence: CTA
ggactacagacttgtgcgac

SEQ ID NO: 225278 - DNA, 20 bp, Artificial Sequence
  Description of Artificial Sequence: Synthetic oligonucleotide
  Target: ATXN1; (-) strand; PAM type: YTN; PAM sequence: CTG
agtagctaggactacagact

SEQ ID NO: 225279 - DNA, 20 bp, Artificial Sequence
  Description of Artificial Sequence: Synthetic oligonucleotide
  Target: ATXN1; (-) strand; PAM type: YTN; PAM sequence: CTG
ctgagtagctaggactacag

SEQ ID NO: 225280 - DNA, 20 bp, Artificial Sequence
  Description of Artificial Sequence: Synthetic oligonucleotide
  Target: ATXN1; (-) strand; PAM type: YTN; PAM sequence: CTC
agcctgctgagtagctagga

SEQ ID NO: 225281 - DNA, 20 bp, Artificial Sequence
  Description of Artificial Sequence: Synthetic oligonucleotide
  Target: ATXN1; (-) strand; PAM type: YTN; PAM sequence: CTC
ccgcctcagcctgctgagta

SEQ ID NO: 225282 - DNA, 20 bp, Artificial Sequence
  Description of Artificial Sequence: Synthetic oligonucleotide
  Target: ATXN1; (-) strand; PAM type: YTN; PAM sequence: CTC
cagtgatcctcccgcctcag

SEQ ID NO: 225283 - DNA, 20 bp, Artificial Sequence
  Description of Artificial Sequence: Synthetic oligonucleotide
  Target: ATXN1; (-) strand; PAM type: YTN; PAM sequence: CTG
ggctccagtgatcctcccgc

SEQ ID NO: 225284 - DNA, 20 bp, Artificial Sequence
  Description of Artificial Sequence: Synthetic oligonucleotide
  Target: ATXN1; (-) strand; PAM type: YTN; PAM sequence: CTC
ctgggctccagtgatcctcc

SEQ ID NO: 225285 - DNA, 20 bp, Artificial Sequence
  Description of Artificial Sequence: Synthetic oligonucleotide
  Target: ATXN1; (-) strand; PAM type: YTN; PAM sequence: CTG
tagtgtcgaactcctgggct

SEQ ID NO: 225286 - DNA, 20 bp, Artificial Sequence
  Description of Artificial Sequence: Synthetic oligonucleotide
  Target: ATXN1; (-) strand; PAM type: YTN; PAM sequence: CTC
actgtagtgtcgaactcctg

SEQ ID NO: 225287 - DNA, 20 bp, Artificial Sequence
  Description of Artificial Sequence: Synthetic oligonucleotide
  Target: ATXN1; (-) strand; PAM type: YTN; PAM sequence: TTG
cccaggccagagggtagtgg

SEQ ID NO: 225288 - DNA, 20 bp, Artificial Sequence
  Description of Artificial Sequence: Synthetic oligonucleotide
  Target: ATXN1; (-) strand; PAM type: YTN; PAM sequence: CTG
ttgcccaggccagagggtag

SEQ ID NO: 225289 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaggccagagggt

SEQ ID NO: 225290 - DNA, 20 bp, Artificial Sequence
  Description of Artificial Sequence: Synthetic oligonucleotide
  Target: ATXN1; (-) strand; PAM type: YTN; PAM sequence: CTC
actctgttgcccaggccaga

SEQ ID NO: 225291 - DNA, 20 bp, Artificial Sequence
  Description of Artificial Sequence: Synthetic oligonucleotide
  Target: ATXN1; (-) strand; PAM type: YTN; PAM sequence: TTG
tatatatagagagagaaaca

SEQ ID NO: 225292 - DNA, 20 bp, Artificial Sequence
  Description of Artificial Sequence: Synthetic oligonucleotide
  Target: ATXN1; (-) strand; PAM type: YTN; PAM sequence: TTT
gtatatatagagagagaaac

SEQ ID NO: 225293 - DNA, 20 bp, Artificial Sequence
  Description of Artificial Sequence: Synthetic oligonucleotide
  Target: ATXN1; (-) strand; PAM type: YTN; PAM sequence: TTA
tttgtatatatagagagaga

SEQ ID NO: 225294 - DNA, 20 bp, Artificial Sequence
  Description of Artificial Sequence: Synthetic oligonucleotide
  Target: ATXN1; (-) strand; PAM type: YTN; PAM sequence: TTT
atttgtatatatagagagag

SEQ ID NO: 225295 - DNA, 20 bp, Artificial Sequence
  Description of Artificial Sequence: Synthetic oligonucleotide
  Target: ATXN1; (-) strand; PAM type: YTN; PAM sequence: TTA
tttatttgtatatatagaga

SEQ ID NO: 225296 - DNA, 20 bp, Artificial Sequence
  Description of Artificial Sequence: Synthetic oligonucleotide
  Target: ATXN1; (-) strand; PAM type: YTN; PAM sequence: TTT
atttatttgtatatatagag

SEQ ID NO: 225297 - DNA, 20 bp, Artificial Sequence
  Description of Artificial Sequence: Synthetic oligonucleotide
  Target: ATXN1; (-) strand; PAM type: YTN; PAM sequence: TTC
atttatttatttgtatatat

SEQ ID NO: 225298 - DNA, 20 bp, Artificial Sequence
  Description of Artificial Sequence: Synthetic oligonucleotide
  Target: ATXN1; (-) strand; PAM type: YTN; PAM sequence: TTA
ttcatttatttatttgtata

SEQ ID NO: 225299 - DNA, 20 bp, Artificial Sequence
  Description of Artificial Sequence: Synthetic oligonucleotide
  Target: ATXN1; (-) strand; PAM type: YTN; PAM sequence: TTT
attcatttatttatttgtat

SEQ ID NO: 225300 - DNA, 20 bp, Artificial Sequence
  Description of Artificial Sequence: Synthetic oligonucleotide
  Target: ATXN1; (-) strand; PAM type: YTN; PAM sequence: TTA
tttattcatttatttatttg

SEQ ID NO: 225301 - DNA, 20 bp, Artificial Sequence
  Description of Artificial Sequence: Synthetic oligonucleotide
  Target: ATXN1; (-) strand; PAM type: YTN; PAM sequence: TTT
atttattcatttatttattt

SEQ ID NO: 225302 - DNA, 20 bp, Artificial Sequence
  Description of Artificial Sequence: Synthetic oligonucleotide
  Target: ATXN1; (-) strand; PAM type: YTN; PAM sequence: TTA
tttatttattcatttattta

SEQ ID NO: 225303 - DNA, 20 bp, Artificial Sequence
  Description of Artificial Sequence: Synthetic oligonucleotide
  Target: ATXN1; (-) strand; PAM type: YTN; PAM sequence: TTT
atttatttattcatttattt

SEQ ID NO: 225304 - DNA, 20 bp, Artificial Sequence
  Description of Artificial Sequence: Synthetic oligonucleotide
  Target: ATXN1; (-) strand; PAM type: YTN; PAM sequence: TTA
tttatttatttattcattta

SEQ ID NO: 225305 - DNA, 20 bp, Artificial Sequence
  Description of Artificial Sequence: Synthetic oligonucleotide
  Target: ATXN1; (-) strand; PAM type: YTN; PAM sequence: TTT
atttatttatttattcattt

SEQ ID NO: 225306 - DNA, 20 bp, Artificial Sequence
  Description of Artificial Sequence: Synthetic oligonucleotide
  Target: ATXN1; (-) strand; PAM type: YTN; PAM sequence: TTT
tatttatttatttattcatt

SEQ ID NO: 225307 - DNA, 20 bp, Artificial Sequence
  Description of Artificial Sequence: Synthetic oligonucleotide
  Target: ATXN1; (-) strand; PAM type: YTN; PAM sequence: TTA
cattttatttatttatttat

SEQ ID NO: 225308 - DNA, 20 bp, Artificial Sequence
  Description of Artificial Sequence: Synthetic oligonucleotide
  Target: ATXN1; (-) strand; PAM type: YTN; PAM sequence: TTA
tcatattacattttatttat

SEQ ID NO: 225309 - DNA, 20 bp, Artificial Sequence
  Description of Artificial Sequence: Synthetic oligonucleotide
  Target: ATXN1; (-) strand; PAM type: YTN; PAM sequence: TTA
tatgttatcatattacattt

SEQ ID NO: 225310 - DNA, 20 bp, Artificial Sequence
  Description of Artificial Sequence: Synthetic oligonucleotide
  Target: ATXN1; (-) strand; PAM type: YTN; PAM sequence: TTT
atatgttatcatattacatt

SEQ ID NO: 225311 - DNA, 20 bp, Artificial Sequence
  Description of Artificial Sequence: Synthetic oligonucleotide
  Target: ATXN1; (-) strand; PAM type: YTN; PAM sequence: CTG
tcggtatacgtgatatttat

SEQ ID NO: 225312 - DNA, 20 bp, Artificial Sequence
  Description of Artificial Sequence: Synthetic oligonucleotide
  Target: ATXN1; (-) strand; PAM type: YTN; PAM sequence: TTA
atatataaagtaaggactgt

SEQ ID NO: 225313 - DNA, 20 bp, Artificial Sequence
  Description of Artificial Sequence: Synthetic oligonucleotide
  Target: ATXN1; (-) strand; PAM type: YTN; PAM sequence: TTA
aataagacattaatatataa

SEQ ID NO: 225314 - DNA, 20 bp, Artificial Sequence
  Description of Artificial Sequence: Synthetic oligonucleotide
  Target: ATXN1; (-) strand; PAM type: YTN; PAM sequence: CTG
tccagggttaaataagacat

SEQ ID NO: 225315 - DNA, 20 bp, Artificial Sequence
  Description of Artificial Sequence: Synthetic oligonucleotide
  Target: ATXN1; (-) strand; PAM type: YTN; PAM sequence: CTA
agagagcccaggagagctgt

SEQ ID NO: 225316 - DNA, 20 bp, Artificial Sequence
  Description of Artificial Sequence: Synthetic oligonucleotide
  Target: ATXN1; (-) strand; PAM type: YTN; PAM sequence: CTG
agtggtgaaggctaagagag

SEQ ID NO: 225317 - DNA, 20 bp, Artificial Sequence
  Description of Artificial Sequence: Synthetic oligonucleotide
  Target: ATXN1; (-) strand; PAM type: YTN; PAM sequence: TTC
tgagtggtgaaggctaagag

SEQ ID NO: 225318 - DNA, 20 bp, Artificial Sequence
  Description of Artificial Sequence: Synthetic oligonucleotide
  Target: ATXN1; (-) strand; PAM type: YTN; PAM sequence: TTC
atagccatgttctgagtggt

SEQ ID NO: 225319 - DNA, 20 bp, Artificial Sequence
  Description of Artificial Sequence: Synthetic oligonucleotide
  Target: ATXN1; (-) strand; PAM type: YTN; PAM sequence: CTG
aggcattcatagccatgttc

SEQ ID NO: 225320 - DNA, 20 bp, Artificial Sequence
  Description of Artificial Sequence: Synthetic oligonucleotide
  Target: ATXN1; (-) strand; PAM type: YTN; PAM sequence: CTA
gccagtgtggcctgaggcat

SEQ ID NO: 225321 - DNA, 20 bp, Artificial Sequence
  Description of Artificial Sequence: Synthetic oligonucleotide
  Target: ATXN1; (-) strand; PAM type: YTN; PAM sequence: CTC
cacctagccagtgtggcctg

SEQ ID NO: 225322 - DNA, 20 bp, Artificial Sequence
  Description of Artificial Sequence: Synthetic oligonucleotide
  Target: ATXN1; (-) strand; PAM type: YTN; PAM sequence: CTC
tccacctagccagtgtggcc

SEQ ID NO: 225323 - DNA, 20 bp, Artificial Sequence
  Description of Artificial Sequence: Synthetic oligonucleotide
  Target: ATXN1; (-) strand; PAM type: YTN; PAM sequence: CTC
tctccacctagccagtgtgg

SEQ ID NO: 225324 - DNA, 20 bp, Artificial Sequence
  Description of Artificial Sequence: Synthetic oligonucleotide
  Target: ATXN1; (-) strand; PAM type: YTN; PAM sequence: CTA
gctctctccacctagccagt

SEQ ID NO: 225325 - DNA, 20 bp, Artificial Sequence
  Description of Artificial Sequence: Synthetic oligonucleotide
  Target: ATXN1; (-) strand; PAM type: YTN; PAM sequence: TTC
ctagctctctccacctagcc

SEQ ID NO: 225326 - DNA, 20 bp, Artificial Sequence
  Description of Artificial Sequence: Synthetic oligonucleotide
  Target: ATXN1; (-) strand; PAM type: YTN; PAM sequence: CTC
attcctagctctctccacct

SEQ ID NO: 225327 - DNA, 20 bp, Artificial Sequence
  Description of Artificial Sequence: Synthetic oligonucleotide
  Target: ATXN1; (-) strand; PAM type: YTN; PAM sequence: TTC
tcattcctagctctctccac

SEQ ID NO: 225328 - DNA, 20 bp, Artificial Sequence
  Description of Artificial Sequence: Synthetic oligonucleotide
  Target: ATXN1; (-) strand; PAM type: YTN; PAM sequence: TTA
attctcattcctagctctct

SEQ ID NO: 225329 - DNA, 20 bp, Artificial Sequence
  Description of Artificial Sequence: Synthetic oligonucleotide
  Target: ATXN1; (-) strand; PAM type: YTN; PAM sequence: CTG
aatcatatacattaattctc

SEQ ID NO: 225330 - DNA, 20 bp, Artificial Sequence
  Description of Artificial Sequence: Synthetic oligonucleotide
  Target: ATXN1; (-) strand; PAM type: YTN; PAM sequence: CTA
agctgaatcatatacattaa

SEQ ID NO: 225331 - DNA, 20 bp, Artificial Sequence
  Description of Artificial Sequence: Synthetic oligonucleotide
  Target: ATXN1; (-) strand; PAM type: YTN; PAM sequence: CTG
ataaaatcactaagctgaat

SEQ ID NO: 225332 - DNA, 20 bp, Artificial Sequence
  Description of Artificial Sequence: Synthetic oligonucleotide
  Target: ATXN1; (-) strand; PAM type: YTN; PAM sequence: TTA
agagaaaccagataatcaat

SEQ ID NO: 225333 - DNA, 20 bp, Artificial Sequence
  Description of Artificial Sequence: Synthetic oligonucleotide
  Target: ATXN1; (-) strand; PAM type: YTN; PAM sequence: CTT
aagagaaaccagataatcaa

SEQ ID NO: 225334 - DNA, 20 bp, Artificial Sequence
  Description of Artificial Sequence: Synthetic oligonucleotide
  Target: ATXN1; (-) strand; PAM type: YTN; PAM sequence: CTG
taaacttaagagaaaccaga

SEQ ID NO: 225335 - DNA, 20 bp, Artificial Sequence
  Description of Artificial Sequence: Synthetic oligonucleotide
  Target: ATXN1; (-) strand; PAM type: YTN; PAM sequence: CTA
tatctgtaaacttaagagaa

SEQ ID NO: 225336 - DNA, 20 bp, Artificial Sequence
  Description of Artificial Sequence: Synthetic oligonucleotide
  Target: ATXN1; (-) strand; PAM type: YTN; PAM sequence: TTG
cctatatctgtaaacttaag

SEQ ID NO: 225337 - DNA, 20 bp, Artificial Sequence
  Description of Artificial Sequence: Synthetic oligonucleotide
  Target: ATXN1; (-) strand; PAM type: YTN; PAM sequence: TTT
gcctatatctgtaaacttaa

SEQ ID NO: 225338 - DNA, 20 bp, Artificial Sequence
  Description of Artificial Sequence: Synthetic oligonucleotide
  Target: ATXN1; (-) strand; PAM type: YTN; PAM sequence: TTC
atatttgcctatatctgtaa

SEQ ID NO: 225339 - DNA, 20 bp, Artificial Sequence
  Description of Artificial Sequence: Synthetic oligonucleotide
  Target: ATXN1; (-) strand; PAM type: YTN; PAM sequence: TTT
catatttgcctatatctgta

SEQ ID NO: 225340 - DNA, 20 bp, Artificial Sequence
  Description of Artificial Sequence: Synthetic oligonucleotide
  Target: ATXN1; (-) strand; PAM type: YTN; PAM sequence: CTT
tcatatttgcctatatctgt

SEQ ID NO: 225341 - DNA, 20 bp, Artificial Sequence
  Description of Artificial Sequence: Synthetic oligonucleotide
  Target: ATXN1; (-) strand; PAM type: YTN; PAM sequence: CTC
ctttcatatttgcctatatc

SEQ ID NO: 225342 - DNA, 20 bp, Artificial Sequence
  Description of Artificial Sequence: Synthetic oligonucleotide
  Target: ATXN1; (-) strand; PAM type: YTN; PAM sequence: TTC
aatctcctttcatatttgcc

SEQ ID NO: 225343 - DNA, 20 bp, Artificial Sequence
  Description of Artificial Sequence: Synthetic oligonucleotide
  Target: ATXN1; (-) strand; PAM type: YTN; PAM sequence: CTT
caatctcctttcatatttgc

SEQ ID NO: 225344 - DNA, 20 bp, Artificial Sequence
  Description of Artificial Sequence: Synthetic oligonucleotide
  Target: ATXN1; (-) strand; PAM type: YTN; PAM sequence: TTG
tcatgtcttcaatctccttt

SEQ ID NO: 225345 - DNA, 20 bp, Artificial Sequence
  Description of Artificial Sequence: Synthetic oligonucleotide
  Target: ATXN1; (-) strand; PAM type: YTN; PAM sequence: TTG
gttgtcatgtcttcaatctc

SEQ ID NO: 225346 - DNA, 20 bp, Artificial Sequence
  Description of Artificial Sequence: Synthetic oligonucleotide
  Target: ATXN1; (-) strand; PAM type: YTN; PAM sequence: CTT
ggttgtcatgtcttcaatct

SEQ ID NO: 225347 - DNA, 20 bp, Artificial Sequence
  Description of Artificial Sequence: Synthetic oligonucleotide
  Target: ATXN1; (-) strand; PAM type: YTN; PAM sequence: TTG
tcttggttgtcatgtcttca

SEQ ID NO: 225348 - DNA, 20 bp, Artificial Sequence
  Description of Artificial Sequence: Synthetic oligonucleotide
  Target: ATXN1; (-) strand; PAM type: YTN; PAM sequence: CTT
gtcttggttgtcatgtcttc

SEQ ID NO: 225349 - DNA, 20 bp, Artificial Sequence
  Description of Artificial Sequence: Synthetic oligonucleotide
  Target: ATXN1; (-) strand; PAM type: YTN; PAM sequence: CTA
cttgtcttggttgtcatgtc

SEQ ID NO: 225350 - DNA, 20 bp, Artificial Sequence
  Description of Artificial Sequence: Synthetic oligonucleotide
  Target: ATXN1; (-) strand; PAM type: YTN; PAM sequence: CTA
tctacttgtcttggttgtca

SEQ ID NO: 225351 - DNA, 20 bp, Artificial Sequence
  Description of Artificial Sequence: Synthetic oligonucleotide
  Target: ATXN1; (-) strand; PAM type: YTN; PAM sequence: CTG
tcctatctacttgtcttggt

SEQ ID NO: 225352 - DNA, 20 bp, Artificial Sequence
  Description of Artificial Sequence: Synthetic oligonucleotide
  Target: ATXN1; (-) strand; PAM type: YTN; PAM sequence: CTC
tgtcctatctacttgtcttg

SEQ ID NO: 225353 - DNA, 20 bp, Artificial Sequence
  Description of Artificial Sequence: Synthetic oligonucleotide
  Target: ATXN1; (-) strand; PAM type: YTN; PAM sequence: CTC
gatgccacagcctctgtcct

SEQ ID NO: 225354 - DNA, 20 bp, Artificial Sequence
  Description of Artificial Sequence: Synthetic oligonucleotide
  Target: ATXN1; (-) strand; PAM type: YTN; PAM sequence: TTC
tcgatgccacagcctctgtc

SEQ ID NO: 225355 - DNA, 20 bp, Artificial Sequence
  Description of Artificial Sequence: Synthetic oligonucleotide
  Target: ATXN1; (-) strand; PAM type: YTN; PAM sequence: CTT
ctcgatgccacagcctctgt

SEQ ID NO: 225356 - DNA, 20 bp, Artificial Sequence
  Description of Artificial Sequence: Synthetic oligonucleotide
  Target: ATXN1; (-) strand; PAM type: YTN; PAM sequence: TTC
ttctcgatgccacagcctct

SEQ ID NO: 225357 - DNA, 20 bp, Artificial Sequence
  Description of Artificial Sequence: Synthetic oligonucleotide
  Target: ATXN1; (-) strand; PAM type: YTN; PAM sequence: CTC
ataattcttctcgatgccac

SEQ ID NO: 225358 - DNA, 20 bp, Artificial Sequence
  Description of Artificial Sequence: Synthetic oligonucleotide
  Target: ATXN1; (-) strand; PAM type: YTN; PAM sequence: CTC
aaaagctcataattcttctc

SEQ ID NO: 225359 - DNA, 20 bp, Artificial Sequence
  Description of Artificial Sequence: Synthetic oligonucleotide
  Target: ATXN1; (-) strand; PAM type: YTN; PAM sequence: CTG
atgcctcaaaagctcataat

SEQ ID NO: 225360 - DNA, 20 bp, Artificial Sequence
  Description of Artificial Sequence: Synthetic oligonucleotide
  Target: ATXN1; (-) strand; PAM type: YTN; PAM sequence: CTC
gacatagtagcgtcctgatg

SEQ ID NO: 225361 - DNA, 20 bp, Artificial Sequence
  Description of Artificial Sequence: Synthetic oligonucleotide
  Target: ATXN1; (-) strand; PAM type: YTN; PAM sequence: TTA
cctcgacatagtagcgtcct

SEQ ID NO: 225362 - DNA, 20 bp, Artificial Sequence
  Description of Artificial Sequence: Synthetic oligonucleotide
  Target: ATXN1; (-) strand; PAM type: YTN; PAM sequence: TTA
ttacctcgacatagtagcgt

SEQ ID NO: 225363 - DNA, 20 bp, Artificial Sequence
  Description of Artificial Sequence: Synthetic oligonucleotide
  Target: ATXN1; (-) strand; PAM type: YTN; PAM sequence: CTG
tgaagttattacctcgacat

SEQ ID NO: 225364 - DNA, 20 bp, Artificial Sequence
  Description of Artificial Sequence: Synthetic oligonucleotide
  Target: ATXN1; (-) strand; PAM type: YTN; PAM sequence: TTC
tgtgaagttattacctcgac

SEQ ID NO: 225365 - DNA, 20 bp, Artificial Sequence
  Description of Artificial Sequence: Synthetic oligonucleotide
  Target: ATXN1; (-) strand; PAM type: YTN; PAM sequence: TTT
ctgtgaagttattacctcga

SEQ ID NO: 225366 - DNA, 20 bp, Artificial Sequence
  Description of Artificial Sequence: Synthetic oligonucleotide
  Target: ATXN1; (-) strand; PAM type: YTN; PAM sequence: TTG
tcatttctgtgaagttatta

SEQ ID NO: 225367 - DNA, 20 bp, Artificial Sequence
  Description of Artificial Sequence: Synthetic oligonucleotide
  Target: ATXN1; (-) strand; PAM type: YTN; PAM sequence: TTA
ttgtcatttctgtgaagtta

SEQ ID NO: 225368 - DNA, 20 bp, Artificial Sequence
  Description of Artificial Sequence: Synthetic oligonucleotide
  Target: ATXN1; (-) strand; PAM type: YTN; PAM sequence: CTT
attgtcatttctgtgaagtt

SEQ ID NO: 225369 - DNA, 20 bp, Artificial Sequence
  Description of Artificial Sequence: Synthetic oligonucleotide
  Target: ATXN1; (-) strand; PAM type: YTN; PAM sequence: TTG
gagacttattgtcatttctg

SEQ ID NO: 225370 - DNA, 20 bp, Artificial Sequence
  Description of Artificial Sequence: Synthetic oligonucleotide
  Target: ATXN1; (-) strand; PAM type: YTN; PAM sequence: CTT
ggagacttattgtcatttct

SEQ ID NO: 225371 - DNA, 20 bp, Artificial Sequence
  Description of Artificial Sequence: Synthetic oligonucleotide
  Target: ATXN1; (-) strand; PAM type: YTN; PAM sequence: TTC
ttggagacttattgtcattt

SEQ ID NO: 225372 - DNA, 20 bp, Artificial Sequence
  Description of Artificial Sequence: Synthetic oligonucleotide
  Target: ATXN1; (-) strand; PAM type: YTN; PAM sequence: TTT
cttggagacttattgtcatt

SEQ ID NO: 225373 - DNA, 20 bp, Artificial Sequence
  Description of Artificial Sequence: Synthetic oligonucleotide
  Target: ATXN1; (-) strand; PAM type: YTN; PAM sequence: TTT
tcttggagacttattgtcat

SEQ ID NO: 225374 - DNA, 20 bp, Artificial Sequence
  Description of Artificial Sequence: Synthetic oligonucleotide
  Target: ATXN1; (-) strand; PAM type: YTN; PAM sequence: TTT
ttcttggagacttattgtca

SEQ ID NO: 225375 - DNA, 20 bp, Artificial Sequence
  Description of Artificial Sequence: Synthetic oligonucleotide
  Target: ATXN1; (-) strand; PAM type: YTN; PAM sequence: TTT
tttcttggagacttattgtc

SEQ ID NO: 225376 - DNA, 20 bp, Artificial Sequence
  Description of Artificial Sequence: Synthetic oligonucleotide
  Target: ATXN1; (-) strand; PAM type: YTN; PAM sequence: TTT
ttttcttggagacttattgt

SEQ ID NO: 225377 - DNA, 20 bp, Artificial Sequence
  Description of Artificial Sequence: Synthetic oligonucleotide
  Target: ATXN1; (-) strand; PAM type: YTN; PAM sequence: CTT
tttttcttggagacttattg

SEQ ID NO: 225378 - DNA, 20 bp, Artificial Sequence
  Description of Artificial Sequence: Synthetic oligonucleotide
  Target: ATXN1; (-) strand; PAM type: YTN; PAM sequence: TTA
actttttttcttggagactt

SEQ ID NO: 225379 - DNA, 20 bp, Artificial Sequence
  Description of Artificial Sequence: Synthetic oligonucleotide
  Target: ATXN1; (-) strand; PAM type: YTN; PAM sequence: TTT
aactttttttcttggagact

SEQ ID NO: 225380 - DNA, 20 bp, Artificial Sequence
  Description of Artificial Sequence: Synthetic oligonucleotide
  Target: ATXN1; (-) strand; PAM type: YTN; PAM sequence: CTA
tatagtgaatataatttaac

SEQ ID NO: 225381 - DNA, 20 bp, Artificial Sequence
  Description of Artificial Sequence: Synthetic oligonucleotide
  Target: ATXN1; (-) strand; PAM type: YTN; PAM sequence: CTA
ctatatagtgaatataattt

SEQ ID NO: 225382 - DNA, 20 bp, Artificial Sequence
  Description of Artificial Sequence: Synthetic oligonucleotide
  Target: ATXN1; (-) strand; PAM type: YTN; PAM sequence: CTA
agtagagtgctactatatag

SEQ ID NO: 225383 - DNA, 20 bp, Artificial Sequence
  Description of Artificial Sequence: Synthetic oligonucleotide
  Target: ATXN1; (-) strand; PAM type: YTN; PAM sequence: TTC
ctaagtagagtgctactata

SEQ ID NO: 225384 - DNA, 20 bp, Artificial Sequence
  Description of Artificial Sequence: Synthetic oligonucleotide
  Target: ATXN1; (-) strand; PAM type: YTN; PAM sequence: CTT
cctaagtagagtgctactat

SEQ ID NO: 225385 - DNA, 20 bp, Artificial Sequence
  Description of Artificial Sequence: Synthetic oligonucleotide
  Target: ATXN1; (-) strand; PAM type: YTN; PAM sequence: CTC
ccttcctaagtagagtgcta

SEQ ID NO: 225386 - DNA, 20 bp, Artificial Sequence
  Description of Artificial Sequence: Synthetic oligonucleotide
  Target: ATXN1; (-) strand; PAM type: YTN; PAM sequence: TTC
ctcccttcctaagtagagtg

SEQ ID NO: 225387 - DNA, 20 bp, Artificial Sequence
  Description of Artificial Sequence: Synthetic oligonucleotide
  Target: ATXN1; (-) strand; PAM type: YTN; PAM sequence: TTT
cctcccttcctaagtagagt

SEQ ID NO: 225388 - DNA, 20 bp, Artificial Sequence
  Description of Artificial Sequence: Synthetic oligonucleotide
  Target: ATXN1; (-) strand; PAM type: YTN; PAM sequence: TTA
taaaatttcctcccttccta

SEQ ID NO: 225389 - DNA, 20 bp, Artificial Sequence
  Description of Artificial Sequence: Synthetic oligonucleotide
  Target: ATXN1; (-) strand; PAM type: YTN; PAM sequence: TTG
taaaatgtattataaaattt

SEQ ID NO: 225390 - DNA, 20 bp, Artificial Sequence
  Description of Artificial Sequence: Synthetic oligonucleotide
  Target: ATXN1; (-) strand; PAM type: YTN; PAM sequence: TTC
cggcagaaatcattgtaaaa

SEQ ID NO: 225391 - DNA, 20 bp, Artificial Sequence
  Description of Artificial Sequence: Synthetic oligonucleotide
  Target: ATXN1; (-) strand; PAM type: YTN; PAM sequence: TTT
ccggcagaaatcattgtaaa

SEQ ID NO: 225392 - DNA, 20 bp, Artificial Sequence
  Description of Artificial Sequence: Synthetic oligonucleotide
  Target: ATXN1; (-) strand; PAM type: YTN; PAM sequence: TTT
tccggcagaaatcattgtaa

SEQ ID NO: 225393 - DNA, 20 bp, Artificial Sequence
  Description of Artificial Sequence: Synthetic oligonucleotide
  Target: ATXN1; (-) strand; PAM type: YTN; PAM sequence: CTC
aacattttccggcagaaatc

SEQ ID NO: 225394 - DNA, 20 bp, Artificial Sequence
  Description of Artificial Sequence: Synthetic oligonucleotide
  Target: ATXN1; (-) strand; PAM type: YTN; PAM sequence: TTA
gaaaggggagaaaactcaac

SEQ ID NO: 225395 - DNA, 20 bp, Artificial Sequence
  Description of Artificial Sequence: Synthetic oligonucleotide
  Target: ATXN1; (-) strand; PAM type: YTN; PAM sequence: TTG
ttagaaaggggagaaaactc

SEQ ID NO: 225396 - DNA, 20 bp, Artificial Sequence
  Description of Artificial Sequence: Synthetic oligonucleotide
  Target: ATXN1; (-) strand; PAM type: YTN; PAM sequence: CTG
acattgttagaaaggggaga

SEQ ID NO: 225397 - DNA, 20 bp, Artificial Sequence
  Description of Artificial Sequence: Synthetic oligonucleotide
  Target: ATXN1; (-) strand; PAM type: YTN; PAM sequence: TTA
atgctgacattgttagaaag

SEQ ID NO: 225398 - DNA, 20 bp, Artificial Sequence
  Description of Artificial Sequence: Synthetic oligonucleotide
  Target: ATXN1; (-) strand; PAM type: YTN; PAM sequence: TTA
aatgcattaatgctgacatt

SEQ ID NO: 225399 - DNA, 20 bp, Artificial Sequence
  Description of Artificial Sequence: Synthetic oligonucleotide
  Target: ATXN1; (-) strand; PAM type: YTN; PAM sequence: TTT
aaatgcattaatgctgacat

SEQ ID NO: 225400 - DNA, 20 bp, Artificial Sequence
  Description of Artificial Sequence: Synthetic oligonucleotide
  Target: ATXN1; (-) strand; PAM type: YTN; PAM sequence: TTA
tttaaatgcattaatgctga

SEQ ID NO: 225401 - DNA, 20 bp, Artificial Sequence
  Description of Artificial Sequence: Synthetic oligonucleotide
  Target: ATXN1; (-) strand; PAM type: YTN; PAM sequence: CTC
agaatattatttaaatgcat

SEQ ID NO: 225402 - DNA, 20 bp, Artificial Sequence
  Description of Artificial Sequence: Synthetic oligonucleotide
  Target: ATXN1; (-) strand; PAM type: YTN; PAM sequence: TTA
ctcagaatattatttaaatg

SEQ ID NO: 225403 - DNA, 20 bp, Artificial Sequence
  Description of Artificial Sequence: Synthetic oligonucleotide
  Target: ATXN1; (-) strand; PAM type: YTN; PAM sequence: TTT
actcagaatattatttaaat

SEQ ID NO: 225404 - DNA, 20 bp, Artificial Sequence
  Description of Artificial Sequence: Synthetic oligonucleotide
  Target: ATXN1; (-) strand; PAM type: YTN; PAM sequence: TTC
cagatagtatatttactcag

SEQ ID NO: 225405 - DNA, 20 bp, Artificial Sequence
  Description of Artificial Sequence: Synthetic oligonucleotide
  Target: ATXN1; (-) strand; PAM type: YTN; PAM sequence: CTT
ccagatagtatatttactca

SEQ ID NO: 225406 - DNA, 20 bp, Artificial Sequence
  Description of Artificial Sequence: Synthetic oligonucleotide
  Target: ATXN1; (-) strand; PAM type: YTN; PAM sequence: CTG
cttccagatagtatatttac

SEQ ID NO: 225407 - DNA, 20 bp, Artificial Sequence
  Description of Artificial Sequence: Synthetic oligonucleotide
  Target: ATXN1; (-) strand; PAM type: YTN; PAM sequence: CTG
aaataactgcttccagatag

SEQ ID NO: 225408 - DNA, 20 bp, Artificial Sequence
  Description of Artificial Sequence: Synthetic oligonucleotide
  Target: ATXN1; (-) strand; PAM type: YTN; PAM sequence: CTC
ctgaaataactgcttccaga

SEQ ID NO: 225409 - DNA, 20 bp, Artificial Sequence
  Description of Artificial Sequence: Synthetic oligonucleotide
  Target: ATXN1; (-) strand; PAM type: YTN; PAM sequence: TTG
tagactcctgaaataactgc

SEQ ID NO: 225410 - DNA, 20 bp, Artificial Sequence
  Description of Artificial Sequence: Synthetic oligonucleotide
  Target: ATXN1; (-) strand; PAM type: YTN; PAM sequence: TTT
gtagactcctgaaataactg

SEQ ID NO: 225411 - DNA, 20 bp, Artificial Sequence
  Description of Artificial Sequence: Synthetic oligonucleotide
  Target: ATXN1; (-) strand; PAM type: YTN; PAM sequence: TTT
tgtagactcctgaaataact

SEQ ID NO: 225412 - DNA, 20 bp, Artificial Sequence
  Description of Artificial Sequence: Synthetic oligonucleotide
  Target: ATXN1; (-) strand; PAM type: YTN; PAM sequence: TTA
attttgtagactcctgaaat

SEQ ID NO: 225413 - DNA, 20 bp, Artificial Sequence
  Description of Artificial Sequence: Synthetic oligonucleotide
  Target: ATXN1; (-) strand; PAM type: YTN; PAM sequence: TTT
aattttgtagactcctgaaa

SEQ ID NO: 225414 - DNA, 20 bp, Artificial Sequence
  Description of Artificial Sequence: Synthetic oligonucleotide
  Target: ATXN1; (-) strand; PAM type: YTN; PAM sequence: TTA
aatatttaattttgtagact

SEQ ID NO: 225415 - DNA, 20 bp, Artificial Sequence
  Description of Artificial Sequence: Synthetic oligonucleotide
  Target: ATXN1; (-) strand; PAM type: YTN; PAM sequence: TTT
aaatatttaattttgtagac

SEQ ID NO: 225416 - DNA, 20 bp, Artificial Sequence
  Description of Artificial Sequence: Synthetic oligonucleotide
  Target: ATXN1; (-) strand; PAM type: YTN; PAM sequence: CTA
gtaaagatttaaatatttaa

SEQ ID NO: 225417 - DNA, 20 bp, Artificial Sequence
  Description of Artificial Sequence: Synthetic oligonucleotide
  Target: ATXN1; (-) strand; PAM type: YTN; PAM sequence: CTC
tagtaaagatttaaatattt

SEQ ID NO: 225418 - DNA, 20 bp, Artificial Sequence
  Description of Artificial Sequence: Synthetic oligonucleotide
  Target: ATXN1; (-) strand; PAM type: YTN; PAM sequence: TTC
tctagtaaagatttaaatat

SEQ ID NO: 225419 - DNA, 20 bp, Artificial Sequence
  Description of Artificial Sequence: Synthetic oligonucleotide
  Target: ATXN1; (-) strand; PAM type: YTN; PAM sequence: TTT
ctctagtaaagatttaaata

SEQ ID NO: 225420 - DNA, 20 bp, Artificial Sequence
  Description of Artificial Sequence: Synthetic oligonucleotide
  Target: ATXN1; (-) strand; PAM type: YTN; PAM sequence: TTC
catatttctctagtaaagat

SEQ ID NO: 225421 - DNA, 20 bp, Artificial Sequence
  Description of Artificial Sequence: Synthetic oligonucleotide
  Target: ATXN1; (-) strand; PAM type: YTN; PAM sequence: CTT
ccatatttctctagtaaaga

SEQ ID NO: 225422 - DNA, 20 bp, Artificial Sequence
  Description of Artificial Sequence: Synthetic oligonucleotide
  Target: ATXN1; (-) strand; PAM type: YTN; PAM sequence: TTA
cttccatatttctctagtaa

SEQ ID NO: 225423 - DNA, 20 bp, Artificial Sequence
  Description of Artificial Sequence: Synthetic oligonucleotide
  Target: ATXN1; (-) strand; PAM type: YTN; PAM sequence: CTT
acttccatatttctctagta

SEQ ID NO: 225424 - DNA, 20 bp, Artificial Sequence
  Description of Artificial Sequence: Synthetic oligonucleotide
  Target: ATXN1; (-) strand; PAM type: YTN; PAM sequence: TTC
ttacttccatatttctctag

SEQ ID NO: 225425 - DNA, 20 bp, Artificial Sequence
  Description of Artificial Sequence: Synthetic oligonucleotide
  Target: ATXN1; (-) strand; PAM type: YTN; PAM sequence: TTG
ttcttacttccatatttctc

SEQ ID NO: 225426 - DNA, 20 bp, Artificial Sequence
  Description of Artificial Sequence: Synthetic oligonucleotide
  Target: ATXN1; (-) strand; PAM type: YTN; PAM sequence: TTT
gttcttacttccatatttct

SEQ ID NO: 225427 - DNA, 20 bp, Artificial Sequence
  Description of Artificial Sequence: Synthetic oligonucleotide
  Target: ATXN1; (-) strand; PAM type: YTN; PAM sequence: TTT
tgttcttacttccatatttc

SEQ ID NO: 225428 - DNA, 20 bp, Artificial Sequence
  Description of Artificial Sequence: Synthetic oligonucleotide
  Target: ATXN1; (-) strand; PAM type: YTN; PAM sequence: CTT
ttgttcttacttccatattt

SEQ ID NO: 225429 - DNA, 20 bp, Artificial Sequence
  Description of Artificial Sequence: Synthetic oligonucleotide
  Target: ATXN1; (-) strand; PAM type: YTN; PAM sequence: TTC
acttttgttcttacttccat

SEQ ID NO: 225430 - DNA, 20 bp, Artificial Sequence
  Description of Artificial Sequence: Synthetic oligonucleotide
  Target: ATXN1; (-) strand; PAM type: YTN; PAM sequence: TTA
ttcacttttgttcttacttc

SEQ ID NO: 225431 - DNA, 20 bp, Artificial Sequence
  Description of Artificial Sequence: Synthetic oligonucleotide
  Target: ATXN1; (-) strand; PAM type: YTN; PAM sequence: CTC
aatgattattcacttttgtt

SEQ ID NO: 225432 - DNA, 20 bp, Artificial Sequence
  Description of Artificial Sequence: Synthetic oligonucleotide
  Target: ATXN1; (-) strand; PAM type: YTN; PAM sequence: TTC
ctcaatgattattcactttt

SEQ ID NO: 225433 - DNA, 20 bp, Artificial Sequence
  Description of Artificial Sequence: Synthetic oligonucleotide
  Target: ATXN1; (-) strand; PAM type: YTN; PAM sequence: TTA
agagttcctcaatgattatt

SEQ ID NO: 225434 - DNA, 20 bp, Artificial Sequence
  Description of Artificial Sequence: Synthetic oligonucleotide
  Target: ATXN1; (-) strand; PAM type: YTN; PAM sequence: CTT
aagagttcctcaatgattat

SEQ ID NO: 225435 - DNA, 20 bp, Artificial Sequence
  Description of Artificial Sequence: Synthetic oligonucleotide
  Target: ATXN1; (-) strand; PAM type: YTN; PAM sequence: TTC
ttaagagttcctcaatgatt

SEQ ID NO: 225436 - DNA, 20 bp, Artificial Sequence
  Description of Artificial Sequence: Synthetic oligonucleotide
  Target: ATXN1; (-) strand; PAM type: YTN; PAM sequence: CTA
cacagagaatgcaaaaccgt

SEQ ID NO: 225437 - DNA, 20 bp, Artificial Sequence
  Description of Artificial Sequence: Synthetic oligonucleotide
  Target: ATXN1; (-) strand; PAM type: YTN; PAM sequence: CTC
tacacagagaatgcaaaacc

SEQ ID NO: 225438 - DNA, 20 bp, Artificial Sequence
  Description of Artificial Sequence: Synthetic oligonucleotide
  Target: ATXN1; (-) strand; PAM type: YTN; PAM sequence: CTC
tctacacagagaatgcaaaa

SEQ ID NO: 225439 - DNA, 20 bp, Artificial Sequence
  Description of Artificial Sequence: Synthetic oligonucleotide
  Target: ATXN1; (-) strand; PAM type: YTN; PAM sequence: TTC
ctctctacacagagaatgca

SEQ ID NO: 225440 - DNA, 20 bp, Artificial Sequence
  Description of Artificial Sequence: Synthetic oligonucleotide
  Target: ATXN1; (-) strand; PAM type: YTN; PAM sequence: TTC
ccatcataggttcctctcta

SEQ ID NO: 225441 - DNA, 20 bp, Artificial Sequence
  Description of Artificial Sequence: Synthetic oligonucleotide
  Target: ATXN1; (-) strand; PAM type: YTN; PAM sequence: TTT
cccatcataggttcctctct

SEQ ID NO: 225442 - DNA, 20 bp, Artificial Sequence
  Description of Artificial Sequence: Synthetic oligonucleotide
  Target: ATXN1; (-) strand; PAM type: YTN; PAM sequence: TTT
tcccatcataggttcctctc

SEQ ID NO: 225443 - DNA, 20 bp, Artificial Sequence
  Description of Artificial Sequence: Synthetic oligonucleotide
  Target: ATXN1; (-) strand; PAM type: YTN; PAM sequence: TTT
ttcccatcataggttcctct

SEQ ID NO: 225444 - DNA, 20 bp, Artificial Sequence
  Description of Artificial Sequence: Synthetic oligonucleotide
  Target: ATXN1; (-) strand; PAM type: YTN; PAM sequence: TTT
tttcccatcataggttcctc

SEQ ID NO: 225445 - DNA, 20 bp, Artificial Sequence
  Description of Artificial Sequence: Synthetic oligonucleotide
  Target: ATXN1; (-) strand; PAM type: YTN; PAM sequence: TTA
ttttttcccatcataggttc

SEQ ID NO: 225446 - DNA, 20 bp, Artificial Sequence
  Description of Artificial Sequence: Synthetic oligonucleotide
  Target: ATXN1; (-) strand; PAM type: YTN; PAM sequence: TTT
attttttcccatcataggtt

SEQ ID NO: 225447 - DNA, 20 bp, Artificial Sequence
  Description of Artificial Sequence: Synthetic oligonucleotide
  Target: ATXN1; (-) strand; PAM type: YTN; PAM sequence: CTA
accagtaggtcaaaaaggaa

SEQ ID NO: 225448 - DNA, 20 bp, Artificial Sequence
  Description of Artificial Sequence: Synthetic oligonucleotide
  Target: ATXN1; (-) strand; PAM type: YTN; PAM sequence: TTA
tgacagcactaaccagtagg

SEQ ID NO: 225449 - DNA, 20 bp, Artificial Sequence
  Description of Artificial Sequence: Synthetic oligonucleotide
  Target: ATXN1; (-) strand; PAM type: YTN; PAM sequence: TTT
atgacagcactaaccagtag

SEQ ID NO: 225450 - DNA, 20 bp, Artificial Sequence
  Description of Artificial Sequence: Synthetic oligonucleotide
  Target: ATXN1; (-) strand; PAM type: YTN; PAM sequence: CTT
tatgacagcactaaccagta

SEQ ID NO: 225451 - DNA, 20 bp, Artificial Sequence
  Description of Artificial Sequence: Synthetic oligonucleotide
  Target: ATXN1; (-) strand; PAM type: YTN; PAM sequence: CTG
gaggggctttatgacagcac

SEQ ID NO: 225452 - DNA, 20 bp, Artificial Sequence
  Description of Artificial Sequence: Synthetic oligonucleotide
  Target: ATXN1; (-) strand; PAM type: YTN; PAM sequence: CTA
agctggaggggctttatgac

SEQ ID NO: 225453 - DNA, 20 bp, Artificial Sequence
  Description of Artificial Sequence: Synthetic oligonucleotide
  Target: ATXN1; (-) strand; PAM type: YTN; PAM sequence: CTC
aggtcgcctaagctggaggg

SEQ ID NO: 225454 - DNA, 20 bp, Artificial Sequence
  Description of Artificial Sequence: Synthetic oligonucleotide
  Target: ATXN1; (-) strand; PAM type: YTN; PAM sequence: CTC
tcaggtcgcctaagctggag

SEQ ID NO: 225455 - DNA, 20 bp, Artificial Sequence
  Description of Artificial Sequence: Synthetic oligonucleotide
  Target: ATXN1; (-) strand; PAM type: YTN; PAM sequence: TTC
tctcaggtcgcctaagctgg

SEQ ID NO: 225456 - DNA, 20 bp, Artificial Sequence
  Description of Artificial Sequence: Synthetic oligonucleotide
  Target: ATXN1; (-) strand; PAM type: YTN; PAM sequence: TTA
aaaattctctcaggtcgcct

SEQ ID NO: 225457 - DNA, 20 bp, Artificial Sequence
  Description of Artificial Sequence: Synthetic oligonucleotide
  Target: ATXN1; (-) strand; PAM type: YTN; PAM sequence: TTT
aaaaattctctcaggtcgcc

SEQ ID NO: 225458 - DNA, 20 bp, Artificial Sequence
  Description of Artificial Sequence: Synthetic oligonucleotide
  Target: ATXN1; (-) strand; PAM type: YTN; PAM sequence: TTT
taaaaattctctcaggtcgc

SEQ ID NO: 225459 - DNA, 20 bp, Artificial Sequence
  Description of Artificial Sequence: Synthetic oligonucleotide
  Target: ATXN1; (-) strand; PAM type: YTN; PAM sequence: CTG
aaaagagggttttaaaaatt

SEQ ID NO: 225460 - DNA, 20 bp, Artificial Sequence
  Description of Artificial Sequence: Synthetic oligonucleotide
  Target: ATXN1; (-) strand; PAM type: YTN; PAM sequence: TTC
tgaaaagagggttttaaaaa

SEQ ID NO: 225461 - DNA, 20 bp, Artificial Sequence
  Description of Artificial Sequence: Synthetic oligonucleotide
  Target: ATXN1; (-) strand; PAM type: YTN; PAM sequence: CTA
ttctgaaaagagggttttaa

SEQ ID NO: 225462 - DNA, 20 bp, Artificial Sequence
  Description of Artificial Sequence: Synthetic oligonucleotide
  Target: ATXN1; (-) strand; PAM type: YTN; PAM sequence: TTC
cactattctgaaaagagggt

SEQ ID NO: 225463 - DNA, 20 bp, Artificial Sequence
  Description of Artificial Sequence: Synthetic oligonucleotide
  Target: ATXN1; (-) strand; PAM type: YTN; PAM sequence: TTT
ccactattctgaaaagaggg

SEQ ID NO: 225464 - DNA, 20 bp, Artificial Sequence
  Description of Artificial Sequence: Synthetic oligonucleotide
  Target: ATXN1; (-) strand; PAM type: YTN; PAM sequence: TTT
tccactattctgaaaagagg

SEQ ID NO: 225465 - DNA, 20 bp, Artificial Sequence
  Description of Artificial Sequence: Synthetic oligonucleotide
  Target: ATXN1; (-) strand; PAM type: YTN; PAM sequence: CTT
ttccactattctgaaaagag

SEQ ID NO: 225466 - DNA, 20 bp, Artificial Sequence
  Description of Artificial Sequence: Synthetic oligonucleotide
  Target: ATXN1; (-) strand; PAM type: YTN; PAM sequence: TTG
gaaatgagaaggggagaaaa

SEQ ID NO: 225467 - DNA, 20 bp, Artificial Sequence
  Description of Artificial Sequence: Synthetic oligonucleotide
  Target: ATXN1; (-) strand; PAM type: YTN; PAM sequence: CTT
ggaaatgagaaggggagaaa

SEQ ID NO: 225468 - DNA, 20 bp, Artificial Sequence
  Description of Artificial Sequence: Synthetic oligonucleotide
  Target: ATXN1; (-) strand; PAM type: YTN; PAM sequence: CTC
ttggaaatgagaaggggaga

SEQ ID NO: 225469 - DNA, 20 bp, Artificial Sequence
  Description of Artificial Sequence: Synthetic oligonucleotide
  Target: ATXN1; (-) strand; PAM type: YTN; PAM sequence: TTC
tcttggaaatgagaagggga

SEQ ID NO: 225470 - DNA, 20 bp, Artificial Sequence
  Description of Artificial Sequence: Synthetic oligonucleotide
  Target: ATXN1; (-) strand; PAM type: YTN; PAM sequence: TTT
ctcttggaaatgagaagggg

SEQ ID NO: 225471 - DNA, 20 bp, Artificial Sequence
  Description of Artificial Sequence: Synthetic oligonucleotide
  Target: ATXN1; (-) strand; PAM type: YTN; PAM sequence: CTT
tctcttggaaatgagaaggg

SEQ ID NO: 225472 - DNA, 20 bp, Artificial Sequence
  Description of Artificial Sequence: Synthetic oligonucleotide
  Target: ATXN1; (-) strand; PAM type: YTN; PAM sequence: CTA
cctttctcttggaaatgaga

SEQ ID NO: 225473 - DNA, 20 bp, Artificial Sequence
  Description of Artificial Sequence: Synthetic oligonucleotide
  Target: ATXN1; (-) strand; PAM type: YTN; PAM sequence: TTA
gggtcaacactacctttctc

SEQ ID NO: 225474 - DNA, 20 bp, Artificial Sequence
  Description of Artificial Sequence: Synthetic oligonucleotide
  Target: ATXN1; (-) strand; PAM type: YTN; PAM sequence: TTT
agggtcaacactacctttct

SEQ ID NO: 225475 - DNA, 20 bp, Artificial Sequence
  Description of Artificial Sequence: Synthetic oligonucleotide
  Target: ATXN1; (-) strand; PAM type: YTN; PAM sequence: TTT
tagggtcaacactacctttc

SEQ ID NO: 225476 - DNA, 20 bp, Artificial Sequence
  Description of Artificial Sequence: Synthetic oligonucleotide
  Target: ATXN1; (-) strand; PAM type: YTN; PAM sequence: CTT
ttagggtcaacactaccttt

SEQ ID NO: 225477 - DNA, 20 bp, Artificial Sequence
  Description of Artificial Sequence: Synthetic oligonucleotide
  Target: ATXN1; (-) strand; PAM type: YTN; PAM sequence: TTA
gcttttagggtcaacactac

SEQ ID NO: 225478 - DNA, 20 bp, Artificial Sequence
  Description of Artificial Sequence: Synthetic oligonucleotide
  Target: ATXN1; (-) strand; PAM type: YTN; PAM sequence: CTT
agcttttagggtcaacacta

SEQ ID NO: 225479 - DNA, 20 bp, Artificial Sequence
  Description of Artificial Sequence: Synthetic oligonucleotide
  Target: ATXN1; (-) strand; PAM type: YTN; PAM sequence: CTC
ttagcttttagggtcaacac

SEQ ID NO: 225480 - DNA, 20 bp, Artificial Sequence
  Description of Artificial Sequence: Synthetic oligonucleotide
  Target: ATXN1; (-) strand; PAM type: YTN; PAM sequence: CTC
tcttagcttttagggtcaac

SEQ ID NO: 225481 - DNA, 20 bp, Artificial Sequence
  Description of Artificial Sequence: Synthetic oligonucleotide
  Target: ATXN1; (-) strand; PAM type: YTN; PAM sequence: TTC
ctctcttagcttttagggtc

SEQ ID NO: 225482 - DNA, 20 bp, Artificial Sequence
  Description of Artificial Sequence: Synthetic oligonucleotide
  Target: ATXN1; (-) strand; PAM type: YTN; PAM sequence: TTT
cctctcttagcttttagggt

SEQ ID NO: 225483 - DNA, 20 bp, Artificial Sequence
  Description of Artificial Sequence: Synthetic oligonucleotide
  Target: ATXN1; (-) strand; PAM type: YTN; PAM sequence: TTT
tcctctcttagcttttaggg

SEQ ID NO: 225484 - DNA, 20 bp, Artificial Sequence
  Description of Artificial Sequence: Synthetic oligonucleotide
  Target: ATXN1; (-) strand; PAM type: YTN; PAM sequence: CTT
ttcctctcttagcttttagg

SEQ ID NO: 225485 - DNA, 20 bp, Artificial Sequence
  Description of Artificial Sequence: Synthetic oligonucleotide
  Target: ATXN1; (-) strand; PAM type: YTN; PAM sequence: CTA
gtcttttcctctcttagctt

SEQ ID NO: 225486 - DNA, 20 bp, Artificial Sequence
  Description of Artificial Sequence: Synthetic oligonucleotide
  Target: ATXN1; (-) strand; PAM type: YTN; PAM sequence: TTC
cacaacacacatctagtctt

SEQ ID NO: 225487 - DNA, 20 bp, Artificial Sequence
  Description of Artificial Sequence: Synthetic oligonucleotide
  Target: ATXN1; (-) strand; PAM type: YTN; PAM sequence: TTA
gagaaagaagagtcgagaaa

SEQ ID NO: 225488 - DNA, 20 bp, Artificial Sequence
  Description of Artificial Sequence: Synthetic oligonucleotide
  Target: ATXN1; (-) strand; PAM type: YTN; PAM sequence: TTA
tatagcaagaatattagaga

SEQ ID NO: 225489 - DNA, 20 bp, Artificial Sequence
  Description of Artificial Sequence: Synthetic oligonucleotide
  Target: ATXN1; (-) strand; PAM type: YTN; PAM sequence: TTT
atatagcaagaatattagag

SEQ ID NO: 225490 - DNA, 20 bp, Artificial Sequence
  Description of Artificial Sequence: Synthetic oligonucleotide
  Target: ATXN1; (-) strand; PAM type: YTN; PAM sequence: CTA
ccatgtttatatagcaagaa

SEQ ID NO: 225491 - DNA, 20 bp, Artificial Sequence
  Description of Artificial Sequence: Synthetic oligonucleotide
  Target: ATXN1; (-) strand; PAM type: YTN; PAM sequence: CTG
atggaactaccatgtttata

SEQ ID NO: 225492 - DNA, 20 bp, Artificial Sequence
  Description of Artificial Sequence: Synthetic oligonucleotide
  Target: ATXN1; (-) strand; PAM type: YTN; PAM sequence: TTA
ctgatggaactaccatgttt

SEQ ID NO: 225493 - DNA, 20 bp, Artificial Sequence
  Description of Artificial Sequence: Synthetic oligonucleotide
  Target: ATXN1; (-) strand; PAM type: YTN; PAM sequence: CTT
actgatggaactaccatgtt

SEQ ID NO: 225494 - DNA, 20 bp, Artificial Sequence
  Description of Artificial Sequence: Synthetic oligonucleotide
  Target: ATXN1; (-) strand; PAM type: YTN; PAM sequence: CTC
ttactgatggaactaccatg

SEQ ID NO: 225495 - DNA, 20 bp, Artificial Sequence
  Description of Artificial Sequence: Synthetic oligonucleotide
  Target: ATXN1; (-) strand; PAM type: YTN; PAM sequence: TTA
aaactcttactgatggaact

SEQ ID NO: 225496 - DNA, 20 bp, Artificial Sequence
  Description of Artificial Sequence: Synthetic oligonucleotide
  Target: ATXN1; (-) strand; PAM type: YTN; PAM sequence: CTT
aaaactcttactgatggaac

SEQ ID NO: 225497 - DNA, 20 bp, Artificial Sequence
  Description of Artificial Sequence: Synthetic oligonucleotide
  Target: ATXN1; (-) strand; PAM type: YTN; PAM sequence: TTC
cttaaaactcttactgatgg

SEQ ID NO: 225498 - DNA, 20 bp, Artificial Sequence
  Description of Artificial Sequence: Synthetic oligonucleotide
  Target: ATXN1; (-) strand; PAM type: YTN; PAM sequence: CTT
ccttaaaactcttactgatg

SEQ ID NO: 225499 - DNA, 20 bp, Artificial Sequence
  Description of Artificial Sequence: Synthetic oligonucleotide
  Target: ATXN1; (-) strand; PAM type: YTN; PAM sequence: CTC
gccaacgcttccttaaaact

SEQ ID NO: 225500 - DNA, 20 bp, Artificial Sequence
  Description of Artificial Sequence: Synthetic oligonucleotide
  Target: ATXN1; (-) strand; PAM type: YTN; PAM sequence: TTG
tgacagtgtggtgtcccaaa

SEQ ID NO: 225501 - DNA, 20 bp, Artificial Sequence
  Description of Artificial Sequence: Synthetic oligonucleotide
  Target: ATXN1; (-) strand; PAM type: YTN; PAM sequence: CTC
attgtgacagtgtggtgtcc

SEQ ID NO: 225502 - DNA, 20 bp, Artificial Sequence
  Description of Artificial Sequence: Synthetic oligonucleotide
  Target: ATXN1; (-) strand; PAM type: YTN; PAM sequence: CTA
ctcattgtgacagtgtggtg

SEQ ID NO: 225503 - DNA, 20 bp, Artificial Sequence
  Description of Artificial Sequence: Synthetic oligonucleotide
  Target: ATXN1; (-) strand; PAM type: YTN; PAM sequence: TTG
gtgctactcattgtgacagt

SEQ ID NO: 225504 - DNA, 20 bp, Artificial Sequence
  Description of Artificial Sequence: Synthetic oligonucleotide
  Target: ATXN1; (-) strand; PAM type: YTN; PAM sequence: CTG
taacgtggtggtgttggtgc

SEQ ID NO: 225505 - DNA, 20 bp, Artificial Sequence
  Description of Artificial Sequence: Synthetic oligonucleotide
  Target: ATXN1; (-) strand; PAM type: YTN; PAM sequence: TTC
cactgtaacgtggtggtgtt

SEQ ID NO: 225506 - DNA, 20 bp, Artificial Sequence
  Description of Artificial Sequence: Synthetic oligonucleotide
  Target: ATXN1; (-) strand; PAM type: YTN; PAM sequence: TTT
ccactgtaacgtggtggtgt

SEQ ID NO: 225507 - DNA, 20 bp, Artificial Sequence
  Description of Artificial Sequence: Synthetic oligonucleotide
  Target: ATXN1; (-) strand; PAM type: YTN; PAM sequence: CTG
tggcgtttccactgtaacgt

SEQ ID NO: 225508 - DNA, 20 bp, Artificial Sequence
  Description of Artificial Sequence: Synthetic oligonucleotide
  Target: ATXN1; (-) strand; PAM type: YTN; PAM sequence: CTC
cactgtggcgtttccactgt

SEQ ID NO: 225509 - DNA, 20 bp, Artificial Sequence
  Description of Artificial Sequence: Synthetic oligonucleotide
  Target: ATXN1; (-) strand; PAM type: YTN; PAM sequence: CTA
gctccactgtggcgtttcca

SEQ ID NO: 225510 - DNA, 20 bp, Artificial Sequence
  Description of Artificial Sequence: Synthetic oligonucleotide
  Target: ATXN1; (-) strand; PAM type: YTN; PAM sequence: TTA
ctagctccactgtggcgttt

SEQ ID NO: 225511 - DNA, 20 bp, Artificial Sequence
  Description of Artificial Sequence: Synthetic oligonucleotide
  Target: ATXN1; (-) strand; PAM type: YTN; PAM sequence: CTG
ttactagctccactgtggcg

SEQ ID NO: 225512 - DNA, 20 bp, Artificial Sequence
  Description of Artificial Sequence: Synthetic oligonucleotide
  Target: ATXN1; (-) strand; PAM type: YTN; PAM sequence: CTC
tgttactagctccactgtgg

SEQ ID NO: 225513 - DNA, 20 bp, Artificial Sequence
  Description of Artificial Sequence: Synthetic oligonucleotide
  Target: ATXN1; (-) strand; PAM type: YTN; PAM sequence: CTA
acactctgttactagctcca

SEQ ID NO: 225514 - DNA, 20 bp, Artificial Sequence
  Description of Artificial Sequence: Synthetic oligonucleotide
  Target: ATXN1; (-) strand; PAM type: YTN; PAM sequence: CTA
atactaacactctgttacta

SEQ ID NO: 225515 - DNA, 20 bp, Artificial Sequence
  Description of Artificial Sequence: Synthetic oligonucleotide
  Target: ATXN1; (-) strand; PAM type: YTN; PAM sequence: TTC
atcccgctaatactaacact

SEQ ID NO: 225516 - DNA, 20 bp, Artificial Sequence
  Description of Artificial Sequence: Synthetic oligonucleotide
  Target: ATXN1; (-) strand; PAM type: YTN; PAM sequence: TTG
caccagcaggtgtattcatc

SEQ ID NO: 225517 - DNA, 20 bp, Artificial Sequence
  Description of Artificial Sequence: Synthetic oligonucleotide
  Target: ATXN1; (-) strand; PAM type: YTN; PAM sequence: CTA
aattgcaccagcaggtgtat

SEQ ID NO: 225518 - DNA, 20 bp, Artificial Sequence
  Description of Artificial Sequence: Synthetic oligonucleotide
  Target: ATXN1; (-) strand; PAM type: YTN; PAM sequence: TTC
acctaaattgcaccagcagg

SEQ ID NO: 225519 - DNA, 20 bp, Artificial Sequence
  Description of Artificial Sequence: Synthetic oligonucleotide
  Target: ATXN1; (-) strand; PAM type: YTN; PAM sequence: TTA
tggaaattcacctaaattgc

SEQ ID NO: 225520 - DNA, 20 bp, Artificial Sequence
  Description of Artificial Sequence: Synthetic oligonucleotide
  Target: ATXN1; (-) strand; PAM type: YTN; PAM sequence: CTG
ttatggaaattcacctaaat

SEQ ID NO: 225521 - DNA, 20 bp, Artificial Sequence
  Description of Artificial Sequence: Synthetic oligonucleotide
  Target: ATXN1; (-) strand; PAM type: YTN; PAM sequence: TTC
tgttatggaaattcacctaa

SEQ ID NO: 225522 - DNA, 20 bp, Artificial Sequence
  Description of Artificial Sequence: Synthetic oligonucleotide
  Target: ATXN1; (-) strand; PAM type: YTN; PAM sequence: CTA
atatatgttctgttatggaa

SEQ ID NO: 225523 - DNA, 20 bp, Artificial Sequence
  Description of Artificial Sequence: Synthetic oligonucleotide
  Target: ATXN1; (-) strand; PAM type: YTN; PAM sequence: TTA
actaatatatgttctgttat

SEQ ID NO: 225524 - DNA, 20 bp, Artificial Sequence
  Description of Artificial Sequence: Synthetic oligonucleotide
  Target: ATXN1; (-) strand; PAM type: YTN; PAM sequence: CTA
aagcaaaattaactaatata

SEQ ID NO: 225525 - DNA, 20 bp, Artificial Sequence
  Description of Artificial Sequence: Synthetic oligonucleotide
  Target: ATXN1; (-) strand; PAM type: YTN; PAM sequence: TTC
ataatctaaagcaaaattaa

SEQ ID NO: 225526 - DNA, 20 bp, Artificial Sequence
  Description of Artificial Sequence: Synthetic oligonucleotide
  Target: ATXN1; (-) strand; PAM type: YTN; PAM sequence: TTC
ccaattcataatctaaagca

SEQ ID NO: 225527 - DNA, 20 bp, Artificial Sequence
  Description of Artificial Sequence: Synthetic oligonucleotide
  Target: ATXN1; (-) strand; PAM type: YTN; PAM sequence: TTT
cccaattcataatctaaagc

SEQ ID NO: 225528 - DNA, 20 bp, Artificial Sequence
  Description of Artificial Sequence: Synthetic oligonucleotide
  Target: ATXN1; (-) strand; PAM type: YTN; PAM sequence: TTT
tcccaattcataatctaaag

SEQ ID NO: 225529 - DNA, 20 bp, Artificial Sequence
  Description of Artificial Sequence: Synthetic oligonucleotide
  Target: ATXN1; (-) strand; PAM type: YTN; PAM sequence: CTA
aggaattttcccaattcata

SEQ ID NO: 225530 - DNA, 20 bp, Artificial Sequence
  Description of Artificial Sequence: Synthetic oligonucleotide
  Target: ATXN1; (-) strand; PAM type: YTN; PAM sequence: CTA
ataatatgctaaggaatttt

SEQ ID NO: 225531 - DNA, 20 bp, Artificial Sequence
  Description of Artificial Sequence: Synthetic oligonucleotide
  Target: ATXN1; (-) strand; PAM type: YTN; PAM sequence: CTG
atatgataatatgctaataa

SEQ ID NO: 225532 - DNA, 20 bp, Artificial Sequence
  Description of Artificial Sequence: Synthetic oligonucleotide
  Target: ATXN1; (-) strand; PAM type: YTN; PAM sequence: TTA
tgctgatatgataatatgct

SEQ ID NO: 225533 - DNA, 20 bp, Artificial Sequence
  Description of Artificial Sequence: Synthetic oligonucleotide
  Target: ATXN1; (-) strand; PAM type: YTN; PAM sequence: TTG
ttatgctgatatgataatat

SEQ ID NO: 225534 - DNA, 20 bp, Artificial Sequence
  Description of Artificial Sequence: Synthetic oligonucleotide
  Target: ATXN1; (-) strand; PAM type: YTN; PAM sequence: TTG
ttgttatgctgatatgataa

SEQ ID NO: 225535 - DNA, 20 bp, Artificial Sequence
  Description of Artificial Sequence: Synthetic oligonucleotide
  Target: ATXN1; (-) strand; PAM type: YTN; PAM sequence: CTT
gttgttatgctgatatgata

SEQ ID NO: 225536 - DNA, 20 bp, Artificial Sequence
  Description of Artificial Sequence: Synthetic oligonucleotide
  Target: ATXN1; (-) strand; PAM type: YTN; PAM sequence: TTA
atacttgttgttatgctgat

SEQ ID NO: 225537 - DNA, 20 bp, Artificial Sequence
  Description of Artificial Sequence: Synthetic oligonucleotide
  Target: ATXN1; (-) strand; PAM type: YTN; PAM sequence: CTT
aatacttgttgttatgctga

SEQ ID NO: 225538 - DNA, 20 bp, Artificial Sequence
  Description of Artificial Sequence: Synthetic oligonucleotide
  Target: ATXN1; (-) strand; PAM type: YTN; PAM sequence: TTG
tgtccttaatacttgttgtt

SEQ ID NO: 225539 - DNA, 20 bp, Artificial Sequence
  Description of Artificial Sequence: Synthetic oligonucleotide
  Target: ATXN1; (-) strand; PAM type: YTN; PAM sequence: TTT
gtgtccttaatacttgttgt

SEQ ID NO: 225540 - DNA, 20 bp, Artificial Sequence
  Description of Artificial Sequence: Synthetic oligonucleotide
  Target: ATXN1; (-) strand; PAM type: YTN; PAM sequence: TTT
tgtgtccttaatacttgttg

SEQ ID NO: 225541 - DNA, 20 bp, Artificial Sequence
  Description of Artificial Sequence: Synthetic oligonucleotide
  Target: ATXN1; (-) strand; PAM type: YTN; PAM sequence: TTT
ttgtgtccttaatacttgtt

SEQ ID NO: 225542 - DNA, 20 bp, Artificial Sequence
  Description of Artificial Sequence: Synthetic oligonucleotide
  Target: ATXN1; (-) strand; PAM type: YTN; PAM sequence: TTA
gaatttttgtgtccttaata

SEQ ID NO: 225543 - DNA, 20 bp, Artificial Sequence
  Description of Artificial Sequence: Synthetic oligonucleotide
  Target: ATXN1; (-) strand; PAM type: YTN; PAM sequence: TTG
taattagaatttttgtgtcc

SEQ ID NO: 225544 - DNA, 20 bp, Artificial Sequence
  Description of Artificial Sequence: Synthetic oligonucleotide
  Target: ATXN1; (-) strand; PAM type: YTN; PAM sequence: CTT
gtaattagaatttttgtgtc

SEQ ID NO: 225545 - DNA, 20 bp, Artificial Sequence
  Description of Artificial Sequence: Synthetic oligonucleotide
  Target: ATXN1; (-) strand; PAM type: YTN; PAM sequence: TTA
cttgtaattagaatttttgt

SEQ ID NO: 225546 - DNA, 20 bp, Artificial Sequence
  Description of Artificial Sequence: Synthetic oligonucleotide
  Target: ATXN1; (-) strand; PAM type: YTN; PAM sequence: CTT
acttgtaattagaatttttg

SEQ ID NO: 225547 - DNA, 20 bp, Artificial Sequence
  Description of Artificial Sequence: Synthetic oligonucleotide
  Target: ATXN1; (-) strand; PAM type: YTN; PAM sequence: TTG
gtggcaaaaacttacttgta

SEQ ID NO: 225548 - DNA, 20 bp, Artificial Sequence
  Description of Artificial Sequence: Synthetic oligonucleotide
  Target: ATXN1; (-) strand; PAM type: YTN; PAM sequence: TTT
ggtggcaaaaacttacttgt

SEQ ID NO: 225549 - DNA, 20 bp, Artificial Sequence
  Description of Artificial Sequence: Synthetic oligonucleotide
  Target: ATXN1; (-) strand; PAM type: YTN; PAM sequence: TTA
taagtttggtggcaaaaact

SEQ ID NO: 225550 - DNA, 20 bp, Artificial Sequence
  Description of Artificial Sequence: Synthetic oligonucleotide
  Target: ATXN1; (-) strand; PAM type: YTN; PAM sequence: TTG
aagaagtggaaattataagt

SEQ ID NO: 225551 - DNA, 20 bp, Artificial Sequence
  Description of Artificial Sequence: Synthetic oligonucleotide
  Target: ATXN1; (-) strand; PAM type: YTN; PAM sequence: TTA
gacaagtccaagggtaaaaa

SEQ ID NO: 225552 - DNA, 20 bp, Artificial Sequence
  Description of Artificial Sequence: Synthetic oligonucleotide
  Target: ATXN1; (-) strand; PAM type: YTN; PAM sequence: CTT
agacaagtccaagggtaaaa

SEQ ID NO: 225553 - DNA, 20 bp, Artificial Sequence
  Description of Artificial Sequence: Synthetic oligonucleotide
  Target: ATXN1; (-) strand; PAM type: YTN; PAM sequence: CTG
agtagagtcttagacaagtc

SEQ ID NO: 225554 - DNA, 20 bp, Artificial Sequence
  Description of Artificial Sequence: Synthetic oligonucleotide
  Target: ATXN1; (-) strand; PAM type: YTN; PAM sequence: TTG
aagggaagagaaggcctgag

SEQ ID NO: 225555 - DNA, 20 bp, Artificial Sequence
  Description of Artificial Sequence: Synthetic oligonucleotide
  Target: ATXN1; (-) strand; PAM type: YTN; PAM sequence: TTT
gaagggaagagaaggcctga

SEQ ID NO: 225556 - DNA, 20 bp, Artificial Sequence
  Description of Artificial Sequence: Synthetic oligonucleotide
  Target: ATXN1; (-) strand; PAM type: YTN; PAM sequence: CTG
ggatttgaagggaagagaag

SEQ ID NO: 225557 - DNA, 20 bp, Artificial Sequence
  Description of Artificial Sequence: Synthetic oligonucleotide
  Target: ATXN1; (-) strand; PAM type: YTN; PAM sequence: TTA
actgggatttgaagggaaga

SEQ ID NO: 225558 - DNA, 20 bp, Artificial Sequence
  Description of Artificial Sequence: Synthetic oligonucleotide
  Target: ATXN1; (-) strand; PAM type: YTN; PAM sequence: CTT
aactgggatttgaagggaag

SEQ ID NO: 225559 - DNA, 20 bp, Artificial Sequence
  Description of Artificial Sequence: Synthetic oligonucleotide
  Target: ATXN1; (-) strand; PAM type: YTN; PAM sequence: CTC
cttaactgggatttgaaggg

SEQ ID NO: 225560 - DNA, 20 bp, Artificial Sequence
  Description of Artificial Sequence: Synthetic oligonucleotide
  Target: ATXN1; (-) strand; PAM type: YTN; PAM sequence: CTA
aatggcgtctccttaactgg

SEQ ID NO: 225561 - DNA, 20 bp, Artificial Sequence
  Description of Artificial Sequence: Synthetic oligonucleotide
  Target: ATXN1; (-) strand; PAM type: YTN; PAM sequence: TTC
taaatggcgtctccttaact

SEQ ID NO: 225562 - DNA, 20 bp, Artificial Sequence
  Description of Artificial Sequence: Synthetic oligonucleotide
  Target: ATXN1; (-) strand; PAM type: YTN; PAM sequence: CTA
tattctaaatggcgtctcct

SEQ ID NO: 225563 - DNA, 20 bp, Artificial Sequence
  Description of Artificial Sequence: Synthetic oligonucleotide
  Target: ATXN1; (-) strand; PAM type: YTN; PAM sequence: TTA
aaaagatgaatcaacagcta

SEQ ID NO: 225564 - DNA, 20 bp, Artificial Sequence
  Description of Artificial Sequence: Synthetic oligonucleotide
  Target: ATXN1; (-) strand; PAM type: YTN; PAM sequence: CTG
ttaaaaagatgaatcaacag

SEQ ID NO: 225565 - DNA, 20 bp, Artificial Sequence
  Description of Artificial Sequence: Synthetic oligonucleotide
  Target: ATXN1; (-) strand; PAM type: YTN; PAM sequence: TTG
taccaaaaaaaaaagagtgc

SEQ ID NO: 225566 - DNA, 20 bp, Artificial Sequence
  Description of Artificial Sequence: Synthetic oligonucleotide
  Target: ATXN1; (-) strand; PAM type: YTN; PAM sequence: TTT
gtaccaaaaaaaaaagagtg

SEQ ID NO: 225567 - DNA, 20 bp, Artificial Sequence
  Description of Artificial Sequence: Synthetic oligonucleotide
  Target: ATXN1; (-) strand; PAM type: YTN; PAM sequence: TTT
tgtaccaaaaaaaaaagagt

SEQ ID NO: 225568 - DNA, 20 bp, Artificial Sequence
  Description of Artificial Sequence: Synthetic oligonucleotide
  Target: ATXN1; (-) strand; PAM type: YTN; PAM sequence: TTT
ttgtaccaaaaaaaaaagag

SEQ ID NO: 225569 - DNA, 20 bp, Artificial Sequence
  Description of Artificial Sequence: Synthetic oligonucleotide
  Target: ATXN1; (-) strand; PAM type: YTN; PAM sequence: CTA
gagatttttgtaccaaaaaa

SEQ ID NO: 225570 - DNA, 20 bp, Artificial Sequence
  Description of Artificial Sequence: Synthetic oligonucleotide
  Target: ATXN1; (-) strand; PAM type: YTN; PAM sequence: TTA
agtggaaagaagaaaagccc

SEQ ID NO: 225571 - DNA, 20 bp, Artificial Sequence
  Description of Artificial Sequence: Synthetic oligonucleotide
  Target: ATXN1; (-) strand; PAM type: YTN; PAM sequence: TTT
aagtggaaagaagaaaagcc

SEQ ID NO: 225572 - DNA, 20 bp, Artificial Sequence
  Description of Artificial Sequence: Synthetic oligonucleotide
  Target: ATXN1; (-) strand; PAM type: YTN; PAM sequence: CTG
ggtgggaaaaaggatttaag

SEQ ID NO: 225573 - DNA, 20 bp, Artificial Sequence
  Description of Artificial Sequence: Synthetic oligonucleotide
  Target: ATXN1; (-) strand; PAM type: YTN; PAM sequence: TTC
agagagcactgggtgggaaa

SEQ ID NO: 225574 - DNA, 20 bp, Artificial Sequence
  Description of Artificial Sequence: Synthetic oligonucleotide
  Target: ATXN1; (-) strand; PAM type: YTN; PAM sequence: CTT
cagagagcactgggtgggaa

SEQ ID NO: 225575 - DNA, 20 bp, Artificial Sequence
  Description of Artificial Sequence: Synthetic oligonucleotide
  Target: ATXN1; (-) strand; PAM type: YTN; PAM sequence: CTC
ttcagagagcactgggtggg

SEQ ID NO: 225576 - DNA, 20 bp, Artificial Sequence
  Description of Artificial Sequence: Synthetic oligonucleotide
  Target: ATXN1; (-) strand; PAM type: YTN; PAM sequence: TTA
gctcttcagagagcactggg

SEQ ID NO: 225577 - DNA, 20 bp, Artificial Sequence
  Description of Artificial Sequence: Synthetic oligonucleotide
  Target: ATXN1; (-) strand; PAM type: YTN; PAM sequence: CTT
agctcttcagagagcactgg

SEQ ID NO: 225578 - DNA, 20 bp, Artificial Sequence
  Description of Artificial Sequence: Synthetic oligonucleotide
  Target: ATXN1; (-) strand; PAM type: YTN; PAM sequence: TTA
gccttagctcttcagagagc

SEQ ID NO: 225579 - DNA, 20 bp, Artificial Sequence
  Description of Artificial Sequence: Synthetic oligonucleotide
  Target: ATXN1; (-) strand; PAM type: YTN; PAM sequence: TTA
gaaaaggaaaaagttagcct

SEQ ID NO: 225580 - DNA, 20 bp, Artificial Sequence
  Description of Artificial Sequence: Synthetic oligonucleotide
  Target: ATXN1; (-) strand; PAM type: YTN; PAM sequence: TTT
agaaaaggaaaaagttagcc

SEQ ID NO: 225581 - DNA, 20 bp, Artificial Sequence
  Description of Artificial Sequence: Synthetic oligonucleotide
  Target: ATXN1; (-) strand; PAM type: YTN; PAM sequence: CTT
tagaaaaggaaaaagttagc

SEQ ID NO: 225582 - DNA, 20 bp, Artificial Sequence
  Description of Artificial Sequence: Synthetic oligonucleotide
  Target: ATXN1; (-) strand; PAM type: YTN; PAM sequence: CTA
tggggaaacagcataggaaa

SEQ ID NO: 225583 - DNA, 20 bp, Artificial Sequence
  Description of Artificial Sequence: Synthetic oligonucleotide
  Target: ATXN1; (-) strand; PAM type: YTN; PAM sequence: TTA
tatgagacatgaagagggtg

SEQ ID NO: 225584 - DNA, 20 bp, Artificial Sequence
  Description of Artificial Sequence: Synthetic oligonucleotide
  Target: ATXN1; (-) strand; PAM type: YTN; PAM sequence: TTT
atatgagacatgaagagggt

SEQ ID NO: 225585 - DNA, 20 bp, Artificial Sequence
  Description of Artificial Sequence: Synthetic oligonucleotide
  Target: ATXN1; (-) strand; PAM type: YTN; PAM sequence: TTT
tatatgagacatgaagaggg

SEQ ID NO: 225586 - DNA, 20 bp, Artificial Sequence
  Description of Artificial Sequence: Synthetic oligonucleotide
  Target: ATXN1; (-) strand; PAM type: YTN; PAM sequence: TTT
ttatatgagacatgaagagg

SEQ ID NO: 225587 - DNA, 20 bp, Artificial Sequence
  Description of Artificial Sequence: Synthetic oligonucleotide
  Target: ATXN1; (-) strand; PAM type: YTN; PAM sequence: CTG
tttttatatgagacatgaag

SEQ ID NO: 225588 - DNA, 20 bp, Artificial Sequence
  Description of Artificial Sequence: Synthetic oligonucleotide
  Target: ATXN1; (-) strand; PAM type: YTN; PAM sequence: TTA
agcccagtgagagtgctgtt

SEQ ID NO: 225589 - DNA, 20 bp, Artificial Sequence
  Description of Artificial Sequence: Synthetic oligonucleotide
  Target: ATXN1; (-) strand; PAM type: YTN; PAM sequence: TTG
gggattaagcccagtgagag

SEQ ID NO: 225590 - DNA, 20 bp, Artificial Sequence
  Description of Artificial Sequence: Synthetic oligonucleotide
  Target: ATXN1; (-) strand; PAM type: YTN; PAM sequence: TTT
ggggattaagcccagtgaga

SEQ ID NO: 225591 - DNA, 20 bp, Artificial Sequence
  Description of Artificial Sequence: Synthetic oligonucleotide
  Target: ATXN1; (-) strand; PAM type: YTN; PAM sequence: TTA
aaaacatttggggattaagc

SEQ ID NO: 225592 - DNA, 20 bp, Artificial Sequence
  Description of Artificial Sequence: Synthetic oligonucleotide
  Target: ATXN1; (-) strand; PAM type: YTN; PAM sequence: CTC
accaaatgagtcaattaaaa

SEQ ID NO: 225593 - DNA, 20 bp, Artificial Sequence
  Description of Artificial Sequence: Synthetic oligonucleotide
  Target: ATXN1; (-) strand; PAM type: YTN; PAM sequence: CTA
gggagagcctcaccaaatga

SEQ ID NO: 225594 - DNA, 20 bp, Artificial Sequence
  Description of Artificial Sequence: Synthetic oligonucleotide
  Target: ATXN1; (-) strand; PAM type: YTN; PAM sequence: TTA
gctagggagagcctcaccaa

SEQ ID NO: 225595 - DNA, 20 bp, Artificial Sequence
  Description of Artificial Sequence: Synthetic oligonucleotide
  Target: ATXN1; (-) strand; PAM type: YTN; PAM sequence: TTT
agctagggagagcctcacca

SEQ ID NO: 225596 - DNA, 20 bp, Artificial Sequence
  Description of Artificial Sequence: Synthetic oligonucleotide
  Target: ATXN1; (-) strand; PAM type: YTN; PAM sequence: TTC
atttagctagggagagcctc

SEQ ID NO: 225597 - DNA, 20 bp, Artificial Sequence
  Description of Artificial Sequence: Synthetic oligonucleotide
  Target: ATXN1; (-) strand; PAM type: YTN; PAM sequence: CTG
ttcatttagctagggagagc

SEQ ID NO: 225598 - DNA, 20 bp, Artificial Sequence
  Description of Artificial Sequence: Synthetic oligonucleotide
  Target: ATXN1; (-) strand; PAM type: YTN; PAM sequence: TTG
aaaaggcagactgttcattt

SEQ ID NO: 225599 - DNA, 20 bp, Artificial Sequence
  Description of Artificial Sequence: Synthetic oligonucleotide
  Target: ATXN1; (-) strand; PAM type: YTN; PAM sequence: TTT
gaaaaggcagactgttcatt

SEQ ID NO: 225600 - DNA, 20 bp, Artificial Sequence
  Description of Artificial Sequence: Synthetic oligonucleotide
  Target: ATXN1; (-) strand; PAM type: YTN; PAM sequence: CTT
tgaaaaggcagactgttcat

SEQ ID NO: 225601 - DNA, 20 bp, Artificial Sequence
  Description of Artificial Sequence: Synthetic oligonucleotide
  Target: ATXN1; (-) strand; PAM type: YTN; PAM sequence: TTC
ctttgaaaaggcagactgtt

SEQ ID NO: 225602 - DNA, 20 bp, Artificial Sequence
  Description of Artificial Sequence: Synthetic oligonucleotide
  Target: ATXN1; (-) strand; PAM type: YTN; PAM sequence: TTG
gttcctttgaaaaggcagac

SEQ ID NO: 225603 - DNA, 20 bp, Artificial Sequence
  Description of Artificial Sequence: Synthetic oligonucleotide
  Target: ATXN1; (-) strand; PAM type: YTN; PAM sequence: TTT
ggttcctttgaaaaggcaga

SEQ ID NO: 225604 - DNA, 20 bp, Artificial Sequence
  Description of Artificial Sequence: Synthetic oligonucleotide
  Target: ATXN1; (-) strand; PAM type: YTN; PAM sequence: CTC
agaaggaagaaatgtttggt

SEQ ID NO: 225605 - DNA, 20 bp, Artificial Sequence
  Description of Artificial Sequence: Synthetic oligonucleotide
  Target: ATXN1; (-) strand; PAM type: YTN; PAM sequence: TTA
aaatactcagaaggaagaaa

SEQ ID NO: 225606 - DNA, 20 bp, Artificial Sequence
  Description of Artificial Sequence: Synthetic oligonucleotide
  Target: ATXN1; (-) strand; PAM type: YTN; PAM sequence: TTT
aaaatactcagaaggaagaa

SEQ ID NO: 225607 - DNA, 20 bp, Artificial Sequence
  Description of Artificial Sequence: Synthetic oligonucleotide
  Target: ATXN1; (-) strand; PAM type: YTN; PAM sequence: TTA
gaagagtttaaaatactcag

SEQ ID NO: 225608 - DNA, 20 bp, Artificial Sequence
  Description of Artificial Sequence: Synthetic oligonucleotide
  Target: ATXN1; (-) strand; PAM type: YTN; PAM sequence: TTG
ttagaagagtttaaaatact

SEQ ID NO: 225609 - DNA, 20 bp, Artificial Sequence
  Description of Artificial Sequence: Synthetic oligonucleotide
  Target: ATXN1; (-) strand; PAM type: YTN; PAM sequence: TTT
gttagaagagtttaaaatac

SEQ ID NO: 225610 - DNA, 20 bp, Artificial Sequence
  Description of Artificial Sequence: Synthetic oligonucleotide
  Target: ATXN1; (-) strand; PAM type: YTN; PAM sequence: CTT
tgttagaagagtttaaaata

SEQ ID NO: 225611 - DNA, 20 bp, Artificial Sequence
  Description of Artificial Sequence: Synthetic oligonucleotide
  Target: ATXN1; (-) strand; PAM type: YTN; PAM sequence: TTG
gctttgttagaagagtttaa

SEQ ID NO: 225612 - DNA, 20 bp, Artificial Sequence
  Description of Artificial Sequence: Synthetic oligonucleotide
  Target: ATXN1; (-) strand; PAM type: YTN; PAM sequence: TTT
ggctttgttagaagagttta

SEQ ID NO: 225613 - DNA, 20 bp, Artificial Sequence
  Description of Artificial Sequence: Synthetic oligonucleotide
  Target: ATXN1; (-) strand; PAM type: YTN; PAM sequence: TTA
atccatgtttggctttgtta

SEQ ID NO: 225614 - DNA, 20 bp, Artificial Sequence
  Description of Artificial Sequence: Synthetic oligonucleotide
  Target: ATXN1; (-) strand; PAM type: YTN; PAM sequence: TTT
aatccatgtttggctttgtt

SEQ ID NO: 225615 - DNA, 20 bp, Artificial Sequence
  Description of Artificial Sequence: Synthetic oligonucleotide
  Target: ATXN1; (-) strand; PAM type: YTN; PAM sequence: CTG
tttaatccatgtttggcttt

SEQ ID NO: 225616 - DNA, 20 bp, Artificial Sequence
  Description of Artificial Sequence: Synthetic oligonucleotide
  Target: ATXN1; (-) strand; PAM type: YTN; PAM sequence: TTA
tgtaacgctgtttaatccat

SEQ ID NO: 225617 - DNA, 20 bp, Artificial Sequence
  Description of Artificial Sequence: Synthetic oligonucleotide
  Target: ATXN1; (-) strand; PAM type: YTN; PAM sequence: CTT
atgtaacgctgtttaatcca

SEQ ID NO: 225618 - DNA, 20 bp, Artificial Sequence
  Description of Artificial Sequence: Synthetic oligonucleotide
  Target: ATXN1; (-) strand; PAM type: YTN; PAM sequence: CTG
tgaagagacttatgtaacgc

SEQ ID NO: 225619 - DNA, 20 bp, Artificial Sequence
  Description of Artificial Sequence: Synthetic oligonucleotide
  Target: ATXN1; (-) strand; PAM type: YTN; PAM sequence: TTA
ggtgctgtgaagagacttat

SEQ ID NO: 225620 - DNA, 20 bp, Artificial Sequence
  Description of Artificial Sequence: Synthetic oligonucleotide
  Target: ATXN1; (-) strand; PAM type: YTN; PAM sequence: CTT
aggtgctgtgaagagactta

SEQ ID NO: 225621 - DNA, 20 bp, Artificial Sequence
  Description of Artificial Sequence: Synthetic oligonucleotide
  Target: ATXN1; (-) strand; PAM type: YTN; PAM sequence: TTG
aacttaggtgctgtgaagag

SEQ ID NO: 225622 - DNA, 20 bp, Artificial Sequence
  Description of Artificial Sequence: Synthetic oligonucleotide
  Target: ATXN1; (-) strand; PAM type: YTN; PAM sequence: TTT
gaacttaggtgctgtgaaga

SEQ ID NO: 225623 - DNA, 20 bp, Artificial Sequence
  Description of Artificial Sequence: Synthetic oligonucleotide
  Target: ATXN1; (-) strand; PAM type: YTN; PAM sequence: CTA
atttgaacttaggtgctgtg

SEQ ID NO: 225624 - DNA, 20 bp, Artificial Sequence
  Description of Artificial Sequence: Synthetic oligonucleotide
  Target: ATXN1; (-) strand; PAM type: YTN; PAM sequence: TTC
ctaatttgaacttaggtgct

SEQ ID NO: 225625 - DNA, 20 bp, Artificial Sequence
  Description of Artificial Sequence: Synthetic oligonucleotide
  Target: ATXN1; (-) strand; PAM type: YTN; PAM sequence: TTG
attcctaatttgaacttagg

SEQ ID NO: 225626 - DNA, 20 bp, Artificial Sequence
  Description of Artificial Sequence: Synthetic oligonucleotide
  Target: ATXN1; (-) strand; PAM type: YTN; PAM sequence: CTT
gattcctaatttgaacttag

SEQ ID NO: 225627 - DNA, 20 bp, Artificial Sequence
  Description of Artificial Sequence: Synthetic oligonucleotide
  Target: ATXN1; (-) strand; PAM type: YTN; PAM sequence: TTG
ggacttgattcctaatttga

SEQ ID NO: 225628 - DNA, 20 bp, Artificial Sequence
  Description of Artificial Sequence: Synthetic oligonucleotide
  Target: ATXN1; (-) strand; PAM type: YTN; PAM sequence: TTA
ttgggacttgattcctaatt

SEQ ID NO: 225629 - DNA, 20 bp, Artificial Sequence
  Description of Artificial Sequence: Synthetic oligonucleotide
  Target: ATXN1; (-) strand; PAM type: YTN; PAM sequence: TTG
gttattgggacttgattcct

SEQ ID NO: 225630 - DNA, 20 bp, Artificial Sequence
  Description of Artificial Sequence: Synthetic oligonucleotide
  Target: ATXN1; (-) strand; PAM type: YTN; PAM sequence: TTG
gtgaaaacagtatccatgtc

SEQ ID NO: 225631 - DNA, 20 bp, Artificial Sequence
  Description of Artificial Sequence: Synthetic oligonucleotide
  Target: ATXN1; (-) strand; PAM type: YTN; PAM sequence: TTA
ttggtgaaaacagtatccat

SEQ ID NO: 225632 - DNA, 20 bp, Artificial Sequence
  Description of Artificial Sequence: Synthetic oligonucleotide
  Target: ATXN1; (-) strand; PAM type: YTN; PAM sequence: TTT
attggtgaaaacagtatcca

SEQ ID NO: 225633 - DNA, 20 bp, Artificial Sequence
  Description of Artificial Sequence: Synthetic oligonucleotide
  Target: ATXN1; (-) strand; PAM type: YTN; PAM sequence: CTA
tttattggtgaaaacagtat

SEQ ID NO: 225634 - DNA, 20 bp, Artificial Sequence
  Description of Artificial Sequence: Synthetic oligonucleotide
  Target: ATXN1; (-) strand; PAM type: YTN; PAM sequence: TTG
atggggtggctatttattgg

SEQ ID NO: 225635 - DNA, 20 bp, Artificial Sequence
  Description of Artificial Sequence: Synthetic oligonucleotide
  Target: ATXN1; (-) strand; PAM type: YTN; PAM sequence: CTT
gatggggtggctatttattg

SEQ ID NO: 225636 - DNA, 20 bp, Artificial Sequence
  Description of Artificial Sequence: Synthetic oligonucleotide
  Target: ATXN1; (-) strand; PAM type: YTN; PAM sequence: CTA
gtcgatggggcagcttgatg

SEQ ID NO: 225637 - DNA, 20 bp, Artificial Sequence
  Description of Artificial Sequence: Synthetic oligonucleotide
  Target: ATXN1; (-) strand; PAM type: YTN; PAM sequence: TTC
ctagtcgatggggcagcttg

SEQ ID NO: 225638 - DNA, 20 bp, Artificial Sequence
  Description of Artificial Sequence: Synthetic oligonucleotide
  Target: ATXN1; (-) strand; PAM type: YTN; PAM sequence: CTT
cctagtcgatggggcagctt

SEQ ID NO: 225639 - DNA, 20 bp, Artificial Sequence
  Description of Artificial Sequence: Synthetic oligonucleotide
  Target: ATXN1; (-) strand; PAM type: YTN; PAM sequence: CTC
ttcctagtcgatggggcagc

SEQ ID NO: 225640 - DNA, 20 bp, Artificial Sequence
  Description of Artificial Sequence: Synthetic oligonucleotide
  Target: ATXN1; (-) strand; PAM type: YTN; PAM sequence: CTG
agtgggcctcttcctagtcg

SEQ ID NO: 225641 - DNA, 20 bp, Artificial Sequence
  Description of Artificial Sequence: Synthetic oligonucleotide
  Target: ATXN1; (-) strand; PAM type: YTN; PAM sequence: TTC
cgggtgcctgagtgggcctc

SEQ ID NO: 225642 - DNA, 20 bp, Artificial Sequence
  Description of Artificial Sequence: Synthetic oligonucleotide
  Target: ATXN1; (-) strand; PAM type: YTN; PAM sequence: CTT
ccgggtgcctgagtgggcct

SEQ ID NO: 225643 - DNA, 20 bp, Artificial Sequence
  Description of Artificial Sequence: Synthetic oligonucleotide
  Target: ATXN1; (-) strand; PAM type: YTN; PAM sequence: CTG
gggcaaagcttccgggtgcc

SEQ ID NO: 225644 - DNA, 20 bp, Artificial Sequence
  Description of Artificial Sequence: Synthetic oligonucleotide
  Target: ATXN1; (-) strand; PAM type: YTN; PAM sequence: CTC
tggggcaaagcttccgggtg

SEQ ID NO: 225645 - DNA, 20 bp, Artificial Sequence
  Description of Artificial Sequence: Synthetic oligonucleotide
  Target: ATXN1; (-) strand; PAM type: YTN; PAM sequence: CTC
tctggggcaaagcttccggg

SEQ ID NO: 225646 - DNA, 20 bp, Artificial Sequence
  Description of Artificial Sequence: Synthetic oligonucleotide
  Target: ATXN1; (-) strand; PAM type: YTN; PAM sequence: CTG
ctctctggggcaaagcttcc

SEQ ID NO: 225647 - DNA, 20 bp, Artificial Sequence
  Description of Artificial Sequence: Synthetic oligonucleotide
  Target: ATXN1; (-) strand; PAM type: YTN; PAM sequence: TTC
tgctctctggggcaaagctt

SEQ ID NO: 225648 - DNA, 20 bp, Artificial Sequence
  Description of Artificial Sequence: Synthetic oligonucleotide
  Target: ATXN1; (-) strand; PAM type: YTN; PAM sequence: CTC
attctgctctctggggcaaa

SEQ ID NO: 225649 - DNA, 20 bp, Artificial Sequence
  Description of Artificial Sequence: Synthetic oligonucleotide
  Target: ATXN1; (-) strand; PAM type: YTN; PAM sequence: TTC
aggaagggacctcattctgc

SEQ ID NO: 225650 - DNA, 20 bp, Artificial Sequence
  Description of Artificial Sequence: Synthetic oligonucleotide
  Target: ATXN1; (-) strand; PAM type: YTN; PAM sequence: TTT
caggaagggacctcattctg

SEQ ID NO: 225651 - DNA, 20 bp, Artificial Sequence
  Description of Artificial Sequence: Synthetic oligonucleotide
  Target: ATXN1; (-) strand; PAM type: YTN; PAM sequence: CTG
cagagcagtggtatagtttc

SEQ ID NO: 225652 - DNA, 20 bp, Artificial Sequence
  Description of Artificial Sequence: Synthetic oligonucleotide
  Target: ATXN1; (-) strand; PAM type: YTN; PAM sequence: CTG
tgggtgagatatgtctgcag

SEQ ID NO: 225653 - DNA, 20 bp, Artificial Sequence
  Description of Artificial Sequence: Synthetic oligonucleotide
  Target: ATXN1; (-) strand; PAM type: YTN; PAM sequence: CTG
gcaataggaaagcactgtgg

SEQ ID NO: 225654 - DNA, 20 bp, Artificial Sequence
  Description of Artificial Sequence: Synthetic oligonucleotide
  Target: ATXN1; (-) strand; PAM type: YTN; PAM sequence: CTC
ctggcaataggaaagcactg

SEQ ID NO: 225655 - DNA, 20 bp, Artificial Sequence
  Description of Artificial Sequence: Synthetic oligonucleotide
  Target: ATXN1; (-) strand; PAM type: YTN; PAM sequence: CTC
ccggtgctcctggcaatagg

SEQ ID NO: 225656 - DNA, 20 bp, Artificial Sequence
  Description of Artificial Sequence: Synthetic oligonucleotide
  Target: ATXN1; (-) strand; PAM type: YTN; PAM sequence: TTC
cctcccggtgctcctggcaa

SEQ ID NO: 225657 - DNA, 20 bp, Artificial Sequence
  Description of Artificial Sequence: Synthetic oligonucleotide
  Target: ATXN1; (-) strand; PAM type: YTN; PAM sequence: TTA
gaatgggcaaatattccctc

SEQ ID NO: 225658 - DNA, 20 bp, Artificial Sequence
  Description of Artificial Sequence: Synthetic oligonucleotide
  Target: ATXN1; (-) strand; PAM type: YTN; PAM sequence: TTA
gaagggatgattagaatggg

SEQ ID NO: 225659 - DNA, 20 bp, Artificial Sequence
  Description of Artificial Sequence: Synthetic oligonucleotide
  Target: ATXN1; (-) strand; PAM type: YTN; PAM sequence: CTG
cgccattagaagggatgatt

SEQ ID NO: 225660 - DNA, 20 bp, Artificial Sequence
  Description of Artificial Sequence: Synthetic oligonucleotide
  Target: ATXN1; (-) strand; PAM type: YTN; PAM sequence: TTG
ctgcgccattagaagggatg

SEQ ID NO: 225661 - DNA, 20 bp, Artificial Sequence
  Description of Artificial Sequence: Synthetic oligonucleotide
  Target: ATXN1; (-) strand; PAM type: YTN; PAM sequence: CTT
gctgcgccattagaagggat

SEQ ID NO: 225662 - DNA, 20 bp, Artificial Sequence
  Description of Artificial Sequence: Synthetic oligonucleotide
  Target: ATXN1; (-) strand; PAM type: YTN; PAM sequence: CTC
ttgctgcgccattagaaggg

SEQ ID NO: 225663 - DNA, 20 bp, Artificial Sequence
  Description of Artificial Sequence: Synthetic oligonucleotide
  Target: ATXN1; (-) strand; PAM type: YTN; PAM sequence: CTG
tgcatgatctcttgctgcgc

SEQ ID NO: 225664 - DNA, 20 bp, Artificial Sequence
  Description of Artificial Sequence: Synthetic oligonucleotide
  Target: ATXN1; (-) strand; PAM type: YTN; PAM sequence: CTC
tgtgcatgatctcttgctgc

SEQ ID NO: 225665 - DNA, 20 bp, Artificial Sequence
  Description of Artificial Sequence: Synthetic oligonucleotide
  Target: ATXN1; (-) strand; PAM type: YTN; PAM sequence: TTC
cccgtcacctctgtgcatga

SEQ ID NO: 225666 - DNA, 20 bp, Artificial Sequence
  Description of Artificial Sequence: Synthetic oligonucleotide
  Target: ATXN1; (-) strand; PAM type: YTN; PAM sequence: TTT
ccccgtcacctctgtgcatg

SEQ ID NO: 225667 - DNA, 20 bp, Artificial Sequence
  Description of Artificial Sequence: Synthetic oligonucleotide
  Target: ATXN1; (-) strand; PAM type: YTN; PAM sequence: CTT
tccccgtcacctctgtgcat

SEQ ID NO: 225668 - DNA, 20 bp, Artificial Sequence
  Description of Artificial Sequence: Synthetic oligonucleotide
  Target: ATXN1; (-) strand; PAM type: YTN; PAM sequence: TTC
tttccccgtcacctctgtgc

SEQ ID NO: 225669 - DNA, 20 bp, Artificial Sequence
  Description of Artificial Sequence: Synthetic oligonucleotide
  Target: ATXN1; (-) strand; PAM type: YTN; PAM sequence: TTT
ctttccccgtcacctctgtg

SEQ ID NO: 225670 - DNA, 20 bp, Artificial Sequence
  Description of Artificial Sequence: Synthetic oligonucleotide
  Target: ATXN1; (-) strand; PAM type: YTN; PAM sequence: CTT
tctttccccgtcacctctgt

SEQ ID NO: 225671 - DNA, 20 bp, Artificial Sequence
  Description of Artificial Sequence: Synthetic oligonucleotide
  Target: ATXN1; (-) strand; PAM type: YTN; PAM sequence: CTC
tttctttccccgtcacctct

SEQ ID NO: 225672 - DNA, 20 bp, Artificial Sequence
  Description of Artificial Sequence: Synthetic oligonucleotide
  Target: ATXN1; (-) strand; PAM type: YTN; PAM sequence: CTG
ctctttctttccccgtcacc

SEQ ID NO: 225673 - DNA, 20 bp, Artificial Sequence
  Description of Artificial Sequence: Synthetic oligonucleotide
  Target: ATXN1; (-) strand; PAM type: YTN; PAM sequence: TTA
accacagagtagtggcactg

SEQ ID NO: 225674 - DNA, 20 bp, Artificial Sequence
  Description of Artificial Sequence: Synthetic oligonucleotide
  Target: ATXN1; (-) strand; PAM type: YTN; PAM sequence: TTC
acaatacaggtgaaaagtta

SEQ ID NO: 225675 - DNA, 20 bp, Artificial Sequence
  Description of Artificial Sequence: Synthetic oligonucleotide
  Target: ATXN1; (-) strand; PAM type: YTN; PAM sequence: TTA
attcacaatacaggtgaaaa

SEQ ID NO: 225676 - DNA, 20 bp, Artificial Sequence
  Description of Artificial Sequence: Synthetic oligonucleotide
  Target: ATXN1; (-) strand; PAM type: YTN; PAM sequence: TTA
aatgaataatgagtgtagtt

SEQ ID NO: 225677 - DNA, 20 bp, Artificial Sequence
  Description of Artificial Sequence: Synthetic oligonucleotide
  Target: ATXN1; (-) strand; PAM type: YTN; PAM sequence: TTT
aaatgaataatgagtgtagt

SEQ ID NO: 225678 - DNA, 20 bp, Artificial Sequence
  Description of Artificial Sequence: Synthetic oligonucleotide
  Target: ATXN1; (-) strand; PAM type: YTN; PAM sequence: CTG
tttaaatgaataatgagtgt

SEQ ID NO: 225679 - DNA, 20 bp, Artificial Sequence
  Description of Artificial Sequence: Synthetic oligonucleotide
  Target: ATXN1; (-) strand; PAM type: YTN; PAM sequence: TTA
ggtgctgtttaaatgaataa

SEQ ID NO: 225680 - DNA, 20 bp, Artificial Sequence
  Description of Artificial Sequence: Synthetic oligonucleotide
  Target: ATXN1; (-) strand; PAM type: YTN; PAM sequence: TTT
aggtgctgtttaaatgaata

SEQ ID NO: 225681 - DNA, 20 bp, Artificial Sequence
  Description of Artificial Sequence: Synthetic oligonucleotide
  Target: ATXN1; (-) strand; PAM type: YTN; PAM sequence: CTT
taggtgctgtttaaatgaat

SEQ ID NO: 225682 - DNA, 20 bp, Artificial Sequence
  Description of Artificial Sequence: Synthetic oligonucleotide
  Target: ATXN1; (-) strand; PAM type: YTN; PAM sequence: TTC
tttaggtgctgtttaaatga

SEQ ID NO: 225683 - DNA, 20 bp, Artificial Sequence
  Description of Artificial Sequence: Synthetic oligonucleotide
  Target: ATXN1; (-) strand; PAM type: YTN; PAM sequence: TTG
aaggttctttaggtgctgtt

SEQ ID NO: 225684 - DNA, 20 bp, Artificial Sequence
  Description of Artificial Sequence: Synthetic oligonucleotide
  Target: ATXN1; (-) strand; PAM type: YTN; PAM sequence: CTT
gaaggttctttaggtgctgt

SEQ ID NO: 225685 - DNA, 20 bp, Artificial Sequence
  Description of Artificial Sequence: Synthetic oligonucleotide
  Target: ATXN1; (-) strand; PAM type: YTN; PAM sequence: TTA
gacttgaaggttctttaggt

SEQ ID NO: 225686 - DNA, 20 bp, Artificial Sequence
  Description of Artificial Sequence: Synthetic oligonucleotide
  Target: ATXN1; (-) strand; PAM type: YTN; PAM sequence: TTT
agacttgaaggttctttagg

SEQ ID NO: 225687 - DNA, 20 bp, Artificial Sequence
  Description of Artificial Sequence: Synthetic oligonucleotide
  Target: ATXN1; (-) strand; PAM type: YTN; PAM sequence: CTA
atgatagagtgatgtgttta

SEQ ID NO: 225688 - DNA, 20 bp, Artificial Sequence
  Description of Artificial Sequence: Synthetic oligonucleotide
  Target: ATXN1; (-) strand; PAM type: YTN; PAM sequence: TTC
agcaacagtcactaatgata

SEQ ID NO: 225689 - DNA, 20 bp, Artificial Sequence
  Description of Artificial Sequence: Synthetic oligonucleotide
  Target: ATXN1; (-) strand; PAM type: YTN; PAM sequence: CTT
cagcaacagtcactaatgat

SEQ ID NO: 225690 - DNA, 20 bp, Artificial Sequence
  Description of Artificial Sequence: Synthetic oligonucleotide
  Target: ATXN1; (-) strand; PAM type: YTN; PAM sequence: TTC
ttcagcaacagtcactaatg

SEQ ID NO: 225691 - DNA, 20 bp, Artificial Sequence
  Description of Artificial Sequence: Synthetic oligonucleotide
  Target: ATXN1; (-) strand; PAM type: YTN; PAM sequence: CTT
cttcagcaacagtcactaat

SEQ ID NO: 225692 - DNA, 20 bp, Artificial Sequence
  Description of Artificial Sequence: Synthetic oligonucleotide
  Target: ATXN1; (-) strand; PAM type: YTN; PAM sequence: TTC
agtgaagcccttcttcagca

SEQ ID NO: 225693 - DNA, 20 bp, Artificial Sequence
  Description of Artificial Sequence: Synthetic oligonucleotide
  Target: ATXN1; (-) strand; PAM type: YTN; PAM sequence: TTT
cagtgaagcccttcttcagc

SEQ ID NO: 225694 - DNA, 20 bp, Artificial Sequence
  Description of Artificial Sequence: Synthetic oligonucleotide
  Target: ATXN1; (-) strand; PAM type: YTN; PAM sequence: TTA
atacaatcatatttcagtga

SEQ ID NO: 225695 - DNA, 20 bp, Artificial Sequence
  Description of Artificial Sequence: Synthetic oligonucleotide
  Target: ATXN1; (-) strand; PAM type: YTN; PAM sequence: CTC
acatgttaatacaatcatat

SEQ ID NO: 225696 - DNA, 20 bp, Artificial Sequence
  Description of Artificial Sequence: Synthetic oligonucleotide
  Target: ATXN1; (-) strand; PAM type: YTN; PAM sequence: TTC
ctcacatgttaatacaatca

SEQ ID NO: 225697 - DNA, 20 bp, Artificial Sequence
  Description of Artificial Sequence: Synthetic oligonucleotide
  Target: ATXN1; (-) strand; PAM type: YTN; PAM sequence: CTT
cctcacatgttaatacaatc

SEQ ID NO: 225698 - DNA, 20 bp, Artificial Sequence
  Description of Artificial Sequence: Synthetic oligonucleotide
  Target: ATXN1; (-) strand; PAM type: YTN; PAM sequence: TTC
agcttcctcacatgttaata

SEQ ID NO: 225699 - DNA, 20 bp, Artificial Sequence
  Description of Artificial Sequence: Synthetic oligonucleotide
  Target: ATXN1; (-) strand; PAM type: YTN; PAM sequence: TTT
cagcttcctcacatgttaat

SEQ ID NO: 225700 - DNA, 20 bp, Artificial Sequence
  Description of Artificial Sequence: Synthetic oligonucleotide
  Target: ATXN1; (-) strand; PAM type: YTN; PAM sequence: TTC
atttcagcttcctcacatgt

SEQ ID NO: 225701 - DNA, 20 bp, Artificial Sequence
  Description of Artificial Sequence: Synthetic oligonucleotide
  Target: ATXN1; (-) strand; PAM type: YTN; PAM sequence: CTA
aagaaaattcatttcagctt

SEQ ID NO: 225702 - DNA, 20 bp, Artificial Sequence
  Description of Artificial Sequence: Synthetic oligonucleotide
  Target: ATXN1; (-) strand; PAM type: YTN; PAM sequence: CTC
taaagaaaattcatttcagc

SEQ ID NO: 225703 - DNA, 20 bp, Artificial Sequence
  Description of Artificial Sequence: Synthetic oligonucleotide
  Target: ATXN1; (-) strand; PAM type: YTN; PAM sequence: CTG
ctctaaagaaaattcatttc

SEQ ID NO: 225704 - DNA, 20 bp, Artificial Sequence
  Description of Artificial Sequence: Synthetic oligonucleotide
  Target: ATXN1; (-) strand; PAM type: YTN; PAM sequence: CTA
tgagctgctctaaagaaaat

SEQ ID NO: 225705 - DNA, 20 bp, Artificial Sequence
  Description of Artificial Sequence: Synthetic oligonucleotide
  Target: ATXN1; (-) strand; PAM type: YTN; PAM sequence: TTG
gtactatgagctgctctaaa

SEQ ID NO: 225706 - DNA, 20 bp, Artificial Sequence
  Description of Artificial Sequence: Synthetic oligonucleotide
  Target: ATXN1; (-) strand; PAM type: YTN; PAM sequence: CTG
ggagtgagaatgggaggggc

SEQ ID NO: 225707 - DNA, 20 bp, Artificial Sequence
  Description of Artificial Sequence: Synthetic oligonucleotide
  Target: ATXN1; (-) strand; PAM type: YTN; PAM sequence: CTA
ctgggagtgagaatgggagg

SEQ ID NO: 225708 - DNA, 20 bp, Artificial Sequence
  Description of Artificial Sequence: Synthetic oligonucleotide
  Target: ATXN1; (-) strand; PAM type: YTN; PAM sequence: CTC
ccagctactgggagtgagaa

SEQ ID NO: 225709 - DNA, 20 bp, Artificial Sequence
  Description of Artificial Sequence: Synthetic oligonucleotide
  Target: ATXN1; (-) strand; PAM type: YTN; PAM sequence: TTA
gaacaatgaagcatcatctc

SEQ ID NO: 225710 - DNA, 20 bp, Artificial Sequence
  Description of Artificial Sequence: Synthetic oligonucleotide
  Target: ATXN1; (-) strand; PAM type: YTN; PAM sequence: CTT
agaacaatgaagcatcatct

SEQ ID NO: 225711 - DNA, 20 bp, Artificial Sequence
  Description of Artificial Sequence: Synthetic oligonucleotide
  Target: ATXN1; (-) strand; PAM type: YTN; PAM sequence: CTA
agcttagaacaatgaagcat

SEQ ID NO: 225712 - DNA, 20 bp, Artificial Sequence
  Description of Artificial Sequence: Synthetic oligonucleotide
  Target: ATXN1; (-) strand; PAM type: YTN; PAM sequence: TTA
agtctaagcttagaacaatg

SEQ ID NO: 225713 - DNA, 20 bp, Artificial Sequence
  Description of Artificial Sequence: Synthetic oligonucleotide
  Target: ATXN1; (-) strand; PAM type: YTN; PAM sequence: TTG
tattaagtctaagcttagaa

SEQ ID NO: 225714 - DNA, 20 bp, Artificial Sequence
  Description of Artificial Sequence: Synthetic oligonucleotide
  Target: ATXN1; (-) strand; PAM type: YTN; PAM sequence: TTA
agaaaagtgcagtgttgtat

SEQ ID NO: 225715 - DNA, 20 bp, Artificial Sequence
  Description of Artificial Sequence: Synthetic oligonucleotide
  Target: ATXN1; (-) strand; PAM type: YTN; PAM sequence: TTT
aagaaaagtgcagtgttgta

SEQ ID NO: 225716 - DNA, 20 bp, Artificial Sequence
  Description of Artificial Sequence: Synthetic oligonucleotide
  Target: ATXN1; (-) strand; PAM type: YTN; PAM sequence: TTG
tttaagaaaagtgcagtgtt

SEQ ID NO: 225717 - DNA, 20 bp, Artificial Sequence
  Description of Artificial Sequence: Synthetic oligonucleotide
  Target: ATXN1; (-) strand; PAM type: YTN; PAM sequence: TTT
gtttaagaaaagtgcagtgt

SEQ ID NO: 225718 - DNA, 20 bp, Artificial Sequence
  Description of Artificial Sequence: Synthetic oligonucleotide
  Target: ATXN1; (-) strand; PAM type: YTN; PAM sequence: TTA
tttgtttaagaaaagtgcag

SEQ ID NO: 225719 - DNA, 20 bp, Artificial Sequence
  Description of Artificial Sequence: Synthetic oligonucleotide
  Target: ATXN1; (-) strand; PAM type: YTN; PAM sequence: TTT
atttgtttaagaaaagtgca

SEQ ID NO: 225720 - DNA, 20 bp, Artificial Sequence
  Description of Artificial Sequence: Synthetic oligonucleotide
  Target: ATXN1; (-) strand; PAM type: YTN; PAM sequence: TTA
gcaaaaggtttatttgttta

SEQ ID NO: 225721 - DNA, 20 bp, Artificial Sequence
  Description of Artificial Sequence: Synthetic oligonucleotide
  Target: ATXN1; (-) strand; PAM type: YTN; PAM sequence: TTT
agcaaaaggtttatttgttt

SEQ ID NO: 225722 - DNA, 20 bp, Artificial Sequence
  Description of Artificial Sequence: Synthetic oligonucleotide
  Target: ATXN1; (-) strand; PAM type: YTN; PAM sequence: CTT
tagcaaaaggtttatttgtt

SEQ ID NO: 225723 - DNA, 20 bp, Artificial Sequence
  Description of Artificial Sequence: Synthetic oligonucleotide
  Target: ATXN1; (-) strand; PAM type: YTN; PAM sequence: TTA
atccactttagcaaaaggtt

SEQ ID NO: 225724 - DNA, 20 bp, Artificial Sequence
  Description of Artificial Sequence: Synthetic oligonucleotide
  Target: ATXN1; (-) strand; PAM type: YTN; PAM sequence: TTT
aatccactttagcaaaaggt

SEQ ID NO: 225725 - DNA, 20 bp, Artificial Sequence
  Description of Artificial Sequence: Synthetic oligonucleotide
  Target: ATXN1; (-) strand; PAM type: YTN; PAM sequence: TTT
taatccactttagcaaaagg

SEQ ID NO: 225726 - DNA, 20 bp, Artificial Sequence
  Description of Artificial Sequence: Synthetic oligonucleotide
  Target: ATXN1; (-) strand; PAM type: YTN; PAM sequence: TTG
agatgttttaatccacttta

SEQ ID NO: 225727 - DNA, 20 bp, Artificial Sequence
  Description of Artificial Sequence: Synthetic oligonucleotide
  Target: ATXN1; (-) strand; PAM type: YTN; PAM sequence: CTG
ttgagatgttttaatccact

SEQ ID NO: 225728 - DNA, 20 bp, Artificial Sequence
  Description of Artificial Sequence: Synthetic oligonucleotide
  Target: ATXN1; (-) strand; PAM type: YTN; PAM sequence: CTG
catgtgtgccgtagctgttg

SEQ ID NO: 225729 - DNA, 20 bp, Artificial Sequence
  Description of Artificial Sequence: Synthetic oligonucleotide
  Target: ATXN1; (-) strand; PAM type: YTN; PAM sequence: TTA
atgactgcatgtgtgccgta

SEQ ID NO: 225730 - DNA, 20 bp, Artificial Sequence
  Description of Artificial Sequence: Synthetic oligonucleotide
  Target: ATXN1; (-) strand; PAM type: YTN; PAM sequence: TTT
aatgactgcatgtgtgccgt

SEQ ID NO: 225731 - DNA, 20 bp, Artificial Sequence
  Description of Artificial Sequence: Synthetic oligonucleotide
  Target: ATXN1; (-) strand; PAM type: YTN; PAM sequence: CTT
taatgactgcatgtgtgccg

SEQ ID NO: 225732 - DNA, 20 bp, Artificial Sequence
  Description of Artificial Sequence: Synthetic oligonucleotide
  Target: ATXN1; (-) strand; PAM type: YTN; PAM sequence: CTG
aacagtctttaatgactgca

SEQ ID NO: 225733 - DNA, 20 bp, Artificial Sequence
  Description of Artificial Sequence: Synthetic oligonucleotide
  Target: ATXN1; (-) strand; PAM type: YTN; PAM sequence: CTA
tatgctgaacagtctttaat

SEQ ID NO: 225734 - DNA, 20 bp, Artificial Sequence
  Description of Artificial Sequence: Synthetic oligonucleotide
  Target: ATXN1; (-) strand; PAM type: YTN; PAM sequence: CTG
tctatatgctgaacagtctt

SEQ ID NO: 225735 - DNA, 20 bp, Artificial Sequence
  Description of Artificial Sequence: Synthetic oligonucleotide
  Target: ATXN1; (-) strand; PAM type: YTN; PAM sequence: TTA
tctgtctatatgctgaacag

SEQ ID NO: 225736 - DNA, 20 bp, Artificial Sequence
  Description of Artificial Sequence: Synthetic oligonucleotide
  Target: ATXN1; (-) strand; PAM type: YTN; PAM sequence: CTG
tggaaattatctgtctatat

SEQ ID NO: 225737 - DNA, 20 bp, Artificial Sequence
  Description of Artificial Sequence: Synthetic oligonucleotide
  Target: ATXN1; (-) strand; PAM type: YTN; PAM sequence: TTA
aaccatacactgtggaaatt

SEQ ID NO: 225738 - DNA, 20 bp, Artificial Sequence
  Description of Artificial Sequence: Synthetic oligonucleotide
  Target: ATXN1; (-) strand; PAM type: YTN; PAM sequence: CTT
aaaccatacactgtggaaat

SEQ ID NO: 225739 - DNA, 20 bp, Artificial Sequence
  Description of Artificial Sequence: Synthetic oligonucleotide
  Target: ATXN1; (-) strand; PAM type: YTN; PAM sequence: TTC
ttaaaccatacactgtggaa

SEQ ID NO: 225740 - DNA, 20 bp, Artificial Sequence
  Description of Artificial Sequence: Synthetic oligonucleotide
  Target: ATXN1; (-) strand; PAM type: YTN; PAM sequence: CTT
cttaaaccatacactgtgga

SEQ ID NO: 225741 - DNA, 20 bp, Artificial Sequence
  Description of Artificial Sequence: Synthetic oligonucleotide
  Target: ATXN1; (-) strand; PAM type: YTN; PAM sequence: TTA
acttcttaaaccatacactg

SEQ ID NO: 225742 - DNA, 20 bp, Artificial Sequence
  Description of Artificial Sequence: Synthetic oligonucleotide
  Target: ATXN1; (-) strand; PAM type: YTN; PAM sequence: TTT
aacttcttaaaccatacact

SEQ ID NO: 225743 - DNA, 20 bp, Artificial Sequence
  Description of Artificial Sequence: Synthetic oligonucleotide
  Target: ATXN1; (-) strand; PAM type: YTN; PAM sequence: CTG
tttaacttcttaaaccatac

SEQ ID NO: 225744 - DNA, 20 bp, Artificial Sequence
  Description of Artificial Sequence: Synthetic oligonucleotide
  Target: ATXN1; (-) strand; PAM type: YTN; PAM sequence: TTC
tgtttaacttcttaaaccat

SEQ ID NO: 225745 - DNA, 20 bp, Artificial Sequence
  Description of Artificial Sequence: Synthetic oligonucleotide
  Target: ATXN1; (-) strand; PAM type: YTN; PAM sequence: TTT
ctgtttaacttcttaaacca

SEQ ID NO: 225746 - DNA, 20 bp, Artificial Sequence
  Description of Artificial Sequence: Synthetic oligonucleotide
  Target: ATXN1; (-) strand; PAM type: YTN; PAM sequence: CTT
tctgtttaacttcttaaacc

SEQ ID NO: 225747 - DNA, 20 bp, Artificial Sequence
  Description of Artificial Sequence: Synthetic oligonucleotide
  Target: ATXN1; (-) strand; PAM type: YTN; PAM sequence: TTA
actttctgtttaacttctta

SEQ ID NO: 225748 - DNA, 20 bp, Artificial Sequence
  Description of Artificial Sequence: Synthetic oligonucleotide
  Target: ATXN1; (-) strand; PAM type: YTN; PAM sequence: CTG
ttaactttctgtttaacttc

SEQ ID NO: 225749 - DNA, 20 bp, Artificial Sequence
  Description of Artificial Sequence: Synthetic oligonucleotide
  Target: ATXN1; (-) strand; PAM type: YTN; PAM sequence: CTC
tgttaactttctgtttaact

SEQ ID NO: 225750 - DNA, 20 bp, Artificial Sequence
  Description of Artificial Sequence: Synthetic oligonucleotide
  Target: ATXN1; (-) strand; PAM type: YTN; PAM sequence: TTC
tctgttaactttctgtttaa

SEQ ID NO: 225751 - DNA, 20 bp, Artificial Sequence
  Description of Artificial Sequence: Synthetic oligonucleotide
  Target: ATXN1; (-) strand; PAM type: YTN; PAM sequence: TTT
ctctgttaactttctgttta

SEQ ID NO: 225752 - DNA, 20 bp, Artificial Sequence
  Description of Artificial Sequence: Synthetic oligonucleotide
  Target: ATXN1; (-) strand; PAM type: YTN; PAM sequence: TTC
aagaacagtttctctgttaa

SEQ ID NO: 225753 - DNA, 20 bp, Artificial Sequence
  Description of Artificial Sequence: Synthetic oligonucleotide
  Target: ATXN1; (-) strand; PAM type: YTN; PAM sequence: CTT
caagaacagtttctctgtta

SEQ ID NO: 225754 - DNA, 20 bp, Artificial Sequence
  Description of Artificial Sequence: Synthetic oligonucleotide
  Target: ATXN1; (-) strand; PAM type: YTN; PAM sequence: CTC
atacttcaagaacagtttct

SEQ ID NO: 225755 - DNA, 20 bp, Artificial Sequence
  Description of Artificial Sequence: Synthetic oligonucleotide
  Target: ATXN1; (-) strand; PAM type: YTN; PAM sequence: TTC
tcatacttcaagaacagttt

SEQ ID NO: 225756 - DNA, 20 bp, Artificial Sequence
  Description of Artificial Sequence: Synthetic oligonucleotide
  Target: ATXN1; (-) strand; PAM type: YTN; PAM sequence: TTA
atcattctcatacttcaaga

SEQ ID NO: 225757 - DNA, 20 bp, Artificial Sequence
  Description of Artificial Sequence: Synthetic oligonucleotide
  Target: ATXN1; (-) strand; PAM type: YTN; PAM sequence: CTT
aatcattctcatacttcaag

SEQ ID NO: 225758 - DNA, 20 bp, Artificial Sequence
  Description of Artificial Sequence: Synthetic oligonucleotide
  Target: ATXN1; (-) strand; PAM type: YTN; PAM sequence: TTC
cacttaatcattctcatact

SEQ ID NO: 225759 - DNA, 20 bp, Artificial Sequence
  Description of Artificial Sequence: Synthetic oligonucleotide
  Target: ATXN1; (-) strand; PAM type: YTN; PAM sequence: TTT
ccacttaatcattctcatac

SEQ ID NO: 225760 - DNA, 20 bp, Artificial Sequence
  Description of Artificial Sequence: Synthetic oligonucleotide
  Target: ATXN1; (-) strand; PAM type: YTN; PAM sequence: TTA
acatttccacttaatcattc

SEQ ID NO: 225761 - DNA, 20 bp, Artificial Sequence
  Description of Artificial Sequence: Synthetic oligonucleotide
  Target: ATXN1; (-) strand; PAM type: YTN; PAM sequence: TTT
aacatttccacttaatcatt

SEQ ID NO: 225762 - DNA, 20 bp, Artificial Sequence
  Description of Artificial Sequence: Synthetic oligonucleotide
  Target: ATXN1; (-) strand; PAM type: YTN; PAM sequence: TTG
aaaatttaacatttccactt

SEQ ID NO: 225763 - DNA, 20 bp, Artificial Sequence
  Description of Artificial Sequence: Synthetic oligonucleotide
  Target: ATXN1; (-) strand; PAM type: YTN; PAM sequence: CTT
gaaaatttaacatttccact

SEQ ID NO: 225764 - DNA, 20 bp, Artificial Sequence
  Description of Artificial Sequence: Synthetic oligonucleotide
  Target: ATXN1; (-) strand; PAM type: YTN; PAM sequence: TTG
ccttgaaaatttaacatttc

SEQ ID NO: 225765 - DNA, 20 bp, Artificial Sequence
  Description of Artificial Sequence: Synthetic oligonucleotide
  Target: ATXN1; (-) strand; PAM type: YTN; PAM sequence: TTT
gccttgaaaatttaacattt

SEQ ID NO: 225766 - DNA, 20 bp, Artificial Sequence
  Description of Artificial Sequence: Synthetic oligonucleotide
  Target: ATXN1; (-) strand; PAM type: YTN; PAM sequence: CTT
tgccttgaaaatttaacatt

SEQ ID NO: 225767 - DNA, 20 bp, Artificial Sequence
  Description of Artificial Sequence: Synthetic oligonucleotide
  Target: ATXN1; (-) strand; PAM type: YTN; PAM sequence: TTA
aaaaatactttgccttgaaa

SEQ ID NO: 225768 - DNA, 20 bp, Artificial Sequence
  Description of Artificial Sequence: Synthetic oligonucleotide
  Target: ATXN1; (-) strand; PAM type: YTN; PAM sequence: TTT
aaaaaatactttgccttgaa

SEQ ID NO: 225769 - DNA, 20 bp, Artificial Sequence
  Description of Artificial Sequence: Synthetic oligonucleotide
  Target: ATXN1; (-) strand; PAM type: YTN; PAM sequence: TTA
tttaaaaaatactttgcctt

SEQ ID NO: 225770 - DNA, 20 bp, Artificial Sequence
  Description of Artificial Sequence: Synthetic oligonucleotide
  Target: ATXN1; (-) strand; PAM type: YTN; PAM sequence: TTG
aggttatttaaaaaatactt

SEQ ID NO: 225771 - DNA, 20 bp, Artificial Sequence
  Description of Artificial Sequence: Synthetic oligonucleotide
  Target: ATXN1; (-) strand; PAM type: YTN; PAM sequence: TTT
gaggttatttaaaaaatact

SEQ ID NO: 225772 - DNA, 20 bp, Artificial Sequence
  Description of Artificial Sequence: Synthetic oligonucleotide
  Target: ATXN1; (-) strand; PAM type: YTN; PAM sequence: TTT
tgaggttatttaaaaaatac

SEQ ID NO: 225773 - DNA, 20 bp, Artificial Sequence
  Description of Artificial Sequence: Synthetic oligonucleotide
  Target: ATXN1; (-) strand; PAM type: YTN; PAM sequence: TTT
ttgaggttatttaaaaaata

SEQ ID NO: 225774 - DNA, 20 bp, Artificial Sequence
  Description of Artificial Sequence: Synthetic oligonucleotide
  Target: ATXN1; (-) strand; PAM type: YTN; PAM sequence: TTA
atttttgaggttatttaaaa

SEQ ID NO: 225775 - DNA, 20 bp, Artificial Sequence
  Description of Artificial Sequence: Synthetic oligonucleotide
  Target: ATXN1; (-) strand; PAM type: YTN; PAM sequence: TTT
aatttttgaggttatttaaa

SEQ ID NO: 225776 - DNA, 20 bp, Artificial Sequence
  Description of Artificial Sequence: Synthetic oligonucleotide
  Target: ATXN1; (-) strand; PAM type: YTN; PAM sequence: TTT
taatttttgaggttatttaa

SEQ ID NO: 225777 - DNA, 20 bp, Artificial Sequence
  Description of Artificial Sequence: Synthetic oligonucleotide
  Target: ATXN1; (-) strand; PAM type: YTN; PAM sequence: TTT
ttaatttttgaggttattta

SEQ ID NO: 225778 - DNA, 20 bp, Artificial Sequence
  Description of Artificial Sequence: Synthetic oligonucleotide
  Target: ATXN1; (-) strand; PAM type: YTN; PAM sequence: TTT
tttaatttttgaggttattt

SEQ ID NO: 225779 - DNA, 20 bp, Artificial Sequence
  Description of Artificial Sequence: Synthetic oligonucleotide
  Target: ATXN1; (-) strand; PAM type: YTN; PAM sequence: TTT
ttttaatttttgaggttatt

SEQ ID NO: 225780 - DNA, 20 bp, Artificial Sequence
  Description of Artificial Sequence: Synthetic oligonucleotide
  Target: ATXN1; (-) strand; PAM type: YTN; PAM sequence: TTT
tttttaatttttgaggttat

SEQ ID NO: 225781 - DNA, 20 bp, Artificial Sequence
  Description of Artificial Sequence: Synthetic oligonucleotide
  Target: ATXN1; (-) strand; PAM type: YTN; PAM sequence: TTT
ttttttaatttttgaggtta

SEQ ID NO: 225782 - DNA, 20 bp, Artificial Sequence
  Description of Artificial Sequence: Synthetic oligonucleotide
  Target: ATXN1; (-) strand; PAM type: YTN; PAM sequence: TTT
tttttttaatttttgaggtt

SEQ ID NO: 225783 - DNA, 20 bp, Artificial Sequence
  Description of Artificial Sequence: Synthetic oligonucleotide
  Target: ATXN1; (-) strand; PAM type: YTN; PAM sequence: TTT
ttttttttaatttttgaggt

SEQ ID NO: 225784 - DNA, 20 bp, Artificial Sequence
  Description of Artificial Sequence: Synthetic oligonucleotide
  Target: ATXN1; (-) strand; PAM type: YTN; PAM sequence: TTT
tttttttttaatttttgagg

SEQ ID NO: 225785 - DNA, 20 bp, Artificial Sequence
  Description of Artificial Sequence: Synthetic oligonucleotide
  Target: ATXN1; (-) strand; PAM type: YTN; PAM sequence: TTT
ttttttttttaatttttgag

SEQ ID NO: 225786 - DNA, 20 bp, Artificial Sequence
  Description of Artificial Sequence: Synthetic oligonucleotide
  Target: ATXN1; (-) strand; PAM type: YTN; PAM sequence: TTT
tttttttttttaatttttga

SEQ ID NO: 225787 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttaatttttg

SEQ ID NO: 225788 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttaattttt

SEQ ID NO: 225789 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttaatttt

SEQ ID NO: 225790 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttaattt

SEQ ID NO: 225791 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttaatt

SEQ ID NO: 225792 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttaat

SEQ ID NO: 225793 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttttttaa

SEQ ID NO: 225794 - DNA, 20 bp, Artificial Sequence
  Description of Artificial Sequence: Synthetic oligonucleotide
  Target: ATXN1; (-) strand; PAM type: YTN; PAM sequence: TTC
agtgaagatctttttttttt

SEQ ID NO: 225795 - DNA, 20 bp, Artificial Sequence
  Description of Artificial Sequence: Synthetic oligonucleotide
  Target: ATXN1; (-) strand; PAM type: YTN; PAM sequence: CTT
cagtgaagatcttttttttt

SEQ ID NO: 225796 - DNA, 20 bp, Artificial Sequence
  Description of Artificial Sequence: Synthetic oligonucleotide
  Target: ATXN1; (-) strand; PAM type: YTN; PAM sequence: TTA
gcttcagtgaagatcttttt

SEQ ID NO: 225797 - DNA, 20 bp, Artificial Sequence
  Description of Artificial Sequence: Synthetic oligonucleotide
  Target: ATXN1; (-) strand; PAM type: YTN; PAM sequence: TTT
agcttcagtgaagatctttt

SEQ ID NO: 225798 - DNA, 20 bp, Artificial Sequence
  Description of Artificial Sequence: Synthetic oligonucleotide
  Target: ATXN1; (-) strand; PAM type: YTN; PAM sequence: TTT
tagcttcagtgaagatcttt

SEQ ID NO: 225799 - DNA, 20 bp, Artificial Sequence
  Description of Artificial Sequence: Synthetic oligonucleotide
  Target: ATXN1; (-) strand; PAM type: YTN; PAM sequence: TTT
ttagcttcagtgaagatctt

SEQ ID NO: 225800 - DNA, 20 bp, Artificial Sequence
  Description of Artificial Sequence: Synthetic oligonucleotide
  Target: ATXN1; (-) strand; PAM type: YTN; PAM sequence: CTT
tttagcttcagtgaagatct

SEQ ID NO: 225801 - DNA, 20 bp, Artificial Sequence
  Description of Artificial Sequence: Synthetic oligonucleotide
  Target: ATXN1; (-) strand; PAM type: YTN; PAM sequence: TTG
gtcatgtctttttagcttca

SEQ ID NO: 225802 - DNA, 20 bp, Artificial Sequence
  Description of Artificial Sequence: Synthetic oligonucleotide
  Target: ATXN1; (-) strand; PAM type: YTN; PAM sequence: TTC
attggtcatgtctttttagc

SEQ ID NO: 225803 - DNA, 20 bp, Artificial Sequence
  Description of Artificial Sequence: Synthetic oligonucleotide
  Target: ATXN1; (-) strand; PAM type: YTN; PAM sequence: CTT
cattggtcatgtctttttag

SEQ ID NO: 225804 - DNA, 20 bp, Artificial Sequence
  Description of Artificial Sequence: Synthetic oligonucleotide
  Target: ATXN1; (-) strand; PAM type: YTN; PAM sequence: TTC
cttcattggtcatgtctttt

SEQ ID NO: 225805 - DNA, 20 bp, Artificial Sequence
  Description of Artificial Sequence: Synthetic oligonucleotide
  Target: ATXN1; (-) strand; PAM type: YTN; PAM sequence: TTT
ccttcattggtcatgtcttt

SEQ ID NO: 225806 - DNA, 20 bp, Artificial Sequence
  Description of Artificial Sequence: Synthetic oligonucleotide
  Target: ATXN1; (-) strand; PAM type: YTN; PAM sequence: TTT
tccttcattggtcatgtctt

SEQ ID NO: 225807 - DNA, 20 bp, Artificial Sequence
  Description of Artificial Sequence: Synthetic oligonucleotide
  Target: ATXN1; (-) strand; PAM type: YTN; PAM sequence: CTT
ttccttcattggtcatgtct

SEQ ID NO: 225808 - DNA, 20 bp, Artificial Sequence
  Description of Artificial Sequence: Synthetic oligonucleotide
  Target: ATXN1; (-) strand; PAM type: YTN; PAM sequence: TTA
atgcttttccttcattggtc

SEQ ID NO: 225809 - DNA, 20 bp, Artificial Sequence
  Description of Artificial Sequence: Synthetic oligonucleotide
  Target: ATXN1; (-) strand; PAM type: YTN; PAM sequence: TTT
aatgcttttccttcattggt

SEQ ID NO: 225810 - DNA, 20 bp, Artificial Sequence
  Description of Artificial Sequence: Synthetic oligonucleotide
  Target: ATXN1; (-) strand; PAM type: YTN; PAM sequence: CTA
atttaatgcttttccttcat

SEQ ID NO: 225811 - DNA, 20 bp, Artificial Sequence
  Description of Artificial Sequence: Synthetic oligonucleotide
  Target: ATXN1; (-) strand; PAM type: YTN; PAM sequence: CTC
ctaatttaatgcttttcctt

SEQ ID NO: 225812 - DNA, 20 bp, Artificial Sequence
  Description of Artificial Sequence: Synthetic oligonucleotide
  Target: ATXN1; (-) strand; PAM type: YTN; PAM sequence: CTC
cagactcctaatttaatgct

SEQ ID NO: 225813 - DNA, 20 bp, Artificial Sequence
  Description of Artificial Sequence: Synthetic oligonucleotide
  Target: ATXN1; (-) strand; PAM type: YTN; PAM sequence: CTG
aaaaccagactccagactcc

SEQ ID NO: 225814 - DNA, 20 bp, Artificial Sequence
  Description of Artificial Sequence: Synthetic oligonucleotide
  Target: ATXN1; (-) strand; PAM type: YTN; PAM sequence: CTG
aggctgaaaaccagactcca

SEQ ID NO: 225815 - DNA, 20 bp, Artificial Sequence
  Description of Artificial Sequence: Synthetic oligonucleotide
  Target: ATXN1; (-) strand; PAM type: YTN; PAM sequence: TTG
atggctgaggctgaaaacca

SEQ ID NO: 225816 - DNA, 20 bp, Artificial Sequence
  Description of Artificial Sequence: Synthetic oligonucleotide
  Target: ATXN1; (-) strand; PAM type: YTN; PAM sequence: TTT
gatggctgaggctgaaaacc

SEQ ID NO: 225817 - DNA, 20 bp, Artificial Sequence
  Description of Artificial Sequence: Synthetic oligonucleotide
  Target: ATXN1; (-) strand; PAM type: YTN; PAM sequence: TTG
tttgatggctgaggctgaaa

SEQ ID NO: 225818 - DNA, 20 bp, Artificial Sequence
  Description of Artificial Sequence: Synthetic oligonucleotide
  Target: ATXN1; (-) strand; PAM type: YTN; PAM sequence: TTT
gtttgatggctgaggctgaa

SEQ ID NO: 225819 - DNA, 20 bp, Artificial Sequence
  Description of Artificial Sequence: Synthetic oligonucleotide
  Target: ATXN1; (-) strand; PAM type: YTN; PAM sequence: CTG
tttgtttgatggctgaggct

SEQ ID NO: 225820 - DNA, 20 bp, Artificial Sequence
  Description of Artificial Sequence: Synthetic oligonucleotide
  Target: ATXN1; (-) strand; PAM type: YTN; PAM sequence: CTA
caacacacagcctgtttgtt

SEQ ID NO: 225821 - DNA, 20 bp, Artificial Sequence
  Description of Artificial Sequence: Synthetic oligonucleotide
  Target: ATXN1; (-) strand; PAM type: YTN; PAM sequence: CTC
ctacaacacacagcctgttt

SEQ ID NO: 225822 - DNA, 20 bp, Artificial Sequence
  Description of Artificial Sequence: Synthetic oligonucleotide
  Target: ATXN1; (-) strand; PAM type: YTN; PAM sequence: TTA
aatgaccactcctacaacac

SEQ ID NO: 225823 - DNA, 20 bp, Artificial Sequence
  Description of Artificial Sequence: Synthetic oligonucleotide
  Target: ATXN1; (-) strand; PAM type: YTN; PAM sequence: TTA
gtgcggttaaatgaccactc

SEQ ID NO: 225824 - DNA, 20 bp, Artificial Sequence
  Description of Artificial Sequence: Synthetic oligonucleotide
  Target: ATXN1; (-) strand; PAM type: YTN; PAM sequence: CTT
agtgcggttaaatgaccact

SEQ ID NO: 225825 - DNA, 20 bp, Artificial Sequence
  Description of Artificial Sequence: Synthetic oligonucleotide
  Target: ATXN1; (-) strand; PAM type: YTN; PAM sequence: TTG
aggcttagtgcggttaaatg

SEQ ID NO: 225826 - DNA, 20 bp, Artificial Sequence
  Description of Artificial Sequence: Synthetic oligonucleotide
  Target: ATXN1; (-) strand; PAM type: YTN; PAM sequence: TTT
gaggcttagtgcggttaaat

SEQ ID NO: 225827 - DNA, 20 bp, Artificial Sequence
  Description of Artificial Sequence: Synthetic oligonucleotide
  Target: ATXN1; (-) strand; PAM type: YTN; PAM sequence: TTA
cagaggaaacatttgaggct

SEQ ID NO: 225828 - DNA, 20 bp, Artificial Sequence
  Description of Artificial Sequence: Synthetic oligonucleotide
  Target: ATXN1; (-) strand; PAM type: YTN; PAM sequence: TTT
acagaggaaacatttgaggc

SEQ ID NO: 225829 - DNA, 20 bp, Artificial Sequence
  Description of Artificial Sequence: Synthetic oligonucleotide
  Target: ATXN1; (-) strand; PAM type: YTN; PAM sequence: TTT
tacagaggaaacatttgagg

SEQ ID NO: 225830 - DNA, 20 bp, Artificial Sequence
  Description of Artificial Sequence: Synthetic oligonucleotide
  Target: ATXN1; (-) strand; PAM type: YTN; PAM sequence: CTA
attttacagaggaaacattt

SEQ ID NO: 225831 - DNA, 20 bp, Artificial Sequence
  Description of Artificial Sequence: Synthetic oligonucleotide
  Target: ATXN1; (-) strand; PAM type: YTN; PAM sequence: TTC
taattttacagaggaaacat

SEQ ID NO: 225832 - DNA, 20 bp, Artificial Sequence
  Description of Artificial Sequence: Synthetic oligonucleotide
  Target: ATXN1; (-) strand; PAM type: YTN; PAM sequence: CTA
atgttctaattttacagagg

SEQ ID NO: 225833 - DNA, 20 bp, Artificial Sequence
  Description of Artificial Sequence: Synthetic oligonucleotide
  Target: ATXN1; (-) strand; PAM type: YTN; PAM sequence: TTG
aacctaatgttctaatttta

SEQ ID NO: 225834 - DNA, 20 bp, Artificial Sequence
  Description of Artificial Sequence: Synthetic oligonucleotide
  Target: ATXN1; (-) strand; PAM type: YTN; PAM sequence: TTA
attgaacctaatgttctaat

SEQ ID NO: 225835 - DNA, 20 bp, Artificial Sequence
  Description of Artificial Sequence: Synthetic oligonucleotide
  Target: ATXN1; (-) strand; PAM type: YTN; PAM sequence: TTT
aattgaacctaatgttctaa

SEQ ID NO: 225836 - DNA, 20 bp, Artificial Sequence
  Description of Artificial Sequence: Synthetic oligonucleotide
  Target: ATXN1; (-) strand; PAM type: YTN; PAM sequence: CTT
taattgaacctaatgttcta

SEQ ID NO: 225837 - DNA, 20 bp, Artificial Sequence
  Description of Artificial Sequence: Synthetic oligonucleotide
  Target: ATXN1; (-) strand; PAM type: YTN; PAM sequence: TTA
aatggctttaattgaaccta

SEQ ID NO: 225838 - DNA, 20 bp, Artificial Sequence
  Description of Artificial Sequence: Synthetic oligonucleotide
  Target: ATXN1; (-) strand; PAM type: YTN; PAM sequence: CTT
aaatggctttaattgaacct

SEQ ID NO: 225839 - DNA, 20 bp, Artificial Sequence
  Description of Artificial Sequence: Synthetic oligonucleotide
  Target: ATXN1; (-) strand; PAM type: YTN; PAM sequence: TTA
aagcttaaatggctttaatt

SEQ ID NO: 225840 - DNA, 20 bp, Artificial Sequence
  Description of Artificial Sequence: Synthetic oligonucleotide
  Target: ATXN1; (-) strand; PAM type: YTN; PAM sequence: TTT
aaagcttaaatggctttaat

SEQ ID NO: 225841 - DNA, 20 bp, Artificial Sequence
  Description of Artificial Sequence: Synthetic oligonucleotide
  Target: ATXN1; (-) strand; PAM type: YTN; PAM sequence: TTT
taaagcttaaatggctttaa

SEQ ID NO: 225842 - DNA, 20 bp, Artificial Sequence
  Description of Artificial Sequence: Synthetic oligonucleotide
  Target: ATXN1; (-) strand; PAM type: YTN; PAM sequence: TTG
gacggacaatcgtagaattt

SEQ ID NO: 225843 - DNA, 20 bp, Artificial Sequence
  Description of Artificial Sequence: Synthetic oligonucleotide
  Target: ATXN1; (-) strand; PAM type: YTN; PAM sequence: TTG
aattggacggacaatcgtag

SEQ ID NO: 225844 - DNA, 20 bp, Artificial Sequence
  Description of Artificial Sequence: Synthetic oligonucleotide
  Target: ATXN1; (-) strand; PAM type: YTN; PAM sequence: TTA
ttgaattggacggacaatcg

SEQ ID NO: 225845 - DNA, 20 bp, Artificial Sequence
  Description of Artificial Sequence: Synthetic oligonucleotide
  Target: ATXN1; (-) strand; PAM type: YTN; PAM sequence: TTT
attgaattggacggacaatc

SEQ ID NO: 225846 - DNA, 20 bp, Artificial Sequence
  Description of Artificial Sequence: Synthetic oligonucleotide
  Target: ATXN1; (-) strand; PAM type: YTN; PAM sequence: TTT
tattgaattggacggacaat

SEQ ID NO: 225847 - DNA, 20 bp, Artificial Sequence
  Description of Artificial Sequence: Synthetic oligonucleotide
  Target: ATXN1; (-) strand; PAM type: YTN; PAM sequence: TTA
ttttattgaattggacggac

SEQ ID NO: 225848 - DNA, 20 bp, Artificial Sequence
  Description of Artificial Sequence: Synthetic oligonucleotide
  Target: ATXN1; (-) strand; PAM type: YTN; PAM sequence: TTT
attttattgaattggacgga

SEQ ID NO: 225849 - DNA, 20 bp, Artificial Sequence
  Description of Artificial Sequence: Synthetic oligonucleotide
  Target: ATXN1; (-) strand; PAM type: YTN; PAM sequence: TTA
aatacagtttattttattga

SEQ ID NO: 225850 - DNA, 20 bp, Artificial Sequence
  Description of Artificial Sequence: Synthetic oligonucleotide
  Target: ATXN1; (-) strand; PAM type: YTN; PAM sequence: TTA
ttaaatacagtttattttat

SEQ ID NO: 225851 - DNA, 20 bp, Artificial Sequence
  Description of Artificial Sequence: Synthetic oligonucleotide
  Target: ATXN1; (-) strand; PAM type: YTN; PAM sequence: TTG
aaaaagcaggtattattaaa

SEQ ID NO: 225852 - DNA, 20 bp, Artificial Sequence
  Description of Artificial Sequence: Synthetic oligonucleotide
  Target: ATXN1; (-) strand; PAM type: YTN; PAM sequence: TTA
gttgaaaaagcaggtattat

SEQ ID NO: 225853 - DNA, 20 bp, Artificial Sequence
  Description of Artificial Sequence: Synthetic oligonucleotide
  Target: ATXN1; (-) strand; PAM type: YTN; PAM sequence: CTT
agttgaaaaagcaggtatta

SEQ ID NO: 225854 - DNA, 20 bp, Artificial Sequence
  Description of Artificial Sequence: Synthetic oligonucleotide
  Target: ATXN1; (-) strand; PAM type: YTN; PAM sequence: TTA
gcttagttgaaaaagcaggt

SEQ ID NO: 225855 - DNA, 20 bp, Artificial Sequence
  Description of Artificial Sequence: Synthetic oligonucleotide
  Target: ATXN1; (-) strand; PAM type: YTN; PAM sequence: TTA
aaaaattagcttagttgaaa

SEQ ID NO: 225856 - DNA, 20 bp, Artificial Sequence
  Description of Artificial Sequence: Synthetic oligonucleotide
  Target: ATXN1; (-) strand; PAM type: YTN; PAM sequence: TTT
aaaaaattagcttagttgaa

SEQ ID NO: 225857 - DNA, 20 bp, Artificial Sequence
  Description of Artificial Sequence: Synthetic oligonucleotide
  Target: ATXN1; (-) strand; PAM type: YTN; PAM sequence: TTT
taaaaaattagcttagttga

SEQ ID NO: 225858 - DNA, 20 bp, Artificial Sequence
  Description of Artificial Sequence: Synthetic oligonucleotide
  Target: ATXN1; (-) strand; PAM type: YTN; PAM sequence: CTT
ttaaaaaattagcttagttg

SEQ ID NO: 225859 - DNA, 20 bp, Artificial Sequence
  Description of Artificial Sequence: Synthetic oligonucleotide
  Target: ATXN1; (-) strand; PAM type: YTN; PAM sequence: CTG
ccttttaaaaaattagctta

SEQ ID NO: 225860 - DNA, 20 bp, Artificial Sequence
  Description of Artificial Sequence: Synthetic oligonucleotide
  Target: ATXN1; (-) strand; PAM type: YTN; PAM sequence: TTC
tgccttttaaaaaattagct

SEQ ID NO: 225861 - DNA, 20 bp, Artificial Sequence
  Description of Artificial Sequence: Synthetic oligonucleotide
  Target: ATXN1; (-) strand; PAM type: YTN; PAM sequence: TTT
ctgccttttaaaaaattagc

SEQ ID NO: 225862 - DNA, 20 bp, Artificial Sequence
  Description of Artificial Sequence: Synthetic oligonucleotide
  Target: ATXN1; (-) strand; PAM type: YTN; PAM sequence: TTT
tctgccttttaaaaaattag

SEQ ID NO: 225863 - DNA, 20 bp, Artificial Sequence
  Description of Artificial Sequence: Synthetic oligonucleotide
  Target: ATXN1; (-) strand; PAM type: YTN; PAM sequence: TTA
gattttctgccttttaaaaa

SEQ ID NO: 225864 - DNA, 20 bp, Artificial Sequence
  Description of Artificial Sequence: Synthetic oligonucleotide
  Target: ATXN1; (-) strand; PAM type: YTN; PAM sequence: CTG
gttagattttctgcctttta

SEQ ID NO: 225865 - DNA, 20 bp, Artificial Sequence
  Description of Artificial Sequence: Synthetic oligonucleotide
  Target: ATXN1; (-) strand; PAM type: YTN; PAM sequence: TTC
tggttagattttctgccttt

SEQ ID NO: 225866 - DNA, 20 bp, Artificial Sequence
  Description of Artificial Sequence: Synthetic oligonucleotide
  Target: ATXN1; (-) strand; PAM type: YTN; PAM sequence: TTT
ctggttagattttctgcctt

SEQ ID NO: 225867 - DNA, 20 bp, Artificial Sequence
  Description of Artificial Sequence: Synthetic oligonucleotide
  Target: ATXN1; (-) strand; PAM type: YTN; PAM sequence: TTT
tctggttagattttctgcct

SEQ ID NO: 225868 - DNA, 20 bp, Artificial Sequence
  Description of Artificial Sequence: Synthetic oligonucleotide
  Target: ATXN1; (-) strand; PAM type: YTN; PAM sequence: CTT
ttctggttagattttctgcc

SEQ ID NO: 225869 - DNA, 20 bp, Artificial Sequence
  Description of Artificial Sequence: Synthetic oligonucleotide
  Target: ATXN1; (-) strand; PAM type: YTN; PAM sequence: TTC
ttttctggttagattttctg

SEQ ID NO: 225870 - DNA, 20 bp, Artificial Sequence
  Description of Artificial Sequence: Synthetic oligonucleotide
  Target: ATXN1; (-) strand; PAM type: YTN; PAM sequence: TTA
ttcttttctggttagatttt

SEQ ID NO: 225871 - DNA, 20 bp, Artificial Sequence
  Description of Artificial Sequence: Synthetic oligonucleotide
  Target: ATXN1; (-) strand; PAM type: YTN; PAM sequence: TTT
attcttttctggttagattt

SEQ ID NO: 225872 - DNA, 20 bp, Artificial Sequence
  Description of Artificial Sequence: Synthetic oligonucleotide
  Target: ATXN1; (-) strand; PAM type: YTN; PAM sequence: TTT
tattcttttctggttagatt

SEQ ID NO: 225873 - DNA, 20 bp, Artificial Sequence
  Description of Artificial Sequence: Synthetic oligonucleotide
  Target: ATXN1; (-) strand; PAM type: YTN; PAM sequence: TTT
ttattcttttctggttagat

SEQ ID NO: 225874 - DNA, 20 bp, Artificial Sequence
  Description of Artificial Sequence: Synthetic oligonucleotide
  Target: ATXN1; (-) strand; PAM type: YTN; PAM sequence: TTT
tttattcttttctggttaga

SEQ ID NO: 225875 - DNA, 20 bp, Artificial Sequence
  Description of Artificial Sequence: Synthetic oligonucleotide
  Target: ATXN1; (-) strand; PAM type: YTN; PAM sequence: TTA
aacattttttattcttttct

SEQ ID NO: 225876 - DNA, 20 bp, Artificial Sequence
  Description of Artificial Sequence: Synthetic oligonucleotide
  Target: ATXN1; (-) strand; PAM type: YTN; PAM sequence: TTG
tacaagttaaacatttttta

SEQ ID NO: 225877 - DNA, 20 bp, Artificial Sequence
  Description of Artificial Sequence: Synthetic oligonucleotide
  Target: ATXN1; (-) strand; PAM type: YTN; PAM sequence: TTA
tgttgtacaagttaaacatt

SEQ ID NO: 225878 - DNA, 20 bp, Artificial Sequence
  Description of Artificial Sequence: Synthetic oligonucleotide
  Target: ATXN1; (-) strand; PAM type: YTN; PAM sequence: TTT
atgttgtacaagttaaacat

SEQ ID NO: 225879 - DNA, 20 bp, Artificial Sequence
  Description of Artificial Sequence: Synthetic oligonucleotide
  Target: ATXN1; (-) strand; PAM type: YTN; PAM sequence: CTG
gacaaagtttatgttgtaca

SEQ ID NO: 225880 - DNA, 20 bp, Artificial Sequence
  Description of Artificial Sequence: Synthetic oligonucleotide
  Target: ATXN1; (-) strand; PAM type: YTN; PAM sequence: TTC
tggacaaagtttatgttgta

SEQ ID NO: 225881 - DNA, 20 bp, Artificial Sequence
  Description of Artificial Sequence: Synthetic oligonucleotide
  Target: ATXN1; (-) strand; PAM type: YTN; PAM sequence: TTT
ctggacaaagtttatgttgt

SEQ ID NO: 225882 - DNA, 20 bp, Artificial Sequence
  Description of Artificial Sequence: Synthetic oligonucleotide
  Target: ATXN1; (-) strand; PAM type: YTN; PAM sequence: CTG
atttctggacaaagtttatg

SEQ ID NO: 225883 - DNA, 20 bp, Artificial Sequence
  Description of Artificial Sequence: Synthetic oligonucleotide
  Target: ATXN1; (-) strand; PAM type: YTN; PAM sequence: TTG
gaagagcagatactgatttc

SEQ ID NO: 225884 - DNA, 20 bp, Artificial Sequence
  Description of Artificial Sequence: Synthetic oligonucleotide
  Target: ATXN1; (-) strand; PAM type: YTN; PAM sequence: TTT
ggaagagcagatactgattt

SEQ ID NO: 225885 - DNA, 20 bp, Artificial Sequence
  Description of Artificial Sequence: Synthetic oligonucleotide
  Target: ATXN1; (-) strand; PAM type: YTN; PAM sequence: CTT
tggaagagcagatactgatt

SEQ ID NO: 225886 - DNA, 20 bp, Artificial Sequence
  Description of Artificial Sequence: Synthetic oligonucleotide
  Target: ATXN1; (-) strand; PAM type: YTN; PAM sequence: TTC
tttggaagagcagatactga

SEQ ID NO: 225887 - DNA, 20 bp, Artificial Sequence
  Description of Artificial Sequence: Synthetic oligonucleotide
  Target: ATXN1; (-) strand; PAM type: YTN; PAM sequence: TTT
ctttggaagagcagatactg

SEQ ID NO: 225888 - DNA, 20 bp, Artificial Sequence
  Description of Artificial Sequence: Synthetic oligonucleotide
  Target: ATXN1; (-) strand; PAM type: YTN; PAM sequence: TTT
tctttggaagagcagatact

SEQ ID NO: 225889 - DNA, 20 bp, Artificial Sequence
  Description of Artificial Sequence: Synthetic oligonucleotide
  Target: ATXN1; (-) strand; PAM type: YTN; PAM sequence: TTT
ttctttggaagagcagatac

SEQ ID NO: 225890 - DNA, 20 bp, Artificial Sequence
  Description of Artificial Sequence: Synthetic oligonucleotide
  Target: ATXN1; (-) strand; PAM type: YTN; PAM sequence: CTA
tttttctttggaagagcaga

SEQ ID NO: 225891 - DNA, 20 bp, Artificial Sequence
  Description of Artificial Sequence: Synthetic oligonucleotide
  Target: ATXN1; (-) strand; PAM type: YTN; PAM sequence: CTG
aacaatagaaaacaaaaggc

SEQ ID NO: 225892 - DNA, 20 bp, Artificial Sequence
  Description of Artificial Sequence: Synthetic oligonucleotide
  Target: ATXN1; (-) strand; PAM type: YTN; PAM sequence: CTG
tacactgaacaatagaaaac

SEQ ID NO: 225893 - DNA, 20 bp, Artificial Sequence
  Description of Artificial Sequence: Synthetic oligonucleotide
  Target: ATXN1; (-) strand; PAM type: YTN; PAM sequence: TTA
gtggtaagctgtacactgaa

SEQ ID NO: 225894 - DNA, 20 bp, Artificial Sequence
  Description of Artificial Sequence: Synthetic oligonucleotide
  Target: ATXN1; (-) strand; PAM type: YTN; PAM sequence: CTT
agtggtaagctgtacactga

SEQ ID NO: 225895 - DNA, 20 bp, Artificial Sequence
  Description of Artificial Sequence: Synthetic oligonucleotide
  Target: ATXN1; (-) strand; PAM type: YTN; PAM sequence: TTG
cttagtggtaagctgtacac

SEQ ID NO: 225896 - DNA, 20 bp, Artificial Sequence
  Description of Artificial Sequence: Synthetic oligonucleotide
  Target: ATXN1; (-) strand; PAM type: YTN; PAM sequence: CTT
gcttagtggtaagctgtaca

SEQ ID NO: 225897 - DNA, 20 bp, Artificial Sequence
  Description of Artificial Sequence: Synthetic oligonucleotide
  Target: ATXN1; (-) strand; PAM type: YTN; PAM sequence: TTC
cttgcttagtggtaagctgt

SEQ ID NO: 225898 - DNA, 20 bp, Artificial Sequence
  Description of Artificial Sequence: Synthetic oligonucleotide
  Target: ATXN1; (-) strand; PAM type: YTN; PAM sequence: TTA
ttccttgcttagtggtaagc

SEQ ID NO: 225899 - DNA, 20 bp, Artificial Sequence
  Description of Artificial Sequence: Synthetic oligonucleotide
  Target: ATXN1; (-) strand; PAM type: YTN; PAM sequence: TTT
attccttgcttagtggtaag

SEQ ID NO: 225900 - DNA, 20 bp, Artificial Sequence
  Description of Artificial Sequence: Synthetic oligonucleotide
  Target: ATXN1; (-) strand; PAM type: YTN; PAM sequence: CTG
tagccccacatttattcctt

SEQ ID NO: 225901 - DNA, 20 bp, Artificial Sequence
  Description of Artificial Sequence: Synthetic oligonucleotide
  Target: ATXN1; (-) strand; PAM type: YTN; PAM sequence: CTG
gcacatacagatgaactgta

SEQ ID NO: 225902 - DNA, 20 bp, Artificial Sequence
  Description of Artificial Sequence: Synthetic oligonucleotide
  Target: ATXN1; (-) strand; PAM type: YTN; PAM sequence: TTG
aaagtaacatgctggcacat

SEQ ID NO: 225903 - DNA, 20 bp, Artificial Sequence
  Description of Artificial Sequence: Synthetic oligonucleotide
  Target: ATXN1; (-) strand; PAM type: YTN; PAM sequence: CTT
gaaagtaacatgctggcaca

SEQ ID NO: 225904 - DNA, 20 bp, Artificial Sequence
  Description of Artificial Sequence: Synthetic oligonucleotide
  Target: ATXN1; (-) strand; PAM type: YTN; PAM sequence: CTG
aacccttgaaagtaacatgc

SEQ ID NO: 225905 - DNA, 20 bp, Artificial Sequence
  Description of Artificial Sequence: Synthetic oligonucleotide
  Target: ATXN1; (-) strand; PAM type: YTN; PAM sequence: CTA
ctgaacccttgaaagtaaca

SEQ ID NO: 225906 - DNA, 20 bp, Artificial Sequence
  Description of Artificial Sequence: Synthetic oligonucleotide
  Target: ATXN1; (-) strand; PAM type: YTN; PAM sequence: CTG
ccgtggagctactgaaccct

SEQ ID NO: 225907 - DNA, 20 bp, Artificial Sequence
  Description of Artificial Sequence: Synthetic oligonucleotide
  Target: ATXN1; (-) strand; PAM type: YTN; PAM sequence: TTC
tgccgtggagctactgaacc

SEQ ID NO: 225908 - DNA, 20 bp, Artificial Sequence
  Description of Artificial Sequence: Synthetic oligonucleotide
  Target: ATXN1; (-) strand; PAM type: YTN; PAM sequence: TTT
ctgccgtggagctactgaac

SEQ ID NO: 225909 - DNA, 20 bp, Artificial Sequence
  Description of Artificial Sequence: Synthetic oligonucleotide
  Target: ATXN1; (-) strand; PAM type: YTN; PAM sequence: CTT
tctgccgtggagctactgaa

SEQ ID NO: 225910 - DNA, 20 bp, Artificial Sequence
  Description of Artificial Sequence: Synthetic oligonucleotide
  Target: ATXN1; (-) strand; PAM type: YTN; PAM sequence: TTC
tttctgccgtggagctactg

SEQ ID NO: 225911 - DNA, 20 bp, Artificial Sequence
  Description of Artificial Sequence: Synthetic oligonucleotide
  Target: ATXN1; (-) strand; PAM type: YTN; PAM sequence: TTT
ctttctgccgtggagctact

SEQ ID NO: 225912 - DNA, 20 bp, Artificial Sequence
  Description of Artificial Sequence: Synthetic oligonucleotide
  Target: ATXN1; (-) strand; PAM type: YTN; PAM sequence: TTA
atagtgagtaatagagaagt

SEQ ID NO: 225913 - DNA, 20 bp, Artificial Sequence
  Description of Artificial Sequence: Synthetic oligonucleotide
  Target: ATXN1; (-) strand; PAM type: YTN; PAM sequence: TTT
aatagtgagtaatagagaag

SEQ ID NO: 225914 - DNA, 20 bp, Artificial Sequence
  Description of Artificial Sequence: Synthetic oligonucleotide
  Target: ATXN1; (-) strand; PAM type: YTN; PAM sequence: TTG
aaatgcagtttaatagtgag

SEQ ID NO: 225915 - DNA, 20 bp, Artificial Sequence
  Description of Artificial Sequence: Synthetic oligonucleotide
  Target: ATXN1; (-) strand; PAM type: YTN; PAM sequence: TTT
gaaatgcagtttaatagtga

SEQ ID NO: 225916 - DNA, 20 bp, Artificial Sequence
  Description of Artificial Sequence: Synthetic oligonucleotide
  Target: ATXN1; (-) strand; PAM type: YTN; PAM sequence: TTT
tgaaatgcagtttaatagtg

SEQ ID NO: 225917 - DNA, 20 bp, Artificial Sequence
  Description of Artificial Sequence: Synthetic oligonucleotide
  Target: ATXN1; (-) strand; PAM type: YTN; PAM sequence: TTG
taggttttgaaatgcagttt

SEQ ID NO: 225918 - DNA, 20 bp, Artificial Sequence
  Description of Artificial Sequence: Synthetic oligonucleotide
  Target: ATXN1; (-) strand; PAM type: YTN; PAM sequence: TTT
gtaggttttgaaatgcagtt

SEQ ID NO: 225919 - DNA, 20 bp, Artificial Sequence
  Description of Artificial Sequence: Synthetic oligonucleotide
  Target: ATXN1; (-) strand; PAM type: YTN; PAM sequence: TTT
tgtaggttttgaaatgcagt

SEQ ID NO: 225920 - DNA, 20 bp, Artificial Sequence
  Description of Artificial Sequence: Synthetic oligonucleotide
  Target: ATXN1; (-) strand; PAM type: YTN; PAM sequence: TTT
ttgtaggttttgaaatgcag

SEQ ID NO: 225921 - DNA, 20 bp, Artificial Sequence
  Description of Artificial Sequence: Synthetic oligonucleotide
  Target: ATXN1; (-) strand; PAM type: YTN; PAM sequence: CTG
tttttgtaggttttgaaatg

SEQ ID NO: 225922 - DNA, 20 bp, Artificial Sequence
  Description of Artificial Sequence: Synthetic oligonucleotide
  Target: ATXN1; (-) strand; PAM type: YTN; PAM sequence: TTG
gagctgtttttgtaggtttt

SEQ ID NO: 225923 - DNA, 20 bp, Artificial Sequence
  Description of Artificial Sequence: Synthetic oligonucleotide
  Target: ATXN1; (-) strand; PAM type: YTN; PAM sequence: TTT
ggagctgtttttgtaggttt

SEQ ID NO: 225924 - DNA, 20 bp, Artificial Sequence
  Description of Artificial Sequence: Synthetic oligonucleotide
  Target: ATXN1; (-) strand; PAM type: YTN; PAM sequence: TTT
tggagctgtttttgtaggtt

SEQ ID NO: 225925 - DNA, 20 bp, Artificial Sequence
  Description of Artificial Sequence: Synthetic oligonucleotide
  Target: ATXN1; (-) strand; PAM type: YTN; PAM sequence: TTA
attttggagctgtttttgta

SEQ ID NO: 225926 - DNA, 20 bp, Artificial Sequence
  Description of Artificial Sequence: Synthetic oligonucleotide
  Target: ATXN1; (-) strand; PAM type: YTN; PAM sequence: CTT
aattttggagctgtttttgt

SEQ ID NO: 225927 - DNA, 20 bp, Artificial Sequence
  Description of Artificial Sequence: Synthetic oligonucleotide
  Target: ATXN1; (-) strand; PAM type: YTN; PAM sequence: CTG
gcttaattttggagctgttt

SEQ ID NO: 225928 - DNA, 20 bp, Artificial Sequence
  Description of Artificial Sequence: Synthetic oligonucleotide
  Target: ATXN1; (-) strand; PAM type: YTN; PAM sequence: TTG
ctggcttaattttggagctg

SEQ ID NO: 225929 - DNA, 20 bp, Artificial Sequence
  Description of Artificial Sequence: Synthetic oligonucleotide
  Target: ATXN1; (-) strand; PAM type: YTN; PAM sequence: TTT
gctggcttaattttggagct

SEQ ID NO: 225930 - DNA, 20 bp, Artificial Sequence
  Description of Artificial Sequence: Synthetic oligonucleotide
  Target: ATXN1; (-) strand; PAM type: YTN; PAM sequence: TTT
tgctggcttaattttggagc

SEQ ID NO: 225931 - DNA, 20 bp, Artificial Sequence
  Description of Artificial Sequence: Synthetic oligonucleotide
  Target: ATXN1; (-) strand; PAM type: YTN; PAM sequence: TTC
agatggatgacagcaacatt

SEQ ID NO: 225932 - DNA, 20 bp, Artificial Sequence
  Description of Artificial Sequence: Synthetic oligonucleotide
  Target: ATXN1; (-) strand; PAM type: YTN; PAM sequence: CTA
acaggttcagatggatgaca

SEQ ID NO: 225933 - DNA, 20 bp, Artificial Sequence
  Description of Artificial Sequence: Synthetic oligonucleotide
  Target: ATXN1; (-) strand; PAM type: YTN; PAM sequence: TTC
taacaggttcagatggatga

SEQ ID NO: 225934 - DNA, 20 bp, Artificial Sequence
  Description of Artificial Sequence: Synthetic oligonucleotide
  Target: ATXN1; (-) strand; PAM type: YTN; PAM sequence: TTT
ctaacaggttcagatggatg

SEQ ID NO: 225935 - DNA, 20 bp, Artificial Sequence
  Description of Artificial Sequence: Synthetic oligonucleotide
  Target: ATXN1; (-) strand; PAM type: YTN; PAM sequence: TTG
agatttctaacaggttcaga

SEQ ID NO: 225936 - DNA, 20 bp, Artificial Sequence
  Description of Artificial Sequence: Synthetic oligonucleotide
  Target: ATXN1; (-) strand; PAM type: YTN; PAM sequence: CTT
gagatttctaacaggttcag

SEQ ID NO: 225937 - DNA, 20 bp, Artificial Sequence
  Description of Artificial Sequence: Synthetic oligonucleotide
  Target: ATXN1; (-) strand; PAM type: YTN; PAM sequence: CTA
tgacgagcttgagatttcta

SEQ ID NO: 225938 - DNA, 20 bp, Artificial Sequence
  Description of Artificial Sequence: Synthetic oligonucleotide
  Target: ATXN1; (-) strand; PAM type: YTN; PAM sequence: TTC
tatgacgagcttgagatttc

SEQ ID NO: 225939 - DNA, 20 bp, Artificial Sequence
  Description of Artificial Sequence: Synthetic oligonucleotide
  Target: ATXN1; (-) strand; PAM type: YTN; PAM sequence: TTG
aatggtgaggtcaaagattc

SEQ ID NO: 225940 - DNA, 20 bp, Artificial Sequence
  Description of Artificial Sequence: Synthetic oligonucleotide
  Target: ATXN1; (-) strand; PAM type: YTN; PAM sequence: TTG
taaaacattgaatggtgagg

SEQ ID NO: 225941 - DNA, 20 bp, Artificial Sequence
  Description of Artificial Sequence: Synthetic oligonucleotide
  Target: ATXN1; (-) strand; PAM type: YTN; PAM sequence: TTT
gtaaaacattgaatggtgag

SEQ ID NO: 225942 - DNA, 20 bp, Artificial Sequence
  Description of Artificial Sequence: Synthetic oligonucleotide
  Target: ATXN1; (-) strand; PAM type: YTN; PAM sequence: CTC
aatttgtaaaacattgaatg

SEQ ID NO: 225943 - DNA, 20 bp, Artificial Sequence
  Description of Artificial Sequence: Synthetic oligonucleotide
  Target: ATXN1; (-) strand; PAM type: YTN; PAM sequence: TTA
ctcaatttgtaaaacattga

SEQ ID NO: 225944 - DNA, 20 bp, Artificial Sequence
  Description of Artificial Sequence: Synthetic oligonucleotide
  Target: ATXN1; (-) strand; PAM type: YTN; PAM sequence: TTA
gtagtaaatgacagggacat

SEQ ID NO: 225945 - DNA, 20 bp, Artificial Sequence
  Description of Artificial Sequence: Synthetic oligonucleotide
  Target: ATXN1; (-) strand; PAM type: YTN; PAM sequence: TTT
agtagtaaatgacagggaca

SEQ ID NO: 225946 - DNA, 20 bp, Artificial Sequence
  Description of Artificial Sequence: Synthetic oligonucleotide
  Target: ATXN1; (-) strand; PAM type: YTN; PAM sequence: TTT
tagtagtaaatgacagggac

SEQ ID NO: 225947 - DNA, 20 bp, Artificial Sequence
  Description of Artificial Sequence: Synthetic oligonucleotide
  Target: ATXN1; (-) strand; PAM type: YTN; PAM sequence: TTG
tcattttagtagtaaatgac

SEQ ID NO: 225948 - DNA, 20 bp, Artificial Sequence
  Description of Artificial Sequence: Synthetic oligonucleotide
  Target: ATXN1; (-) strand; PAM type: YTN; PAM sequence: TTT
gtcattttagtagtaaatga

SEQ ID NO: 225949 - DNA, 20 bp, Artificial Sequence
  Description of Artificial Sequence: Synthetic oligonucleotide
  Target: ATXN1; (-) strand; PAM type: YTN; PAM sequence: TTT
tgtcattttagtagtaaatg

SEQ ID NO: 225950 - DNA, 20 bp, Artificial Sequence
  Description of Artificial Sequence: Synthetic oligonucleotide
  Target: ATXN1; (-) strand; PAM type: YTN; PAM sequence: TTT
ttgtcattttagtagtaaat

SEQ ID NO: 225951 - DNA, 20 bp, Artificial Sequence
  Description of Artificial Sequence: Synthetic oligonucleotide
  Target: ATXN1; (-) strand; PAM type: YTN; PAM sequence: TTA
tttttgtcattttagtagta

SEQ ID NO: 225952 - DNA, 20 bp, Artificial Sequence
  Description of Artificial Sequence: Synthetic oligonucleotide
  Target: ATXN1; (-) strand; PAM type: YTN; PAM sequence: TTT
atttttgtcattttagtagt

SEQ ID NO: 225953 - DNA, 20 bp, Artificial Sequence
  Description of Artificial Sequence: Synthetic oligonucleotide
  Target: ATXN1; (-) strand; PAM type: YTN; PAM sequence: TTT
tatttttgtcattttagtag

SEQ ID NO: 225954 - DNA, 20 bp, Artificial Sequence
  Description of Artificial Sequence: Synthetic oligonucleotide
  Target: ATXN1; (-) strand; PAM type: YTN; PAM sequence: TTT
ttatttttgtcattttagta

SEQ ID NO: 225955 - DNA, 20 bp, Artificial Sequence
  Description of Artificial Sequence: Synthetic oligonucleotide
  Target: ATXN1; (-) strand; PAM type: YTN; PAM sequence: TTA
tttttatttttgtcatttta

SEQ ID NO: 225956 - DNA, 20 bp, Artificial Sequence
  Description of Artificial Sequence: Synthetic oligonucleotide
  Target: ATXN1; (-) strand; PAM type: YTN; PAM sequence: TTT
atttttatttttgtcatttt

SEQ ID NO: 225957 - DNA, 20 bp, Artificial Sequence
  Description of Artificial Sequence: Synthetic oligonucleotide
  Target: ATXN1; (-) strand; PAM type: YTN; PAM sequence: TTT
tatttttatttttgtcattt

SEQ ID NO: 225958 - DNA, 20 bp, Artificial Sequence
  Description of Artificial Sequence: Synthetic oligonucleotide
  Target: ATXN1; (-) strand; PAM type: YTN; PAM sequence: CTT
ttatttttatttttgtcatt

SEQ ID NO: 225959 - DNA, 20 bp, Artificial Sequence
  Description of Artificial Sequence: Synthetic oligonucleotide
  Target: ATXN1; (-) strand; PAM type: YTN; PAM sequence: TTA
ccttttatttttatttttgt

SEQ ID NO: 225960 - DNA, 20 bp, Artificial Sequence
  Description of Artificial Sequence: Synthetic oligonucleotide
  Target: ATXN1; (-) strand; PAM type: YTN; PAM sequence: TTT
accttttatttttatttttg

SEQ ID NO: 225961 - DNA, 20 bp, Artificial Sequence
  Description of Artificial Sequence: Synthetic oligonucleotide
  Target: ATXN1; (-) strand; PAM type: YTN; PAM sequence: CTT
taccttttatttttattttt

SEQ ID NO: 225962 - DNA, 20 bp, Artificial Sequence
  Description of Artificial Sequence: Synthetic oligonucleotide
  Target: ATXN1; (-) strand; PAM type: YTN; PAM sequence: CTC
tttaccttttatttttattt

SEQ ID NO: 225963 - DNA, 20 bp, Artificial Sequence
  Description of Artificial Sequence: Synthetic oligonucleotide
  Target: ATXN1; (-) strand; PAM type: YTN; PAM sequence: TTC
tctttaccttttatttttat

SEQ ID NO: 225964 - DNA, 20 bp, Artificial Sequence
  Description of Artificial Sequence: Synthetic oligonucleotide
  Target: ATXN1; (-) strand; PAM type: YTN; PAM sequence: TTC
agtgttctctttacctttta

SEQ ID NO: 225965 - DNA, 20 bp, Artificial Sequence
  Description of Artificial Sequence: Synthetic oligonucleotide
  Target: ATXN1; (-) strand; PAM type: YTN; PAM sequence: CTT
cagtgttctctttacctttt

SEQ ID NO: 225966 - DNA, 20 bp, Artificial Sequence
  Description of Artificial Sequence: Synthetic oligonucleotide
  Target: ATXN1; (-) strand; PAM type: YTN; PAM sequence: CTA
accttcagtgttctctttac

SEQ ID NO: 225967 - DNA, 20 bp, Artificial Sequence
  Description of Artificial Sequence: Synthetic oligonucleotide
  Target: ATXN1; (-) strand; PAM type: YTN; PAM sequence: CTC
ctaaccttcagtgttctctt

SEQ ID NO: 225968 - DNA, 20 bp, Artificial Sequence
  Description of Artificial Sequence: Synthetic oligonucleotide
  Target: ATXN1; (-) strand; PAM type: YTN; PAM sequence: CTA
ctcctaaccttcagtgttct

SEQ ID NO: 225969 - DNA, 20 bp, Artificial Sequence
  Description of Artificial Sequence: Synthetic oligonucleotide
  Target: ATXN1; (-) strand; PAM type: YTN; PAM sequence: CTC
acctactcctaaccttcagt

SEQ ID NO: 225970 - DNA, 20 bp, Artificial Sequence
  Description of Artificial Sequence: Synthetic oligonucleotide
  Target: ATXN1; (-) strand; PAM type: YTN; PAM sequence: TTC
ccatcctcacctactcctaa

SEQ ID NO: 225971 - DNA, 20 bp, Artificial Sequence
  Description of Artificial Sequence: Synthetic oligonucleotide
  Target: ATXN1; (-) strand; PAM type: YTN; PAM sequence: TTT
cccatcctcacctactccta

SEQ ID NO: 225972 - DNA, 20 bp, Artificial Sequence
  Description of Artificial Sequence: Synthetic oligonucleotide
  Target: ATXN1; (-) strand; PAM type: YTN; PAM sequence: TTT
tcccatcctcacctactcct

SEQ ID NO: 225973 - DNA, 20 bp, Artificial Sequence
  Description of Artificial Sequence: Synthetic oligonucleotide
  Target: ATXN1; (-) strand; PAM type: YTN; PAM sequence: CTT
ttcccatcctcacctactcc

SEQ ID NO: 225974 - DNA, 20 bp, Artificial Sequence
  Description of Artificial Sequence: Synthetic oligonucleotide
  Target: ATXN1; (-) strand; PAM type: YTN; PAM sequence: TTC
ccttttcccatcctcaccta

SEQ ID NO: 225975 - DNA, 20 bp, Artificial Sequence
  Description of Artificial Sequence: Synthetic oligonucleotide
  Target: ATXN1; (-) strand; PAM type: YTN; PAM sequence: CTT
cccttttcccatcctcacct

SEQ ID NO: 225976 - DNA, 20 bp, Artificial Sequence
  Description of Artificial Sequence: Synthetic oligonucleotide
  Target: ATXN1; (-) strand; PAM type: YTN; PAM sequence: TTC
ttcccttttcccatcctcac

SEQ ID NO: 225977 - DNA, 20 bp, Artificial Sequence
  Description of Artificial Sequence: Synthetic oligonucleotide
  Target: ATXN1; (-) strand; PAM type: YTN; PAM sequence: TTG
ttcttcccttttcccatcct

SEQ ID NO: 225978 - DNA, 20 bp, Artificial Sequence
  Description of Artificial Sequence: Synthetic oligonucleotide
  Target: ATXN1; (-) strand; PAM type: YTN; PAM sequence: TTT
gttcttcccttttcccatcc

SEQ ID NO: 225979 - DNA, 20 bp, Artificial Sequence
  Description of Artificial Sequence: Synthetic oligonucleotide
  Target: ATXN1; (-) strand; PAM type: YTN; PAM sequence: TTC
agccggacatgtttgttctt

SEQ ID NO: 225980 - DNA, 20 bp, Artificial Sequence
  Description of Artificial Sequence: Synthetic oligonucleotide
  Target: ATXN1; (-) strand; PAM type: YTN; PAM sequence: CTG
aattcagccggacatgtttg

SEQ ID NO: 225981 - DNA, 20 bp, Artificial Sequence
  Description of Artificial Sequence: Synthetic oligonucleotide
  Target: ATXN1; (-) strand; PAM type: YTN; PAM sequence: CTC
tgaattcagccggacatgtt

SEQ ID NO: 225982 - DNA, 20 bp, Artificial Sequence
  Description of Artificial Sequence: Synthetic oligonucleotide
  Target: ATXN1; (-) strand; PAM type: YTN; PAM sequence: CTA
gctctgaattcagccggaca

SEQ ID NO: 225983 - DNA, 20 bp, Artificial Sequence
  Description of Artificial Sequence: Synthetic oligonucleotide
  Target: ATXN1; (-) strand; PAM type: YTN; PAM sequence: TTG
gaatctagctctgaattcag

SEQ ID NO: 225984 - DNA, 20 bp, Artificial Sequence
  Description of Artificial Sequence: Synthetic oligonucleotide
  Target: ATXN1; (-) strand; PAM type: YTN; PAM sequence: CTT
ggaatctagctctgaattca

SEQ ID NO: 225985 - DNA, 20 bp, Artificial Sequence
  Description of Artificial Sequence: Synthetic oligonucleotide
  Target: ATXN1; (-) strand; PAM type: YTN; PAM sequence: CTG
aaacccacttggaatctagc

SEQ ID NO: 225986 - DNA, 20 bp, Artificial Sequence
  Description of Artificial Sequence: Synthetic oligonucleotide
  Target: ATXN1; (-) strand; PAM type: YTN; PAM sequence: CTC
cctgaaacccacttggaatc

SEQ ID NO: 225987 - DNA, 20 bp, Artificial Sequence
  Description of Artificial Sequence: Synthetic oligonucleotide
  Target: ATXN1; (-) strand; PAM type: YTN; PAM sequence: TTC
agtcctccctgaaacccact

SEQ ID NO: 225988 - DNA, 20 bp, Artificial Sequence
  Description of Artificial Sequence: Synthetic oligonucleotide
  Target: ATXN1; (-) strand; PAM type: YTN; PAM sequence: CTT
cagtcctccctgaaacccac

SEQ ID NO: 225989 - DNA, 20 bp, Artificial Sequence
  Description of Artificial Sequence: Synthetic oligonucleotide
  Target: ATXN1; (-) strand; PAM type: YTN; PAM sequence: CTG
acttcagtcctccctgaaac

SEQ ID NO: 225990 - DNA, 20 bp, Artificial Sequence
  Description of Artificial Sequence: Synthetic oligonucleotide
  Target: ATXN1; (-) strand; PAM type: YTN; PAM sequence: CTC
tgacttcagtcctccctgaa

SEQ ID NO: 225991 - DNA, 20 bp, Artificial Sequence
  Description of Artificial Sequence: Synthetic oligonucleotide
  Target: ATXN1; (-) strand; PAM type: YTN; PAM sequence: TTC
tctgacttcagtcctccctg

SEQ ID NO: 225992 - DNA, 20 bp, Artificial Sequence
  Description of Artificial Sequence: Synthetic oligonucleotide
  Target: ATXN1; (-) strand; PAM type: YTN; PAM sequence: TTG
cagttctctgacttcagtcc

SEQ ID NO: 225993 - DNA, 20 bp, Artificial Sequence
  Description of Artificial Sequence: Synthetic oligonucleotide
  Target: ATXN1; (-) strand; PAM type: YTN; PAM sequence: TTT
gcagttctctgacttcagtc

SEQ ID NO: 225994 - DNA, 20 bp, Artificial Sequence
  Description of Artificial Sequence: Synthetic oligonucleotide
  Target: ATXN1; (-) strand; PAM type: YTN; PAM sequence: CTG
tgaataaacagatggtgaaa

SEQ ID NO: 225995 - DNA, 20 bp, Artificial Sequence
  Description of Artificial Sequence: Synthetic oligonucleotide
  Target: ATXN1; (-) strand; PAM type: YTN; PAM sequence: CTG
atgagtcaaaggtaaagctg

SEQ ID NO: 225996 - DNA, 20 bp, Artificial Sequence
  Description of Artificial Sequence: Synthetic oligonucleotide
  Target: ATXN1; (-) strand; PAM type: YTN; PAM sequence: CTC
tgatgagtcaaaggtaaagc

SEQ ID NO: 225997 - DNA, 20 bp, Artificial Sequence
  Description of Artificial Sequence: Synthetic oligonucleotide
  Target: ATXN1; (-) strand; PAM type: YTN; PAM sequence: CTC
actctgatgagtcaaaggta

SEQ ID NO: 225998 - DNA, 20 bp, Artificial Sequence
  Description of Artificial Sequence: Synthetic oligonucleotide
  Target: ATXN1; (-) strand; PAM type: YTN; PAM sequence: TTC
agacctcactctgatgagtc

SEQ ID NO: 225999 - DNA, 20 bp, Artificial Sequence
  Description of Artificial Sequence: Synthetic oligonucleotide
  Target: ATXN1; (-) strand; PAM type: YTN; PAM sequence: TTT
cagacctcactctgatgagt

SEQ ID NO: 226000 - DNA, 20 bp, Artificial Sequence
  Description of Artificial Sequence: Synthetic oligonucleotide
  Target: ATXN1; (-) strand; PAM type: YTN; PAM sequence: TTT
tcagacctcactctgatgag

SEQ ID NO: 226001 - DNA, 20 bp, Artificial Sequence
  Description of Artificial Sequence: Synthetic oligonucleotide
  Target: ATXN1; (-) strand; PAM type: YTN; PAM sequence: CTA
tgacccacaaacagttttca

SEQ ID NO: 226002 - DNA, 20 bp, Artificial Sequence
  Description of Artificial Sequence: Synthetic oligonucleotide
  Target: ATXN1; (-) strand; PAM type: YTN; PAM sequence: TTA
ctatgacccacaaacagttt

SEQ ID NO: 226003 - DNA, 20 bp, Artificial Sequence
  Description of Artificial Sequence: Synthetic oligonucleotide
  Target: ATXN1; (-) strand; PAM type: YTN; PAM sequence: TTT
actatgacccacaaacagtt

SEQ ID NO: 226004 - DNA, 20 bp, Artificial Sequence
  Description of Artificial Sequence: Synthetic oligonucleotide
  Target: ATXN1; (-) strand; PAM type: YTN; PAM sequence: TTT
tactatgacccacaaacagt

SEQ ID NO: 226005 - DNA, 20 bp, Artificial Sequence
  Description of Artificial Sequence: Synthetic oligonucleotide
  Target: ATXN1; (-) strand; PAM type: YTN; PAM sequence: TTT
ttactatgacccacaaacag

SEQ ID NO: 226006 - DNA, 20 bp, Artificial Sequence
  Description of Artificial Sequence: Synthetic oligonucleotide
  Target: ATXN1; (-) strand; PAM type: YTN; PAM sequence: CTT
tttactatgacccacaaaca

SEQ ID NO: 226007 - DNA, 20 bp, Artificial Sequence
  Description of Artificial Sequence: Synthetic oligonucleotide
  Target: ATXN1; (-) strand; PAM type: YTN; PAM sequence: CTC
tttttactatgacccacaaa

SEQ ID NO: 226008 - DNA, 20 bp, Artificial Sequence
  Description of Artificial Sequence: Synthetic oligonucleotide
  Target: ATXN1; (-) strand; PAM type: YTN; PAM sequence: TTC
agaactctttttactatgac

SEQ ID NO: 226009 - DNA, 20 bp, Artificial Sequence
  Description of Artificial Sequence: Synthetic oligonucleotide
  Target: ATXN1; (-) strand; PAM type: YTN; PAM sequence: CTT
cagaactctttttactatga

SEQ ID NO: 226010 - DNA, 20 bp, Artificial Sequence
  Description of Artificial Sequence: Synthetic oligonucleotide
  Target: ATXN1; (-) strand; PAM type: YTN; PAM sequence: TTG
tccttcagaactctttttac

SEQ ID NO: 226011 - DNA, 20 bp, Artificial Sequence
  Description of Artificial Sequence: Synthetic oligonucleotide
  Target: ATXN1; (-) strand; PAM type: YTN; PAM sequence: CTG
gaagtcacattgtccttcag

SEQ ID NO: 226012 - DNA, 20 bp, Artificial Sequence
  Description of Artificial Sequence: Synthetic oligonucleotide
  Target: ATXN1; (-) strand; PAM type: YTN; PAM sequence: CTC
cctggaagtcacattgtcct

SEQ ID NO: 226013 - DNA, 20 bp, Artificial Sequence
  Description of Artificial Sequence: Synthetic oligonucleotide
  Target: ATXN1; (-) strand; PAM type: YTN; PAM sequence: CTC
tccctggaagtcacattgtc

SEQ ID NO: 226014 - DNA, 20 bp, Artificial Sequence
  Description of Artificial Sequence: Synthetic oligonucleotide
  Target: ATXN1; (-) strand; PAM type: YTN; PAM sequence: TTA
cctctccctggaagtcacat

SEQ ID NO: 226015 - DNA, 20 bp, Artificial Sequence
  Description of Artificial Sequence: Synthetic oligonucleotide
  Target: ATXN1; (-) strand; PAM type: YTN; PAM sequence: CTT
acctctccctggaagtcaca

SEQ ID NO: 226016 - DNA, 20 bp, Artificial Sequence
  Description of Artificial Sequence: Synthetic oligonucleotide
  Target: ATXN1; (-) strand; PAM type: YTN; PAM sequence: TTG
gcttacctctccctggaagt

SEQ ID NO: 226017 - DNA, 20 bp, Artificial Sequence
  Description of Artificial Sequence: Synthetic oligonucleotide
  Target: ATXN1; (-) strand; PAM type: YTN; PAM sequence: CTC
atgcagtgtaggttggctta

SEQ ID NO: 226018 - DNA, 20 bp, Artificial Sequence
  Description of Artificial Sequence: Synthetic oligonucleotide
  Target: ATXN1; (-) strand; PAM type: YTN; PAM sequence: CTG
gctcatgcagtgtaggttgg

SEQ ID NO: 226019 - DNA, 20 bp, Artificial Sequence
  Description of Artificial Sequence: Synthetic oligonucleotide
  Target: ATXN1; (-) strand; PAM type: YTN; PAM sequence: CTG
ctggctcatgcagtgtaggt

SEQ ID NO: 226020 - DNA, 20 bp, Artificial Sequence
  Description of Artificial Sequence: Synthetic oligonucleotide
  Target: ATXN1; (-) strand; PAM type: YTN; PAM sequence: CTC
tgctggctcatgcagtgtag

SEQ ID NO: 226021 - DNA, 20 bp, Artificial Sequence
  Description of Artificial Sequence: Synthetic oligonucleotide
  Target: ATXN1; (-) strand; PAM type: YTN; PAM sequence: CTG
ctctgctggctcatgcagtg

SEQ ID NO: 226022 - DNA, 20 bp, Artificial Sequence
  Description of Artificial Sequence: Synthetic oligonucleotide
  Target: ATXN1; (-) strand; PAM type: YTN; PAM sequence: TTC
agtgtctgctctgctggctc

SEQ ID NO: 226023 - DNA, 20 bp, Artificial Sequence
  Description of Artificial Sequence: Synthetic oligonucleotide
  Target: ATXN1; (-) strand; PAM type: YTN; PAM sequence: TTT
cagtgtctgctctgctggct

SEQ ID NO: 226024 - DNA, 20 bp, Artificial Sequence
  Description of Artificial Sequence: Synthetic oligonucleotide
  Target: ATXN1; (-) strand; PAM type: YTN; PAM sequence: CTT
tcagtgtctgctctgctggc

SEQ ID NO: 226025 - DNA, 20 bp, Artificial Sequence
  Description of Artificial Sequence: Synthetic oligonucleotide
  Target: ATXN1; (-) strand; PAM type: YTN; PAM sequence: TTA
tcacctttcagtgtctgctc

SEQ ID NO: 226026 - DNA, 20 bp, Artificial Sequence
  Description of Artificial Sequence: Synthetic oligonucleotide
  Target: ATXN1; (-) strand; PAM type: YTN; PAM sequence: CTT
atcacctttcagtgtctgct

SEQ ID NO: 226027 - DNA, 20 bp, Artificial Sequence
  Description of Artificial Sequence: Synthetic oligonucleotide
  Target: ATXN1; (-) strand; PAM type: YTN; PAM sequence: TTC
ttatcacctttcagtgtctg

SEQ ID NO: 226028 - DNA, 20 bp, Artificial Sequence
  Description of Artificial Sequence: Synthetic oligonucleotide
  Target: ATXN1; (-) strand; PAM type: YTN; PAM sequence: CTT
cttatcacctttcagtgtct

SEQ ID NO: 226029 - DNA, 20 bp, Artificial Sequence
  Description of Artificial Sequence: Synthetic oligonucleotide
  Target: ATXN1; (-) strand; PAM type: YTN; PAM sequence: TTC
ttcttatcacctttcagtgt

SEQ ID NO: 226030 - DNA, 20 bp, Artificial Sequence
  Description of Artificial Sequence: Synthetic oligonucleotide
  Target: ATXN1; (-) strand; PAM type: YTN; PAM sequence: TTT
cttcttatcacctttcagtg

SEQ ID NO: 226031 - DNA, 20 bp, Artificial Sequence
  Description of Artificial Sequence: Synthetic oligonucleotide
  Target: ATXN1; (-) strand; PAM type: YTN; PAM sequence: TTT
tcttcttatcacctttcagt

SEQ ID NO: 226032 - DNA, 20 bp, Artificial Sequence
  Description of Artificial Sequence: Synthetic oligonucleotide
  Target: ATXN1; (-) strand; PAM type: YTN; PAM sequence: TTT
ttcttcttatcacctttcag

SEQ ID NO: 226033 - DNA, 20 bp, Artificial Sequence
  Description of Artificial Sequence: Synthetic oligonucleotide
  Target: ATXN1; (-) strand; PAM type: YTN; PAM sequence: CTT
tttcttcttatcacctttca

SEQ ID NO: 226034 - DNA, 20 bp, Artificial Sequence
  Description of Artificial Sequence: Synthetic oligonucleotide
  Target: ATXN1; (-) strand; PAM type: YTN; PAM sequence: TTC
tttttcttcttatcaccttt

SEQ ID NO: 226035 - DNA, 20 bp, Artificial Sequence
  Description of Artificial Sequence: Synthetic oligonucleotide
  Target: ATXN1; (-) strand; PAM type: YTN; PAM sequence: CTT
ctttttcttcttatcacctt

SEQ ID NO: 226036 - DNA, 20 bp, Artificial Sequence
  Description of Artificial Sequence: Synthetic oligonucleotide
  Target: ATXN1; (-) strand; PAM type: YTN; PAM sequence: TTA
ataaaaacaagtgcttcttt

SEQ ID NO: 226037 - DNA, 20 bp, Artificial Sequence
  Description of Artificial Sequence: Synthetic oligonucleotide
  Target: ATXN1; (-) strand; PAM type: YTN; PAM sequence: TTA
cgttaataaaaacaagtgct

SEQ ID NO: 226038 - DNA, 20 bp, Artificial Sequence
  Description of Artificial Sequence: Synthetic oligonucleotide
  Target: ATXN1; (-) strand; PAM type: YTN; PAM sequence: CTT
acgttaataaaaacaagtgc

SEQ ID NO: 226039 - DNA, 20 bp, Artificial Sequence
  Description of Artificial Sequence: Synthetic oligonucleotide
  Target: ATXN1; (-) strand; PAM type: YTN; PAM sequence: TTG
gtgaggtcttacgttaataa

SEQ ID NO: 226040 - DNA, 20 bp, Artificial Sequence
  Description of Artificial Sequence: Synthetic oligonucleotide
  Target: ATXN1; (-) strand; PAM type: YTN; PAM sequence: CTG
aggaagttggtgaggtctta

SEQ ID NO: 226041 - DNA, 20 bp, Artificial Sequence
  Description of Artificial Sequence: Synthetic oligonucleotide
  Target: ATXN1; (-) strand; PAM type: YTN; PAM sequence: TTG
gggaagtctgaggaagttgg

SEQ ID NO: 226042 - DNA, 20 bp, Artificial Sequence
  Description of Artificial Sequence: Synthetic oligonucleotide
  Target: ATXN1; (-) strand; PAM type: YTN; PAM sequence: TTT
ggggaagtctgaggaagttg

SEQ ID NO: 226043 - DNA, 20 bp, Artificial Sequence
  Description of Artificial Sequence: Synthetic oligonucleotide
  Target: ATXN1; (-) strand; PAM type: YTN; PAM sequence: TTC
atttggggaagtctgaggaa

SEQ ID NO: 226044 - DNA, 20 bp, Artificial Sequence
  Description of Artificial Sequence: Synthetic oligonucleotide
  Target: ATXN1; (-) strand; PAM type: YTN; PAM sequence: TTT
catttggggaagtctgagga

SEQ ID NO: 226045 - DNA, 20 bp, Artificial Sequence
  Description of Artificial Sequence: Synthetic oligonucleotide
  Target: ATXN1; (-) strand; PAM type: YTN; PAM sequence: CTG
acatttcatttggggaagtc

SEQ ID NO: 226046 - DNA, 20 bp, Artificial Sequence
  Description of Artificial Sequence: Synthetic oligonucleotide
  Target: ATXN1; (-) strand; PAM type: YTN; PAM sequence: CTC
agaatcatgcgagtctgaca

SEQ ID NO: 226047 - DNA, 20 bp, Artificial Sequence
  Description of Artificial Sequence: Synthetic oligonucleotide
  Target: ATXN1; (-) strand; PAM type: YTN; PAM sequence: TTA
ctcagaatcatgcgagtctg

SEQ ID NO: 226048 - DNA, 20 bp, Artificial Sequence
  Description of Artificial Sequence: Synthetic oligonucleotide
  Target: ATXN1; (-) strand; PAM type: YTN; PAM sequence: CTT
actcagaatcatgcgagtct

SEQ ID NO: 226049 - DNA, 20 bp, Artificial Sequence
  Description of Artificial Sequence: Synthetic oligonucleotide
  Target: ATXN1; (-) strand; PAM type: YTN; PAM sequence: TTC
ttactcagaatcatgcgagt

SEQ ID NO: 226050 - DNA, 20 bp, Artificial Sequence
  Description of Artificial Sequence: Synthetic oligonucleotide
  Target: ATXN1; (-) strand; PAM type: YTN; PAM sequence: TTG
attcttactcagaatcatgc

SEQ ID NO: 226051 - DNA, 20 bp, Artificial Sequence
  Description of Artificial Sequence: Synthetic oligonucleotide
  Target: ATXN1; (-) strand; PAM type: YTN; PAM sequence: CTA
agggacacagttgattctta

SEQ ID NO: 226052 - DNA, 20 bp, Artificial Sequence
  Description of Artificial Sequence: Synthetic oligonucleotide
  Target: ATXN1; (-) strand; PAM type: YTN; PAM sequence: TTC
taagggacacagttgattct

SEQ ID NO: 226053 - DNA, 20 bp, Artificial Sequence
  Description of Artificial Sequence: Synthetic oligonucleotide
  Target: ATXN1; (-) strand; PAM type: YTN; PAM sequence: CTT
ctaagggacacagttgattc

SEQ ID NO: 226054 - DNA, 20 bp, Artificial Sequence
  Description of Artificial Sequence: Synthetic oligonucleotide
  Target: ATXN1; (-) strand; PAM type: YTN; PAM sequence: TTC
ttctaagggacacagttgat

SEQ ID NO: 226055 - DNA, 20 bp, Artificial Sequence
  Description of Artificial Sequence: Synthetic oligonucleotide
  Target: ATXN1; (-) strand; PAM type: YTN; PAM sequence: TTT
cttctaagggacacagttga

SEQ ID NO: 226056 - DNA, 20 bp, Artificial Sequence
  Description of Artificial Sequence: Synthetic oligonucleotide
  Target: ATXN1; (-) strand; PAM type: YTN; PAM sequence: TTT
tcttctaagggacacagttg

SEQ ID NO: 226057 - DNA, 20 bp, Artificial Sequence
  Description of Artificial Sequence: Synthetic oligonucleotide
  Target: ATXN1; (-) strand; PAM type: YTN; PAM sequence: TTT
ttcttctaagggacacagtt

SEQ ID NO: 226058 - DNA, 20 bp, Artificial Sequence
  Description of Artificial Sequence: Synthetic oligonucleotide
  Target: ATXN1; (-) strand; PAM type: YTN; PAM sequence: TTG
ggatgtttttcttctaaggg

SEQ ID NO: 226059 - DNA, 20 bp, Artificial Sequence
  Description of Artificial Sequence: Synthetic oligonucleotide
  Target: ATXN1; (-) strand; PAM type: YTN; PAM sequence: TTT
gggatgtttttcttctaagg

SEQ ID NO: 226060 - DNA, 20 bp, Artificial Sequence
  Description of Artificial Sequence: Synthetic oligonucleotide
  Target: ATXN1; (-) strand; PAM type: YTN; PAM sequence: CTG
aatttgggatgtttttcttc

SEQ ID NO: 226061 - DNA, 20 bp, Artificial Sequence
  Description of Artificial Sequence: Synthetic oligonucleotide
  Target: ATXN1; (-) strand; PAM type: YTN; PAM sequence: TTA
tcactgaatttgggatgttt

SEQ ID NO: 226062 - DNA, 20 bp, Artificial Sequence
  Description of Artificial Sequence: Synthetic oligonucleotide
  Target: ATXN1; (-) strand; PAM type: YTN; PAM sequence: TTG
gtcaaaaagaatggcccacg

SEQ ID NO: 226063 - DNA, 20 bp, Artificial Sequence
  Description of Artificial Sequence: Synthetic oligonucleotide
  Target: ATXN1; (-) strand; PAM type: YTN; PAM sequence: TTT
ggtcaaaaagaatggcccac

SEQ ID NO: 226064 - DNA, 20 bp, Artificial Sequence
  Description of Artificial Sequence: Synthetic oligonucleotide
  Target: ATXN1; (-) strand; PAM type: YTN; PAM sequence: CTA
tttggtcaaaaagaatggcc

SEQ ID NO: 226065 - DNA, 20 bp, Artificial Sequence
  Description of Artificial Sequence: Synthetic oligonucleotide
  Target: ATXN1; (-) strand; PAM type: YTN; PAM sequence: TTC
gtgagcaaaatctatttggt

SEQ ID NO: 226066 - DNA, 20 bp, Artificial Sequence
  Description of Artificial Sequence: Synthetic oligonucleotide
  Target: ATXN1; (-) strand; PAM type: YTN; PAM sequence: TTA
aaaaaatgttcgtgagcaaa

SEQ ID NO: 226067 - DNA, 20 bp, Artificial Sequence
  Description of Artificial Sequence: Synthetic oligonucleotide
  Target: ATXN1; (-) strand; PAM type: YTN; PAM sequence: TTA
cattaaaaaaatgttcgtga

SEQ ID NO: 226068 - DNA, 20 bp, Artificial Sequence
  Description of Artificial Sequence: Synthetic oligonucleotide
  Target: ATXN1; (-) strand; PAM type: YTN; PAM sequence: TTT
acattaaaaaaatgttcgtg

SEQ ID NO: 226069 - DNA, 20 bp, Artificial Sequence
  Description of Artificial Sequence: Synthetic oligonucleotide
  Target: ATXN1; (-) strand; PAM type: YTN; PAM sequence: CTG
ggaaatttacattaaaaaaa

SEQ ID NO: 226070 - DNA, 20 bp, Artificial Sequence
  Description of Artificial Sequence: Synthetic oligonucleotide
  Target: ATXN1; (-) strand; PAM type: YTN; PAM sequence: CTA
ctgggaaatttacattaaaa

SEQ ID NO: 226071 - DNA, 20 bp, Artificial Sequence
  Description of Artificial Sequence: Synthetic oligonucleotide
  Target: ATXN1; (-) strand; PAM type: YTN; PAM sequence: TTC
ctactgggaaatttacatta

SEQ ID NO: 226072 - DNA, 20 bp, Artificial Sequence
  Description of Artificial Sequence: Synthetic oligonucleotide
  Target: ATXN1; (-) strand; PAM type: YTN; PAM sequence: CTT
cctactgggaaatttacatt

SEQ ID NO: 226073 - DNA, 20 bp, Artificial Sequence
  Description of Artificial Sequence: Synthetic oligonucleotide
  Target: ATXN1; (-) strand; PAM type: YTN; PAM sequence: TTG
cttcctactgggaaatttac

SEQ ID NO: 226074 - DNA, 20 bp, Artificial Sequence
  Description of Artificial Sequence: Synthetic oligonucleotide
  Target: ATXN1; (-) strand; PAM type: YTN; PAM sequence: CTG
tgttgcttcctactgggaaa

SEQ ID NO: 226075 - DNA, 20 bp, Artificial Sequence
  Description of Artificial Sequence: Synthetic oligonucleotide
  Target: ATXN1; (-) strand; PAM type: YTN; PAM sequence: CTG
tactgtgttgcttcctactg

SEQ ID NO: 226076 - DNA, 20 bp, Artificial Sequence
  Description of Artificial Sequence: Synthetic oligonucleotide
  Target: ATXN1; (-) strand; PAM type: YTN; PAM sequence: CTC
tgtactgtgttgcttcctac

SEQ ID NO: 226077 - DNA, 20 bp, Artificial Sequence
  Description of Artificial Sequence: Synthetic oligonucleotide
  Target: ATXN1; (-) strand; PAM type: YTN; PAM sequence: TTA
aaactctgtactgtgttgct

SEQ ID NO: 226078 - DNA, 20 bp, Artificial Sequence
  Description of Artificial Sequence: Synthetic oligonucleotide
  Target: ATXN1; (-) strand; PAM type: YTN; PAM sequence: TTT
aaaactctgtactgtgttgc

SEQ ID NO: 226079 - DNA, 20 bp, Artificial Sequence
  Description of Artificial Sequence: Synthetic oligonucleotide
  Target: ATXN1; (-) strand; PAM type: YTN; PAM sequence: TTT
taaaactctgtactgtgttg

SEQ ID NO: 226080 - DNA, 20 bp, Artificial Sequence
  Description of Artificial Sequence: Synthetic oligonucleotide
  Target: ATXN1; (-) strand; PAM type: YTN; PAM sequence: TTT
ttaaaactctgtactgtgtt

SEQ ID NO: 226081 - DNA, 20 bp, Artificial Sequence
  Description of Artificial Sequence: Synthetic oligonucleotide
  Target: ATXN1; (-) strand; PAM type: YTN; PAM sequence: TTT
tttaaaactctgtactgtgt

SEQ ID NO: 226082 - DNA, 20 bp, Artificial Sequence
  Description of Artificial Sequence: Synthetic oligonucleotide
  Target: ATXN1; (-) strand; PAM type: YTN; PAM sequence: TTA
ttttttaaaactctgtactg

SEQ ID NO: 226083 - DNA, 20 bp, Artificial Sequence
  Description of Artificial Sequence: Synthetic oligonucleotide
  Target: ATXN1; (-) strand; PAM type: YTN; PAM sequence: TTT
attttttaaaactctgtact

SEQ ID NO: 226084 - DNA, 20 bp, Artificial Sequence
  Description of Artificial Sequence: Synthetic oligonucleotide
  Target: ATXN1; (-) strand; PAM type: YTN; PAM sequence: TTT
tattttttaaaactctgtac

SEQ ID NO: 226085 - DNA, 20 bp, Artificial Sequence
  Description of Artificial Sequence: Synthetic oligonucleotide
  Target: ATXN1; (-) strand; PAM type: YTN; PAM sequence: TTA
agaattttattttttaaaac

SEQ ID NO: 226086 - DNA, 20 bp, Artificial Sequence
  Description of Artificial Sequence: Synthetic oligonucleotide
  Target: ATXN1; (-) strand; PAM type: YTN; PAM sequence: CTG
agcggattaagaattttatt

SEQ ID NO: 226087 - DNA, 20 bp, Artificial Sequence
  Description of Artificial Sequence: Synthetic oligonucleotide
  Target: ATXN1; (-) strand; PAM type: YTN; PAM sequence: TTC
atcctgagcggattaagaat

SEQ ID NO: 226088 - DNA, 20 bp, Artificial Sequence
  Description of Artificial Sequence: Synthetic oligonucleotide
  Target: ATXN1; (-) strand; PAM type: YTN; PAM sequence: TTT
catcctgagcggattaagaa

SEQ ID NO: 226089 - DNA, 20 bp, Artificial Sequence
  Description of Artificial Sequence: Synthetic oligonucleotide
  Target: ATXN1; (-) strand; PAM type: YTN; PAM sequence: TTA
agtagtgtgtttcatcctga

SEQ ID NO: 226090 - DNA, 20 bp, Artificial Sequence
  Description of Artificial Sequence: Synthetic oligonucleotide
  Target: ATXN1; (-) strand; PAM type: YTN; PAM sequence: TTT
aagtagtgtgtttcatcctg

SEQ ID NO: 226091 - DNA, 20 bp, Artificial Sequence
  Description of Artificial Sequence: Synthetic oligonucleotide
  Target: ATXN1; (-) strand; PAM type: YTN; PAM sequence: TTT
taagtagtgtgtttcatcct

SEQ ID NO: 226092 - DNA, 20 bp, Artificial Sequence
  Description of Artificial Sequence: Synthetic oligonucleotide
  Target: ATXN1; (-) strand; PAM type: YTN; PAM sequence: TTA
ttttaagtagtgtgtttcat

SEQ ID NO: 226093 - DNA, 20 bp, Artificial Sequence
  Description of Artificial Sequence: Synthetic oligonucleotide
  Target: ATXN1; (-) strand; PAM type: YTN; PAM sequence: TTT
attttaagtagtgtgtttca

SEQ ID NO: 226094 - DNA, 20 bp, Artificial Sequence
  Description of Artificial Sequence: Synthetic oligonucleotide
  Target: ATXN1; (-) strand; PAM type: YTN; PAM sequence: TTC
agtttattttaagtagtgtg

SEQ ID NO: 226095 - DNA, 20 bp, Artificial Sequence
  Description of Artificial Sequence: Synthetic oligonucleotide
  Target: ATXN1; (-) strand; PAM type: YTN; PAM sequence: TTA
ggtgtcattcagtttatttt

SEQ ID NO: 226096 - DNA, 20 bp, Artificial Sequence
  Description of Artificial Sequence: Synthetic oligonucleotide
  Target: ATXN1; (-) strand; PAM type: YTN; PAM sequence: TTT
aggtgtcattcagtttattt

SEQ ID NO: 226097 - DNA, 20 bp, Artificial Sequence
  Description of Artificial Sequence: Synthetic oligonucleotide
  Target: ATXN1; (-) strand; PAM type: YTN; PAM sequence: TTT
taggtgtcattcagtttatt

SEQ ID NO: 226098 - DNA, 20 bp, Artificial Sequence
  Description of Artificial Sequence: Synthetic oligonucleotide
  Target: ATXN1; (-) strand; PAM type: YTN; PAM sequence: TTC
agcggatcattttaggtgtc

SEQ ID NO: 226099 - DNA, 20 bp, Artificial Sequence
  Description of Artificial Sequence: Synthetic oligonucleotide
  Target: ATXN1; (-) strand; PAM type: YTN; PAM sequence: TTC
attcagcggatcattttagg

SEQ ID NO: 226100 - DNA, 20 bp, Artificial Sequence
  Description of Artificial Sequence: Synthetic oligonucleotide
  Target: ATXN1; (-) strand; PAM type: YTN; PAM sequence: TTT
cattcagcggatcattttag

SEQ ID NO: 226101 - DNA, 20 bp, Artificial Sequence
  Description of Artificial Sequence: Synthetic oligonucleotide
  Target: ATXN1; (-) strand; PAM type: YTN; PAM sequence: TTT
tcattcagcggatcatttta

SEQ ID NO: 226102 - DNA, 20 bp, Artificial Sequence
  Description of Artificial Sequence: Synthetic oligonucleotide
  Target: ATXN1; (-) strand; PAM type: YTN; PAM sequence: CTT
ttcattcagcggatcatttt

SEQ ID NO: 226103 - DNA, 20 bp, Artificial Sequence
  Description of Artificial Sequence: Synthetic oligonucleotide
  Target: ATXN1; (-) strand; PAM type: YTN; PAM sequence: TTC
ttttcattcagcggatcatt

SEQ ID NO: 226104 - DNA, 20 bp, Artificial Sequence
  Description of Artificial Sequence: Synthetic oligonucleotide
  Target: ATXN1; (-) strand; PAM type: YTN; PAM sequence: TTT
cttttcattcagcggatcat

SEQ ID NO: 226105 - DNA, 20 bp, Artificial Sequence
  Description of Artificial Sequence: Synthetic oligonucleotide
  Target: ATXN1; (-) strand; PAM type: YTN; PAM sequence: TTT
tcttttcattcagcggatca

SEQ ID NO: 226106 - DNA, 20 bp, Artificial Sequence
  Description of Artificial Sequence: Synthetic oligonucleotide
  Target: ATXN1; (-) strand; PAM type: YTN; PAM sequence: CTT
ttcttttcattcagcggatc

SEQ ID NO: 226107 - DNA, 20 bp, Artificial Sequence
  Description of Artificial Sequence: Synthetic oligonucleotide
  Target: ATXN1; (-) strand; PAM type: YTN; PAM sequence: TTG
gaatagcttttcttttcatt

SEQ ID NO: 226108 - DNA, 20 bp, Artificial Sequence
  Description of Artificial Sequence: Synthetic oligonucleotide
  Target: ATXN1; (-) strand; PAM type: YTN; PAM sequence: CTT
ggaatagcttttcttttcat

SEQ ID NO: 226109 - DNA, 20 bp, Artificial Sequence
  Description of Artificial Sequence: Synthetic oligonucleotide
  Target: ATXN1; (-) strand; PAM type: YTN; PAM sequence: TTG
tgacttggaatagcttttct

SEQ ID NO: 226110 - DNA, 20 bp, Artificial Sequence
  Description of Artificial Sequence: Synthetic oligonucleotide
  Target: ATXN1; (-) strand; PAM type: YTN; PAM sequence: TTT
gtgacttggaatagcttttc

SEQ ID NO: 226111 - DNA, 20 bp, Artificial Sequence
  Description of Artificial Sequence: Synthetic oligonucleotide
  Target: ATXN1; (-) strand; PAM type: YTN; PAM sequence: TTT
tgtgacttggaatagctttt

SEQ ID NO: 226112 - DNA, 20 bp, Artificial Sequence
  Description of Artificial Sequence: Synthetic oligonucleotide
  Target: ATXN1; (-) strand; PAM type: YTN; PAM sequence: TTA
ttttgtgacttggaatagct

SEQ ID NO: 226113 - DNA, 20 bp, Artificial Sequence
  Description of Artificial Sequence: Synthetic oligonucleotide
  Target: ATXN1; (-) strand; PAM type: YTN; PAM sequence: TTT
attttgtgacttggaatagc

SEQ ID NO: 226114 - DNA, 20 bp, Artificial Sequence
  Description of Artificial Sequence: Synthetic oligonucleotide
  Target: ATXN1; (-) strand; PAM type: YTN; PAM sequence: TTA
ataatagtttattttgtgac

SEQ ID NO: 226115 - DNA, 20 bp, Artificial Sequence
  Description of Artificial Sequence: Synthetic oligonucleotide
  Target: ATXN1; (-) strand; PAM type: YTN; PAM sequence: CTT
aataatagtttattttgtga

SEQ ID NO: 226116 - DNA, 20 bp, Artificial Sequence
  Description of Artificial Sequence: Synthetic oligonucleotide
  Target: ATXN1; (-) strand; PAM type: YTN; PAM sequence: TTC
catggcttaataatagttta

SEQ ID NO: 226117 - DNA, 20 bp, Artificial Sequence
  Description of Artificial Sequence: Synthetic oligonucleotide
  Target: ATXN1; (-) strand; PAM type: YTN; PAM sequence: CTT
ccatggcttaataatagttt

SEQ ID NO: 226118 - DNA, 20 bp, Artificial Sequence
  Description of Artificial Sequence: Synthetic oligonucleotide
  Target: ATXN1; (-) strand; PAM type: YTN; PAM sequence: CTG
aaaaggagagtgagaataca

SEQ ID NO: 226119 - DNA, 20 bp, Artificial Sequence
  Description of Artificial Sequence: Synthetic oligonucleotide
  Target: ATXN1; (-) strand; PAM type: YTN; PAM sequence: TTC
ataaaaatgtcactgaaaag

SEQ ID NO: 226120 - DNA, 20 bp, Artificial Sequence
  Description of Artificial Sequence: Synthetic oligonucleotide
  Target: ATXN1; (-) strand; PAM type: YTN; PAM sequence: TTT
cataaaaatgtcactgaaaa

SEQ ID NO: 226121 - DNA, 20 bp, Artificial Sequence
  Description of Artificial Sequence: Synthetic oligonucleotide
  Target: ATXN1; (-) strand; PAM type: YTN; PAM sequence: CTA
ccacatgtgtttcataaaaa

SEQ ID NO: 226122 - DNA, 20 bp, Artificial Sequence
  Description of Artificial Sequence: Synthetic oligonucleotide
  Target: ATXN1; (-) strand; PAM type: YTN; PAM sequence: CTG
cctaccacatgtgtttcata

SEQ ID NO: 226123 - DNA, 20 bp, Artificial Sequence
  Description of Artificial Sequence: Synthetic oligonucleotide
  Target: ATXN1; (-) strand; PAM type: YTN; PAM sequence: CTG
caaagcacaaactgcctacc

SEQ ID NO: 226124 - DNA, 20 bp, Artificial Sequence
  Description of Artificial Sequence: Synthetic oligonucleotide
  Target: ATXN1; (-) strand; PAM type: YTN; PAM sequence: CTG
ctgcaaagcacaaactgcct

SEQ ID NO: 226125 - DNA, 20 bp, Artificial Sequence
  Description of Artificial Sequence: Synthetic oligonucleotide
  Target: ATXN1; (-) strand; PAM type: YTN; PAM sequence: CTC
tgctgcaaagcacaaactgc

SEQ ID NO: 226126 - DNA, 20 bp, Artificial Sequence
  Description of Artificial Sequence: Synthetic oligonucleotide
  Target: ATXN1; (-) strand; PAM type: YTN; PAM sequence: TTC
tctgctgcaaagcacaaact

SEQ ID NO: 226127 - DNA, 20 bp, Artificial Sequence
  Description of Artificial Sequence: Synthetic oligonucleotide
  Target: ATXN1; (-) strand; PAM type: YTN; PAM sequence: TTT
ctctgctgcaaagcacaaac

SEQ ID NO: 226128 - DNA, 20 bp, Artificial Sequence
  Description of Artificial Sequence: Synthetic oligonucleotide
  Target: ATXN1; (-) strand; PAM type: YTN; PAM sequence: TTT
tctctgctgcaaagcacaaa

SEQ ID NO: 226129 - DNA, 20 bp, Artificial Sequence
  Description of Artificial Sequence: Synthetic oligonucleotide
  Target: ATXN1; (-) strand; PAM type: YTN; PAM sequence: TTG
agttttctctgctgcaaagc

SEQ ID NO: 226130 - DNA, 20 bp, Artificial Sequence
  Description of Artificial Sequence: Synthetic oligonucleotide
  Target: ATXN1; (-) strand; PAM type: YTN; PAM sequence: TTT
gagttttctctgctgcaaag

SEQ ID NO: 226131 - DNA, 20 bp, Artificial Sequence
  Description of Artificial Sequence: Synthetic oligonucleotide
  Target: ATXN1; (-) strand; PAM type: YTN; PAM sequence: TTA
tttgagttttctctgctgca

SEQ ID NO: 226132 - DNA, 20 bp, Artificial Sequence
  Description of Artificial Sequence: Synthetic oligonucleotide
  Target: ATXN1; (-) strand; PAM type: YTN; PAM sequence: TTG
ggaaagcattatttgagttt

SEQ ID NO: 226133 - DNA, 20 bp, Artificial Sequence
  Description of Artificial Sequence: Synthetic oligonucleotide
  Target: ATXN1; (-) strand; PAM type: YTN; PAM sequence: TTA
attgggaaagcattatttga

SEQ ID NO: 226134 - DNA, 20 bp, Artificial Sequence
  Description of Artificial Sequence: Synthetic oligonucleotide
  Target: ATXN1; (-) strand; PAM type: YTN; PAM sequence: TTT
aattgggaaagcattatttg

SEQ ID NO: 226135 - DNA, 20 bp, Artificial Sequence
  Description of Artificial Sequence: Synthetic oligonucleotide
  Target: ATXN1; (-) strand; PAM type: YTN; PAM sequence: TTT
taattgggaaagcattattt

SEQ ID NO: 226136 - DNA, 20 bp, Artificial Sequence
  Description of Artificial Sequence: Synthetic oligonucleotide
  Target: ATXN1; (-) strand; PAM type: YTN; PAM sequence: TTT
ttaattgggaaagcattatt

SEQ ID NO: 226137 - DNA, 20 bp, Artificial Sequence
  Description of Artificial Sequence: Synthetic oligonucleotide
  Target: ATXN1; (-) strand; PAM type: YTN; PAM sequence: TTT
tttaattgggaaagcattat

SEQ ID NO: 226138 - DNA, 20 bp, Artificial Sequence
  Description of Artificial Sequence: Synthetic oligonucleotide
  Target: ATXN1; (-) strand; PAM type: YTN; PAM sequence: TTT
ttttaattgggaaagcatta

SEQ ID NO: 226139 - DNA, 20 bp, Artificial Sequence
  Description of Artificial Sequence: Synthetic oligonucleotide
  Target: ATXN1; (-) strand; PAM type: YTN; PAM sequence: CTG
gaagaccccaggattttttt

SEQ ID NO: 226140 - DNA, 20 bp, Artificial Sequence
  Description of Artificial Sequence: Synthetic oligonucleotide
  Target: ATXN1; (-) strand; PAM type: YTN; PAM sequence: TTG
accagcatggaggagaacaa

SEQ ID NO: 226141 - DNA, 20 bp, Artificial Sequence
  Description of Artificial Sequence: Synthetic oligonucleotide
  Target: ATXN1; (-) strand; PAM type: YTN; PAM sequence: TTT
gaccagcatggaggagaaca

SEQ ID NO: 226142 - DNA, 20 bp, Artificial Sequence
  Description of Artificial Sequence: Synthetic oligonucleotide
  Target: ATXN1; (-) strand; PAM type: YTN; PAM sequence: CTG
tccagatcgccagtttgacc

SEQ ID NO: 226143 - DNA, 20 bp, Artificial Sequence
  Description of Artificial Sequence: Synthetic oligonucleotide
  Target: ATXN1; (-) strand; PAM type: YTN; PAM sequence: CTC
caaagagcctgtccagatcg

SEQ ID NO: 226144 - DNA, 20 bp, Artificial Sequence
  Description of Artificial Sequence: Synthetic oligonucleotide
  Target: ATXN1; (-) strand; PAM type: YTN; PAM sequence: TTG
ctccaaagagcctgtccaga

SEQ ID NO: 226145 - DNA, 20 bp, Artificial Sequence
  Description of Artificial Sequence: Synthetic oligonucleotide
  Target: ATXN1; (-) strand; PAM type: YTN; PAM sequence: CTT
gctccaaagagcctgtccag

SEQ ID NO: 226146 - DNA, 20 bp, Artificial Sequence
  Description of Artificial Sequence: Synthetic oligonucleotide
  Target: ATXN1; (-) strand; PAM type: YTN; PAM sequence: TTG
agcaccttgctccaaagagc

SEQ ID NO: 226147 - DNA, 20 bp, Artificial Sequence
  Description of Artificial Sequence: Synthetic oligonucleotide
  Target: ATXN1; (-) strand; PAM type: YTN; PAM sequence: TTC
aagagttgagcaccttgctc

SEQ ID NO: 226148 - DNA, 20 bp, Artificial Sequence
  Description of Artificial Sequence: Synthetic oligonucleotide
  Target: ATXN1; (-) strand; PAM type: YTN; PAM sequence: CTT
caagagttgagcaccttgct

SEQ ID NO: 226149 - DNA, 20 bp, Artificial Sequence
  Description of Artificial Sequence: Synthetic oligonucleotide
  Target: ATXN1; (-) strand; PAM type: YTN; PAM sequence: TTC
ttcaagagttgagcaccttg

SEQ ID NO: 226150 - DNA, 20 bp, Artificial Sequence
  Description of Artificial Sequence: Synthetic oligonucleotide
  Target: ATXN1; (-) strand; PAM type: YTN; PAM sequence: CTA
ttcttcaagagttgagcacc

SEQ ID NO: 226151 - DNA, 20 bp, Artificial Sequence
  Description of Artificial Sequence: Synthetic oligonucleotide
  Target: ATXN1; (-) strand; PAM type: YTN; PAM sequence: TTG
ccaatactattcttcaagag

SEQ ID NO: 226152 - DNA, 20 bp, Artificial Sequence
  Description of Artificial Sequence: Synthetic oligonucleotide
  Target: ATXN1; (-) strand; PAM type: YTN; PAM sequence: CTT
gccaatactattcttcaaga

SEQ ID NO: 226153 - DNA, 20 bp, Artificial Sequence
  Description of Artificial Sequence: Synthetic oligonucleotide
  Target: ATXN1; (-) strand; PAM type: YTN; PAM sequence: CTG
caccccagatgcagagaagt

SEQ ID NO: 226154 - DNA, 20 bp, Artificial Sequence
  Description of Artificial Sequence: Synthetic oligonucleotide
  Target: ATXN1; (-) strand; PAM type: YTN; PAM sequence: TTC
tgcaccccagatgcagagaa

SEQ ID NO: 226155 - DNA, 20 bp, Artificial Sequence
  Description of Artificial Sequence: Synthetic oligonucleotide
  Target: ATXN1; (-) strand; PAM type: YTN; PAM sequence: TTT
ctgcaccccagatgcagaga

SEQ ID NO: 226156 - DNA, 20 bp, Artificial Sequence
  Description of Artificial Sequence: Synthetic oligonucleotide
  Target: ATXN1; (-) strand; PAM type: YTN; PAM sequence: TTT
tctgcaccccagatgcagag

SEQ ID NO: 226157 - DNA, 20 bp, Artificial Sequence
  Description of Artificial Sequence: Synthetic oligonucleotide
  Target: ATXN1; (-) strand; PAM type: YTN; PAM sequence: CTT
ttctgcaccccagatgcaga

SEQ ID NO: 226158 - DNA, 20 bp, Artificial Sequence
  Description of Artificial Sequence: Synthetic oligonucleotide
  Target: ATXN1; (-) strand; PAM type: YTN; PAM sequence: TTA
tcttttctgcaccccagatg

SEQ ID NO: 226159 - DNA, 20 bp, Artificial Sequence
  Description of Artificial Sequence: Synthetic oligonucleotide
  Target: ATXN1; (-) strand; PAM type: YTN; PAM sequence: CTT
atcttttctgcaccccagat

SEQ ID NO: 226160 - DNA, 20 bp, Artificial Sequence
  Description of Artificial Sequence: Synthetic oligonucleotide
  Target: ATXN1; (-) strand; PAM type: YTN; PAM sequence: TTC
ttatcttttctgcaccccag

SEQ ID NO: 226161 - DNA, 20 bp, Artificial Sequence
  Description of Artificial Sequence: Synthetic oligonucleotide
  Target: ATXN1; (-) strand; PAM type: YTN; PAM sequence: CTG
tgttcttatcttttctgcac

SEQ ID NO: 226162 - DNA, 20 bp, Artificial Sequence
  Description of Artificial Sequence: Synthetic oligonucleotide
  Target: ATXN1; (-) strand; PAM type: YTN; PAM sequence: TTG
cagagcacagcaagatatgc

SEQ ID NO: 226163 - DNA, 20 bp, Artificial Sequence
  Description of Artificial Sequence: Synthetic oligonucleotide
  Target: ATXN1; (-) strand; PAM type: YTN; PAM sequence: CTG
gtgggggttgcagagcacag

SEQ ID NO: 226164 - DNA, 20 bp, Artificial Sequence
  Description of Artificial Sequence: Synthetic oligonucleotide
  Target: ATXN1; (-) strand; PAM type: YTN; PAM sequence: TTG
tcaggcagcgagtaggaatg

SEQ ID NO: 226165 - DNA, 20 bp, Artificial Sequence
  Description of Artificial Sequence: Synthetic oligonucleotide
  Target: ATXN1; (-) strand; PAM type: YTN; PAM sequence: TTG
atcatgttgtcaggcagcga

SEQ ID NO: 226166 - DNA, 20 bp, Artificial Sequence
  Description of Artificial Sequence: Synthetic oligonucleotide
  Target: ATXN1; (-) strand; PAM type: YTN; PAM sequence: TTT
gatcatgttgtcaggcagcg

SEQ ID NO: 226167 - DNA, 20 bp, Artificial Sequence
  Description of Artificial Sequence: Synthetic oligonucleotide
  Target: ATXN1; (-) strand; PAM type: YTN; PAM sequence: CTT
tgatcatgttgtcaggcagc

SEQ ID NO: 226168 - DNA, 20 bp, Artificial Sequence
  Description of Artificial Sequence: Synthetic oligonucleotide
  Target: ATXN1; (-) strand; PAM type: YTN; PAM sequence: CTC
ctttgatcatgttgtcaggc

SEQ ID NO: 226169 - DNA, 20 bp, Artificial Sequence
  Description of Artificial Sequence: Synthetic oligonucleotide
  Target: ATXN1; (-) strand; PAM type: YTN; PAM sequence: TTC
caccctcctttgatcatgtt

SEQ ID NO: 226170 - DNA, 20 bp, Artificial Sequence
  Description of Artificial Sequence: Synthetic oligonucleotide
  Target: ATXN1; (-) strand; PAM type: YTN; PAM sequence: CTT
ccaccctcctttgatcatgt

SEQ ID NO: 226171 - DNA, 20 bp, Artificial Sequence
  Description of Artificial Sequence: Synthetic oligonucleotide
  Target: ATXN1; (-) strand; PAM type: YTN; PAM sequence: CTC
ttccaccctcctttgatcat

SEQ ID NO: 226172 - DNA, 20 bp, Artificial Sequence
  Description of Artificial Sequence: Synthetic oligonucleotide
  Target: ATXN1; (-) strand; PAM type: YTN; PAM sequence: CTC
ctcttccaccctcctttgat

SEQ ID NO: 226173 - DNA, 20 bp, Artificial Sequence
  Description of Artificial Sequence: Synthetic oligonucleotide
  Target: ATXN1; (-) strand; PAM type: YTN; PAM sequence: CTC
tcctcttccaccctcctttg

SEQ ID NO: 226174 - DNA, 20 bp, Artificial Sequence
  Description of Artificial Sequence: Synthetic oligonucleotide
  Target: ATXN1; (-) strand; PAM type: YTN; PAM sequence: TTG
gctctcctcttccaccctcc

SEQ ID NO: 226175 - DNA, 20 bp, Artificial Sequence
  Description of Artificial Sequence: Synthetic oligonucleotide
  Target: ATXN1; (-) strand; PAM type: YTN; PAM sequence: CTT
ggctctcctcttccaccctc

SEQ ID NO: 226176 - DNA, 20 bp, Artificial Sequence
  Description of Artificial Sequence: Synthetic oligonucleotide
  Target: ATXN1; (-) strand; PAM type: YTN; PAM sequence: TTA
aacttggctctcctcttcca

SEQ ID NO: 226177 - DNA, 20 bp, Artificial Sequence
  Description of Artificial Sequence: Synthetic oligonucleotide
  Target: ATXN1; (-) strand; PAM type: YTN; PAM sequence: TTA
ttaaacttggctctcctctt

SEQ ID NO: 226178 - DNA, 20 bp, Artificial Sequence
  Description of Artificial Sequence: Synthetic oligonucleotide
  Target: ATXN1; (-) strand; PAM type: YTN; PAM sequence: CTG
gtaaggttattaaacttggc

SEQ ID NO: 226179 - DNA, 20 bp, Artificial Sequence
  Description of Artificial Sequence: Synthetic oligonucleotide
  Target: ATXN1; (-) strand; PAM type: YTN; PAM sequence: CTC
ctggtaaggttattaaactt

SEQ ID NO: 226180 - DNA, 20 bp, Artificial Sequence
  Description of Artificial Sequence: Synthetic oligonucleotide
  Target: ATXN1; (-) strand; PAM type: YTN; PAM sequence: CTG
atctcctggtaaggttatta

SEQ ID NO: 226181 - DNA, 20 bp, Artificial Sequence
  Description of Artificial Sequence: Synthetic oligonucleotide
  Target: ATXN1; (-) strand; PAM type: YTN; PAM sequence: TTG
gccccagacaatctgatctc

SEQ ID NO: 226182 - DNA, 20 bp, Artificial Sequence
  Description of Artificial Sequence: Synthetic oligonucleotide
  Target: ATXN1; (-) strand; PAM type: YTN; PAM sequence: CTT
ggccccagacaatctgatct

SEQ ID NO: 226183 - DNA, 20 bp, Artificial Sequence
  Description of Artificial Sequence: Synthetic oligonucleotide
  Target: ATXN1; (-) strand; PAM type: YTN; PAM sequence: CTG
cttggccccagacaatctga

SEQ ID NO: 226184 - DNA, 20 bp, Artificial Sequence
  Description of Artificial Sequence: Synthetic oligonucleotide
  Target: ATXN1; (-) strand; PAM type: YTN; PAM sequence: TTC
tgcttggccccagacaatct

SEQ ID NO: 226185 - DNA, 20 bp, Artificial Sequence
  Description of Artificial Sequence: Synthetic oligonucleotide
  Target: ATXN1; (-) strand; PAM type: YTN; PAM sequence: CTT
ctgcttggccccagacaatc

SEQ ID NO: 226186 - DNA, 20 bp, Artificial Sequence
  Description of Artificial Sequence: Synthetic oligonucleotide
  Target: ATXN1; (-) strand; PAM type: YTN; PAM sequence: CTC
aggacttctgcttggcccca

SEQ ID NO: 226187 - DNA, 20 bp, Artificial Sequence
  Description of Artificial Sequence: Synthetic oligonucleotide
  Target: ATXN1; (-) strand; PAM type: YTN; PAM sequence: CTA
tctcaggacttctgcttggc

SEQ ID NO: 226188 - DNA, 20 bp, Artificial Sequence
  Description of Artificial Sequence: Synthetic oligonucleotide
  Target: ATXN1; (-) strand; PAM type: YTN; PAM sequence: TTC
agcagctatctcaggacttc

SEQ ID NO: 226189 - DNA, 20 bp, Artificial Sequence
  Description of Artificial Sequence: Synthetic oligonucleotide
  Target: ATXN1; (-) strand; PAM type: YTN; PAM sequence: CTG
taaatggccaggattcagca

SEQ ID NO: 226190 - DNA, 20 bp, Artificial Sequence
  Description of Artificial Sequence: Synthetic oligonucleotide
  Target: ATXN1; (-) strand; PAM type: YTN; PAM sequence: CTC
tgtaaatggccaggattcag

SEQ ID NO: 226191 - DNA, 20 bp, Artificial Sequence
  Description of Artificial Sequence: Synthetic oligonucleotide
  Target: ATXN1; (-) strand; PAM type: YTN; PAM sequence: CTG
ctctgtaaatggccaggatt

SEQ ID NO: 226192 - DNA, 20 bp, Artificial Sequence
  Description of Artificial Sequence: Synthetic oligonucleotide
  Target: ATXN1; (-) strand; PAM type: YTN; PAM sequence: TTG
tgctgctctgtaaatggcca

SEQ ID NO: 226193 - DNA, 20 bp, Artificial Sequence
  Description of Artificial Sequence: Synthetic oligonucleotide
  Target: ATXN1; (-) strand; PAM type: YTN; PAM sequence: TTT
gtgctgctctgtaaatggcc

SEQ ID NO: 226194 - DNA, 20 bp, Artificial Sequence
  Description of Artificial Sequence: Synthetic oligonucleotide
  Target: ATXN1; (-) strand; PAM type: YTN; PAM sequence: TTT
tgtgctgctctgtaaatggc

SEQ ID NO: 226195 - DNA, 20 bp, Artificial Sequence
  Description of Artificial Sequence: Synthetic oligonucleotide
  Target: ATXN1; (-) strand; PAM type: YTN; PAM sequence: CTA
gttttgtgctgctctgtaaa

SEQ ID NO: 226196 - DNA, 20 bp, Artificial Sequence
  Description of Artificial Sequence: Synthetic oligonucleotide
  Target: ATXN1; (-) strand; PAM type: YTN; PAM sequence: TTG
ggtcggccatggcaaccgcg

SEQ ID NO: 226197 - DNA, 20 bp, Artificial Sequence
  Description of Artificial Sequence: Synthetic oligonucleotide
  Target: ATXN1; (-) strand; PAM type: YTN; PAM sequence: TTT
gggtcggccatggcaaccgc

SEQ ID NO: 226198 - DNA, 20 bp, Artificial Sequence
  Description of Artificial Sequence: Synthetic oligonucleotide
  Target: ATXN1; (-) strand; PAM type: YTN; PAM sequence: TTG
tttgggtcggccatggcaac

SEQ ID NO: 226199 - DNA, 20 bp, Artificial Sequence
  Description of Artificial Sequence: Synthetic oligonucleotide
  Target: ATXN1; (-) strand; PAM type: YTN; PAM sequence: CTG
gggtatattgtttgggtcgg

SEQ ID NO: 226200 - DNA, 20 bp, Artificial Sequence
  Description of Artificial Sequence: Synthetic oligonucleotide
  Target: ATXN1; (-) strand; PAM type: YTN; PAM sequence: CTG
aagctggggtatattgtttg

SEQ ID NO: 226201 - DNA, 20 bp, Artificial Sequence
  Description of Artificial Sequence: Synthetic oligonucleotide
  Target: ATXN1; (-) strand; PAM type: YTN; PAM sequence: TTA
ggaagccaaaggaggctgaa

SEQ ID NO: 226202 - DNA, 20 bp, Artificial Sequence
  Description of Artificial Sequence: Synthetic oligonucleotide
  Target: ATXN1; (-) strand; PAM type: YTN; PAM sequence: CTG
tgggtggcggttaggaagcc

SEQ ID NO: 226203 - DNA, 20 bp, Artificial Sequence
  Description of Artificial Sequence: Synthetic oligonucleotide
  Target: ATXN1; (-) strand; PAM type: YTN; PAM sequence: TTG
gaggtctgtgggtggcggtt

SEQ ID NO: 226204 - DNA, 20 bp, Artificial Sequence
  Description of Artificial Sequence: Synthetic oligonucleotide
  Target: ATXN1; (-) strand; PAM type: YTN; PAM sequence: TTT
ggaggtctgtgggtggcggt

SEQ ID NO: 226205 - DNA, 20 bp, Artificial Sequence
  Description of Artificial Sequence: Synthetic oligonucleotide
  Target: ATXN1; (-) strand; PAM type: YTN; PAM sequence: CTG
cccacgtttggaggtctgtg

SEQ ID NO: 226206 - DNA, 20 bp, Artificial Sequence
  Description of Artificial Sequence: Synthetic oligonucleotide
  Target: ATXN1; (-) strand; PAM type: YTN; PAM sequence: CTC
ctgcccacgtttggaggtct

SEQ ID NO: 226207 - DNA, 20 bp, Artificial Sequence
  Description of Artificial Sequence: Synthetic oligonucleotide
  Target: ATXN1; (-) strand; PAM type: YTN; PAM sequence: CTC
ctcctgcccacgtttggagg

SEQ ID NO: 226208 - DNA, 20 bp, Artificial Sequence
  Description of Artificial Sequence: Synthetic oligonucleotide
  Target: ATXN1; (-) strand; PAM type: YTN; PAM sequence: TTC
acctcctcctgcccacgttt

SEQ ID NO: 226209 - DNA, 20 bp, Artificial Sequence
  Description of Artificial Sequence: Synthetic oligonucleotide
  Target: ATXN1; (-) strand; PAM type: YTN; PAM sequence: TTT
cacctcctcctgcccacgtt

SEQ ID NO: 226210 - DNA, 20 bp, Artificial Sequence
  Description of Artificial Sequence: Synthetic oligonucleotide
  Target: ATXN1; (-) strand; PAM type: YTN; PAM sequence: TTT
tcacctcctcctgcccacgt

SEQ ID NO: 226211 - DNA, 20 bp, Artificial Sequence
  Description of Artificial Sequence: Synthetic oligonucleotide
  Target: ATXN1; (-) strand; PAM type: YTN; PAM sequence: TTC
ccatcggtgagcagttttca

SEQ ID NO: 226212 - DNA, 20 bp, Artificial Sequence
  Description of Artificial Sequence: Synthetic oligonucleotide
  Target: ATXN1; (-) strand; PAM type: YTN; PAM sequence: CTC
aattcccatcggtgagcagt

SEQ ID NO: 226213 - DNA, 20 bp, Artificial Sequence
  Description of Artificial Sequence: Synthetic oligonucleotide
  Target: ATXN1; (-) strand; PAM type: YTN; PAM sequence: CTC
ctcaattcccatcggtgagc

SEQ ID NO: 226214 - DNA, 20 bp, Artificial Sequence
  Description of Artificial Sequence: Synthetic oligonucleotide
  Target: ATXN1; (-) strand; PAM type: YTN; PAM sequence: CTA
gctcctcaattcccatcggt

SEQ ID NO: 226215 - DNA, 20 bp, Artificial Sequence
  Description of Artificial Sequence: Synthetic oligonucleotide
  Target: ATXN1; (-) strand; PAM type: YTN; PAM sequence: CTA
cctagctcctcaattcccat

SEQ ID NO: 226216 - DNA, 20 bp, Artificial Sequence
  Description of Artificial Sequence: Synthetic oligonucleotide
  Target: ATXN1; (-) strand; PAM type: YTN; PAM sequence: CTC
tacctagctcctcaattccc

SEQ ID NO: 226217 - DNA, 20 bp, Artificial Sequence
  Description of Artificial Sequence: Synthetic oligonucleotide
  Target: ATXN1; (-) strand; PAM type: YTN; PAM sequence: TTC
catcctctacctagctcctc

SEQ ID NO: 226218 - DNA, 20 bp, Artificial Sequence
  Description of Artificial Sequence: Synthetic oligonucleotide
  Target: ATXN1; (-) strand; PAM type: YTN; PAM sequence: TTT
ccatcctctacctagctcct

SEQ ID NO: 226219 - DNA, 20 bp, Artificial Sequence
  Description of Artificial Sequence: Synthetic oligonucleotide
  Target: ATXN1; (-) strand; PAM type: YTN; PAM sequence: CTT
tccatcctctacctagctcc

SEQ ID NO: 226220 - DNA, 20 bp, Artificial Sequence
  Description of Artificial Sequence: Synthetic oligonucleotide
  Target: ATXN1; (-) strand; PAM type: YTN; PAM sequence: CTG
cagcccagatcccctttcca

SEQ ID NO: 226221 - DNA, 20 bp, Artificial Sequence
  Description of Artificial Sequence: Synthetic oligonucleotide
  Target: ATXN1; (-) strand; PAM type: YTN; PAM sequence: CTG
atctgcagcccagatcccct

SEQ ID NO: 226222 - DNA, 20 bp, Artificial Sequence
  Description of Artificial Sequence: Synthetic oligonucleotide
  Target: ATXN1; (-) strand; PAM type: YTN; PAM sequence: CTC
cgggctgatctgcagcccag

SEQ ID NO: 226223 - DNA, 20 bp, Artificial Sequence
  Description of Artificial Sequence: Synthetic oligonucleotide
  Target: ATXN1; (-) strand; PAM type: YTN; PAM sequence: TTA
caccctccgggctgatctgc

SEQ ID NO: 226224 - DNA, 20 bp, Artificial Sequence
  Description of Artificial Sequence: Synthetic oligonucleotide
  Target: ATXN1; (-) strand; PAM type: YTN; PAM sequence: TTA
ccacgttacaccctccgggc

SEQ ID NO: 226225 - DNA, 20 bp, Artificial Sequence
  Description of Artificial Sequence: Synthetic oligonucleotide
  Target: ATXN1; (-) strand; PAM type: YTN; PAM sequence: CTT
accacgttacaccctccggg

SEQ ID NO: 226226 - DNA, 20 bp, Artificial Sequence
  Description of Artificial Sequence: Synthetic oligonucleotide
  Target: ATXN1; (-) strand; PAM type: YTN; PAM sequence: CTG
cttaccacgttacaccctcc

SEQ ID NO: 226227 - DNA, 20 bp, Artificial Sequence
  Description of Artificial Sequence: Synthetic oligonucleotide
  Target: ATXN1; (-) strand; PAM type: YTN; PAM sequence: CTA
aaagcagcacgtctgcttac

SEQ ID NO: 226228 - DNA, 20 bp, Artificial Sequence
  Description of Artificial Sequence: Synthetic oligonucleotide
  Target: ATXN1; (-) strand; PAM type: YTN; PAM sequence: CTA
gcagctaaaagcagcacgtc

SEQ ID NO: 226229 - DNA, 20 bp, Artificial Sequence
  Description of Artificial Sequence: Synthetic oligonucleotide
  Target: ATXN1; (-) strand; PAM type: YTN; PAM sequence: CTC
acagaagcaaagcctagcag

SEQ ID NO: 226230 - DNA, 20 bp, Artificial Sequence
  Description of Artificial Sequence: Synthetic oligonucleotide
  Target: ATXN1; (-) strand; PAM type: YTN; PAM sequence: TTA
gaaatgaggtgaaaactcac

SEQ ID NO: 226231 - DNA, 20 bp, Artificial Sequence
  Description of Artificial Sequence: Synthetic oligonucleotide
  Target: ATXN1; (-) strand; PAM type: YTN; PAM sequence: CTT
agaaatgaggtgaaaactca

SEQ ID NO: 226232 - DNA, 20 bp, Artificial Sequence
  Description of Artificial Sequence: Synthetic oligonucleotide
  Target: ATXN1; (-) strand; PAM type: YTN; PAM sequence: TTC
cacttagaaatgaggtgaaa

SEQ ID NO: 226233 - DNA, 20 bp, Artificial Sequence
  Description of Artificial Sequence: Synthetic oligonucleotide
  Target: ATXN1; (-) strand; PAM type: YTN; PAM sequence: TTT
ccacttagaaatgaggtgaa

SEQ ID NO: 226234 - DNA, 20 bp, Artificial Sequence
  Description of Artificial Sequence: Synthetic oligonucleotide
  Target: ATXN1; (-) strand; PAM type: YTN; PAM sequence: TTT
tccacttagaaatgaggtga

SEQ ID NO: 226235 - DNA, 20 bp, Artificial Sequence
  Description of Artificial Sequence: Synthetic oligonucleotide
  Target: ATXN1; (-) strand; PAM type: YTN; PAM sequence: CTG
ttttccacttagaaatgagg

SEQ ID NO: 226236 - DNA, 20 bp, Artificial Sequence
  Description of Artificial Sequence: Synthetic oligonucleotide
  Target: ATXN1; (-) strand; PAM type: YTN; PAM sequence: TTA
agatctgttttccacttaga

SEQ ID NO: 226237 - DNA, 20 bp, Artificial Sequence
  Description of Artificial Sequence: Synthetic oligonucleotide
  Target: ATXN1; (-) strand; PAM type: YTN; PAM sequence: CTT
aagatctgttttccacttag

SEQ ID NO: 226238 - DNA, 20 bp, Artificial Sequence
  Description of Artificial Sequence: Synthetic oligonucleotide
  Target: ATXN1; (-) strand; PAM type: YTN; PAM sequence: TTC
ttaagatctgttttccactt

SEQ ID NO: 226239 - DNA, 20 bp, Artificial Sequence
  Description of Artificial Sequence: Synthetic oligonucleotide
  Target: ATXN1; (-) strand; PAM type: YTN; PAM sequence: CTT
cttaagatctgttttccact

SEQ ID NO: 226240 - DNA, 20 bp, Artificial Sequence
  Description of Artificial Sequence: Synthetic oligonucleotide
  Target: ATXN1; (-) strand; PAM type: YTN; PAM sequence: TTC
ttcttaagatctgttttcca

SEQ ID NO: 226241 - DNA, 20 bp, Artificial Sequence
  Description of Artificial Sequence: Synthetic oligonucleotide
  Target: ATXN1; (-) strand; PAM type: YTN; PAM sequence: TTT
cttcttaagatctgttttcc

SEQ ID NO: 226242 - DNA, 20 bp, Artificial Sequence
  Description of Artificial Sequence: Synthetic oligonucleotide
  Target: ATXN1; (-) strand; PAM type: YTN; PAM sequence: TTT
tcttcttaagatctgttttc

SEQ ID NO: 226243 - DNA, 20 bp, Artificial Sequence
  Description of Artificial Sequence: Synthetic oligonucleotide
  Target: ATXN1; (-) strand; PAM type: YTN; PAM sequence: TTT
ttcttcttaagatctgtttt

SEQ ID NO: 226244 - DNA, 20 bp, Artificial Sequence
  Description of Artificial Sequence: Synthetic oligonucleotide
  Target: ATXN1; (-) strand; PAM type: YTN; PAM sequence: CTT
tttcttcttaagatctgttt

SEQ ID NO: 226245 - DNA, 20 bp, Artificial Sequence
  Description of Artificial Sequence: Synthetic oligonucleotide
  Target: ATXN1; (-) strand; PAM type: YTN; PAM sequence: TTC
tttttcttcttaagatctgt

SEQ ID NO: 226246 - DNA, 20 bp, Artificial Sequence
  Description of Artificial Sequence: Synthetic oligonucleotide
  Target: ATXN1; (-) strand; PAM type: YTN; PAM sequence: TTT
ctttttcttcttaagatctg

SEQ ID NO: 226247 - DNA, 20 bp, Artificial Sequence
  Description of Artificial Sequence: Synthetic oligonucleotide
  Target: ATXN1; (-) strand; PAM type: YTN; PAM sequence: CTG
gtttctttttcttcttaaga

SEQ ID NO: 226248 - DNA, 20 bp, Artificial Sequence
  Description of Artificial Sequence: Synthetic oligonucleotide
  Target: ATXN1; (-) strand; PAM type: YTN; PAM sequence: TTA
gctggtttctttttcttctt

SEQ ID NO: 226249 - DNA, 20 bp, Artificial Sequence
  Description of Artificial Sequence: Synthetic oligonucleotide
  Target: ATXN1; (-) strand; PAM type: YTN; PAM sequence: TTT
agctggtttctttttcttct

SEQ ID NO: 226250 - DNA, 20 bp, Artificial Sequence
  Description of Artificial Sequence: Synthetic oligonucleotide
  Target: ATXN1; (-) strand; PAM type: YTN; PAM sequence: TTT
tagctggtttctttttcttc

SEQ ID NO: 226251 - DNA, 20 bp, Artificial Sequence
  Description of Artificial Sequence: Synthetic oligonucleotide
  Target: ATXN1; (-) strand; PAM type: YTN; PAM sequence: TTT
ttagctggtttctttttctt

SEQ ID NO: 226252 - DNA, 20 bp, Artificial Sequence
  Description of Artificial Sequence: Synthetic oligonucleotide
  Target: ATXN1; (-) strand; PAM type: YTN; PAM sequence: TTG
ggtttttagctggtttcttt

SEQ ID NO: 226253 - DNA, 20 bp, Artificial Sequence
  Description of Artificial Sequence: Synthetic oligonucleotide
  Target: ATXN1; (-) strand; PAM type: YTN; PAM sequence: TTG
tcccatgttgggtttttagc

SEQ ID NO: 226254 - DNA, 20 bp, Artificial Sequence
  Description of Artificial Sequence: Synthetic oligonucleotide
  Target: ATXN1; (-) strand; PAM type: YTN; PAM sequence: TTA
aaggtgatagtaattgtccc

SEQ ID NO: 226255 - DNA, 20 bp, Artificial Sequence
  Description of Artificial Sequence: Synthetic oligonucleotide
  Target: ATXN1; (-) strand; PAM type: YTN; PAM sequence: TTT
aaaggtgatagtaattgtcc

SEQ ID NO: 226256 - DNA, 20 bp, Artificial Sequence
  Description of Artificial Sequence: Synthetic oligonucleotide
  Target: ATXN1; (-) strand; PAM type: YTN; PAM sequence: CTA
aaaccaaagtttaaaggtga

SEQ ID NO: 226257 - DNA, 20 bp, Artificial Sequence
  Description of Artificial Sequence: Synthetic oligonucleotide
  Target: ATXN1; (-) strand; PAM type: YTN; PAM sequence: TTA
aaggtgctaaaaccaaagtt

SEQ ID NO: 226258 - DNA, 20 bp, Artificial Sequence
  Description of Artificial Sequence: Synthetic oligonucleotide
  Target: ATXN1; (-) strand; PAM type: YTN; PAM sequence: TTT
aaaggtgctaaaaccaaagt

SEQ ID NO: 226259 - DNA, 20 bp, Artificial Sequence
  Description of Artificial Sequence: Synthetic oligonucleotide
  Target: ATXN1; (-) strand; PAM type: YTN; PAM sequence: TTC
cagagtttaaaggtgctaaa

SEQ ID NO: 226260 - DNA, 20 bp, Artificial Sequence
  Description of Artificial Sequence: Synthetic oligonucleotide
  Target: ATXN1; (-) strand; PAM type: YTN; PAM sequence: TTC
attccagagtttaaaggtgc

SEQ ID NO: 226261 - DNA, 20 bp, Artificial Sequence
  Description of Artificial Sequence: Synthetic oligonucleotide
  Target: ATXN1; (-) strand; PAM type: YTN; PAM sequence: TTC
acggttcattccagagttta

SEQ ID NO: 226262 - DNA, 20 bp, Artificial Sequence
  Description of Artificial Sequence: Synthetic oligonucleotide
  Target: ATXN1; (-) strand; PAM type: YTN; PAM sequence: CTG
gttcacggttcattccagag

SEQ ID NO: 226263 - DNA, 20 bp, Artificial Sequence
  Description of Artificial Sequence: Synthetic oligonucleotide
  Target: ATXN1; (-) strand; PAM type: YTN; PAM sequence: TTG
ctggttcacggttcattcca

SEQ ID NO: 226264 - DNA, 20 bp, Artificial Sequence
  Description of Artificial Sequence: Synthetic oligonucleotide
  Target: ATXN1; (-) strand; PAM type: YTN; PAM sequence: TTT
gctggttcacggttcattcc

SEQ ID NO: 226265 - DNA, 20 bp, Artificial Sequence
  Description of Artificial Sequence: Synthetic oligonucleotide
  Target: ATXN1; (-) strand; PAM type: YTN; PAM sequence: TTT
tgctggttcacggttcattc

SEQ ID NO: 226266 - DNA, 20 bp, Artificial Sequence
  Description of Artificial Sequence: Synthetic oligonucleotide
  Target: ATXN1; (-) strand; PAM type: YTN; PAM sequence: TTG
ttttgctggttcacggttca

SEQ ID NO: 226267 - DNA, 20 bp, Artificial Sequence
  Description of Artificial Sequence: Synthetic oligonucleotide
  Target: ATXN1; (-) strand; PAM type: YTN; PAM sequence: TTT
gttttgctggttcacggttc

SEQ ID NO: 226268 - DNA, 20 bp, Artificial Sequence
  Description of Artificial Sequence: Synthetic oligonucleotide
  Target: ATXN1; (-) strand; PAM type: YTN; PAM sequence: TTC
catttgttttgctggttcac

SEQ ID NO: 226269 - DNA, 20 bp, Artificial Sequence
  Description of Artificial Sequence: Synthetic oligonucleotide
  Target: ATXN1; (-) strand; PAM type: YTN; PAM sequence: TTT
ccatttgttttgctggttca

SEQ ID NO: 226270 - DNA, 20 bp, Artificial Sequence
  Description of Artificial Sequence: Synthetic oligonucleotide
  Target: ATXN1; (-) strand; PAM type: YTN; PAM sequence: TTT
tccatttgttttgctggttc

SEQ ID NO: 226271 - DNA, 20 bp, Artificial Sequence
  Description of Artificial Sequence: Synthetic oligonucleotide
  Target: ATXN1; (-) strand; PAM type: YTN; PAM sequence: TTT
ttccatttgttttgctggtt

SEQ ID NO: 226272 - DNA, 20 bp, Artificial Sequence
  Description of Artificial Sequence: Synthetic oligonucleotide
  Target: ATXN1; (-) strand; PAM type: YTN; PAM sequence: TTT
tttccatttgttttgctggt

SEQ ID NO: 226273 - DNA, 20 bp, Artificial Sequence
  Description of Artificial Sequence: Synthetic oligonucleotide
  Target: ATXN1; (-) strand; PAM type: YTN; PAM sequence: TTT
ttttccatttgttttgctgg

SEQ ID NO: 226274 - DNA, 20 bp, Artificial Sequence
  Description of Artificial Sequence: Synthetic oligonucleotide
  Target: ATXN1; (-) strand; PAM type: YTN; PAM sequence: TTT
tttttccatttgttttgctg

SEQ ID NO: 226275 - DNA, 20 bp, Artificial Sequence
  Description of Artificial Sequence: Synthetic oligonucleotide
  Target: ATXN1; (-) strand; PAM type: YTN; PAM sequence: TTT
ttttttccatttgttttgct

SEQ ID NO: 226276 - DNA, 20 bp, Artificial Sequence
  Description of Artificial Sequence: Synthetic oligonucleotide
  Target: ATXN1; (-) strand; PAM type: YTN; PAM sequence: TTT
tttttttccatttgttttgc

SEQ ID NO: 226277 - DNA, 20 bp, Artificial Sequence
  Description of Artificial Sequence: Synthetic oligonucleotide
  Target: ATXN1; (-) strand; PAM type: YTN; PAM sequence: TTT
ttttttttccatttgttttg

SEQ ID NO: 226278 - DNA, 20 bp, Artificial Sequence
  Description of Artificial Sequence: Synthetic oligonucleotide
  Target: ATXN1; (-) strand; PAM type: YTN; PAM sequence: TTT
tttttttttccatttgtttt

SEQ ID NO: 226279 - DNA, 20 bp, Artificial Sequence
  Description of Artificial Sequence: Synthetic oligonucleotide
  Target: ATXN1; (-) strand; PAM type: YTN; PAM sequence: TTG
ttttttttttttccatttgt

SEQ ID NO: 226280 - DNA, 20 bp, Artificial Sequence
  Description of Artificial Sequence: Synthetic oligonucleotide
  Target: ATXN1; (-) strand; PAM type: YTN; PAM sequence: TTT
gttttttttttttccatttg

SEQ ID NO: 226281 - DNA, 20 bp, Artificial Sequence
  Description of Artificial Sequence: Synthetic oligonucleotide
  Target: ATXN1; (-) strand; PAM type: YTN; PAM sequence: TTT
tgttttttttttttccattt

SEQ ID NO: 226282 - DNA, 20 bp, Artificial Sequence
  Description of Artificial Sequence: Synthetic oligonucleotide
  Target: ATXN1; (-) strand; PAM type: YTN; PAM sequence: TTT
ttgttttttttttttccatt

SEQ ID NO: 226283 - DNA, 20 bp, Artificial Sequence
  Description of Artificial Sequence: Synthetic oligonucleotide
  Target: ATXN1; (-) strand; PAM type: YTN; PAM sequence: CTT
tttgttttttttttttccat

SEQ ID NO: 226284 - DNA, 20 bp, Artificial Sequence
  Description of Artificial Sequence: Synthetic oligonucleotide
  Target: ATXN1; (-) strand; PAM type: YTN; PAM sequence: CTG
ctttttgttttttttttttc

SEQ ID NO: 226285 - DNA, 20 bp, Artificial Sequence
  Description of Artificial Sequence: Synthetic oligonucleotide
  Target: ATXN1; (-) strand; PAM type: YTN; PAM sequence: TTA
ccatacccaggaggtcgctg

SEQ ID NO: 226286 - DNA, 20 bp, Artificial Sequence
  Description of Artificial Sequence: Synthetic oligonucleotide
  Target: ATXN1; (-) strand; PAM type: YTN; PAM sequence: TTC
agatattaccatacccagga

SEQ ID NO: 226287 - DNA, 20 bp, Artificial Sequence
  Description of Artificial Sequence: Synthetic oligonucleotide
  Target: ATXN1; (-) strand; PAM type: YTN; PAM sequence: CTG
ttcagatattaccataccca

SEQ ID NO: 226288 - DNA, 20 bp, Artificial Sequence
  Description of Artificial Sequence: Synthetic oligonucleotide
  Target: ATXN1; (-) strand; PAM type: YTN; PAM sequence: TTC
tgttcagatattaccatacc

SEQ ID NO: 226289 - DNA, 20 bp, Artificial Sequence
  Description of Artificial Sequence: Synthetic oligonucleotide
  Target: ATXN1; (-) strand; PAM type: YTN; PAM sequence: CTT
ctgttcagatattaccatac

SEQ ID NO: 226290 - DNA, 20 bp, Artificial Sequence
  Description of Artificial Sequence: Synthetic oligonucleotide
  Target: ATXN1; (-) strand; PAM type: YTN; PAM sequence: CTC
gcttctgttcagatattacc

SEQ ID NO: 226291 - DNA, 20 bp, Artificial Sequence
  Description of Artificial Sequence: Synthetic oligonucleotide
  Target: ATXN1; (-) strand; PAM type: YTN; PAM sequence: CTC
ccaaacctcgcttctgttca

SEQ ID NO: 226292 - DNA, 20 bp, Artificial Sequence
  Description of Artificial Sequence: Synthetic oligonucleotide
  Target: ATXN1; (-) strand; PAM type: YTN; PAM sequence: CTG
atgccaacatcccctcccaa

SEQ ID NO: 226293 - DNA, 20 bp, Artificial Sequence
  Description of Artificial Sequence: Synthetic oligonucleotide
  Target: ATXN1; (-) strand; PAM type: YTN; PAM sequence: TTA
tcaccctgatgccaacatcc

SEQ ID NO: 226294 - DNA, 20 bp, Artificial Sequence
  Description of Artificial Sequence: Synthetic oligonucleotide
  Target: ATXN1; (-) strand; PAM type: YTN; PAM sequence: TTT
atcaccctgatgccaacatc

SEQ ID NO: 226295 - DNA, 20 bp, Artificial Sequence
  Description of Artificial Sequence: Synthetic oligonucleotide
  Target: ATXN1; (-) strand; PAM type: YTN; PAM sequence: CTA
gggtttatcaccctgatgcc

SEQ ID NO: 226296 - DNA, 20 bp, Artificial Sequence
  Description of Artificial Sequence: Synthetic oligonucleotide
  Target: ATXN1; (-) strand; PAM type: YTN; PAM sequence: TTC
ctagggtttatcaccctgat

SEQ ID NO: 226297 - DNA, 20 bp, Artificial Sequence
  Description of Artificial Sequence: Synthetic oligonucleotide
  Target: ATXN1; (-) strand; PAM type: YTN; PAM sequence: TTA
aaccagaacgtcacaacacg

SEQ ID NO: 226298 - DNA, 20 bp, Artificial Sequence
  Description of Artificial Sequence: Synthetic oligonucleotide
  Target: ATXN1; (-) strand; PAM type: YTN; PAM sequence: TTT
aaaccagaacgtcacaacac

SEQ ID NO: 226299 - DNA, 20 bp, Artificial Sequence
  Description of Artificial Sequence: Synthetic oligonucleotide
  Target: ATXN1; (-) strand; PAM type: YTN; PAM sequence: TTT
taaaccagaacgtcacaaca

SEQ ID NO: 226300 - DNA, 20 bp, Artificial Sequence
  Description of Artificial Sequence: Synthetic oligonucleotide
  Target: ATXN1; (-) strand; PAM type: YTN; PAM sequence: TTG
ttttaaaccagaacgtcaca

SEQ ID NO: 226301 - DNA, 20 bp, Artificial Sequence
  Description of Artificial Sequence: Synthetic oligonucleotide
  Target: ATXN1; (-) strand; PAM type: YTN; PAM sequence: CTT
gttttaaaccagaacgtcac

SEQ ID NO: 226302 - DNA, 20 bp, Artificial Sequence
  Description of Artificial Sequence: Synthetic oligonucleotide
  Target: ATXN1; (-) strand; PAM type: YTN; PAM sequence: TTC
aaataggaacttgttttaaa

SEQ ID NO: 226303 - DNA, 20 bp, Artificial Sequence
  Description of Artificial Sequence: Synthetic oligonucleotide
  Target: ATXN1; (-) strand; PAM type: YTN; PAM sequence: CTT
caaataggaacttgttttaa

SEQ ID NO: 226304 - DNA, 20 bp, Artificial Sequence
  Description of Artificial Sequence: Synthetic oligonucleotide
  Target: ATXN1; (-) strand; PAM type: YTN; PAM sequence: TTA
atggcatcttcaaataggaa

SEQ ID NO: 226305 - DNA, 20 bp, Artificial Sequence
  Description of Artificial Sequence: Synthetic oligonucleotide
  Target: ATXN1; (-) strand; PAM type: YTN; PAM sequence: TTT
aatggcatcttcaaatagga

SEQ ID NO: 226306 - DNA, 20 bp, Artificial Sequence
  Description of Artificial Sequence: Synthetic oligonucleotide
  Target: ATXN1; (-) strand; PAM type: YTN; PAM sequence: TTT
taatggcatcttcaaatagg

SEQ ID NO: 226307 - DNA, 20 bp, Artificial Sequence
  Description of Artificial Sequence: Synthetic oligonucleotide
  Target: ATXN1; (-) strand; PAM type: YTN; PAM sequence: TTT
ttaatggcatcttcaaatag

SEQ ID NO: 226308 - DNA, 20 bp, Artificial Sequence
  Description of Artificial Sequence: Synthetic oligonucleotide
  Target: ATXN1; (-) strand; PAM type: YTN; PAM sequence: TTT
tttaatggcatcttcaaata

SEQ ID NO: 226309 - DNA, 20 bp, Artificial Sequence
  Description of Artificial Sequence: Synthetic oligonucleotide
  Target: ATXN1; (-) strand; PAM type: YTN; PAM sequence: CTT
ttttaatggcatcttcaaat

SEQ ID NO: 226310 - DNA, 20 bp, Artificial Sequence
  Description of Artificial Sequence: Synthetic oligonucleotide
  Target: ATXN1; (-) strand; PAM type: YTN; PAM sequence: CTA
aacttttttaatggcatctt

SEQ ID NO: 226311 - DNA, 20 bp, Artificial Sequence
  Description of Artificial Sequence: Synthetic oligonucleotide
  Target: ATXN1; (-) strand; PAM type: YTN; PAM sequence: CTG
tatctaaacttttttaatgg

SEQ ID NO: 226312 - DNA, 20 bp, Artificial Sequence
  Description of Artificial Sequence: Synthetic oligonucleotide
  Target: ATXN1; (-) strand; PAM type: YTN; PAM sequence: TTC
tgtatctaaacttttttaat

SEQ ID NO: 226313 - DNA, 20 bp, Artificial Sequence
  Description of Artificial Sequence: Synthetic oligonucleotide
  Target: ATXN1; (-) strand; PAM type: YTN; PAM sequence: TTT
ctgtatctaaacttttttaa

SEQ ID NO: 226314 - DNA, 20 bp, Artificial Sequence
  Description of Artificial Sequence: Synthetic oligonucleotide
  Target: ATXN1; (-) strand; PAM type: YTN; PAM sequence: TTG
tgtagtttctgtatctaaac

SEQ ID NO: 226315 - DNA, 20 bp, Artificial Sequence
  Description of Artificial Sequence: Synthetic oligonucleotide
  Target: ATXN1; (-) strand; PAM type: YTN; PAM sequence: TTT
gtgtagtttctgtatctaaa

SEQ ID NO: 226316 - DNA, 20 bp, Artificial Sequence
  Description of Artificial Sequence: Synthetic oligonucleotide
  Target: ATXN1; (-) strand; PAM type: YTN; PAM sequence: CTT
tgtgtagtttctgtatctaa

SEQ ID NO: 226317 - DNA, 20 bp, Artificial Sequence
  Description of Artificial Sequence: Synthetic oligonucleotide
  Target: ATXN1; (-) strand; PAM type: YTN; PAM sequence: TTC
tttgtgtagtttctgtatct

SEQ ID NO: 226318 - DNA, 20 bp, Artificial Sequence
  Description of Artificial Sequence: Synthetic oligonucleotide
  Target: ATXN1; (-) strand; PAM type: YTN; PAM sequence: TTT
ctttgtgtagtttctgtatc

SEQ ID NO: 226319 - DNA, 20 bp, Artificial Sequence
  Description of Artificial Sequence: Synthetic oligonucleotide
  Target: ATXN1; (-) strand; PAM type: YTN; PAM sequence: CTT
tctttgtgtagtttctgtat

SEQ ID NO: 226320 - DNA, 20 bp, Artificial Sequence
  Description of Artificial Sequence: Synthetic oligonucleotide
  Target: ATXN1; (-) strand; PAM type: YTN; PAM sequence: CTC
tttctttgtgtagtttctgt

SEQ ID NO: 226321 - DNA, 20 bp, Artificial Sequence
  Description of Artificial Sequence: Synthetic oligonucleotide
  Target: ATXN1; (-) strand; PAM type: YTN; PAM sequence: CTG
tctctttctttgtgtagttt

SEQ ID NO: 226322 - DNA, 20 bp, Artificial Sequence
  Description of Artificial Sequence: Synthetic oligonucleotide
  Target: ATXN1; (-) strand; PAM type: YTN; PAM sequence: CTC
tgtctctttctttgtgtagt

SEQ ID NO: 226323 - DNA, 20 bp, Artificial Sequence
  Description of Artificial Sequence: Synthetic oligonucleotide
  Target: ATXN1; (-) strand; PAM type: YTN; PAM sequence: TTC
ctctgtctctttctttgtgt

SEQ ID NO: 226324 - DNA, 20 bp, Artificial Sequence
  Description of Artificial Sequence: Synthetic oligonucleotide
  Target: ATXN1; (-) strand; PAM type: YTN; PAM sequence: TTT
cctctgtctctttctttgtg

SEQ ID NO: 226325 - DNA, 20 bp, Artificial Sequence
  Description of Artificial Sequence: Synthetic oligonucleotide
  Target: ATXN1; (-) strand; PAM type: YTN; PAM sequence: TTT
tcctctgtctctttctttgt

SEQ ID NO: 226326 - DNA, 20 bp, Artificial Sequence
  Description of Artificial Sequence: Synthetic oligonucleotide
  Target: ATXN1; (-) strand; PAM type: YTN; PAM sequence: TTT
ttcctctgtctctttctttg

SEQ ID NO: 226327 - DNA, 20 bp, Artificial Sequence
  Description of Artificial Sequence: Synthetic oligonucleotide
  Target: ATXN1; (-) strand; PAM type: YTN; PAM sequence: TTT
tttcctctgtctctttcttt

SEQ ID NO: 226328 - DNA, 20 bp, Artificial Sequence
  Description of Artificial Sequence: Synthetic oligonucleotide
  Target: ATXN1; (-) strand; PAM type: YTN; PAM sequence: CTT
ttttcctctgtctctttctt

SEQ ID NO: 226329 - DNA, 20 bp, Artificial Sequence
  Description of Artificial Sequence: Synthetic oligonucleotide
  Target: ATXN1; (-) strand; PAM type: YTN; PAM sequence: TTC
ttttttcctctgtctctttc

SEQ ID NO: 226330 - DNA, 20 bp, Artificial Sequence
  Description of Artificial Sequence: Synthetic oligonucleotide
  Target: ATXN1; (-) strand; PAM type: YTN; PAM sequence: CTT
cttttttcctctgtctcttt

SEQ ID NO: 226331 - DNA, 20 bp, Artificial Sequence
  Description of Artificial Sequence: Synthetic oligonucleotide
  Target: ATXN1; (-) strand; PAM type: YTN; PAM sequence: TTA
gggtaatcttcttttttcct

SEQ ID NO: 226332 - DNA, 20 bp, Artificial Sequence
  Description of Artificial Sequence: Synthetic oligonucleotide
  Target: ATXN1; (-) strand; PAM type: YTN; PAM sequence: TTT
agggtaatcttcttttttcc

SEQ ID NO: 226333 - DNA, 20 bp, Artificial Sequence
  Description of Artificial Sequence: Synthetic oligonucleotide
  Target: ATXN1; (-) strand; PAM type: YTN; PAM sequence: TTT
tagggtaatcttcttttttc

SEQ ID NO: 226334 - DNA, 20 bp, Artificial Sequence
  Description of Artificial Sequence: Synthetic oligonucleotide
  Target: ATXN1; (-) strand; PAM type: YTN; PAM sequence: TTT
ttagggtaatcttctttttt

SEQ ID NO: 226335 - DNA, 20 bp, Artificial Sequence
  Description of Artificial Sequence: Synthetic oligonucleotide
  Target: ATXN1; (-) strand; PAM type: YTN; PAM sequence: TTA
tttttagggtaatcttcttt

SEQ ID NO: 226336 - DNA, 20 bp, Artificial Sequence
  Description of Artificial Sequence: Synthetic oligonucleotide
  Target: ATXN1; (-) strand; PAM type: YTN; PAM sequence: TTT
atttttagggtaatcttctt

SEQ ID NO: 226337 - DNA, 20 bp, Artificial Sequence
  Description of Artificial Sequence: Synthetic oligonucleotide
  Target: ATXN1; (-) strand; PAM type: YTN; PAM sequence: TTG
gtggtttatttttagggtaa

SEQ ID NO: 226338 - DNA, 20 bp, Artificial Sequence
  Description of Artificial Sequence: Synthetic oligonucleotide
  Target: ATXN1; (-) strand; PAM type: YTN; PAM sequence: TTC
attggtggtttatttttagg

SEQ ID NO: 226339 - DNA, 20 bp, Artificial Sequence
  Description of Artificial Sequence: Synthetic oligonucleotide
  Target: ATXN1; (-) strand; PAM type: YTN; PAM sequence: TTC
aacatgtgtcataaaaaatt

SEQ ID NO: 226340 - DNA, 20 bp, Artificial Sequence
  Description of Artificial Sequence: Synthetic oligonucleotide
  Target: ATXN1; (-) strand; PAM type: YTN; PAM sequence: TTT
caacatgtgtcataaaaaat

SEQ ID NO: 226341 - DNA, 20 bp, Artificial Sequence
  Description of Artificial Sequence: Synthetic oligonucleotide
  Target: ATXN1; (-) strand; PAM type: YTN; PAM sequence: TTA
gtttcaacatgtgtcataaa

SEQ ID NO: 226342 - DNA, 20 bp, Artificial Sequence
  Description of Artificial Sequence: Synthetic oligonucleotide
  Target: ATXN1; (-) strand; PAM type: YTN; PAM sequence: TTG
ttagtttcaacatgtgtcat

SEQ ID NO: 226343 - DNA, 20 bp, Artificial Sequence
  Description of Artificial Sequence: Synthetic oligonucleotide
  Target: ATXN1; (-) strand; PAM type: YTN; PAM sequence: CTG
ttgttagtttcaacatgtgt

SEQ ID NO: 226344 - DNA, 20 bp, Artificial Sequence
  Description of Artificial Sequence: Synthetic oligonucleotide
  Target: ATXN1; (-) strand; PAM type: YTN; PAM sequence: CTA
gtctgttgttagtttcaaca

SEQ ID NO: 226345 - DNA, 20 bp, Artificial Sequence
  Description of Artificial Sequence: Synthetic oligonucleotide
  Target: ATXN1; (-) strand; PAM type: YTN; PAM sequence: CTG
ggctagtctgttgttagttt

SEQ ID NO: 226346 - DNA, 20 bp, Artificial Sequence
  Description of Artificial Sequence: Synthetic oligonucleotide
  Target: ATXN1; (-) strand; PAM type: YTN; PAM sequence: TTC
cctgggctagtctgttgtta

SEQ ID NO: 226347 - DNA, 20 bp, Artificial Sequence
  Description of Artificial Sequence: Synthetic oligonucleotide
  Target: ATXN1; (-) strand; PAM type: YTN; PAM sequence: CTG
agcgccattccctgggctag

SEQ ID NO: 226348 - DNA, 20 bp, Artificial Sequence
  Description of Artificial Sequence: Synthetic oligonucleotide
  Target: ATXN1; (-) strand; PAM type: YTN; PAM sequence: CTC
catcgcctgagcgccattcc

SEQ ID NO: 226349 - DNA, 20 bp, Artificial Sequence
  Description of Artificial Sequence: Synthetic oligonucleotide
  Target: ATXN1; (-) strand; PAM type: YTN; PAM sequence: TTG
tcccagagcataggtgctcc

SEQ ID NO: 226350 - DNA, 20 bp, Artificial Sequence
  Description of Artificial Sequence: Synthetic oligonucleotide
  Target: ATXN1; (-) strand; PAM type: YTN; PAM sequence: CTT
gtcccagagcataggtgctc

SEQ ID NO: 226351 - DNA, 20 bp, Artificial Sequence
  Description of Artificial Sequence: Synthetic oligonucleotide
  Target: ATXN1; (-) strand; PAM type: YTN; PAM sequence: CTG
gacagtggccatgcttgtcc

SEQ ID NO: 226352 - DNA, 20 bp, Artificial Sequence
  Description of Artificial Sequence: Synthetic oligonucleotide
  Target: ATXN1; (-) strand; PAM type: YTN; PAM sequence: TTA
gctggacagtggccatgctt

SEQ ID NO: 226353 - DNA, 20 bp, Artificial Sequence
  Description of Artificial Sequence: Synthetic oligonucleotide
  Target: ATXN1; (-) strand; PAM type: YTN; PAM sequence: CTT
agctggacagtggccatgct

SEQ ID NO: 226354 - DNA, 20 bp, Artificial Sequence
  Description of Artificial Sequence: Synthetic oligonucleotide
  Target: ATXN1; (-) strand; PAM type: YTN; PAM sequence: TTG
cttagctggacagtggccat

SEQ ID NO: 226355 - DNA, 20 bp, Artificial Sequence
  Description of Artificial Sequence: Synthetic oligonucleotide
  Target: ATXN1; (-) strand; PAM type: YTN; PAM sequence: CTT
gcttagctggacagtggcca

SEQ ID NO: 226356 - DNA, 20 bp, Artificial Sequence
  Description of Artificial Sequence: Synthetic oligonucleotide
  Target: ATXN1; (-) strand; PAM type: YTN; PAM sequence: TTA
atggcttgcttagctggaca

SEQ ID NO: 226357 - DNA, 20 bp, Artificial Sequence
  Description of Artificial Sequence: Synthetic oligonucleotide
  Target: ATXN1; (-) strand; PAM type: YTN; PAM sequence: TTA
tagatgaagaagtgaatggc

SEQ ID NO: 226358 - DNA, 20 bp, Artificial Sequence
  Description of Artificial Sequence: Synthetic oligonucleotide
  Target: ATXN1; (-) strand; PAM type: YTN; PAM sequence: TTT
atagatgaagaagtgaatgg

SEQ ID NO: 226359 - DNA, 20 bp, Artificial Sequence
  Description of Artificial Sequence: Synthetic oligonucleotide
  Target: ATXN1; (-) strand; PAM type: YTN; PAM sequence: CTG
ccccgtttatagatgaagaa

SEQ ID NO: 226360 - DNA, 20 bp, Artificial Sequence
  Description of Artificial Sequence: Synthetic oligonucleotide
  Target: ATXN1; (-) strand; PAM type: YTN; PAM sequence: CTC
tgccccgtttatagatgaag

SEQ ID NO: 226361 - DNA, 20 bp, Artificial Sequence
  Description of Artificial Sequence: Synthetic oligonucleotide
  Target: ATXN1; (-) strand; PAM type: YTN; PAM sequence: TTC
tctgccccgtttatagatga

SEQ ID NO: 226362 - DNA, 20 bp, Artificial Sequence
  Description of Artificial Sequence: Synthetic oligonucleotide
  Target: ATXN1; (-) strand; PAM type: YTN; PAM sequence: CTT
ctctgccccgtttatagatg

SEQ ID NO: 226363 - DNA, 20 bp, Artificial Sequence
  Description of Artificial Sequence: Synthetic oligonucleotide
  Target: ATXN1; (-) strand; PAM type: YTN; PAM sequence: CTC
cccttctctgccccgtttat

SEQ ID NO: 226364 - DNA, 20 bp, Artificial Sequence
  Description of Artificial Sequence: Synthetic oligonucleotide
  Target: ATXN1; (-) strand; PAM type: YTN; PAM sequence: TTC
tccccttctctgccccgttt

SEQ ID NO: 226365 - DNA, 20 bp, Artificial Sequence
  Description of Artificial Sequence: Synthetic oligonucleotide
  Target: ATXN1; (-) strand; PAM type: YTN; PAM sequence: CTT
ctccccttctctgccccgtt

SEQ ID NO: 226366 - DNA, 20 bp, Artificial Sequence
  Description of Artificial Sequence: Synthetic oligonucleotide
  Target: ATXN1; (-) strand; PAM type: YTN; PAM sequence: CTC
cttctccccttctctgcccc

SEQ ID NO: 226367 - DNA, 20 bp, Artificial Sequence
  Description of Artificial Sequence: Synthetic oligonucleotide
  Target: ATXN1; (-) strand; PAM type: YTN; PAM sequence: CTA
ctccttctccccttctctgc

SEQ ID NO: 226368 - DNA, 20 bp, Artificial Sequence
  Description of Artificial Sequence: Synthetic oligonucleotide
  Target: ATXN1; (-) strand; PAM type: YTN; PAM sequence: TTA
aagacagcctactccttctc

SEQ ID NO: 226369 - DNA, 20 bp, Artificial Sequence
  Description of Artificial Sequence: Synthetic oligonucleotide
  Target: ATXN1; (-) strand; PAM type: YTN; PAM sequence: TTT
aaagacagcctactccttct

SEQ ID NO: 226370 - DNA, 20 bp, Artificial Sequence
  Description of Artificial Sequence: Synthetic oligonucleotide
  Target: ATXN1; (-) strand; PAM type: YTN; PAM sequence: TTG
tgtgtaaaggaatttaaaga

SEQ ID NO: 226371 - DNA, 20 bp, Artificial Sequence
  Description of Artificial Sequence: Synthetic oligonucleotide
  Target: ATXN1; (-) strand; PAM type: YTN; PAM sequence: CTT
gtgtgtaaaggaatttaaag

SEQ ID NO: 226372 - DNA, 20 bp, Artificial Sequence
  Description of Artificial Sequence: Synthetic oligonucleotide
  Target: ATXN1; (-) strand; PAM type: YTN; PAM sequence: CTG
tcttgtgtgtaaaggaattt

SEQ ID NO: 226373 - DNA, 20 bp, Artificial Sequence
  Description of Artificial Sequence: Synthetic oligonucleotide
  Target: ATXN1; (-) strand; PAM type: YTN; PAM sequence: TTG
aataggagtggtgagagagg

SEQ ID NO: 226374 - DNA, 20 bp, Artificial Sequence
  Description of Artificial Sequence: Synthetic oligonucleotide
  Target: ATXN1; (-) strand; PAM type: YTN; PAM sequence: CTA
tgttgaataggagtggtgag

SEQ ID NO: 226375 - DNA, 20 bp, Artificial Sequence
  Description of Artificial Sequence: Synthetic oligonucleotide
  Target: ATXN1; (-) strand; PAM type: YTN; PAM sequence: TTC
caacactatgttgaatagga

SEQ ID NO: 226376 - DNA, 20 bp, Artificial Sequence
  Description of Artificial Sequence: Synthetic oligonucleotide
  Target: ATXN1; (-) strand; PAM type: YTN; PAM sequence: CTT
ccaacactatgttgaatagg

SEQ ID NO: 226377 - DNA, 20 bp, Artificial Sequence
  Description of Artificial Sequence: Synthetic oligonucleotide
  Target: ATXN1; (-) strand; PAM type: YTN; PAM sequence: CTG
gccagaacttccaacactat

SEQ ID NO: 226378 - DNA, 20 bp, Artificial Sequence
  Description of Artificial Sequence: Synthetic oligonucleotide
  Target: ATXN1; (-) strand; PAM type: YTN; PAM sequence: TTG
ccctggccagaacttccaac

SEQ ID NO: 226379 - DNA, 20 bp, Artificial Sequence
  Description of Artificial Sequence: Synthetic oligonucleotide
  Target: ATXN1; (-) strand; PAM type: YTN; PAM sequence: CTG
attgccctggccagaacttc

SEQ ID NO: 226380 - DNA, 20 bp, Artificial Sequence
  Description of Artificial Sequence: Synthetic oligonucleotide
  Target: ATXN1; (-) strand; PAM type: YTN; PAM sequence: CTG
cctgattgccctggccagaa

SEQ ID NO: 226381 - DNA, 20 bp, Artificial Sequence
  Description of Artificial Sequence: Synthetic oligonucleotide
  Target: ATXN1; (-) strand; PAM type: YTN; PAM sequence: CTC
ctgcctgattgccctggcca

SEQ ID NO: 226382 - DNA, 20 bp, Artificial Sequence
  Description of Artificial Sequence: Synthetic oligonucleotide
  Target: ATXN1; (-) strand; PAM type: YTN; PAM sequence: TTC
tcctgcctgattgccctggc

SEQ ID NO: 226383 - DNA, 20 bp, Artificial Sequence
  Description of Artificial Sequence: Synthetic oligonucleotide
  Target: ATXN1; (-) strand; PAM type: YTN; PAM sequence: CTT
ctcctgcctgattgccctgg

SEQ ID NO: 226384 - DNA, 20 bp, Artificial Sequence
  Description of Artificial Sequence: Synthetic oligonucleotide
  Target: ATXN1; (-) strand; PAM type: YTN; PAM sequence: TTC
cttctcctgcctgattgccc

SEQ ID NO: 226385 - DNA, 20 bp, Artificial Sequence
  Description of Artificial Sequence: Synthetic oligonucleotide
  Target: ATXN1; (-) strand; PAM type: YTN; PAM sequence: TTT
ccttctcctgcctgattgcc

SEQ ID NO: 226386 - DNA, 20 bp, Artificial Sequence
  Description of Artificial Sequence: Synthetic oligonucleotide
  Target: ATXN1; (-) strand; PAM type: YTN; PAM sequence: TTA
tttccttctcctgcctgatt

SEQ ID NO: 226387 - DNA, 20 bp, Artificial Sequence
  Description of Artificial Sequence: Synthetic oligonucleotide
  Target: ATXN1; (-) strand; PAM type: YTN; PAM sequence: TTT
atttccttctcctgcctgat

SEQ ID NO: 226388 - DNA, 20 bp, Artificial Sequence
  Description of Artificial Sequence: Synthetic oligonucleotide
  Target: ATXN1; (-) strand; PAM type: YTN; PAM sequence: CTT
tatttccttctcctgcctga

SEQ ID NO: 226389 - DNA, 20 bp, Artificial Sequence
  Description of Artificial Sequence: Synthetic oligonucleotide
  Target: ATXN1; (-) strand; PAM type: YTN; PAM sequence: CTC
tttatttccttctcctgcct

SEQ ID NO: 226390 - DNA, 20 bp, Artificial Sequence
  Description of Artificial Sequence: Synthetic oligonucleotide
  Target: ATXN1; (-) strand; PAM type: YTN; PAM sequence: TTG
aatactctttatttccttct

SEQ ID NO: 226391 - DNA, 20 bp, Artificial Sequence
  Description of Artificial Sequence: Synthetic oligonucleotide
  Target: ATXN1; (-) strand; PAM type: YTN; PAM sequence: CTA
attgaatactctttatttcc

SEQ ID NO: 226392 - DNA, 20 bp, Artificial Sequence
  Description of Artificial Sequence: Synthetic oligonucleotide
  Target: ATXN1; (-) strand; PAM type: YTN; PAM sequence: TTC
ctaattgaatactctttatt

SEQ ID NO: 226393 - DNA, 20 bp, Artificial Sequence
  Description of Artificial Sequence: Synthetic oligonucleotide
  Target: ATXN1; (-) strand; PAM type: YTN; PAM sequence: TTT
cctaattgaatactctttat

SEQ ID NO: 226394 - DNA, 20 bp, Artificial Sequence
  Description of Artificial Sequence: Synthetic oligonucleotide
  Target: ATXN1; (-) strand; PAM type: YTN; PAM sequence: TTT
tcctaattgaatactcttta

SEQ ID NO: 226395 - DNA, 20 bp, Artificial Sequence
  Description of Artificial Sequence: Synthetic oligonucleotide
  Target: ATXN1; (-) strand; PAM type: YTN; PAM sequence: CTT
ttcctaattgaatactcttt

SEQ ID NO: 226396 - DNA, 20 bp, Artificial Sequence
  Description of Artificial Sequence: Synthetic oligonucleotide
  Target: ATXN1; (-) strand; PAM type: YTN; PAM sequence: CTC
ttttcctaattgaatactct

SEQ ID NO: 226397 - DNA, 20 bp, Artificial Sequence
  Description of Artificial Sequence: Synthetic oligonucleotide
  Target: ATXN1; (-) strand; PAM type: YTN; PAM sequence: TTC
ctcttttcctaattgaatac

SEQ ID NO: 226398 - DNA, 20 bp, Artificial Sequence
  Description of Artificial Sequence: Synthetic oligonucleotide
  Target: ATXN1; (-) strand; PAM type: YTN; PAM sequence: CTT
cctcttttcctaattgaata

SEQ ID NO: 226399 - DNA, 20 bp, Artificial Sequence
  Description of Artificial Sequence: Synthetic oligonucleotide
  Target: ATXN1; (-) strand; PAM type: YTN; PAM sequence: TTG
acttcctcttttcctaattg

SEQ ID NO: 226400 - DNA, 20 bp, Artificial Sequence
  Description of Artificial Sequence: Synthetic oligonucleotide
  Target: ATXN1; (-) strand; PAM type: YTN; PAM sequence: TTT
gacttcctcttttcctaatt

SEQ ID NO: 226401 - DNA, 20 bp, Artificial Sequence
  Description of Artificial Sequence: Synthetic oligonucleotide
  Target: ATXN1; (-) strand; PAM type: YTN; PAM sequence: CTG
caaacagggacaatttgact

SEQ ID NO: 226402 - DNA, 20 bp, Artificial Sequence
  Description of Artificial Sequence: Synthetic oligonucleotide
  Target: ATXN1; (-) strand; PAM type: YTN; PAM sequence: CTA
gatatatgatcatgtcatct

SEQ ID NO: 226403 - DNA, 20 bp, Artificial Sequence
  Description of Artificial Sequence: Synthetic oligonucleotide
  Target: ATXN1; (-) strand; PAM type: YTN; PAM sequence: TTC
tagatatatgatcatgtcat

SEQ ID NO: 226404 - DNA, 20 bp, Artificial Sequence
  Description of Artificial Sequence: Synthetic oligonucleotide
  Target: ATXN1; (-) strand; PAM type: YTN; PAM sequence: TTT
ctagatatatgatcatgtca

SEQ ID NO: 226405 - DNA, 20 bp, Artificial Sequence
  Description of Artificial Sequence: Synthetic oligonucleotide
  Target: ATXN1; (-) strand; PAM type: YTN; PAM sequence: TTT
tctagatatatgatcatgtc

SEQ ID NO: 226406 - DNA, 20 bp, Artificial Sequence
  Description of Artificial Sequence: Synthetic oligonucleotide
  Target: ATXN1; (-) strand; PAM type: YTN; PAM sequence: CTG
agacaatggggttttctaga

SEQ ID NO: 226407 - DNA, 20 bp, Artificial Sequence
  Description of Artificial Sequence: Synthetic oligonucleotide
  Target: ATXN1; (-) strand; PAM type: YTN; PAM sequence: TTG
ggctgagacaatggggtttt

SEQ ID NO: 226408 - DNA, 20 bp, Artificial Sequence
  Description of Artificial Sequence: Synthetic oligonucleotide
  Target: ATXN1; (-) strand; PAM type: YTN; PAM sequence: TTT
gggctgagacaatggggttt

SEQ ID NO: 226409 - DNA, 20 bp, Artificial Sequence
  Description of Artificial Sequence: Synthetic oligonucleotide
  Target: ATXN1; (-) strand; PAM type: YTN; PAM sequence: TTA
aggagatttgggctgagaca

SEQ ID NO: 226410 - DNA, 20 bp, Artificial Sequence
  Description of Artificial Sequence: Synthetic oligonucleotide
  Target: ATXN1; (-) strand; PAM type: YTN; PAM sequence: CTT
aaggagatttgggctgagac

SEQ ID NO: 226411 - DNA, 20 bp, Artificial Sequence
  Description of Artificial Sequence: Synthetic oligonucleotide
  Target: ATXN1; (-) strand; PAM type: YTN; PAM sequence: TTA
tcagcttaaggagatttggg

SEQ ID NO: 226412 - DNA, 20 bp, Artificial Sequence
  Description of Artificial Sequence: Synthetic oligonucleotide
  Target: ATXN1; (-) strand; PAM type: YTN; PAM sequence: CTT
atcagcttaaggagatttgg

SEQ ID NO: 226413 - DNA, 20 bp, Artificial Sequence
  Description of Artificial Sequence: Synthetic oligonucleotide
  Target: ATXN1; (-) strand; PAM type: YTN; PAM sequence: TTG
cttatcagcttaaggagatt

SEQ ID NO: 226414 - DNA, 20 bp, Artificial Sequence
  Description of Artificial Sequence: Synthetic oligonucleotide
  Target: ATXN1; (-) strand; PAM type: YTN; PAM sequence: CTG
acgttgcttatcagcttaag

SEQ ID NO: 226415 - DNA, 20 bp, Artificial Sequence
  Description of Artificial Sequence: Synthetic oligonucleotide
  Target: ATXN1; (-) strand; PAM type: YTN; PAM sequence: TTG
ctgacgttgcttatcagctt

SEQ ID NO: 226416 - DNA, 20 bp, Artificial Sequence
  Description of Artificial Sequence: Synthetic oligonucleotide
  Target: ATXN1; (-) strand; PAM type: YTN; PAM sequence: TTT
gctgacgttgcttatcagct

SEQ ID NO: 226417 - DNA, 20 bp, Artificial Sequence
  Description of Artificial Sequence: Synthetic oligonucleotide
  Target: ATXN1; (-) strand; PAM type: YTN; PAM sequence: CTT
tgctgacgttgcttatcagc

SEQ ID NO: 226418 - DNA, 20 bp, Artificial Sequence
  Description of Artificial Sequence: Synthetic oligonucleotide
  Target: ATXN1; (-) strand; PAM type: YTN; PAM sequence: CTC
agactttgctgacgttgctt

SEQ ID NO: 226419 - DNA, 20 bp, Artificial Sequence
  Description of Artificial Sequence: Synthetic oligonucleotide
  Target: ATXN1; (-) strand; PAM type: YTN; PAM sequence: TTG
tatcctcagactttgctgac

SEQ ID NO: 226420 - DNA, 20 bp, Artificial Sequence
  Description of Artificial Sequence: Synthetic oligonucleotide
  Target: ATXN1; (-) strand; PAM type: YTN; PAM sequence: TTT
gtatcctcagactttgctga

SEQ ID NO: 226421 - DNA, 20 bp, Artificial Sequence
  Description of Artificial Sequence: Synthetic oligonucleotide
  Target: ATXN1; (-) strand; PAM type: YTN; PAM sequence: TTT
tgtatcctcagactttgctg

SEQ ID NO: 226422 - DNA, 20 bp, Artificial Sequence
  Description of Artificial Sequence: Synthetic oligonucleotide
  Target: ATXN1; (-) strand; PAM type: YTN; PAM sequence: TTG
attttgtatcctcagacttt

SEQ ID NO: 226423 - DNA, 20 bp, Artificial Sequence
  Description of Artificial Sequence: Synthetic oligonucleotide
  Target: ATXN1; (-) strand; PAM type: YTN; PAM sequence: TTG
cacattgattttgtatcctc

SEQ ID NO: 226424 - DNA, 20 bp, Artificial Sequence
  Description of Artificial Sequence: Synthetic oligonucleotide
  Target: ATXN1; (-) strand; PAM type: YTN; PAM sequence: TTT
gcacattgattttgtatcct

SEQ ID NO: 226425 - DNA, 20 bp, Artificial Sequence
  Description of Artificial Sequence: Synthetic oligonucleotide
  Target: ATXN1; (-) strand; PAM type: YTN; PAM sequence: TTT
tgcacattgattttgtatcc

SEQ ID NO: 226426 - DNA, 20 bp, Artificial Sequence
  Description of Artificial Sequence: Synthetic oligonucleotide
  Target: ATXN1; (-) strand; PAM type: YTN; PAM sequence: TTT
ttgcacattgattttgtatc

SEQ ID NO: 226427 - DNA, 20 bp, Artificial Sequence
  Description of Artificial Sequence: Synthetic oligonucleotide
  Target: ATXN1; (-) strand; PAM type: YTN; PAM sequence: TTG
tgatttttgcacattgattt

SEQ ID NO: 226428 - DNA, 20 bp, Artificial Sequence
  Description of Artificial Sequence: Synthetic oligonucleotide
  Target: ATXN1; (-) strand; PAM type: YTN; PAM sequence: CTT
gtgatttttgcacattgatt

SEQ ID NO: 226429 - DNA, 20 bp, Artificial Sequence
  Description of Artificial Sequence: Synthetic oligonucleotide
  Target: ATXN1; (-) strand; PAM type: YTN; PAM sequence: TTA
gtggtgtataagaatgcttg

SEQ ID NO: 226430 - DNA, 20 bp, Artificial Sequence
  Description of Artificial Sequence: Synthetic oligonucleotide
  Target: ATXN1; (-) strand; PAM type: YTN; PAM sequence: CTG
ttagtggtgtataagaatgc

SEQ ID NO: 226431 - DNA, 20 bp, Artificial Sequence
  Description of Artificial Sequence: Synthetic oligonucleotide
  Target: ATXN1; (-) strand; PAM type: YTN; PAM sequence: TTG
tctgttagtggtgtataaga

SEQ ID NO: 226432 - DNA, 20 bp, Artificial Sequence
  Description of Artificial Sequence: Synthetic oligonucleotide
  Target: ATXN1; (-) strand; PAM type: YTN; PAM sequence: TTT
gtctgttagtggtgtataag

SEQ ID NO: 226433 - DNA, 20 bp, Artificial Sequence
  Description of Artificial Sequence: Synthetic oligonucleotide
  Target: ATXN1; (-) strand; PAM type: YTN; PAM sequence: CTG
tttgtctgttagtggtgtat

SEQ ID NO: 226434 - DNA, 20 bp, Artificial Sequence
  Description of Artificial Sequence: Synthetic oligonucleotide
  Target: ATXN1; (-) strand; PAM type: YTN; PAM sequence: CTC
tgtttgtctgttagtggtgt

SEQ ID NO: 226435 - DNA, 20 bp, Artificial Sequence
  Description of Artificial Sequence: Synthetic oligonucleotide
  Target: ATXN1; (-) strand; PAM type: YTN; PAM sequence: CTC
tctgtttgtctgttagtggt

SEQ ID NO: 226436 - DNA, 20 bp, Artificial Sequence
  Description of Artificial Sequence: Synthetic oligonucleotide
  Target: ATXN1; (-) strand; PAM type: YTN; PAM sequence: TTG
gctctctgtttgtctgttag

SEQ ID NO: 226437 - DNA, 20 bp, Artificial Sequence
  Description of Artificial Sequence: Synthetic oligonucleotide
  Target: ATXN1; (-) strand; PAM type: YTN; PAM sequence: TTT
ggctctctgtttgtctgtta

SEQ ID NO: 226438 - DNA, 20 bp, Artificial Sequence
  Description of Artificial Sequence: Synthetic oligonucleotide
  Target: ATXN1; (-) strand; PAM type: YTN; PAM sequence: CTC
atgatttggctctctgtttg

SEQ ID NO: 226439 - DNA, 20 bp, Artificial Sequence
  Description of Artificial Sequence: Synthetic oligonucleotide
  Target: ATXN1; (-) strand; PAM type: YTN; PAM sequence: TTG
tgaataggaggtcactcatg

SEQ ID NO: 226440 - DNA, 20 bp, Artificial Sequence
  Description of Artificial Sequence: Synthetic oligonucleotide
  Target: ATXN1; (-) strand; PAM type: YTN; PAM sequence: TTG
aagcagttgtgaataggagg

SEQ ID NO: 226441 - DNA, 20 bp, Artificial Sequence
  Description of Artificial Sequence: Synthetic oligonucleotide
  Target: ATXN1; (-) strand; PAM type: YTN; PAM sequence: TTT
gaagcagttgtgaataggag

SEQ ID NO: 226442 - DNA, 20 bp, Artificial Sequence
  Description of Artificial Sequence: Synthetic oligonucleotide
  Target: ATXN1; (-) strand; PAM type: YTN; PAM sequence: CTT
tgaagcagttgtgaatagga

SEQ ID NO: 226443 - DNA, 20 bp, Artificial Sequence
  Description of Artificial Sequence: Synthetic oligonucleotide
  Target: ATXN1; (-) strand; PAM type: YTN; PAM sequence: CTC
tttgaagcagttgtgaatag

SEQ ID NO: 226444 - DNA, 20 bp, Artificial Sequence
  Description of Artificial Sequence: Synthetic oligonucleotide
  Target: ATXN1; (-) strand; PAM type: YTN; PAM sequence: TTC
tctttgaagcagttgtgaat

SEQ ID NO: 226445 - DNA, 20 bp, Artificial Sequence
  Description of Artificial Sequence: Synthetic oligonucleotide
  Target: ATXN1; (-) strand; PAM type: YTN; PAM sequence: TTA
ttctctttgaagcagttgtg

SEQ ID NO: 226446 - DNA, 20 bp, Artificial Sequence
  Description of Artificial Sequence: Synthetic oligonucleotide
  Target: ATXN1; (-) strand; PAM type: YTN; PAM sequence: TTT
attctctttgaagcagttgt

SEQ ID NO: 226447 - DNA, 20 bp, Artificial Sequence
  Description of Artificial Sequence: Synthetic oligonucleotide
  Target: ATXN1; (-) strand; PAM type: YTN; PAM sequence: TTT
tattctctttgaagcagttg

SEQ ID NO: 226448 - DNA, 20 bp, Artificial Sequence
  Description of Artificial Sequence: Synthetic oligonucleotide
  Target: ATXN1; (-) strand; PAM type: YTN; PAM sequence: CTA
ggtattttattctctttgaa

SEQ ID NO: 226449 - DNA, 20 bp, Artificial Sequence
  Description of Artificial Sequence: Synthetic oligonucleotide
  Target: ATXN1; (-) strand; PAM type: YTN; PAM sequence: TTC
ctaggtattttattctcttt

SEQ ID NO: 226450 - DNA, 20 bp, Artificial Sequence
  Description of Artificial Sequence: Synthetic oligonucleotide
  Target: ATXN1; (-) strand; PAM type: YTN; PAM sequence: TTG
gattcctaggtattttattc

SEQ ID NO: 226451 - DNA, 20 bp, Artificial Sequence
  Description of Artificial Sequence: Synthetic oligonucleotide
  Target: ATXN1; (-) strand; PAM type: YTN; PAM sequence: TTG
taagttggattcctaggtat

SEQ ID NO: 226452 - DNA, 20 bp, Artificial Sequence
  Description of Artificial Sequence: Synthetic oligonucleotide
  Target: ATXN1; (-) strand; PAM type: YTN; PAM sequence: CTT
gtaagttggattcctaggta

SEQ ID NO: 226453 - DNA, 20 bp, Artificial Sequence
  Description of Artificial Sequence: Synthetic oligonucleotide
  Target: ATXN1; (-) strand; PAM type: YTN; PAM sequence: TTC
acatcccttgtaagttggat

SEQ ID NO: 226454 - DNA, 20 bp, Artificial Sequence
  Description of Artificial Sequence: Synthetic oligonucleotide
  Target: ATXN1; (-) strand; PAM type: YTN; PAM sequence: CTT
cacatcccttgtaagttgga

SEQ ID NO: 226455 - DNA, 20 bp, Artificial Sequence
  Description of Artificial Sequence: Synthetic oligonucleotide
  Target: ATXN1; (-) strand; PAM type: YTN; PAM sequence: TTC
ttcacatcccttgtaagttg

SEQ ID NO: 226456 - DNA, 20 bp, Artificial Sequence
  Description of Artificial Sequence: Synthetic oligonucleotide
  Target: ATXN1; (-) strand; PAM type: YTN; PAM sequence: TTG
aaggggttcttcacatccct

SEQ ID NO: 226457 - DNA, 20 bp, Artificial Sequence
  Description of Artificial Sequence: Synthetic oligonucleotide
  Target: ATXN1; (-) strand; PAM type: YTN; PAM sequence: CTT
gaaggggttcttcacatccc

SEQ ID NO: 226458 - DNA, 20 bp, Artificial Sequence
  Description of Artificial Sequence: Synthetic oligonucleotide
  Target: ATXN1; (-) strand; PAM type: YTN; PAM sequence: CTC
cttgaaggggttcttcacat

SEQ ID NO: 226459 - DNA, 20 bp, Artificial Sequence
  Description of Artificial Sequence: Synthetic oligonucleotide
  Target: ATXN1; (-) strand; PAM type: YTN; PAM sequence: TTC
tccttgaaggggttcttcac

SEQ ID NO: 226460 - DNA, 20 bp, Artificial Sequence
  Description of Artificial Sequence: Synthetic oligonucleotide
  Target: ATXN1; (-) strand; PAM type: YTN; PAM sequence: TTG
tagttctccttgaaggggtt

SEQ ID NO: 226461 - DNA, 20 bp, Artificial Sequence
  Description of Artificial Sequence: Synthetic oligonucleotide
  Target: ATXN1; (-) strand; PAM type: YTN; PAM sequence: TTT
gtagttctccttgaaggggt

SEQ ID NO: 226462 - DNA, 20 bp, Artificial Sequence
  Description of Artificial Sequence: Synthetic oligonucleotide
  Target: ATXN1; (-) strand; PAM type: YTN; PAM sequence: TTG
agcagtggtttgtagttctc

SEQ ID NO: 226463 - DNA, 20 bp, Artificial Sequence
  Description of Artificial Sequence: Synthetic oligonucleotide
  Target: ATXN1; (-) strand; PAM type: YTN; PAM sequence: TTC
gttgagcagtggtttgtagt

SEQ ID NO: 226464 - DNA, 20 bp, Artificial Sequence
  Description of Artificial Sequence: Synthetic oligonucleotide
  Target: ATXN1; (-) strand; PAM type: YTN; PAM sequence: TTT
cgttgagcagtggtttgtag

SEQ ID NO: 226465 - DNA, 20 bp, Artificial Sequence
  Description of Artificial Sequence: Synthetic oligonucleotide
  Target: ATXN1; (-) strand; PAM type: YTN; PAM sequence: TTA
tttcgttgagcagtggtttg

SEQ ID NO: 226466 - DNA, 20 bp, Artificial Sequence
  Description of Artificial Sequence: Synthetic oligonucleotide
  Target: ATXN1; (-) strand; PAM type: YTN; PAM sequence: TTT
atttcgttgagcagtggttt

SEQ ID NO: 226467 - DNA, 20 bp, Artificial Sequence
  Description of Artificial Sequence: Synthetic oligonucleotide
  Target: ATXN1; (-) strand; PAM type: YTN; PAM sequence: TTT
tatttcgttgagcagtggtt

SEQ ID NO: 226468 - DNA, 20 bp, Artificial Sequence
  Description of Artificial Sequence: Synthetic oligonucleotide
  Target: ATXN1; (-) strand; PAM type: YTN; PAM sequence: CTT
ttatttcgttgagcagtggt

SEQ ID NO: 226469 - DNA, 20 bp, Artificial Sequence
  Description of Artificial Sequence: Synthetic oligonucleotide
  Target: ATXN1; (-) strand; PAM type: YTN; PAM sequence: CTC
ttttatttcgttgagcagtg

SEQ ID NO: 226470 - DNA, 20 bp, Artificial Sequence
  Description of Artificial Sequence: Synthetic oligonucleotide
  Target: ATXN1; (-) strand; PAM type: YTN; PAM sequence: TTG
tatcctcttttatttcgttg

SEQ ID NO: 226471 - DNA, 20 bp, Artificial Sequence
  Description of Artificial Sequence: Synthetic oligonucleotide
  Target: ATXN1; (-) strand; PAM type: YTN; PAM sequence: TTT
gtatcctcttttatttcgtt

SEQ ID NO: 226472 - DNA, 20 bp, Artificial Sequence
  Description of Artificial Sequence: Synthetic oligonucleotide
  Target: ATXN1; (-) strand; PAM type: YTN; PAM sequence: TTG
tttgtatcctcttttatttc

SEQ ID NO: 226473 - DNA, 20 bp, Artificial Sequence
  Description of Artificial Sequence: Synthetic oligonucleotide
  Target: ATXN1; (-) strand; PAM type: YTN; PAM sequence: TTT
gtttgtatcctcttttattt

SEQ ID NO: 226474 - DNA, 20 bp, Artificial Sequence
  Description of Artificial Sequence: Synthetic oligonucleotide
  Target: ATXN1; (-) strand; PAM type: YTN; PAM sequence: TTC
catttgtttgtatcctcttt

SEQ ID NO: 226475 - DNA, 20 bp, Artificial Sequence
  Description of Artificial Sequence: Synthetic oligonucleotide
  Target: ATXN1; (-) strand; PAM type: YTN; PAM sequence: CTT
ccatttgtttgtatcctctt

SEQ ID NO: 226476 - DNA, 20 bp, Artificial Sequence
  Description of Artificial Sequence: Synthetic oligonucleotide
  Target: ATXN1; (-) strand; PAM type: YTN; PAM sequence: TTC
ttccatttgtttgtatcctc

SEQ ID NO: 226477 - DNA, 20 bp, Artificial Sequence
  Description of Artificial Sequence: Synthetic oligonucleotide
  Target: ATXN1; (-) strand; PAM type: YTN; PAM sequence: TTC
catgagcatggaatgttctt

SEQ ID NO: 226478 - DNA, 20 bp, Artificial Sequence
  Description of Artificial Sequence: Synthetic oligonucleotide
  Target: ATXN1; (-) strand; PAM type: YTN; PAM sequence: TTT
ccatgagcatggaatgttct

SEQ ID NO: 226479 - DNA, 20 bp, Artificial Sequence
  Description of Artificial Sequence: Synthetic oligonucleotide
  Target: ATXN1; (-) strand; PAM type: YTN; PAM sequence: CTT
tccatgagcatggaatgttc

SEQ ID NO: 226480 - DNA, 20 bp, Artificial Sequence
  Description of Artificial Sequence: Synthetic oligonucleotide
  Target: ATXN1; (-) strand; PAM type: YTN; PAM sequence: TTC
ctttccatgagcatggaatg

SEQ ID NO: 226481 - DNA, 20 bp, Artificial Sequence
  Description of Artificial Sequence: Synthetic oligonucleotide
  Target: ATXN1; (-) strand; PAM type: YTN; PAM sequence: CTT
cctttccatgagcatggaat

SEQ ID NO: 226482 - DNA, 20 bp, Artificial Sequence
  Description of Artificial Sequence: Synthetic oligonucleotide
  Target: ATXN1; (-) strand; PAM type: YTN; PAM sequence: TTC
ttcctttccatgagcatgga

SEQ ID NO: 226483 - DNA, 20 bp, Artificial Sequence
  Description of Artificial Sequence: Synthetic oligonucleotide
  Target: ATXN1; (-) strand; PAM type: YTN; PAM sequence: CTT
cttcctttccatgagcatgg

SEQ ID NO: 226484 - DNA, 20 bp, Artificial Sequence
  Description of Artificial Sequence: Synthetic oligonucleotide
  Target: ATXN1; (-) strand; PAM type: YTN; PAM sequence: TTG
cttcttcctttccatgagca

SEQ ID NO: 226485 - DNA, 20 bp, Artificial Sequence
  Description of Artificial Sequence: Synthetic oligonucleotide
  Target: ATXN1; (-) strand; PAM type: YTN; PAM sequence: TTG
acgatattgcttcttccttt

SEQ ID NO: 226486 - DNA, 20 bp, Artificial Sequence
  Description of Artificial Sequence: Synthetic oligonucleotide
  Target: ATXN1; (-) strand; PAM type: YTN; PAM sequence: TTT
gacgatattgcttcttcctt

SEQ ID NO: 226487 - DNA, 20 bp, Artificial Sequence
  Description of Artificial Sequence: Synthetic oligonucleotide
  Target: ATXN1; (-) strand; PAM type: YTN; PAM sequence: TTT
tgacgatattgcttcttcct

SEQ ID NO: 226488 - DNA, 20 bp, Artificial Sequence
  Description of Artificial Sequence: Synthetic oligonucleotide
  Target: ATXN1; (-) strand; PAM type: YTN; PAM sequence: TTG
ggcagtatggccattttgac

SEQ ID NO: 226489 - DNA, 20 bp, Artificial Sequence
  Description of Artificial Sequence: Synthetic oligonucleotide
  Target: ATXN1; (-) strand; PAM type: YTN; PAM sequence: CTT
gggcagtatggccattttga

SEQ ID NO: 226490 - DNA, 20 bp, Artificial Sequence
  Description of Artificial Sequence: Synthetic oligonucleotide
  Target: ATXN1; (-) strand; PAM type: YTN; PAM sequence: TTA
ccttgggcagtatggccatt

SEQ ID NO: 226491 - DNA, 20 bp, Artificial Sequence
  Description of Artificial Sequence: Synthetic oligonucleotide
  Target: ATXN1; (-) strand; PAM type: YTN; PAM sequence: CTA
taaattaccttgggcagtat

SEQ ID NO: 226492 - DNA, 20 bp, Artificial Sequence
  Description of Artificial Sequence: Synthetic oligonucleotide
  Target: ATXN1; (-) strand; PAM type: YTN; PAM sequence: TTG
aatctataaattaccttggg

SEQ ID NO: 226493 - DNA, 20 bp, Artificial Sequence
  Description of Artificial Sequence: Synthetic oligonucleotide
  Target: ATXN1; (-) strand; PAM type: YTN; PAM sequence: TTG
atggggatggcattgaatct

SEQ ID NO: 226494 - DNA, 20 bp, Artificial Sequence
  Description of Artificial Sequence: Synthetic oligonucleotide
  Target: ATXN1; (-) strand; PAM type: YTN; PAM sequence: CTT
gatggggatggcattgaatc

SEQ ID NO: 226495 - DNA, 20 bp, Artificial Sequence
  Description of Artificial Sequence: Synthetic oligonucleotide
  Target: ATXN1; (-) strand; PAM type: YTN; PAM sequence: TTG
gtagcttgatggggatggca

SEQ ID NO: 226496 - DNA, 20 bp, Artificial Sequence
  Description of Artificial Sequence: Synthetic oligonucleotide
  Target: ATXN1; (-) strand; PAM type: YTN; PAM sequence: CTG
tgaagaaagtcattggtagc

SEQ ID NO: 226497 - DNA, 20 bp, Artificial Sequence
  Description of Artificial Sequence: Synthetic oligonucleotide
  Target: ATXN1; (-) strand; PAM type: YTN; PAM sequence: TTC
tgtgaagaaagtcattggta

SEQ ID NO: 226498 - DNA, 20 bp, Artificial Sequence
  Description of Artificial Sequence: Synthetic oligonucleotide
  Target: ATXN1; (-) strand; PAM type: YTN; PAM sequence: TTC
caattctgtgaagaaagtca

SEQ ID NO: 226499 - DNA, 20 bp, Artificial Sequence
  Description of Artificial Sequence: Synthetic oligonucleotide
  Target: ATXN1; (-) strand; PAM type: YTN; PAM sequence: TTT
ccaattctgtgaagaaagtc

SEQ ID NO: 226500 - DNA, 20 bp, Artificial Sequence
  Description of Artificial Sequence: Synthetic oligonucleotide
  Target: ATXN1; (-) strand; PAM type: YTN; PAM sequence: TTT
tccaattctgtgaagaaagt

SEQ ID NO: 226501 - DNA, 20 bp, Artificial Sequence
  Description of Artificial Sequence: Synthetic oligonucleotide
  Target: ATXN1; (-) strand; PAM type: YTN; PAM sequence: TTT
ttccaattctgtgaagaaag

SEQ ID NO: 226502 - DNA, 20 bp, Artificial Sequence
  Description of Artificial Sequence: Synthetic oligonucleotide
  Target: ATXN1; (-) strand; PAM type: YTN; PAM sequence: TTT
tttccaattctgtgaagaaa

SEQ ID NO: 226503 - DNA, 20 bp, Artificial Sequence
  Description of Artificial Sequence: Synthetic oligonucleotide
  Target: ATXN1; (-) strand; PAM type: YTN; PAM sequence: TTA
aagtagttttttccaattct

SEQ ID NO: 226504 - DNA, 20 bp, Artificial Sequence
  Description of Artificial Sequence: Synthetic oligonucleotide
  Target: ATXN1; (-) strand; PAM type: YTN; PAM sequence: TTT
aaagtagttttttccaattc

SEQ ID NO: 226505 - DNA, 20 bp, Artificial Sequence
  Description of Artificial Sequence: Synthetic oligonucleotide
  Target: ATXN1; (-) strand; PAM type: YTN; PAM sequence: CTT
taaagtagttttttccaatt

SEQ ID NO: 226506 - DNA, 20 bp, Artificial Sequence
  Description of Artificial Sequence: Synthetic oligonucleotide
  Target: ATXN1; (-) strand; PAM type: YTN; PAM sequence: TTC
catatgaactttaaagtagt

SEQ ID NO: 226507 - DNA, 20 bp, Artificial Sequence
  Description of Artificial Sequence: Synthetic oligonucleotide
  Target: ATXN1; (-) strand; PAM type: YTN; PAM sequence: TTG
gttccatatgaactttaaag

SEQ ID NO: 226508 - DNA, 20 bp, Artificial Sequence
  Description of Artificial Sequence: Synthetic oligonucleotide
  Target: ATXN1; (-) strand; PAM type: YTN; PAM sequence: TTT
ggttccatatgaactttaaa

SEQ ID NO: 226509 - DNA, 20 bp, Artificial Sequence
  Description of Artificial Sequence: Synthetic oligonucleotide
  Target: ATXN1; (-) strand; PAM type: YTN; PAM sequence: TTT
tggttccatatgaactttaa

SEQ ID NO: 226510 - DNA, 20 bp, Artificial Sequence
  Description of Artificial Sequence: Synthetic oligonucleotide
  Target: ATXN1; (-) strand; PAM type: YTN; PAM sequence: TTT
ttggttccatatgaacttta

SEQ ID NO: 226511 - DNA, 20 bp, Artificial Sequence
  Description of Artificial Sequence: Synthetic oligonucleotide
  Target: ATXN1; (-) strand; PAM type: YTN; PAM sequence: TTT
tttggttccatatgaacttt

SEQ ID NO: 226512 - DNA, 20 bp, Artificial Sequence
  Description of Artificial Sequence: Synthetic oligonucleotide
  Target: ATXN1; (-) strand; PAM type: YTN; PAM sequence: CTT
ttttggttccatatgaactt

SEQ ID NO: 226513 - DNA, 20 bp, Artificial Sequence
  Description of Artificial Sequence: Synthetic oligonucleotide
  Target: ATXN1; (-) strand; PAM type: YTN; PAM sequence: CTC
ttttttggttccatatgaac

SEQ ID NO: 226514 - DNA, 20 bp, Artificial Sequence
  Description of Artificial Sequence: Synthetic oligonucleotide
  Target: ATXN1; (-) strand; PAM type: YTN; PAM sequence: TTG
gcaatgtgggctcttttttg

SEQ ID NO: 226515 - DNA, 20 bp, Artificial Sequence
  Description of Artificial Sequence: Synthetic oligonucleotide
  Target: ATXN1; (-) strand; PAM type: YTN; PAM sequence: CTT
ggcaatgtgggctctttttt

SEQ ID NO: 226516 - DNA, 20 bp, Artificial Sequence
  Description of Artificial Sequence: Synthetic oligonucleotide
  Target: ATXN1; (-) strand; PAM type: YTN; PAM sequence: TTG
acttggcaatgtgggctctt

SEQ ID NO: 226517 - DNA, 20 bp, Artificial Sequence
  Description of Artificial Sequence: Synthetic oligonucleotide
  Target: ATXN1; (-) strand; PAM type: YTN; PAM sequence: TTA
ggattgacttggcaatgtgg

SEQ ID NO: 226518 - DNA, 20 bp, Artificial Sequence
  Description of Artificial Sequence: Synthetic oligonucleotide
  Target: ATXN1; (-) strand; PAM type: YTN; PAM sequence: CTT
aggattgacttggcaatgtg

SEQ ID NO: 226519 - DNA, 20 bp, Artificial Sequence
  Description of Artificial Sequence: Synthetic oligonucleotide
  Target: ATXN1; (-) strand; PAM type: YTN; PAM sequence: TTG
gcttaggattgacttggcaa

SEQ ID NO: 226520 - DNA, 20 bp, Artificial Sequence
  Description of Artificial Sequence: Synthetic oligonucleotide
  Target: ATXN1; (-) strand; PAM type: YTN; PAM sequence: TTT
ggcttaggattgacttggca

SEQ ID NO: 226521 - DNA, 20 bp, Artificial Sequence
  Description of Artificial Sequence: Synthetic oligonucleotide
  Target: ATXN1; (-) strand; PAM type: YTN; PAM sequence: TTT
tggcttaggattgacttggc

SEQ ID NO: 226522 - DNA, 20 bp, Artificial Sequence
  Description of Artificial Sequence: Synthetic oligonucleotide
  Target: ATXN1; (-) strand; PAM type: YTN; PAM sequence: CTT
ttggcttaggattgacttgg

SEQ ID NO: 226523 - DNA, 20 bp, Artificial Sequence
  Description of Artificial Sequence: Synthetic oligonucleotide
  Target: ATXN1; (-) strand; PAM type: YTN; PAM sequence: TTC
ttttggcttaggattgactt

SEQ ID NO: 226524 - DNA, 20 bp, Artificial Sequence
  Description of Artificial Sequence: Synthetic oligonucleotide
  Target: ATXN1; (-) strand; PAM type: YTN; PAM sequence: TTG
ttcttttggcttaggattga

SEQ ID NO: 226525 - DNA, 20 bp, Artificial Sequence
  Description of Artificial Sequence: Synthetic oligonucleotide
  Target: ATXN1; (-) strand; PAM type: YTN; PAM sequence: TTT
gttcttttggcttaggattg

SEQ ID NO: 226526 - DNA, 20 bp, Artificial Sequence
  Description of Artificial Sequence: Synthetic oligonucleotide
  Target: ATXN1; (-) strand; PAM type: YTN; PAM sequence: CTT
tgttcttttggcttaggatt

SEQ ID NO: 226527 - DNA, 20 bp, Artificial Sequence
  Description of Artificial Sequence: Synthetic oligonucleotide
  Target: ATXN1; (-) strand; PAM type: YTN; PAM sequence: CTC
cagctttgttcttttggctt

SEQ ID NO: 226528 - DNA, 20 bp, Artificial Sequence
  Description of Artificial Sequence: Synthetic oligonucleotide
  Target: ATXN1; (-) strand; PAM type: YTN; PAM sequence: TTG
aagtcaggtagtgtgatgcc

SEQ ID NO: 226529 - DNA, 20 bp, Artificial Sequence
  Description of Artificial Sequence: Synthetic oligonucleotide
  Target: ATXN1; (-) strand; PAM type: YTN; PAM sequence: TTT
gaagtcaggtagtgtgatgc

SEQ ID NO: 226530 - DNA, 20 bp, Artificial Sequence
  Description of Artificial Sequence: Synthetic oligonucleotide
  Target: ATXN1; (-) strand; PAM type: YTN; PAM sequence: TTG
tagtatagtttgaagtcagg

SEQ ID NO: 226531 - DNA, 20 bp, Artificial Sequence
  Description of Artificial Sequence: Synthetic oligonucleotide
  Target: ATXN1; (-) strand; PAM type: YTN; PAM sequence: CTT
gtagtatagtttgaagtcag

SEQ ID NO: 226532 - DNA, 20 bp, Artificial Sequence
  Description of Artificial Sequence: Synthetic oligonucleotide
  Target: ATXN1; (-) strand; PAM type: YTN; PAM sequence: CTG
tagccttgtagtatagtttg

SEQ ID NO: 226533 - DNA, 20 bp, Artificial Sequence
  Description of Artificial Sequence: Synthetic oligonucleotide
  Target: ATXN1; (-) strand; PAM type: YTN; PAM sequence: TTA
ctgtagccttgtagtatagt

SEQ ID NO: 226534 - DNA, 20 bp, Artificial Sequence
  Description of Artificial Sequence: Synthetic oligonucleotide
  Target: ATXN1; (-) strand; PAM type: YTN; PAM sequence: TTG
attactgtagccttgtagta

SEQ ID NO: 226535 - DNA, 20 bp, Artificial Sequence
  Description of Artificial Sequence: Synthetic oligonucleotide
  Target: ATXN1; (-) strand; PAM type: YTN; PAM sequence: TTT
gattactgtagccttgtagt

SEQ ID NO: 226536 - DNA, 20 bp, Artificial Sequence
  Description of Artificial Sequence: Synthetic oligonucleotide
  Target: ATXN1; (-) strand; PAM type: YTN; PAM sequence: TTT
tgattactgtagccttgtag

SEQ ID NO: 226537 - DNA, 20 bp, Artificial Sequence
  Description of Artificial Sequence: Synthetic oligonucleotide
  Target: ATXN1; (-) strand; PAM type: YTN; PAM sequence: CTG
ttttgattactgtagccttg

SEQ ID NO: 226538 - DNA, 20 bp, Artificial Sequence
  Description of Artificial Sequence: Synthetic oligonucleotide
  Target: ATXN1; (-) strand; PAM type: YTN; PAM sequence: TTG
gtaccagtaccatgctgttt

SEQ ID NO: 226539 - DNA, 20 bp, Artificial Sequence
  Description of Artificial Sequence: Synthetic oligonucleotide
  Target: ATXN1; (-) strand; PAM type: YTN; PAM sequence: TTT
ggtaccagtaccatgctgtt

SEQ ID NO: 226540 - DNA, 20 bp, Artificial Sequence
  Description of Artificial Sequence: Synthetic oligonucleotide
  Target: ATXN1; (-) strand; PAM type: YTN; PAM sequence: TTT
tggtaccagtaccatgctgt

SEQ ID NO: 226541 - DNA, 20 bp, Artificial Sequence
  Description of Artificial Sequence: Synthetic oligonucleotide
  Target: ATXN1; (-) strand; PAM type: YTN; PAM sequence: CTG
ttttggtaccagtaccatgc

SEQ ID NO: 226542 - DNA, 20 bp, Artificial Sequence
  Description of Artificial Sequence: Synthetic oligonucleotide
  Target: ATXN1; (-) strand; PAM type: YTN; PAM sequence: CTC
tgttttggtaccagtaccat

SEQ ID NO: 226543 - DNA, 20 bp, Artificial Sequence
  Description of Artificial Sequence: Synthetic oligonucleotide
  Target: ATXN1; (-) strand; PAM type: YTN; PAM sequence: CTA
tatctctgttttggtaccag

SEQ ID NO: 226544 - DNA, 20 bp, Artificial Sequence
  Description of Artificial Sequence: Synthetic oligonucleotide
  Target: ATXN1; (-) strand; PAM type: YTN; PAM sequence: TTG
gtctatatctctgttttggt

SEQ ID NO: 226545 - DNA, 20 bp, Artificial Sequence
  Description of Artificial Sequence: Synthetic oligonucleotide
  Target: ATXN1; (-) strand; PAM type: YTN; PAM sequence: TTC
cattggtctatatctctgtt

SEQ ID NO: 226546 - DNA, 20 bp, Artificial Sequence
  Description of Artificial Sequence: Synthetic oligonucleotide
  Target: ATXN1; (-) strand; PAM type: YTN; PAM sequence: CTG
ttccattggtctatatctct

SEQ ID NO: 226547 - DNA, 20 bp, Artificial Sequence
  Description of Artificial Sequence: Synthetic oligonucleotide
  Target: ATXN1; (-) strand; PAM type: YTN; PAM sequence: TTC
tgttccattggtctatatct

SEQ ID NO: 226548 - DNA, 20 bp, Artificial Sequence
  Description of Artificial Sequence: Synthetic oligonucleotide
  Target: ATXN1; (-) strand; PAM type: YTN; PAM sequence: CTG
ttctgttccattggtctata

SEQ ID NO: 226549 - DNA, 20 bp, Artificial Sequence
  Description of Artificial Sequence: Synthetic oligonucleotide
  Target: ATXN1; (-) strand; PAM type: YTN; PAM sequence: CTC
tgttctgttccattggtcta

SEQ ID NO: 226550 - DNA, 20 bp, Artificial Sequence
  Description of Artificial Sequence: Synthetic oligonucleotide
  Target: ATXN1; (-) strand; PAM type: YTN; PAM sequence: CTG
agggctctgttctgttccat

SEQ ID NO: 226551 - DNA, 20 bp, Artificial Sequence
  Description of Artificial Sequence: Synthetic oligonucleotide
  Target: ATXN1; (-) strand; PAM type: YTN; PAM sequence: TTC
tgagggctctgttctgttcc

SEQ ID NO: 226552 - DNA, 20 bp, Artificial Sequence
  Description of Artificial Sequence: Synthetic oligonucleotide
  Target: ATXN1; (-) strand; PAM type: YTN; PAM sequence: TTT
ctgagggctctgttctgttc

SEQ ID NO: 226553 - DNA, 20 bp, Artificial Sequence
  Description of Artificial Sequence: Synthetic oligonucleotide
  Target: ATXN1; (-) strand; PAM type: YTN; PAM sequence: TTA
tttctgagggctctgttctg

SEQ ID NO: 226554 - DNA, 20 bp, Artificial Sequence
  Description of Artificial Sequence: Synthetic oligonucleotide
  Target: ATXN1; (-) strand; PAM type: YTN; PAM sequence: TTG
tagatgtgtggcattatttc

SEQ ID NO: 226555 - DNA, 20 bp, Artificial Sequence
  Description of Artificial Sequence: Synthetic oligonucleotide
  Target: ATXN1; (-) strand; PAM type: YTN; PAM sequence: TTG
tcaaagatcggatagttgta

SEQ ID NO: 226556 - DNA, 20 bp, Artificial Sequence
  Description of Artificial Sequence: Synthetic oligonucleotide
  Target: ATXN1; (-) strand; PAM type: YTN; PAM sequence: TTT
gtcaaagatcggatagttgt

SEQ ID NO: 226557 - DNA, 20 bp, Artificial Sequence
  Description of Artificial Sequence: Synthetic oligonucleotide
  Target: ATXN1; (-) strand; PAM type: YTN; PAM sequence: TTG
tcaggtttgtcaaagatcgg

SEQ ID NO: 226558 - DNA, 20 bp, Artificial Sequence
  Description of Artificial Sequence: Synthetic oligonucleotide
  Target: ATXN1; (-) strand; PAM type: YTN; PAM sequence: TTT
gtcaggtttgtcaaagatcg

SEQ ID NO: 226559 - DNA, 20 bp, Artificial Sequence
  Description of Artificial Sequence: Synthetic oligonucleotide
  Target: ATXN1; (-) strand; PAM type: YTN; PAM sequence: TTT
tgtcaggtttgtcaaagatc

SEQ ID NO: 226560 - DNA, 20 bp, Artificial Sequence
  Description of Artificial Sequence: Synthetic oligonucleotide
  Target: ATXN1; (-) strand; PAM type: YTN; PAM sequence: TTT
ttgtcaggtttgtcaaagat

SEQ ID NO: 226561 - DNA, 20 bp, Artificial Sequence
  Description of Artificial Sequence: Synthetic oligonucleotide
  Target: ATXN1; (-) strand; PAM type: YTN; PAM sequence: TTG
tttttgtcaggtttgtcaaa

SEQ ID NO: 226562 - DNA, 20 bp, Artificial Sequence
  Description of Artificial Sequence: Synthetic oligonucleotide
  Target: ATXN1; (-) strand; PAM type: YTN; PAM sequence: CTT
gtttttgtcaggtttgtcaa

SEQ ID NO: 226563 - DNA, 20 bp, Artificial Sequence
  Description of Artificial Sequence: Synthetic oligonucleotide
  Target: ATXN1; (-) strand; PAM type: YTN; PAM sequence: TTC
ttgtttttgtcaggtttgtc

SEQ ID NO: 226564 - DNA, 20 bp, Artificial Sequence
  Description of Artificial Sequence: Synthetic oligonucleotide
  Target: ATXN1; (-) strand; PAM type: YTN; PAM sequence: TTT
cttgtttttgtcaggtttgt

SEQ ID NO: 226565 - DNA, 20 bp, Artificial Sequence
  Description of Artificial Sequence: Synthetic oligonucleotide
  Target: ATXN1; (-) strand; PAM type: YTN; PAM sequence: TTC
cccatttcttgtttttgtca

SEQ ID NO: 226566 - DNA, 20 bp, Artificial Sequence
  Description of Artificial Sequence: Synthetic oligonucleotide
  Target: ATXN1; (-) strand; PAM type: YTN; PAM sequence: TTT
ccccatttcttgtttttgtc

SEQ ID NO: 226567 - DNA, 20 bp, Artificial Sequence
  Description of Artificial Sequence: Synthetic oligonucleotide
  Target: ATXN1; (-) strand; PAM type: YTN; PAM sequence: CTT
tccccatttcttgtttttgt

SEQ ID NO: 226568 - DNA, 20 bp, Artificial Sequence
  Description of Artificial Sequence: Synthetic oligonucleotide
  Target: ATXN1; (-) strand; PAM type: YTN; PAM sequence: TTA
aatagggaatcctttcccca

SEQ ID NO: 226569 - DNA, 20 bp, Artificial Sequence
  Description of Artificial Sequence: Synthetic oligonucleotide
  Target: ATXN1; (-) strand; PAM type: YTN; PAM sequence: TTA
ttaaatagggaatcctttcc

SEQ ID NO: 226570 - DNA, 20 bp, Artificial Sequence
  Description of Artificial Sequence: Synthetic oligonucleotide
  Target: ATXN1; (-) strand; PAM type: YTN; PAM sequence: TTT
attaaatagggaatcctttc

SEQ ID NO: 226571 - DNA, 20 bp, Artificial Sequence
  Description of Artificial Sequence: Synthetic oligonucleotide
  Target: ATXN1; (-) strand; PAM type: YTN; PAM sequence: TTC
ccagcaccatttattaaata

SEQ ID NO: 226572 - DNA, 20 bp, Artificial Sequence
  Description of Artificial Sequence: Synthetic oligonucleotide
  Target: ATXN1; (-) strand; PAM type: YTN; PAM sequence: TTT
cccagcaccatttattaaat

SEQ ID NO: 226573 - DNA, 20 bp, Artificial Sequence
  Description of Artificial Sequence: Synthetic oligonucleotide
  Target: ATXN1; (-) strand; PAM type: YTN; PAM sequence: TTT
tcccagcaccatttattaaa

SEQ ID NO: 226574 - DNA, 20 bp, Artificial Sequence
  Description of Artificial Sequence: Synthetic oligonucleotide
  Target: ATXN1; (-) strand; PAM type: YTN; PAM sequence: CTA
gccagttttcccagcaccat

SEQ ID NO: 226575 - DNA, 20 bp, Artificial Sequence
  Description of Artificial Sequence: Synthetic oligonucleotide
  Target: ATXN1; (-) strand; PAM type: YTN; PAM sequence: CTA
catatggctagccagttttc

SEQ ID NO: 226576 - DNA, 20 bp, Artificial Sequence
  Description of Artificial Sequence: Synthetic oligonucleotide
  Target: ATXN1; (-) strand; PAM type: YTN; PAM sequence: TTC
tacatatggctagccagttt

SEQ ID NO: 226577 - DNA, 20 bp, Artificial Sequence
  Description of Artificial Sequence: Synthetic oligonucleotide
  Target: ATXN1; (-) strand; PAM type: YTN; PAM sequence: TTT
ctacatatggctagccagtt

SEQ ID NO: 226578 - DNA, 20 bp, Artificial Sequence
  Description of Artificial Sequence: Synthetic oligonucleotide
  Target: ATXN1; (-) strand; PAM type: YTN; PAM sequence: CTT
tctacatatggctagccagt

SEQ ID NO: 226579 - DNA, 20 bp, Artificial Sequence
  Description of Artificial Sequence: Synthetic oligonucleotide
  Target: ATXN1; (-) strand; PAM type: YTN; PAM sequence: TTC
ggctttctacatatggctag

SEQ ID NO: 226580 - DNA, 20 bp, Artificial Sequence
  Description of Artificial Sequence: Synthetic oligonucleotide
  Target: ATXN1; (-) strand; PAM type: YTN; PAM sequence: TTT
cggctttctacatatggcta

SEQ ID NO: 226581 - DNA, 20 bp, Artificial Sequence
  Description of Artificial Sequence: Synthetic oligonucleotide
  Target: ATXN1; (-) strand; PAM type: YTN; PAM sequence: TTC
agtttcggctttctacatat

SEQ ID NO: 226582 - DNA, 20 bp, Artificial Sequence
  Description of Artificial Sequence: Synthetic oligonucleotide
  Target: ATXN1; (-) strand; PAM type: YTN; PAM sequence: TTG
tataaggtgtaaggaagggg

SEQ ID NO: 226583 - DNA, 20 bp, Artificial Sequence
  Description of Artificial Sequence: Synthetic oligonucleotide
  Target: ATXN1; (-) strand; PAM type: YTN; PAM sequence: TTT
gtataaggtgtaaggaaggg

SEQ ID NO: 226584 - DNA, 20 bp, Artificial Sequence
  Description of Artificial Sequence: Synthetic oligonucleotide
  Target: ATXN1; (-) strand; PAM type: YTN; PAM sequence: TTT
tgtataaggtgtaaggaagg

SEQ ID NO: 226585 - DNA, 20 bp, Artificial Sequence
  Description of Artificial Sequence: Synthetic oligonucleotide
  Target: ATXN1; (-) strand; PAM type: YTN; PAM sequence: TTT
ttgtataaggtgtaaggaag

SEQ ID NO: 226586 - DNA, 20 bp, Artificial Sequence
  Description of Artificial Sequence: Synthetic oligonucleotide
  Target: ATXN1; (-) strand; PAM type: YTN; PAM sequence: TTA
atttttgtataaggtgtaag

SEQ ID NO: 226587 - DNA, 20 bp, Artificial Sequence
  Description of Artificial Sequence: Synthetic oligonucleotide
  Target: ATXN1; (-) strand; PAM type: YTN; PAM sequence: TTG
aattaatttttgtataaggt

SEQ ID NO: 226588 - DNA, 20 bp, Artificial Sequence
  Description of Artificial Sequence: Synthetic oligonucleotide
  Target: ATXN1; (-) strand; PAM type: YTN; PAM sequence: CTT
gaattaatttttgtataagg

SEQ ID NO: 226589 - DNA, 20 bp, Artificial Sequence
  Description of Artificial Sequence: Synthetic oligonucleotide
  Target: ATXN1; (-) strand; PAM type: YTN; PAM sequence: TTA
atccatcttgaattaatttt

SEQ ID NO: 226590 - DNA, 20 bp, Artificial Sequence
  Description of Artificial Sequence: Synthetic oligonucleotide
  Target: ATXN1; (-) strand; PAM type: YTN; PAM sequence: TTT
aatccatcttgaattaattt

SEQ ID NO: 226591 - DNA, 20 bp, Artificial Sequence
  Description of Artificial Sequence: Synthetic oligonucleotide
  Target: ATXN1; (-) strand; PAM type: YTN; PAM sequence: CTT
taatccatcttgaattaatt

SEQ ID NO: 226592 - DNA, 20 bp, Artificial Sequence
  Description of Artificial Sequence: Synthetic oligonucleotide
  Target: ATXN1; (-) strand; PAM type: YTN; PAM sequence: TTA
agtctttaatccatcttgaa

SEQ ID NO: 226593 - DNA, 20 bp, Artificial Sequence
  Description of Artificial Sequence: Synthetic oligonucleotide
  Target: ATXN1; (-) strand; PAM type: YTN; PAM sequence: TTT
aagtctttaatccatcttga

SEQ ID NO: 226594 - DNA, 20 bp, Artificial Sequence
  Description of Artificial Sequence: Synthetic oligonucleotide
  Target: ATXN1; (-) strand; PAM type: YTN; PAM sequence: CTA
acatttaagtctttaatcca

SEQ ID NO: 226595 - DNA, 20 bp, Artificial Sequence
  Description of Artificial Sequence: Synthetic oligonucleotide
  Target: ATXN1; (-) strand; PAM type: YTN; PAM sequence: TTA
ggtctaacatttaagtcttt

SEQ ID NO: 226596 - DNA, 20 bp, Artificial Sequence
  Description of Artificial Sequence: Synthetic oligonucleotide
  Target: ATXN1; (-) strand; PAM type: YTN; PAM sequence: TTT
aggtctaacatttaagtctt

SEQ ID NO: 226597 - DNA, 20 bp, Artificial Sequence
  Description of Artificial Sequence: Synthetic oligonucleotide
  Target: ATXN1; (-) strand; PAM type: YTN; PAM sequence: TTT
taggtctaacatttaagtct

SEQ ID NO: 226598 - DNA, 20 bp, Artificial Sequence
  Description of Artificial Sequence: Synthetic oligonucleotide
  Target: ATXN1; (-) strand; PAM type: YTN; PAM sequence: TTA
tggttttaggtctaacattt

SEQ ID NO: 226599 - DNA, 20 bp, Artificial Sequence
  Description of Artificial Sequence: Synthetic oligonucleotide
  Target: ATXN1; (-) strand; PAM type: YTN; PAM sequence: TTT
atggttttaggtctaacatt

SEQ ID NO: 226600 - DNA, 20 bp, Artificial Sequence
  Description of Artificial Sequence: Synthetic oligonucleotide
  Target: ATXN1; (-) strand; PAM type: YTN; PAM sequence: TTT
tatggttttaggtctaacat

SEQ ID NO: 226601 - DNA, 20 bp, Artificial Sequence
  Description of Artificial Sequence: Synthetic oligonucleotide
  Target: ATXN1; (-) strand; PAM type: YTN; PAM sequence: TTT
ttatggttttaggtctaaca

SEQ ID NO: 226602 - DNA, 20 bp, Artificial Sequence
  Description of Artificial Sequence: Synthetic oligonucleotide
  Target: ATXN1; (-) strand; PAM type: YTN; PAM sequence: CTA
gggtttttatggttttaggt

SEQ ID NO: 226603 - DNA, 20 bp, Artificial Sequence
  Description of Artificial Sequence: Synthetic oligonucleotide
  Target: ATXN1; (-) strand; PAM type: YTN; PAM sequence: TTC
tagggtttttatggttttag

SEQ ID NO: 226604 - DNA, 20 bp, Artificial Sequence
  Description of Artificial Sequence: Synthetic oligonucleotide
  Target: ATXN1; (-) strand; PAM type: YTN; PAM sequence: CTT
ctagggtttttatggtttta

SEQ ID NO: 226605 - DNA, 20 bp, Artificial Sequence
  Description of Artificial Sequence: Synthetic oligonucleotide
  Target: ATXN1; (-) strand; PAM type: YTN; PAM sequence: TTC
ttctagggtttttatggttt

SEQ ID NO: 226606 - DNA, 20 bp, Artificial Sequence
  Description of Artificial Sequence: Synthetic oligonucleotide
  Target: ATXN1; (-) strand; PAM type: YTN; PAM sequence: TTT
cttctagggtttttatggtt

SEQ ID NO: 226607 - DNA, 20 bp, Artificial Sequence
  Description of Artificial Sequence: Synthetic oligonucleotide
  Target: ATXN1; (-) strand; PAM type: YTN; PAM sequence: TTT
tcttctagggtttttatggt

SEQ ID NO: 226608 - DNA, 20 bp, Artificial Sequence
  Description of Artificial Sequence: Synthetic oligonucleotide
  Target: ATXN1; (-) strand; PAM type: YTN; PAM sequence: CTA
ggttttcttctagggttttt

SEQ ID NO: 226609 - DNA, 20 bp, Artificial Sequence
  Description of Artificial Sequence: Synthetic oligonucleotide
  Target: ATXN1; (-) strand; PAM type: YTN; PAM sequence: TTG
cctaggttttcttctagggt

SEQ ID NO: 226610 - DNA, 20 bp, Artificial Sequence
  Description of Artificial Sequence: Synthetic oligonucleotide
  Target: ATXN1; (-) strand; PAM type: YTN; PAM sequence: CTG
aatggtattgcctaggtttt

SEQ ID NO: 226611 - DNA, 20 bp, Artificial Sequence
  Description of Artificial Sequence: Synthetic oligonucleotide
  Target: ATXN1; (-) strand; PAM type: YTN; PAM sequence: CTA
tgtcctgaatggtattgcct

SEQ ID NO: 226612 - DNA, 20 bp, Artificial Sequence
  Description of Artificial Sequence: Synthetic oligonucleotide
  Target: ATXN1; (-) strand; PAM type: YTN; PAM sequence: TTG
cccatgcctatgtcctgaat

SEQ ID NO: 226613 - DNA, 20 bp, Artificial Sequence
  Description of Artificial Sequence: Synthetic oligonucleotide
  Target: ATXN1; (-) strand; PAM type: YTN; PAM sequence: TTA
gacatgaagtcgttgcccat

SEQ ID NO: 226614 - DNA, 20 bp, Artificial Sequence
  Description of Artificial Sequence: Synthetic oligonucleotide
  Target: ATXN1; (-) strand; PAM type: YTN; PAM sequence: TTT
agacatgaagtcgttgccca

SEQ ID NO: 226615 - DNA, 20 bp, Artificial Sequence
  Description of Artificial Sequence: Synthetic oligonucleotide
  Target: ATXN1; (-) strand; PAM type: YTN; PAM sequence: TTT
tagacatgaagtcgttgccc

SEQ ID NO: 226616 - DNA, 20 bp, Artificial Sequence
  Description of Artificial Sequence: Synthetic oligonucleotide
  Target: ATXN1; (-) strand; PAM type: YTN; PAM sequence: TTG
gtgttttagacatgaagtcg

SEQ ID NO: 226617 - DNA, 20 bp, Artificial Sequence
  Description of Artificial Sequence: Synthetic oligonucleotide
  Target: ATXN1; (-) strand; PAM type: YTN; PAM sequence: TTT
ggtgttttagacatgaagtc

SEQ ID NO: 226618 - DNA, 20 bp, Artificial Sequence
  Description of Artificial Sequence: Synthetic oligonucleotide
  Target: ATXN1; (-) strand; PAM type: YTN; PAM sequence: TTT
tggtgttttagacatgaagt

SEQ ID NO: 226619 - DNA, 20 bp, Artificial Sequence
  Description of Artificial Sequence: Synthetic oligonucleotide
  Target: ATXN1; (-) strand; PAM type: YTN; PAM sequence: CTT
ttggtgttttagacatgaag

SEQ ID NO: 226620 - DNA, 20 bp, Artificial Sequence
  Description of Artificial Sequence: Synthetic oligonucleotide
  Target: ATXN1; (-) strand; PAM type: YTN; PAM sequence: TTG
cttttggtgttttagacatg

SEQ ID NO: 226621 - DNA, 20 bp, Artificial Sequence
  Description of Artificial Sequence: Synthetic oligonucleotide
  Target: ATXN1; (-) strand; PAM type: YTN; PAM sequence: TTG
ccattgcttttggtgtttta

SEQ ID NO: 226622 - DNA, 20 bp, Artificial Sequence
  Description of Artificial Sequence: Synthetic oligonucleotide
  Target: ATXN1; (-) strand; PAM type: YTN; PAM sequence: TTG
ttgccattgcttttggtgtt

SEQ ID NO: 226623 - DNA, 20 bp, Artificial Sequence
  Description of Artificial Sequence: Synthetic oligonucleotide
  Target: ATXN1; (-) strand; PAM type: YTN; PAM sequence: TTT
gttgccattgcttttggtgt

SEQ ID NO: 226624 - DNA, 20 bp, Artificial Sequence
  Description of Artificial Sequence: Synthetic oligonucleotide
  Target: ATXN1; (-) strand; PAM type: YTN; PAM sequence: TTT
tgttgccattgcttttggtg

SEQ ID NO: 226625 - DNA, 20 bp, Artificial Sequence
  Description of Artificial Sequence: Synthetic oligonucleotide
  Target: ATXN1; (-) strand; PAM type: YTN; PAM sequence: CTT
ttgttgccattgcttttggt

SEQ ID NO: 226626 - DNA, 20 bp, Artificial Sequence
  Description of Artificial Sequence: Synthetic oligonucleotide
  Target: ATXN1; (-) strand; PAM type: YTN; PAM sequence: TTG
gcttttgttgccattgcttt

SEQ ID NO: 226627 - DNA, 20 bp, Artificial Sequence
  Description of Artificial Sequence: Synthetic oligonucleotide
  Target: ATXN1; (-) strand; PAM type: YTN; PAM sequence: TTT
ggcttttgttgccattgctt

SEQ ID NO: 226628 - DNA, 20 bp, Artificial Sequence
  Description of Artificial Sequence: Synthetic oligonucleotide
  Target: ATXN1; (-) strand; PAM type: YTN; PAM sequence: TTT
tggcttttgttgccattgct

SEQ ID NO: 226629 - DNA, 20 bp, Artificial Sequence
  Description of Artificial Sequence: Synthetic oligonucleotide
  Target: ATXN1; (-) strand; PAM type: YTN; PAM sequence: TTG
acaattttggcttttgttgc

SEQ ID NO: 226630 - DNA, 20 bp, Artificial Sequence
  Description of Artificial Sequence: Synthetic oligonucleotide
  Target: ATXN1; (-) strand; PAM type: YTN; PAM sequence: TTT
gacaattttggcttttgttg

SEQ ID NO: 226631 - DNA, 20 bp, Artificial Sequence
  Description of Artificial Sequence: Synthetic oligonucleotide
  Target: ATXN1; (-) strand; PAM type: YTN; PAM sequence: TTA
gatcccatttgacaattttg

SEQ ID NO: 226632 - DNA, 20 bp, Artificial Sequence
  Description of Artificial Sequence: Synthetic oligonucleotide
  Target: ATXN1; (-) strand; PAM type: YTN; PAM sequence: TTA
attagatcccatttgacaat

SEQ ID NO: 226633 - DNA, 20 bp, Artificial Sequence
  Description of Artificial Sequence: Synthetic oligonucleotide
  Target: ATXN1; (-) strand; PAM type: YTN; PAM sequence: TTT
aattagatcccatttgacaa

SEQ ID NO: 226634 - DNA, 20 bp, Artificial Sequence
  Description of Artificial Sequence: Synthetic oligonucleotide
  Target: ATXN1; (-) strand; PAM type: YTN; PAM sequence: TTA
gtttaattagatcccatttg

SEQ ID NO: 226635 - DNA, 20 bp, Artificial Sequence
  Description of Artificial Sequence: Synthetic oligonucleotide
  Target: ATXN1; (-) strand; PAM type: YTN; PAM sequence: TTT
agtttaattagatcccattt

SEQ ID NO: 226636 - DNA, 20 bp, Artificial Sequence
  Description of Artificial Sequence: Synthetic oligonucleotide
  Target: ATXN1; (-) strand; PAM type: YTN; PAM sequence: CTT
tagtttaattagatcccatt

SEQ ID NO: 226637 - DNA, 20 bp, Artificial Sequence
  Description of Artificial Sequence: Synthetic oligonucleotide
  Target: ATXN1; (-) strand; PAM type: YTN; PAM sequence: CTC
tttagtttaattagatccca

SEQ ID NO: 226638 - DNA, 20 bp, Artificial Sequence
  Description of Artificial Sequence: Synthetic oligonucleotide
  Target: ATXN1; (-) strand; PAM type: YTN; PAM sequence: CTG
tgcagaagctctttagttta

SEQ ID NO: 226639 - DNA, 20 bp, Artificial Sequence
  Description of Artificial Sequence: Synthetic oligonucleotide
  Target: ATXN1; (-) strand; PAM type: YTN; PAM sequence: TTG
gctgtgcagaagctctttag

SEQ ID NO: 226640 - DNA, 20 bp, Artificial Sequence
  Description of Artificial Sequence: Synthetic oligonucleotide
  Target: ATXN1; (-) strand; PAM type: YTN; PAM sequence: TTT
ggctgtgcagaagctcttta

SEQ ID NO: 226641 - DNA, 20 bp, Artificial Sequence
  Description of Artificial Sequence: Synthetic oligonucleotide
  Target: ATXN1; (-) strand; PAM type: YTN; PAM sequence: CTT
tggctgtgcagaagctcttt

SEQ ID NO: 226642 - DNA, 20 bp, Artificial Sequence
  Description of Artificial Sequence: Synthetic oligonucleotide
  Target: ATXN1; (-) strand; PAM type: YTN; PAM sequence: TTC
tttggctgtgcagaagctct

SEQ ID NO: 226643 - DNA, 20 bp, Artificial Sequence
  Description of Artificial Sequence: Synthetic oligonucleotide
  Target: ATXN1; (-) strand; PAM type: YTN; PAM sequence: TTT
ctttggctgtgcagaagctc

SEQ ID NO: 226644 - DNA, 20 bp, Artificial Sequence
  Description of Artificial Sequence: Synthetic oligonucleotide
  Target: ATXN1; (-) strand; PAM type: YTN; PAM sequence: CTC
cgatggtagtttctttggct

SEQ ID NO: 226645 - DNA, 20 bp, Artificial Sequence
  Description of Artificial Sequence: Synthetic oligonucleotide
  Target: ATXN1; (-) strand; PAM type: YTN; PAM sequence: TTC
actccgatggtagtttcttt

SEQ ID NO: 226646 - DNA, 20 bp, Artificial Sequence
  Description of Artificial Sequence: Synthetic oligonucleotide
  Target: ATXN1; (-) strand; PAM type: YTN; PAM sequence: CTG
ttcactccgatggtagtttc

SEQ ID NO: 226647 - DNA, 20 bp, Artificial Sequence
  Description of Artificial Sequence: Synthetic oligonucleotide
  Target: ATXN1; (-) strand; PAM type: YTN; PAM sequence: TTG
cctgttcactccgatggtag

SEQ ID NO: 226648 - DNA, 20 bp, Artificial Sequence
  Description of Artificial Sequence: Synthetic oligonucleotide
  Target: ATXN1; (-) strand; PAM type: YTN; PAM sequence: CTG
taggttgcctgttcactccg

SEQ ID NO: 226649 - DNA, 20 bp, Artificial Sequence
  Description of Artificial Sequence: Synthetic oligonucleotide
  Target: ATXN1; (-) strand; PAM type: YTN; PAM sequence: TTC
tgtaggttgcctgttcactc

SEQ ID NO: 226650 - DNA, 20 bp, Artificial Sequence
  Description of Artificial Sequence: Synthetic oligonucleotide
  Target: ATXN1; (-) strand; PAM type: YTN; PAM sequence: CTC
ccattctgtaggttgcctgt

SEQ ID NO: 226651 - DNA, 20 bp, Artificial Sequence
  Description of Artificial Sequence: Synthetic oligonucleotide
  Target: ATXN1; (-) strand; PAM type: YTN; PAM sequence: TTC
tcccattctgtaggttgcct

SEQ ID NO: 226652 - DNA, 20 bp, Artificial Sequence
  Description of Artificial Sequence: Synthetic oligonucleotide
  Target: ATXN1; (-) strand; PAM type: YTN; PAM sequence: TTT
ctcccattctgtaggttgcc

SEQ ID NO: 226653 - DNA, 20 bp, Artificial Sequence
  Description of Artificial Sequence: Synthetic oligonucleotide
  Target: ATXN1; (-) strand; PAM type: YTN; PAM sequence: TTT
tctcccattctgtaggttgc

SEQ ID NO: 226654 - DNA, 20 bp, Artificial Sequence
  Description of Artificial Sequence: Synthetic oligonucleotide
  Target: ATXN1; (-) strand; PAM type: YTN; PAM sequence: TTG
caaaaattttctcccattct

SEQ ID NO: 226655 - DNA, 20 bp, Artificial Sequence
  Description of Artificial Sequence: Synthetic oligonucleotide
  Target: ATXN1; (-) strand; PAM type: YTN; PAM sequence: TTG
tccgatgagtagattgcaaa

SEQ ID NO: 226656 - DNA, 20 bp, Artificial Sequence
  Description of Artificial Sequence: Synthetic oligonucleotide
  Target: ATXN1; (-) strand; PAM type: YTN; PAM sequence: TTT
gtccgatgagtagattgcaa

SEQ ID NO: 226657 - DNA, 20 bp, Artificial Sequence
  Description of Artificial Sequence: Synthetic oligonucleotide
  Target: ATXN1; (-) strand; PAM type: YTN; PAM sequence: CTT
tgtccgatgagtagattgca

SEQ ID NO: 226658 - DNA, 20 bp, Artificial Sequence
  Description of Artificial Sequence: Synthetic oligonucleotide
  Target: ATXN1; (-) strand; PAM type: YTN; PAM sequence: TTA
gccctttgtccgatgagtag

SEQ ID NO: 226659 - DNA, 20 bp, Artificial Sequence
  Description of Artificial Sequence: Synthetic oligonucleotide
  Target: ATXN1; (-) strand; PAM type: YTN; PAM sequence: CTG
gatattagccctttgtccga

SEQ ID NO: 226660 - DNA, 20 bp, Artificial Sequence
  Description of Artificial Sequence: Synthetic oligonucleotide
  Target: ATXN1; (-) strand; PAM type: YTN; PAM sequence: TTC
tggatattagccctttgtcc

SEQ ID NO: 226661 - DNA, 20 bp, Artificial Sequence
  Description of Artificial Sequence: Synthetic oligonucleotide
  Target: ATXN1; (-) strand; PAM type: YTN; PAM sequence: TTG
tagattctggatattagccc

SEQ ID NO: 226662 - DNA, 20 bp, Artificial Sequence
  Description of Artificial Sequence: Synthetic oligonucleotide
  Target: ATXN1; (-) strand; PAM type: YTN; PAM sequence: TTT
gtagattctggatattagcc

SEQ ID NO: 226663 - DNA, 20 bp, Artificial Sequence
  Description of Artificial Sequence: Synthetic oligonucleotide
  Target: ATXN1; (-) strand; PAM type: YTN; PAM sequence: CTT
tgtagattctggatattagc

SEQ ID NO: 226664 - DNA, 20 bp, Artificial Sequence
  Description of Artificial Sequence: Synthetic oligonucleotide
  Target: ATXN1; (-) strand; PAM type: YTN; PAM sequence: TTC
tttgtagattctggatatta

SEQ ID NO: 226665 - DNA, 20 bp, Artificial Sequence
  Description of Artificial Sequence: Synthetic oligonucleotide
  Target: ATXN1; (-) strand; PAM type: YTN; PAM sequence: TTG
agttctttgtagattctgga

SEQ ID NO: 226666 - DNA, 20 bp, Artificial Sequence
  Description of Artificial Sequence: Synthetic oligonucleotide
  Target: ATXN1; (-) strand; PAM type: YTN; PAM sequence: TTT
gagttctttgtagattctgg

SEQ ID NO: 226667 - DNA, 20 bp, Artificial Sequence
  Description of Artificial Sequence: Synthetic oligonucleotide
  Target: ATXN1; (-) strand; PAM type: YTN; PAM sequence: TTG
tttgagttctttgtagattc

SEQ ID NO: 226668 - DNA, 20 bp, Artificial Sequence
  Description of Artificial Sequence: Synthetic oligonucleotide
  Target: ATXN1; (-) strand; PAM type: YTN; PAM sequence: TTT
gtttgagttctttgtagatt

SEQ ID NO: 226669 - DNA, 20 bp, Artificial Sequence
  Description of Artificial Sequence: Synthetic oligonucleotide
  Target: ATXN1; (-) strand; PAM type: YTN; PAM sequence: TTG
taaatttgtttgagttcttt

SEQ ID NO: 226670 - DNA, 20 bp, Artificial Sequence
  Description of Artificial Sequence: Synthetic oligonucleotide
  Target: ATXN1; (-) strand; PAM type: YTN; PAM sequence: CTT
gtaaatttgtttgagttctt

SEQ ID NO: 226671 - DNA, 20 bp, Artificial Sequence
  Description of Artificial Sequence: Synthetic oligonucleotide
  Target: ATXN1; (-) strand; PAM type: YTN; PAM sequence: TTC
ttgtaaatttgtttgagttc

SEQ ID NO: 226672 - DNA, 20 bp, Artificial Sequence
  Description of Artificial Sequence: Synthetic oligonucleotide
  Target: ATXN1; (-) strand; PAM type: YTN; PAM sequence: TTT
cttgtaaatttgtttgagtt

SEQ ID NO: 226673 - DNA, 20 bp, Artificial Sequence
  Description of Artificial Sequence: Synthetic oligonucleotide
  Target: ATXN1; (-) strand; PAM type: YTN; PAM sequence: TTT
tcttgtaaatttgtttgagt

SEQ ID NO: 226674 - DNA, 20 bp, Artificial Sequence
  Description of Artificial Sequence: Synthetic oligonucleotide
  Target: ATXN1; (-) strand; PAM type: YTN; PAM sequence: TTT
ttcttgtaaatttgtttgag

SEQ ID NO: 226675 - DNA, 20 bp, Artificial Sequence
  Description of Artificial Sequence: Synthetic oligonucleotide
  Target: ATXN1; (-) strand; PAM type: YTN; PAM sequence: TTT
tttcttgtaaatttgtttga

SEQ ID NO: 226676 - DNA, 20 bp, Artificial Sequence
  Description of Artificial Sequence: Synthetic oligonucleotide
  Target: ATXN1; (-) strand; PAM type: YTN; PAM sequence: TTT
ttttcttgtaaatttgtttg

SEQ ID NO: 226677 - DNA, 20 bp, Artificial Sequence
  Description of Artificial Sequence: Synthetic oligonucleotide
  Target: ATXN1; (-) strand; PAM type: YTN; PAM sequence: TTG
tttttttcttgtaaatttgt

SEQ ID NO: 226678 - DNA, 20 bp, Artificial Sequence
  Description of Artificial Sequence: Synthetic oligonucleotide
  Target: ATXN1; (-) strand; PAM type: YTN; PAM sequence: TTT
gtttttttcttgtaaatttg

SEQ ID NO: 226679 - DNA, 20 bp, Artificial Sequence
  Description of Artificial Sequence: Synthetic oligonucleotide
  Target: ATXN1; (-) strand; PAM type: YTN; PAM sequence: TTG
tttgtttttttcttgtaaat

SEQ ID NO: 226680 - DNA, 20 bp, Artificial Sequence
  Description of Artificial Sequence: Synthetic oligonucleotide
  Target: ATXN1; (-) strand; PAM type: YTN; PAM sequence: TTG
atggggttgtttgttttttt

SEQ ID NO: 226681 - DNA, 20 bp, Artificial Sequence
  Description of Artificial Sequence: Synthetic oligonucleotide
  Target: ATXN1; (-) strand; PAM type: YTN; PAM sequence: TTT
gatggggttgtttgtttttt

SEQ ID NO: 226682 - DNA, 20 bp, Artificial Sequence
  Description of Artificial Sequence: Synthetic oligonucleotide
  Target: ATXN1; (-) strand; PAM type: YTN; PAM sequence: TTT
tgatggggttgtttgttttt

SEQ ID NO: 226683 - DNA, 20 bp, Artificial Sequence
  Description of Artificial Sequence: Synthetic oligonucleotide
  Target: ATXN1; (-) strand; PAM type: YTN; PAM sequence: TTT
ttgatggggttgtttgtttt

SEQ ID NO: 226684 - DNA, 20 bp, Artificial Sequence
  Description of Artificial Sequence: Synthetic oligonucleotide
  Target: ATXN1; (-) strand; PAM type: YTN; PAM sequence: CTT
tttgatggggttgtttgttt

SEQ ID NO: 226685 - DNA, 20 bp, Artificial Sequence
  Description of Artificial Sequence: Synthetic oligonucleotide
  Target: ATXN1; (-) strand; PAM type: YTN; PAM sequence: TTC
gcccactttttgatggggtt

SEQ ID NO: 226686 - DNA, 20 bp, Artificial Sequence
  Description of Artificial Sequence: Synthetic oligonucleotide
  Target: ATXN1; (-) strand; PAM type: YTN; PAM sequence: CTT
cgcccactttttgatggggt

SEQ ID NO: 226687 - DNA, 20 bp, Artificial Sequence
  Description of Artificial Sequence: Synthetic oligonucleotide
  Target: ATXN1; (-) strand; PAM type: YTN; PAM sequence: TTC
atatccttcgcccacttttt

SEQ ID NO: 226688 - DNA, 20 bp, Artificial Sequence
  Description of Artificial Sequence: Synthetic oligonucleotide
  Target: ATXN1; (-) strand; PAM type: YTN; PAM sequence: CTA
ttcatatccttcgcccactt

SEQ ID NO: 226689 - DNA, 20 bp, Artificial Sequence
  Description of Artificial Sequence: Synthetic oligonucleotide
  Target: ATXN1; (-) strand; PAM type: YTN; PAM sequence: TTG
agaagtgtctattcatatcc

SEQ ID NO: 226690 - DNA, 20 bp, Artificial Sequence
  Description of Artificial Sequence: Synthetic oligonucleotide
  Target: ATXN1; (-) strand; PAM type: YTN; PAM sequence: TTT
gagaagtgtctattcatatc

SEQ ID NO: 226691 - DNA, 20 bp, Artificial Sequence
  Description of Artificial Sequence: Synthetic oligonucleotide
  Target: ATXN1; (-) strand; PAM type: YTN; PAM sequence: TTT
tgagaagtgtctattcatat

SEQ ID NO: 226692 - DNA, 20 bp, Artificial Sequence
  Description of Artificial Sequence: Synthetic oligonucleotide
  Target: ATXN1; (-) strand; PAM type: YTN; PAM sequence: CTT
ttgagaagtgtctattcata

SEQ ID NO: 226693 - DNA, 20 bp, Artificial Sequence
  Description of Artificial Sequence: Synthetic oligonucleotide
  Target: ATXN1; (-) strand; PAM type: YTN; PAM sequence: TTC
ttttgagaagtgtctattca

SEQ ID NO: 226694 - DNA, 20 bp, Artificial Sequence
  Description of Artificial Sequence: Synthetic oligonucleotide
  Target: ATXN1; (-) strand; PAM type: YTN; PAM sequence: CTT
cttttgagaagtgtctattc

SEQ ID NO: 226695 - DNA, 20 bp, Artificial Sequence
  Description of Artificial Sequence: Synthetic oligonucleotide
  Target: ATXN1; (-) strand; PAM type: YTN; PAM sequence: CTG
cataaatgtcttcttttgag

SEQ ID NO: 226696 - DNA, 20 bp, Artificial Sequence
  Description of Artificial Sequence: Synthetic oligonucleotide
  Target: ATXN1; (-) strand; PAM type: YTN; PAM sequence: TTG
gctgcataaatgtcttcttt

SEQ ID NO: 226697 - DNA, 20 bp, Artificial Sequence
  Description of Artificial Sequence: Synthetic oligonucleotide
  Target: ATXN1; (-) strand; PAM type: YTN; PAM sequence: TTT
ggctgcataaatgtcttctt

SEQ ID NO: 226698 - DNA, 20 bp, Artificial Sequence
  Description of Artificial Sequence: Synthetic oligonucleotide
  Target: ATXN1; (-) strand; PAM type: YTN; PAM sequence: TTT
tggctgcataaatgtcttct

SEQ ID NO: 226699 - DNA, 20 bp, Artificial Sequence
  Description of Artificial Sequence: Synthetic oligonucleotide
  Target: ATXN1; (-) strand; PAM type: YTN; PAM sequence: CTT
ttggctgcataaatgtcttc

SEQ ID NO: 226700 - DNA, 20 bp, Artificial Sequence
  Description of Artificial Sequence: Synthetic oligonucleotide
  Target: ATXN1; (-) strand; PAM type: YTN; PAM sequence: TTG
tcttttggctgcataaatgt

SEQ ID NO: 226701 - DNA, 20 bp, Artificial Sequence
  Description of Artificial Sequence: Synthetic oligonucleotide
  Target: ATXN1; (-) strand; PAM type: YTN; PAM sequence: TTT
gtcttttggctgcataaatg

SEQ ID NO: 226702 - DNA, 20 bp, Artificial Sequence
  Description of Artificial Sequence: Synthetic oligonucleotide
  Target: ATXN1; (-) strand; PAM type: YTN; PAM sequence: TTT
tgtcttttggctgcataaat

SEQ ID NO: 226703 - DNA, 20 bp, Artificial Sequence
  Description of Artificial Sequence: Synthetic oligonucleotide
  Target: ATXN1; (-) strand; PAM type: YTN; PAM sequence: TTT
ttgtcttttggctgcataaa

SEQ ID NO: 226704 - DNA, 20 bp, Artificial Sequence
  Description of Artificial Sequence: Synthetic oligonucleotide
  Target: ATXN1; (-) strand; PAM type: YTN; PAM sequence: TTT
tttgtcttttggctgcataa

SEQ ID NO: 226705 - DNA, 20 bp, Artificial Sequence
  Description of Artificial Sequence: Synthetic oligonucleotide
  Target: ATXN1; (-) strand; PAM type: YTN; PAM sequence: CTG
atggccagtgatgatgagca

SEQ ID NO: 226706 - DNA, 20 bp, Artificial Sequence
  Description of Artificial Sequence: Synthetic oligonucleotide
  Target: ATXN1; (-) strand; PAM type: YTN; PAM sequence: CTC
tgatggccagtgatgatgag

SEQ ID NO: 226707 - DNA, 20 bp, Artificial Sequence
  Description of Artificial Sequence: Synthetic oligonucleotide
  Target: ATXN1; (-) strand; PAM type: YTN; PAM sequence: TTC
tctgatggccagtgatgatg

SEQ ID NO: 226708 - DNA, 20 bp, Artificial Sequence
  Description of Artificial Sequence: Synthetic oligonucleotide
  Target: ATXN1; (-) strand; PAM type: YTN; PAM sequence: TTT
ctctgatggccagtgatgat

SEQ ID NO: 226709 - DNA, 20 bp, Artificial Sequence
  Description of Artificial Sequence: Synthetic oligonucleotide
  Target: ATXN1; (-) strand; PAM type: YTN; PAM sequence: TTG
catttctctgatggccagtg

SEQ ID NO: 226710 - DNA, 20 bp, Artificial Sequence
  Description of Artificial Sequence: Synthetic oligonucleotide
  Target: ATXN1; (-) strand; PAM type: YTN; PAM sequence: TTT
gcatttctctgatggccagt

SEQ ID NO: 226711 - DNA, 20 bp, Artificial Sequence
  Description of Artificial Sequence: Synthetic oligonucleotide
  Target: ATXN1; (-) strand; PAM type: YTN; PAM sequence: TTG
atttgcatttctctgatggc

SEQ ID NO: 226712 - DNA, 20 bp, Artificial Sequence
  Description of Artificial Sequence: Synthetic oligonucleotide
  Target: ATXN1; (-) strand; PAM type: YTN; PAM sequence: TTT
gatttgcatttctctgatgg

SEQ ID NO: 226713 - DNA, 20 bp, Artificial Sequence
  Description of Artificial Sequence: Synthetic oligonucleotide
  Target: ATXN1; (-) strand; PAM type: YTN; PAM sequence: TTT
tgatttgcatttctctgatg

SEQ ID NO: 226714 - DNA, 20 bp, Artificial Sequence
  Description of Artificial Sequence: Synthetic oligonucleotide
  Target: ATXN1; (-) strand; PAM type: YTN; PAM sequence: TTG
tggttttgatttgcatttct

SEQ ID NO: 226715 - DNA, 20 bp, Artificial Sequence
  Description of Artificial Sequence: Synthetic oligonucleotide
  Target: ATXN1; (-) strand; PAM type: YTN; PAM sequence: CTG
gtgtgagatggtatgtcatt

SEQ ID NO: 226716 - DNA, 20 bp, Artificial Sequence
  Description of Artificial Sequence: Synthetic oligonucleotide
  Target: ATXN1; (-) strand; PAM type: YTN; PAM sequence: CTA
actggtgtgagatggtatgt

SEQ ID NO: 226717 - DNA, 20 bp, Artificial Sequence
  Description of Artificial Sequence: Synthetic oligonucleotide
  Target: ATXN1; (-) strand; PAM type: YTN; PAM sequence: TTC
taactggtgtgagatggtat

SEQ ID NO: 226718 - DNA, 20 bp, Artificial Sequence
  Description of Artificial Sequence: Synthetic oligonucleotide
  Target: ATXN1; (-) strand; PAM type: YTN; PAM sequence: TTG
ccattctaactggtgtgaga

SEQ ID NO: 226719 - DNA, 20 bp, Artificial Sequence
  Description of Artificial Sequence: Synthetic oligonucleotide
  Target: ATXN1; (-) strand; PAM type: YTN; PAM sequence: TTA
atgattgccattctaactgg

SEQ ID NO: 226720 - DNA, 20 bp, Artificial Sequence
  Description of Artificial Sequence: Synthetic oligonucleotide
  Target: ATXN1; (-) strand; PAM type: YTN; PAM sequence: TTT
aatgattgccattctaactg

SEQ ID NO: 226721 - DNA, 20 bp, Artificial Sequence
  Description of Artificial Sequence: Synthetic oligonucleotide
  Target: ATXN1; (-) strand; PAM type: YTN; PAM sequence: TTT
taatgattgccattctaact

SEQ ID NO: 226722 - DNA, 20 bp, Artificial Sequence
  Description of Artificial Sequence: Synthetic oligonucleotide
  Target: ATXN1; (-) strand; PAM type: YTN; PAM sequence: TTT
ttaatgattgccattctaac

SEQ ID NO: 226723 - DNA, 20 bp, Artificial Sequence
  Description of Artificial Sequence: Synthetic oligonucleotide
  Target: ATXN1; (-) strand; PAM type: YTN; PAM sequence: CTT
tttaatgattgccattctaa

SEQ ID NO: 226724 - DNA, 20 bp, Artificial Sequence
  Description of Artificial Sequence: Synthetic oligonucleotide
  Target: ATXN1; (-) strand; PAM type: YTN; PAM sequence: CTG
actttttaatgattgccatt

SEQ ID NO: 226725 - DNA, 20 bp, Artificial Sequence
  Description of Artificial Sequence: Synthetic oligonucleotide
  Target: ATXN1; (-) strand; PAM type: YTN; PAM sequence: TTC
ctgactttttaatgattgcc

SEQ ID NO: 226726 - DNA, 20 bp, Artificial Sequence
  Description of Artificial Sequence: Synthetic oligonucleotide
  Target: ATXN1; (-) strand; PAM type: YTN; PAM sequence: TTT
cctgactttttaatgattgc

SEQ ID NO: 226727 - DNA, 20 bp, Artificial Sequence
  Description of Artificial Sequence: Synthetic oligonucleotide
  Target: ATXN1; (-) strand; PAM type: YTN; PAM sequence: TTG
tttcctgactttttaatgat

SEQ ID NO: 226728 - DNA, 20 bp, Artificial Sequence
  Description of Artificial Sequence: Synthetic oligonucleotide
  Target: ATXN1; (-) strand; PAM type: YTN; PAM sequence: CTG
ttgtttcctgactttttaat

SEQ ID NO: 226729 - DNA, 20 bp, Artificial Sequence
  Description of Artificial Sequence: Synthetic oligonucleotide
  Target: ATXN1; (-) strand; PAM type: YTN; PAM sequence: CTC
cagcacctgttgtttcctga

SEQ ID NO: 226730 - DNA, 20 bp, Artificial Sequence
  Description of Artificial Sequence: Synthetic oligonucleotide
  Target: ATXN1; (-) strand; PAM type: YTN; PAM sequence: CTC
tccagcacctgttgtttcct

SEQ ID NO: 226731 - DNA, 20 bp, Artificial Sequence
  Description of Artificial Sequence: Synthetic oligonucleotide
  Target: ATXN1; (-) strand; PAM type: YTN; PAM sequence: CTC
cacatcctctccagcacctg

SEQ ID NO: 226732 - DNA, 20 bp, Artificial Sequence
  Description of Artificial Sequence: Synthetic oligonucleotide
  Target: ATXN1; (-) strand; PAM type: YTN; PAM sequence: CTA
tgtctccacatcctctccag

SEQ ID NO: 226733 - DNA, 20 bp, Artificial Sequence
  Description of Artificial Sequence: Synthetic oligonucleotide
  Target: ATXN1; (-) strand; PAM type: YTN; PAM sequence: TTC
ctatgtctccacatcctctc

SEQ ID NO: 226734 - DNA, 20 bp, Artificial Sequence
  Description of Artificial Sequence: Synthetic oligonucleotide
  Target: ATXN1; (-) strand; PAM type: YTN; PAM sequence: TTA
cagtcccacaaacagtgtaa

SEQ ID NO: 226735 - DNA, 20 bp, Artificial Sequence
  Description of Artificial Sequence: Synthetic oligonucleotide
  Target: ATXN1; (-) strand; PAM type: YTN; PAM sequence: TTT
acagtcccacaaacagtgta

SEQ ID NO: 226736 - DNA, 20 bp, Artificial Sequence
  Description of Artificial Sequence: Synthetic oligonucleotide
  Target: ATXN1; (-) strand; PAM type: YTN; PAM sequence: CTA
gtttacagtcccacaaacag

SEQ ID NO: 226737 - DNA, 20 bp, Artificial Sequence
  Description of Artificial Sequence: Synthetic oligonucleotide
  Target: ATXN1; (-) strand; PAM type: YTN; PAM sequence: TTG
aactagtttacagtcccaca

SEQ ID NO: 226738 - DNA, 20 bp, Artificial Sequence
  Description of Artificial Sequence: Synthetic oligonucleotide
  Target: ATXN1; (-) strand; PAM type: YTN; PAM sequence: TTC
cacaatggttgaactagttt

SEQ ID NO: 226739 - DNA, 20 bp, Artificial Sequence
  Description of Artificial Sequence: Synthetic oligonucleotide
  Target: ATXN1; (-) strand; PAM type: YTN; PAM sequence: CTT
ccacaatggttgaactagtt

SEQ ID NO: 226740 - DNA, 20 bp, Artificial Sequence
  Description of Artificial Sequence: Synthetic oligonucleotide
  Target: ATXN1; (-) strand; PAM type: YTN; PAM sequence: CTG
acttccacaatggttgaact

SEQ ID NO: 226741 - DNA, 20 bp, Artificial Sequence
  Description of Artificial Sequence: Synthetic oligonucleotide
  Target: ATXN1; (-) strand; PAM type: YTN; PAM sequence: CTG
aggaatcgccacactgactt

SEQ ID NO: 226742 - DNA, 20 bp, Artificial Sequence
  Description of Artificial Sequence: Synthetic oligonucleotide
  Target: ATXN1; (-) strand; PAM type: YTN; PAM sequence: CTA
gatccctgaggaatcgccac

SEQ ID NO: 226743 - DNA, 20 bp, Artificial Sequence
  Description of Artificial Sequence: Synthetic oligonucleotide
  Target: ATXN1; (-) strand; PAM type: YTN; PAM sequence: TTC
tagatccctgaggaatcgcc

SEQ ID NO: 226744 - DNA, 20 bp, Artificial Sequence
  Description of Artificial Sequence: Synthetic oligonucleotide
  Target: ATXN1; (-) strand; PAM type: YTN; PAM sequence: CTA
gttctagatccctgaggaat

SEQ ID NO: 226745 - DNA, 20 bp, Artificial Sequence
  Description of Artificial Sequence: Synthetic oligonucleotide
  Target: ATXN1; (-) strand; PAM type: YTN; PAM sequence: TTC
tagttctagatccctgagga

SEQ ID NO: 226746 - DNA, 20 bp, Artificial Sequence
  Description of Artificial Sequence: Synthetic oligonucleotide
  Target: ATXN1; (-) strand; PAM type: YTN; PAM sequence: TTT
ctagttctagatccctgagg

SEQ ID NO: 226747 - DNA, 20 bp, Artificial Sequence
  Description of Artificial Sequence: Synthetic oligonucleotide
  Target: ATXN1; (-) strand; PAM type: YTN; PAM sequence: CTG
ggtcaaatggtatttctagt

SEQ ID NO: 226748 - DNA, 20 bp, Artificial Sequence
  Description of Artificial Sequence: Synthetic oligonucleotide
  Target: ATXN1; (-) strand; PAM type: YTN; PAM sequence: TTG
gtatatacccagtaatggga

SEQ ID NO: 226749 - DNA, 20 bp, Artificial Sequence
  Description of Artificial Sequence: Synthetic oligonucleotide
  Target: ATXN1; (-) strand; PAM type: YTN; PAM sequence: TTT
ggtatatacccagtaatggg

SEQ ID NO: 226750 - DNA, 20 bp, Artificial Sequence
  Description of Artificial Sequence: Synthetic oligonucleotide
  Target: ATXN1; (-) strand; PAM type: YTN; PAM sequence: TTT
tggtatatacccagtaatgg

SEQ ID NO: 226751 - DNA, 20 bp, Artificial Sequence
  Description of Artificial Sequence: Synthetic oligonucleotide
  Target: ATXN1; (-) strand; PAM type: YTN; PAM sequence: CTT
ttggtatatacccagtaatg

SEQ ID NO: 226752 - DNA, 20 bp, Artificial Sequence
  Description of Artificial Sequence: Synthetic oligonucleotide
  Target: ATXN1; (-) strand; PAM type: YTN; PAM sequence: CTC
cttttggtatatacccagta

SEQ ID NO: 226753 - DNA, 20 bp, Artificial Sequence
  Description of Artificial Sequence: Synthetic oligonucleotide
  Target: ATXN1; (-) strand; PAM type: YTN; PAM sequence: TTA
tactccttttggtatatacc

SEQ ID NO: 226754 - DNA, 20 bp, Artificial Sequence
  Description of Artificial Sequence: Synthetic oligonucleotide
  Target: ATXN1; (-) strand; PAM type: YTN; PAM sequence: TTT
atactccttttggtatatac

SEQ ID NO: 226755 - DNA, 20 bp, Artificial Sequence
  Description of Artificial Sequence: Synthetic oligonucleotide
  Target: ATXN1; (-) strand; PAM type: YTN; PAM sequence: TTA
tagcagcatgatttatactc

SEQ ID NO: 226756 - DNA, 20 bp, Artificial Sequence
  Description of Artificial Sequence: Synthetic oligonucleotide
  Target: ATXN1; (-) strand; PAM type: YTN; PAM sequence: TTT
atagcagcatgatttatact

SEQ ID NO: 226757 - DNA, 20 bp, Artificial Sequence
  Description of Artificial Sequence: Synthetic oligonucleotide
  Target: ATXN1; (-) strand; PAM type: YTN; PAM sequence: CTT
tatagcagcatgatttatac

SEQ ID NO: 226758 - DNA, 20 bp, Artificial Sequence
  Description of Artificial Sequence: Synthetic oligonucleotide
  Target: ATXN1; (-) strand; PAM type: YTN; PAM sequence: TTG
tgaatagtgccgcaataaac

SEQ ID NO: 226759 - DNA, 20 bp, Artificial Sequence
  Description of Artificial Sequence: Synthetic oligonucleotide
  Target: ATXN1; (-) strand; PAM type: YTN; PAM sequence: CTA
ttgtgaatagtgccgcaata

SEQ ID NO: 226760 - DNA, 20 bp, Artificial Sequence
  Description of Artificial Sequence: Synthetic oligonucleotide
  Target: ATXN1; (-) strand; PAM type: YTN; PAM sequence: TTG
ctattgtgaatagtgccgca

SEQ ID NO: 226761 - DNA, 20 bp, Artificial Sequence
  Description of Artificial Sequence: Synthetic oligonucleotide
  Target: ATXN1; (-) strand; PAM type: YTN; PAM sequence: TTT
gctattgtgaatagtgccgc

SEQ ID NO: 226762 - DNA, 20 bp, Artificial Sequence
  Description of Artificial Sequence: Synthetic oligonucleotide
  Target: ATXN1; (-) strand; PAM type: YTN; PAM sequence: CTT
tgctattgtgaatagtgccg

SEQ ID NO: 226763 - DNA, 20 bp, Artificial Sequence
  Description of Artificial Sequence: Synthetic oligonucleotide
  Target: ATXN1; (-) strand; PAM type: YTN; PAM sequence: TTC
caagtctttgctattgtgaa

SEQ ID NO: 226764 - DNA, 20 bp, Artificial Sequence
  Description of Artificial Sequence: Synthetic oligonucleotide
  Target: ATXN1; (-) strand; PAM type: YTN; PAM sequence: TTG
gttccaagtctttgctattg

SEQ ID NO: 226765 - DNA, 20 bp, Artificial Sequence
  Description of Artificial Sequence: Synthetic oligonucleotide
  Target: ATXN1; (-) strand; PAM type: YTN; PAM sequence: TTG
ggttggttccaagtctttgc

SEQ ID NO: 226766 - DNA, 20 bp, Artificial Sequence
  Description of Artificial Sequence: Synthetic oligonucleotide
  Target: ATXN1; (-) strand; PAM type: YTN; PAM sequence: TTT
gggttggttccaagtctttg

SEQ ID NO: 226767 - DNA, 20 bp, Artificial Sequence
  Description of Artificial Sequence: Synthetic oligonucleotide
  Target: ATXN1; (-) strand; PAM type: YTN; PAM sequence: TTG
gacatttgggttggttccaa

SEQ ID NO: 226768 - DNA, 20 bp, Artificial Sequence
  Description of Artificial Sequence: Synthetic oligonucleotide
  Target: ATXN1; (-) strand; PAM type: YTN; PAM sequence: TTG
ttggacatttgggttggttc

SEQ ID NO: 226769 - DNA, 20 bp, Artificial Sequence
  Description of Artificial Sequence: Synthetic oligonucleotide
  Target: ATXN1; (-) strand; PAM type: YTN; PAM sequence: TTA
tcattgttggacatttgggt

SEQ ID NO: 226770 - DNA, 20 bp, Artificial Sequence
  Description of Artificial Sequence: Synthetic oligonucleotide
  Target: ATXN1; (-) strand; PAM type: YTN; PAM sequence: TTT
atcattgttggacatttggg

SEQ ID NO: 226771 - DNA, 20 bp, Artificial Sequence
  Description of Artificial Sequence: Synthetic oligonucleotide
  Target: ATXN1; (-) strand; PAM type: YTN; PAM sequence: TTA
atgcagtttatcattgttgg

SEQ ID NO: 226772 - DNA, 20 bp, Artificial Sequence
  Description of Artificial Sequence: Synthetic oligonucleotide
  Target: ATXN1; (-) strand; PAM type: YTN; PAM sequence: CTT
aatgcagtttatcattgttg

SEQ ID NO: 226773 - DNA, 20 bp, Artificial Sequence
  Description of Artificial Sequence: Synthetic oligonucleotide
  Target: ATXN1; (-) strand; PAM type: YTN; PAM sequence: TTC
ttaatgcagtttatcattgt

SEQ ID NO: 226774 - DNA, 20 bp, Artificial Sequence
  Description of Artificial Sequence: Synthetic oligonucleotide
  Target: ATXN1; (-) strand; PAM type: YTN; PAM sequence: TTT
cttaatgcagtttatcattg

SEQ ID NO: 226775 - DNA, 20 bp, Artificial Sequence
  Description of Artificial Sequence: Synthetic oligonucleotide
  Target: ATXN1; (-) strand; PAM type: YTN; PAM sequence: TTT
tcttaatgcagtttatcatt

SEQ ID NO: 226776 - DNA, 20 bp, Artificial Sequence
  Description of Artificial Sequence: Synthetic oligonucleotide
  Target: ATXN1; (-) strand; PAM type: YTN; PAM sequence: CTG
gtgtgtatgtgccacatttt

SEQ ID NO: 226777 - DNA, 20 bp, Artificial Sequence
  Description of Artificial Sequence: Synthetic oligonucleotide
  Target: ATXN1; (-) strand; PAM type: YTN; PAM sequence: TTC
cctggtgtgtatgtgccaca

SEQ ID NO: 226778 - DNA, 20 bp, Artificial Sequence
  Description of Artificial Sequence: Synthetic oligonucleotide
  Target: ATXN1; (-) strand; PAM type: YTN; PAM sequence: CTG
catagtattccctggtgtgt

SEQ ID NO: 226779 - DNA, 20 bp, Artificial Sequence
  Description of Artificial Sequence: Synthetic oligonucleotide
  Target: ATXN1; (-) strand; PAM type: YTN; PAM sequence: TTA
tggctgcatagtattccctg

SEQ ID NO: 226780 - DNA, 20 bp, Artificial Sequence
  Description of Artificial Sequence: Synthetic oligonucleotide
  Target: ATXN1; (-) strand; PAM type: YTN; PAM sequence: TTT
atggctgcatagtattccct

SEQ ID NO: 226781 - DNA, 20 bp, Artificial Sequence
  Description of Artificial Sequence: Synthetic oligonucleotide
  Target: ATXN1; (-) strand; PAM type: YTN; PAM sequence: TTT
tatggctgcatagtattccc

SEQ ID NO: 226782 - DNA, 20 bp, Artificial Sequence
  Description of Artificial Sequence: Synthetic oligonucleotide
  Target: ATXN1; (-) strand; PAM type: YTN; PAM sequence: TTT
ttatggctgcatagtattcc

SEQ ID NO: 226783 - DNA, 20 bp, Artificial Sequence
  Description of Artificial Sequence: Synthetic oligonucleotide
  Target: ATXN1; (-) strand; PAM type: YTN; PAM sequence: TTT
tttatggctgcatagtattc

SEQ ID NO: 226784 - DNA, 20 bp, Artificial Sequence
  Description of Artificial Sequence: Synthetic oligonucleotide
  Target: ATXN1; (-) strand; PAM type: YTN; PAM sequence: CTC
atcattttttatggctgcat

SEQ ID NO: 226785 - DNA, 20 bp, Artificial Sequence
  Description of Artificial Sequence: Synthetic oligonucleotide
  Target: ATXN1; (-) strand; PAM type: YTN; PAM sequence: CTA
caaaggacatgaactcatca

SEQ ID NO: 226786 - DNA, 20 bp, Artificial Sequence
  Description of Artificial Sequence: Synthetic oligonucleotide
  Target: ATXN1; (-) strand; PAM type: YTN; PAM sequence: TTC
atccatgtccctacaaagga

SEQ ID NO: 226787 - DNA, 20 bp, Artificial Sequence
  Description of Artificial Sequence: Synthetic oligonucleotide
  Target: ATXN1; (-) strand; PAM type: YTN; PAM sequence: CTT
catccatgtccctacaaagg

SEQ ID NO: 226788 - DNA, 20 bp, Artificial Sequence
  Description of Artificial Sequence: Synthetic oligonucleotide
  Target: ATXN1; (-) strand; PAM type: YTN; PAM sequence: TTC
cagcttcatccatgtcccta

SEQ ID NO: 226789 - DNA, 20 bp, Artificial Sequence
  Description of Artificial Sequence: Synthetic oligonucleotide
  Target: ATXN1; (-) strand; PAM type: YTN; PAM sequence: TTT
ccagcttcatccatgtccct

SEQ ID NO: 226790 - DNA, 20 bp, Artificial Sequence
  Description of Artificial Sequence: Synthetic oligonucleotide
  Target: ATXN1; (-) strand; PAM type: YTN; PAM sequence: CTG
agaatgatggtttccagctt

SEQ ID NO: 226791 - DNA, 20 bp, Artificial Sequence
  Description of Artificial Sequence: Synthetic oligonucleotide
  Target: ATXN1; (-) strand; PAM type: YTN; PAM sequence: TTG
ctgagaatgatggtttccag

SEQ ID NO: 226792 - DNA, 20 bp, Artificial Sequence
  Description of Artificial Sequence: Synthetic oligonucleotide
  Target: ATXN1; (-) strand; PAM type: YTN; PAM sequence: TTT
gctgagaatgatggtttcca

SEQ ID NO: 226793 - DNA, 20 bp, Artificial Sequence
  Description of Artificial Sequence: Synthetic oligonucleotide
  Target: ATXN1; (-) strand; PAM type: YTN; PAM sequence: TTG
cgatagtttgctgagaatga

SEQ ID NO: 226794 - DNA, 20 bp, Artificial Sequence
  Description of Artificial Sequence: Synthetic oligonucleotide
  Target: ATXN1; (-) strand; PAM type: YTN; PAM sequence: CTT
gcgatagtttgctgagaatg

SEQ ID NO: 226795 - DNA, 20 bp, Artificial Sequence
  Description of Artificial Sequence: Synthetic oligonucleotide
  Target: ATXN1; (-) strand; PAM type: YTN; PAM sequence: TTG
tccttgcgatagtttgctga

SEQ ID NO: 226796 - DNA, 20 bp, Artificial Sequence
  Description of Artificial Sequence: Synthetic oligonucleotide
  Target: ATXN1; (-) strand; PAM type: YTN; PAM sequence: TTT
gtccttgcgatagtttgctg

SEQ ID NO: 226797 - DNA, 20 bp, Artificial Sequence
  Description of Artificial Sequence: Synthetic oligonucleotide
  Target: ATXN1; (-) strand; PAM type: YTN; PAM sequence: TTT
tgtccttgcgatagtttgct

SEQ ID NO: 226798 - DNA, 20 bp, Artificial Sequence
  Description of Artificial Sequence: Synthetic oligonucleotide
  Target: ATXN1; (-) strand; PAM type: YTN; PAM sequence: TTT
ttgtccttgcgatagtttgc

SEQ ID NO: 226799 - DNA, 20 bp, Artificial Sequence
  Description of Artificial Sequence: Synthetic oligonucleotide
  Target: ATXN1; (-) strand; PAM type: YTN; PAM sequence: TTT
tttgtccttgcgatagtttg

SEQ ID NO: 226800 - DNA, 20 bp, Artificial Sequence
  Description of Artificial Sequence: Synthetic oligonucleotide
  Target: ATXN1; (-) strand; PAM type: YTN; PAM sequence: TTG
gttttttgtccttgcgatag

SEQ ID NO: 226801 - DNA, 20 bp, Artificial Sequence
  Description of Artificial Sequence: Synthetic oligonucleotide
  Target: ATXN1; (-) strand; PAM type: YTN; PAM sequence: TTT
ggttttttgtccttgcgata

SEQ ID NO: 226802 - DNA, 20 bp, Artificial Sequence
  Description of Artificial Sequence: Synthetic oligonucleotide
  Target: ATXN1; (-) strand; PAM type: YTN; PAM sequence: CTA
tgagtgagaacatgcggtgt

SEQ ID NO: 226803 - DNA, 20 bp, Artificial Sequence
  Description of Artificial Sequence: Synthetic oligonucleotide
  Target: ATXN1; (-) strand; PAM type: YTN; PAM sequence: TTC
ccacctatgagtgagaacat

SEQ ID NO: 226804 - DNA, 20 bp, Artificial Sequence
  Description of Artificial Sequence: Synthetic oligonucleotide
  Target: ATXN1; (-) strand; PAM type: YTN; PAM sequence: TTC
aattcccacctatgagtgag

SEQ ID NO: 226805 - DNA, 20 bp, Artificial Sequence
  Description of Artificial Sequence: Synthetic oligonucleotide
  Target: ATXN1; (-) strand; PAM type: YTN; PAM sequence: TTG
ttcaattcccacctatgagt

SEQ ID NO: 226806 - DNA, 20 bp, Artificial Sequence
  Description of Artificial Sequence: Synthetic oligonucleotide
  Target: ATXN1; (-) strand; PAM type: YTN; PAM sequence: CTC
attgttcaattcccacctat

SEQ ID NO: 226807 - DNA, 20 bp, Artificial Sequence
  Description of Artificial Sequence: Synthetic oligonucleotide
  Target: ATXN1; (-) strand; PAM type: YTN; PAM sequence: TTC
tcattgttcaattcccacct

SEQ ID NO: 226808 - DNA, 20 bp, Artificial Sequence
  Description of Artificial Sequence: Synthetic oligonucleotide
  Target: ATXN1; (-) strand; PAM type: YTN; PAM sequence: CTG
tgcccaagtgttctcattgt

SEQ ID NO: 226809 - DNA, 20 bp, Artificial Sequence
  Description of Artificial Sequence: Synthetic oligonucleotide
  Target: ATXN1; (-) strand; PAM type: YTN; PAM sequence: TTC
ctgtgcccaagtgttctcat

SEQ ID NO: 226810 - DNA, 20 bp, Artificial Sequence
  Description of Artificial Sequence: Synthetic oligonucleotide
  Target: ATXN1; (-) strand; PAM type: YTN; PAM sequence: CTT
cctgtgcccaagtgttctca

SEQ ID NO: 226811 - DNA, 20 bp, Artificial Sequence
  Description of Artificial Sequence: Synthetic oligonucleotide
  Target: ATXN1; (-) strand; PAM type: YTN; PAM sequence: TTC
cccttcctgtgcccaagtgt

SEQ ID NO: 226812 - DNA, 20 bp, Artificial Sequence
  Description of Artificial Sequence: Synthetic oligonucleotide
  Target: ATXN1; (-) strand; PAM type: YTN; PAM sequence: CTG
gggtgtggtgttccccttcc

SEQ ID NO: 226813 - DNA, 20 bp, Artificial Sequence
  Description of Artificial Sequence: Synthetic oligonucleotide
  Target: ATXN1; (-) strand; PAM type: YTN; PAM sequence: TTC
cccccaccccacaacaggcc

SEQ ID NO: 226814 - DNA, 20 bp, Artificial Sequence
  Description of Artificial Sequence: Synthetic oligonucleotide
  Target: ATXN1; (-) strand; PAM type: YTN; PAM sequence: CTT
ccccccaccccacaacaggc

SEQ ID NO: 226815 - DNA, 20 bp, Artificial Sequence
  Description of Artificial Sequence: Synthetic oligonucleotide
  Target: ATXN1; (-) strand; PAM type: YTN; PAM sequence: CTC
ccccttccccccaccccaca

SEQ ID NO: 226816 - DNA, 20 bp, Artificial Sequence
  Description of Artificial Sequence: Synthetic oligonucleotide
  Target: ATXN1; (-) strand; PAM type: YTN; PAM sequence: CTA
tccctcccccttccccccac

SEQ ID NO: 226817 - DNA, 20 bp, Artificial Sequence
  Description of Artificial Sequence: Synthetic oligonucleotide
  Target: ATXN1; (-) strand; PAM type: YTN; PAM sequence: CTA
atgctatccctcccccttcc

SEQ ID NO: 226818 - DNA, 20 bp, Artificial Sequence
  Description of Artificial Sequence: Synthetic oligonucleotide
  Target: ATXN1; (-) strand; PAM type: YTN; PAM sequence: CTC
ctaatgctatccctccccct

SEQ ID NO: 226819 - DNA, 20 bp, Artificial Sequence
  Description of Artificial Sequence: Synthetic oligonucleotide
  Target: ATXN1; (-) strand; PAM type: YTN; PAM sequence: TTA
ggtatatctcctaatgctat

SEQ ID NO: 226820 - DNA, 20 bp, Artificial Sequence
  Description of Artificial Sequence: Synthetic oligonucleotide
  Target: ATXN1; (-) strand; PAM type: YTN; PAM sequence: TTA
cattaggtatatctcctaat

SEQ ID NO: 226821 - DNA, 20 bp, Artificial Sequence
  Description of Artificial Sequence: Synthetic oligonucleotide
  Target: ATXN1; (-) strand; PAM type: YTN; PAM sequence: TTT
acattaggtatatctcctaa

SEQ ID NO: 226822 - DNA, 20 bp, Artificial Sequence
  Description of Artificial Sequence: Synthetic oligonucleotide
  Target: ATXN1; (-) strand; PAM type: YTN; PAM sequence: TTA
aatcgtcatttacattaggt

SEQ ID NO: 226823 - DNA, 20 bp, Artificial Sequence
  Description of Artificial Sequence: Synthetic oligonucleotide
  Target: ATXN1; (-) strand; PAM type: YTN; PAM sequence: CTG
cacccattaaatcgtcattt

SEQ ID NO: 226824 - DNA, 20 bp, Artificial Sequence
  Description of Artificial Sequence: Synthetic oligonucleotide
  Target: ATXN1; (-) strand; PAM type: YTN; PAM sequence: TTG
tactgcacccattaaatcgt

SEQ ID NO: 226825 - DNA, 20 bp, Artificial Sequence
  Description of Artificial Sequence: Synthetic oligonucleotide
  Target: ATXN1; (-) strand; PAM type: YTN; PAM sequence: TTG
ttgtactgcacccattaaat

SEQ ID NO: 226826 - DNA, 20 bp, Artificial Sequence
  Description of Artificial Sequence: Synthetic oligonucleotide
  Target: ATXN1; (-) strand; PAM type: YTN; PAM sequence: TTA
catatgtatacatgtgccat

SEQ ID NO: 226827 - DNA, 20 bp, Artificial Sequence
  Description of Artificial Sequence: Synthetic oligonucleotide
  Target: ATXN1; (-) strand; PAM type: YTN; PAM sequence: TTG
ttacatatgtatacatgtgc

SEQ ID NO: 226828 - DNA, 20 bp, Artificial Sequence
  Description of Artificial Sequence: Synthetic oligonucleotide
  Target: ATXN1; (-) strand; PAM type: YTN; PAM sequence: TTT
gttacatatgtatacatgtg

SEQ ID NO: 226829 - DNA, 20 bp, Artificial Sequence
  Description of Artificial Sequence: Synthetic oligonucleotide
  Target: ATXN1; (-) strand; PAM type: YTN; PAM sequence: TTG
caggtttgttacatatgtat

SEQ ID NO: 226830 - DNA, 20 bp, Artificial Sequence
  Description of Artificial Sequence: Synthetic oligonucleotide
  Target: ATXN1; (-) strand; PAM type: YTN; PAM sequence: CTT
gcaggtttgttacatatgta

SEQ ID NO: 226831 - DNA, 20 bp, Artificial Sequence
  Description of Artificial Sequence: Synthetic oligonucleotide
  Target: ATXN1; (-) strand; PAM type: YTN; PAM sequence: TTA
gggtagatgtgcacaacttg

SEQ ID NO: 226832 - DNA, 20 bp, Artificial Sequence
  Description of Artificial Sequence: Synthetic oligonucleotide
  Target: ATXN1; (-) strand; PAM type: YTN; PAM sequence: TTT
agggtagatgtgcacaactt

SEQ ID NO: 226833 - DNA, 20 bp, Artificial Sequence
  Description of Artificial Sequence: Synthetic oligonucleotide
  Target: ATXN1; (-) strand; PAM type: YTN; PAM sequence: TTT
tagggtagatgtgcacaact

SEQ ID NO: 226834 - DNA, 20 bp, Artificial Sequence
  Description of Artificial Sequence: Synthetic oligonucleotide
  Target: ATXN1; (-) strand; PAM type: YTN; PAM sequence: TTA
agttttagggtagatgtgca

SEQ ID NO: 226835 - DNA, 20 bp, Artificial Sequence
  Description of Artificial Sequence: Synthetic oligonucleotide
  Target: ATXN1; (-) strand; PAM type: YTN; PAM sequence: TTT
aagttttagggtagatgtgc

SEQ ID NO: 226836 - DNA, 20 bp, Artificial Sequence
  Description of Artificial Sequence: Synthetic oligonucleotide
  Target: ATXN1; (-) strand; PAM type: YTN; PAM sequence: CTT
taagttttagggtagatgtg

SEQ ID NO: 226837 - DNA, 20 bp, Artificial Sequence
  Description of Artificial Sequence: Synthetic oligonucleotide
  Target: ATXN1; (-) strand; PAM type: YTN; PAM sequence: TTA
tactttaagttttagggtag

SEQ ID NO: 226838 - DNA, 20 bp, Artificial Sequence
  Description of Artificial Sequence: Synthetic oligonucleotide
  Target: ATXN1; (-) strand; PAM type: YTN; PAM sequence: TTA
aaattatactttaagtttta

SEQ ID NO: 226839 - DNA, 20 bp, Artificial Sequence
  Description of Artificial Sequence: Synthetic oligonucleotide
  Target: ATXN1; (-) strand; PAM type: YTN; PAM sequence: TTT
aaaattatactttaagtttt

SEQ ID NO: 226840 - DNA, 20 bp, Artificial Sequence
  Description of Artificial Sequence: Synthetic oligonucleotide
  Target: ATXN1; (-) strand; PAM type: YTN; PAM sequence: TTT
taaaattatactttaagttt

SEQ ID NO: 226841 - DNA, 20 bp, Artificial Sequence
  Description of Artificial Sequence: Synthetic oligonucleotide
  Target: ATXN1; (-) strand; PAM type: YTN; PAM sequence: TTT
ttaaaattatactttaagtt

SEQ ID NO: 226842 - DNA, 20 bp, Artificial Sequence
  Description of Artificial Sequence: Synthetic oligonucleotide
  Target: ATXN1; (-) strand; PAM type: YTN; PAM sequence: TTT
tttaaaattatactttaagt

SEQ ID NO: 226843 - DNA, 20 bp, Artificial Sequence
  Description of Artificial Sequence: Synthetic oligonucleotide
  Target: ATXN1; (-) strand; PAM type: YTN; PAM sequence: TTT
ttttaaaattatactttaag

SEQ ID NO: 226844 - DNA, 20 bp, Artificial Sequence
  Description of Artificial Sequence: Synthetic oligonucleotide
  Target: ATXN1; (-) strand; PAM type: YTN; PAM sequence: TTA
taaaggaatttttttaaaat

SEQ ID NO: 226845 - DNA, 20 bp, Artificial Sequence
  Description of Artificial Sequence: Synthetic oligonucleotide
  Target: ATXN1; (-) strand; PAM type: YTN; PAM sequence: TTA
taaagagaaatatagagtta

SEQ ID NO: 226846 - DNA, 20 bp, Artificial Sequence
  Description of Artificial Sequence: Synthetic oligonucleotide
  Target: ATXN1; (-) strand; PAM type: YTN; PAM sequence: TTC
atagaggttataaagagaaa

SEQ ID NO: 226847 - DNA, 20 bp, Artificial Sequence
  Description of Artificial Sequence: Synthetic oligonucleotide
  Target: ATXN1; (-) strand; PAM type: YTN; PAM sequence: TTT
catagaggttataaagagaa

SEQ ID NO: 226848 - DNA, 20 bp, Artificial Sequence
  Description of Artificial Sequence: Synthetic oligonucleotide
  Target: ATXN1; (-) strand; PAM type: YTN; PAM sequence: TTT
tcatagaggttataaagaga

SEQ ID NO: 226849 - DNA, 20 bp, Artificial Sequence
  Description of Artificial Sequence: Synthetic oligonucleotide
  Target: ATXN1; (-) strand; PAM type: YTN; PAM sequence: CTT
ttcatagaggttataaagag

SEQ ID NO: 226850 - DNA, 20 bp, Artificial Sequence
  Description of Artificial Sequence: Synthetic oligonucleotide
  Target: ATXN1; (-) strand; PAM type: YTN; PAM sequence: TTG
caatacttttcatagaggtt

SEQ ID NO: 226851 - DNA, 20 bp, Artificial Sequence
  Description of Artificial Sequence: Synthetic oligonucleotide
  Target: ATXN1; (-) strand; PAM type: YTN; PAM sequence: CTA
gttgcaatacttttcataga

SEQ ID NO: 226852 - DNA, 20 bp, Artificial Sequence
  Description of Artificial Sequence: Synthetic oligonucleotide
  Target: ATXN1; (-) strand; PAM type: YTN; PAM sequence: TTC
aaacctagttgcaatacttt

SEQ ID NO: 226853 - DNA, 20 bp, Artificial Sequence
  Description of Artificial Sequence: Synthetic oligonucleotide
  Target: ATXN1; (-) strand; PAM type: YTN; PAM sequence: TTG
ttcaaacctagttgcaatac

SEQ ID NO: 226854 - DNA, 20 bp, Artificial Sequence
  Description of Artificial Sequence: Synthetic oligonucleotide
  Target: ATXN1; (-) strand; PAM type: YTN; PAM sequence: TTT
gttcaaacctagttgcaata

SEQ ID NO: 226855 - DNA, 20 bp, Artificial Sequence
  Description of Artificial Sequence: Synthetic oligonucleotide
  Target: ATXN1; (-) strand; PAM type: YTN; PAM sequence: TTT
tgttcaaacctagttgcaat

SEQ ID NO: 226856 - DNA, 20 bp, Artificial Sequence
  Description of Artificial Sequence: Synthetic oligonucleotide
  Target: ATXN1; (-) strand; PAM type: YTN; PAM sequence: TTA
catgattttgttcaaaccta

SEQ ID NO: 226857 - DNA, 20 bp, Artificial Sequence
  Description of Artificial Sequence: Synthetic oligonucleotide
  Target: ATXN1; (-) strand; PAM type: YTN; PAM sequence: TTT
acatgattttgttcaaacct

SEQ ID NO: 226858 - DNA, 20 bp, Artificial Sequence
  Description of Artificial Sequence: Synthetic oligonucleotide
  Target: ATXN1; (-) strand; PAM type: YTN; PAM sequence: TTG
tttacatgattttgttcaaa

SEQ ID NO: 226859 - DNA, 20 bp, Artificial Sequence
  Description of Artificial Sequence: Synthetic oligonucleotide
  Target: ATXN1; (-) strand; PAM type: YTN; PAM sequence: TTT
gtttacatgattttgttcaa

SEQ ID NO: 226860 - DNA, 20 bp, Artificial Sequence
  Description of Artificial Sequence: Synthetic oligonucleotide
  Target: ATXN1; (-) strand; PAM type: YTN; PAM sequence: TTT
tgtttacatgattttgttca

SEQ ID NO: 226861 - DNA, 20 bp, Artificial Sequence
  Description of Artificial Sequence: Synthetic oligonucleotide
  Target: ATXN1; (-) strand; PAM type: YTN; PAM sequence: CTT
ttgtttacatgattttgttc

SEQ ID NO: 226862 - DNA, 20 bp, Artificial Sequence
  Description of Artificial Sequence: Synthetic oligonucleotide
  Target: ATXN1; (-) strand; PAM type: YTN; PAM sequence: CTC
caagtcttttgtttacatga

SEQ ID NO: 226863 - DNA, 20 bp, Artificial Sequence
  Description of Artificial Sequence: Synthetic oligonucleotide
  Target: ATXN1; (-) strand; PAM type: YTN; PAM sequence: TTA
gtctccaagtcttttgttta

SEQ ID NO: 226864 - DNA, 20 bp, Artificial Sequence
  Description of Artificial Sequence: Synthetic oligonucleotide
  Target: ATXN1; (-) strand; PAM type: YTN; PAM sequence: TTA
agatgttagtctccaagtct

SEQ ID NO: 226865 - DNA, 20 bp, Artificial Sequence
  Description of Artificial Sequence: Synthetic oligonucleotide
  Target: ATXN1; (-) strand; PAM type: YTN; PAM sequence: TTA
aaattaagatgttagtctcc

SEQ ID NO: 226866 - DNA, 20 bp, Artificial Sequence
  Description of Artificial Sequence: Synthetic oligonucleotide
  Target: ATXN1; (-) strand; PAM type: YTN; PAM sequence: TTG
ttaaaattaagatgttagtc

SEQ ID NO: 226867 - DNA, 20 bp, Artificial Sequence
  Description of Artificial Sequence: Synthetic oligonucleotide
  Target: ATXN1; (-) strand; PAM type: YTN; PAM sequence: TTA
cccccacagcccagtatagt

SEQ ID NO: 226868 - DNA, 20 bp, Artificial Sequence
  Description of Artificial Sequence: Synthetic oligonucleotide
  Target: ATXN1; (-) strand; PAM type: YTN; PAM sequence: TTT
acccccacagcccagtatag

SEQ ID NO: 226869 - DNA, 20 bp, Artificial Sequence
  Description of Artificial Sequence: Synthetic oligonucleotide
  Target: ATXN1; (-) strand; PAM type: YTN; PAM sequence: CTG
agtaaagaaaggaaacattt

SEQ ID NO: 226870 - DNA, 20 bp, Artificial Sequence
  Description of Artificial Sequence: Synthetic oligonucleotide
  Target: ATXN1; (-) strand; PAM type: YTN; PAM sequence: CTA
aactgagtaaagaaaggaaa

SEQ ID NO: 226871 - DNA, 20 bp, Artificial Sequence
  Description of Artificial Sequence: Synthetic oligonucleotide
  Target: ATXN1; (-) strand; PAM type: YTN; PAM sequence: TTC
ctaaactgagtaaagaaagg

SEQ ID NO: 226872 - DNA, 20 bp, Artificial Sequence
  Description of Artificial Sequence: Synthetic oligonucleotide
  Target: ATXN1; (-) strand; PAM type: YTN; PAM sequence: TTT
cctaaactgagtaaagaaag

SEQ ID NO: 226873 - DNA, 20 bp, Artificial Sequence
  Description of Artificial Sequence: Synthetic oligonucleotide
  Target: ATXN1; (-) strand; PAM type: YTN; PAM sequence: TTA
taggcacagtttcctaaact

SEQ ID NO: 226874 - DNA, 20 bp, Artificial Sequence
  Description of Artificial Sequence: Synthetic oligonucleotide
  Target: ATXN1; (-) strand; PAM type: YTN; PAM sequence: TTA
ttataggcacagtttcctaa

SEQ ID NO: 226875 - DNA, 20 bp, Artificial Sequence
  Description of Artificial Sequence: Synthetic oligonucleotide
  Target: ATXN1; (-) strand; PAM type: YTN; PAM sequence: TTT
attataggcacagtttccta

SEQ ID NO: 226876 - DNA, 20 bp, Artificial Sequence
  Description of Artificial Sequence: Synthetic oligonucleotide
  Target: ATXN1; (-) strand; PAM type: YTN; PAM sequence: CTA
tttattataggcacagtttc

SEQ ID NO: 226877 - DNA, 20 bp, Artificial Sequence
  Description of Artificial Sequence: Synthetic oligonucleotide
  Target: ATXN1; (-) strand; PAM type: YTN; PAM sequence: TTC
accatagatgtactatttat

SEQ ID NO: 226878 - DNA, 20 bp, Artificial Sequence
  Description of Artificial Sequence: Synthetic oligonucleotide
  Target: ATXN1; (-) strand; PAM type: YTN; PAM sequence: TTA
agtacattcaccatagatgt

SEQ ID NO: 226879 - DNA, 20 bp, Artificial Sequence
  Description of Artificial Sequence: Synthetic oligonucleotide
  Target: ATXN1; (-) strand; PAM type: YTN; PAM sequence: TTC
agtggcattaagtacattca

SEQ ID NO: 226880 - DNA, 20 bp, Artificial Sequence
  Description of Artificial Sequence: Synthetic oligonucleotide
  Target: ATXN1; (-) strand; PAM type: YTN; PAM sequence: TTT
cagtggcattaagtacattc

SEQ ID NO: 226881 - DNA, 20 bp, Artificial Sequence
  Description of Artificial Sequence: Synthetic oligonucleotide
  Target: ATXN1; (-) strand; PAM type: YTN; PAM sequence: TTA
aatatgcatttcagtggcat

SEQ ID NO: 226882 - DNA, 20 bp, Artificial Sequence
  Description of Artificial Sequence: Synthetic oligonucleotide
  Target: ATXN1; (-) strand; PAM type: YTN; PAM sequence: TTT
aaatatgcatttcagtggca

SEQ ID NO: 226883 - DNA, 20 bp, Artificial Sequence
  Description of Artificial Sequence: Synthetic oligonucleotide
  Target: ATXN1; (-) strand; PAM type: YTN; PAM sequence: TTT
taaatatgcatttcagtggc

SEQ ID NO: 226884 - DNA, 20 bp, Artificial Sequence
  Description of Artificial Sequence: Synthetic oligonucleotide
  Target: ATXN1; (-) strand; PAM type: YTN; PAM sequence: TTT
ttaaatatgcatttcagtgg

SEQ ID NO: 226885 - DNA, 20 bp, Artificial Sequence
  Description of Artificial Sequence: Synthetic oligonucleotide
  Target: ATXN1; (-) strand; PAM type: YTN; PAM sequence: TTA
accatttttaaatatgcatt

SEQ ID NO: 226886 - DNA, 20 bp, Artificial Sequence
  Description of Artificial Sequence: Synthetic oligonucleotide
  Target: ATXN1; (-) strand; PAM type: YTN; PAM sequence: TTT
aaccatttttaaatatgcat

SEQ ID NO: 226887 - DNA, 20 bp, Artificial Sequence
  Description of Artificial Sequence: Synthetic oligonucleotide
  Target: ATXN1; (-) strand; PAM type: YTN; PAM sequence: CTT
taaccatttttaaatatgca

SEQ ID NO: 226888 - DNA, 20 bp, Artificial Sequence
  Description of Artificial Sequence: Synthetic oligonucleotide
  Target: ATXN1; (-) strand; PAM type: YTN; PAM sequence: CTG
tgcccaacccactttaacca

SEQ ID NO: 226889 - DNA, 20 bp, Artificial Sequence
  Description of Artificial Sequence: Synthetic oligonucleotide
  Target: ATXN1; (-) strand; PAM type: YTN; PAM sequence: TTA
cagtcgtgagccactgtgcc

SEQ ID NO: 226890 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgccgggattacag

SEQ ID NO: 226891 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgccggga

SEQ ID NO: 226892 - DNA, 20 bp, Artificial Sequence
  Description of Artificial Sequence: Synthetic oligonucleotide
  Target: ATXN1; (-) strand; PAM type: YTN; PAM sequence: CTC
aggtgatccacccgcctcgg

SEQ ID NO: 226893 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatccacccgc

SEQ ID NO: 226894 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatccacc

SEQ ID NO: 226895 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcaggtga

SEQ ID NO: 226896 - DNA, 20 bp, Artificial Sequence
  Description of Artificial Sequence: Synthetic oligonucleotide
  Target: ATXN1; (-) strand; PAM type: YTN; PAM sequence: TTG
gtctcgaactcctgacctca

SEQ ID NO: 226897 - DNA, 20 bp, Artificial Sequence
  Description of Artificial Sequence: Synthetic oligonucleotide
  Target: ATXN1; (-) strand; PAM type: YTN; PAM sequence: TTG
gccagattggtctcgaactc

SEQ ID NO: 226898 - DNA, 20 bp, Artificial Sequence
  Description of Artificial Sequence: Synthetic oligonucleotide
  Target: ATXN1; (-) strand; PAM type: YTN; PAM sequence: CTA
tgttggccagattggtctcg

SEQ ID NO: 226899 - DNA, 20 bp, Artificial Sequence
  Description of Artificial Sequence: Synthetic oligonucleotide
  Target: ATXN1; (-) strand; PAM type: YTN; PAM sequence: TTC
actatgttggccagattggt

SEQ ID NO: 226900 - DNA, 20 bp, Artificial Sequence
  Description of Artificial Sequence: Synthetic oligonucleotide
  Target: ATXN1; (-) strand; PAM type: YTN; PAM sequence: TTT
cactatgttggccagattgg

SEQ ID NO: 226901 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggtttcacta

SEQ ID NO: 226902 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggtttcact

SEQ ID NO: 226903 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggtttcac

SEQ ID NO: 226904 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggtttca

SEQ ID NO: 226905 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacgggg

SEQ ID NO: 226906 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggg

SEQ ID NO: 226907 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 226908 - DNA, 20 bp, Artificial Sequence
  Description of Artificial Sequence: Synthetic oligonucleotide
  Target: ATXN1; (-) strand; PAM type: YTN; PAM sequence: CTA
gttttgtatttttagtagag

SEQ ID NO: 226909 - DNA, 20 bp, Artificial Sequence
  Description of Artificial Sequence: Synthetic oligonucleotide
  Target: ATXN1; (-) strand; PAM type: YTN; PAM sequence: TTA
caggcgtgcgccatcacacc

SEQ ID NO: 226910 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgcgccat

SEQ ID NO: 226911 - DNA, 20 bp, Artificial Sequence
  Description of Artificial Sequence: Synthetic oligonucleotide
  Target: ATXN1; (-) strand; PAM type: YTN; PAM sequence: CTC
ccgggtagctgggattacag

SEQ ID NO: 226912 - DNA, 20 bp, Artificial Sequence
  Description of Artificial Sequence: Synthetic oligonucleotide
  Target: ATXN1; (-) strand; PAM type: YTN; PAM sequence: CTC
aggctcccgggtagctggga

SEQ ID NO: 226913 - DNA, 20 bp, Artificial Sequence
  Description of Artificial Sequence: Synthetic oligonucleotide
  Target: ATXN1; (-) strand; PAM type: YTN; PAM sequence: CTG
gctcaggctcccgggtagct

SEQ ID NO: 226914 - DNA, 20 bp, Artificial Sequence
  Description of Artificial Sequence: Synthetic oligonucleotide
  Target: ATXN1; (-) strand; PAM type: YTN; PAM sequence: CTC
ctggctcaggctcccgggta

SEQ ID NO: 226915 - DNA, 20 bp, Artificial Sequence
  Description of Artificial Sequence: Synthetic oligonucleotide
  Target: ATXN1; (-) strand; PAM type: YTN; PAM sequence: TTC
tcctggctcaggctcccggg

SEQ ID NO: 226916 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcctggctcag

SEQ ID NO: 226917 - DNA, 20 bp, Artificial Sequence
  Description of Artificial Sequence: Synthetic oligonucleotide
  Target: ATXN1; (-) strand; PAM type: YTN; PAM sequence: CTC
caccccccaggttcaagcaa

SEQ ID NO: 226918 - DNA, 20 bp, Artificial Sequence
  Description of Artificial Sequence: Synthetic oligonucleotide
  Target: ATXN1; (-) strand; PAM type: YTN; PAM sequence: CTG
caacctccaccccccaggtt

SEQ ID NO: 226919 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccacccccca

SEQ ID NO: 226920 - DNA, 20 bp, Artificial Sequence
  Description of Artificial Sequence: Synthetic oligonucleotide
  Target: ATXN1; (-) strand; PAM type: YTN; PAM sequence: CTC
agctcactgcaacctccacc

SEQ ID NO: 226921 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgtgatctc

SEQ ID NO: 226922 - DNA, 20 bp, Artificial Sequence
  Description of Artificial Sequence: Synthetic oligonucleotide
  Target: ATXN1; (-) strand; PAM type: YTN; PAM sequence: CTG
cactggagtgcagtggtgtg

SEQ ID NO: 226923 - DNA, 20 bp, Artificial Sequence
  Description of Artificial Sequence: Synthetic oligonucleotide
  Target: ATXN1; (-) strand; PAM type: YTN; PAM sequence: TTG
cctgcactggagtgcagtgg

SEQ ID NO: 226924 - DNA, 20 bp, Artificial Sequence
  Description of Artificial Sequence: Synthetic oligonucleotide
  Target: ATXN1; (-) strand; PAM type: YTN; PAM sequence: TTG
ttgcctgcactggagtgcag

SEQ ID NO: 226925 - DNA, 20 bp, Artificial Sequence
  Description of Artificial Sequence: Synthetic oligonucleotide
  Target: ATXN1; (-) strand; PAM type: YTN; PAM sequence: CTT
gttgcctgcactggagtgca

SEQ ID NO: 226926 - DNA, 20 bp, Artificial Sequence
  Description of Artificial Sequence: Synthetic oligonucleotide
  Target: ATXN1; (-) strand; PAM type: YTN; PAM sequence: CTC
ttgttgcctgcactggagtg

SEQ ID NO: 226927 - DNA, 20 bp, Artificial Sequence
  Description of Artificial Sequence: Synthetic oligonucleotide
  Target: ATXN1; (-) strand; PAM type: YTN; PAM sequence: CTC
gctcttgttgcctgcactgg

SEQ ID NO: 226928 - DNA, 20 bp, Artificial Sequence
  Description of Artificial Sequence: Synthetic oligonucleotide
  Target: ATXN1; (-) strand; PAM type: YTN; PAM sequence: TTG
agatggaatctcgctcttgt

SEQ ID NO: 226929 - DNA, 20 bp, Artificial Sequence
  Description of Artificial Sequence: Synthetic oligonucleotide
  Target: ATXN1; (-) strand; PAM type: YTN; PAM sequence: TTT
gagatggaatctcgctcttg

SEQ ID NO: 226930 - DNA, 20 bp, Artificial Sequence
  Description of Artificial Sequence: Synthetic oligonucleotide
  Target: ATXN1; (-) strand; PAM type: YTN; PAM sequence: TTT
tgagatggaatctcgctctt

SEQ ID NO: 226931 - DNA, 20 bp, Artificial Sequence
  Description of Artificial Sequence: Synthetic oligonucleotide
  Target: ATXN1; (-) strand; PAM type: YTN; PAM sequence: TTT
ttgagatggaatctcgctct

SEQ ID NO: 226932 - DNA, 20 bp, Artificial Sequence
  Description of Artificial Sequence: Synthetic oligonucleotide
  Target: ATXN1; (-) strand; PAM type: YTN; PAM sequence: TTT
tttgagatggaatctcgctc

SEQ ID NO: 226933 - DNA, 20 bp, Artificial Sequence
  Description of Artificial Sequence: Synthetic oligonucleotide
  Target: ATXN1; (-) strand; PAM type: YTN; PAM sequence: TTT
ttttgagatggaatctcgct

SEQ ID NO: 226934 - DNA, 20 bp, Artificial Sequence
  Description of Artificial Sequence: Synthetic oligonucleotide
  Target: ATXN1; (-) strand; PAM type: YTN; PAM sequence: TTG
tttttttgagatggaatctc

SEQ ID NO: 226935 - DNA, 20 bp, Artificial Sequence
  Description of Artificial Sequence: Synthetic oligonucleotide
  Target: ATXN1; (-) strand; PAM type: YTN; PAM sequence: TTT
gtttttttgagatggaatct

SEQ ID NO: 226936 - DNA, 20 bp, Artificial Sequence
  Description of Artificial Sequence: Synthetic oligonucleotide
  Target: ATXN1; (-) strand; PAM type: YTN; PAM sequence: CTT
tgtttttttgagatggaatc

SEQ ID NO: 226937 - DNA, 20 bp, Artificial Sequence
  Description of Artificial Sequence: Synthetic oligonucleotide
  Target: ATXN1; (-) strand; PAM type: YTN; PAM sequence: TTG
ctttgtttttttgagatgga

SEQ ID NO: 226938 - DNA, 20 bp, Artificial Sequence
  Description of Artificial Sequence: Synthetic oligonucleotide
  Target: ATXN1; (-) strand; PAM type: YTN; PAM sequence: TTA
ttgctttgtttttttgagat

SEQ ID NO: 226939 - DNA, 20 bp, Artificial Sequence
  Description of Artificial Sequence: Synthetic oligonucleotide
  Target: ATXN1; (-) strand; PAM type: YTN; PAM sequence: TTG
ttattgctttgtttttttga

SEQ ID NO: 226940 - DNA, 20 bp, Artificial Sequence
  Description of Artificial Sequence: Synthetic oligonucleotide
  Target: ATXN1; (-) strand; PAM type: YTN; PAM sequence: TTG
ttgttattgctttgtttttt

SEQ ID NO: 226941 - DNA, 20 bp, Artificial Sequence
  Description of Artificial Sequence: Synthetic oligonucleotide
  Target: ATXN1; (-) strand; PAM type: YTN; PAM sequence: TTA
accgttgttgttattgcttt

SEQ ID NO: 226942 - DNA, 20 bp, Artificial Sequence
  Description of Artificial Sequence: Synthetic oligonucleotide
  Target: ATXN1; (-) strand; PAM type: YTN; PAM sequence: TTT
aaccgttgttgttattgctt

SEQ ID NO: 226943 - DNA, 20 bp, Artificial Sequence
  Description of Artificial Sequence: Synthetic oligonucleotide
  Target: ATXN1; (-) strand; PAM type: YTN; PAM sequence: CTT
taaccgttgttgttattgct

SEQ ID NO: 226944 - DNA, 20 bp, Artificial Sequence
  Description of Artificial Sequence: Synthetic oligonucleotide
  Target: ATXN1; (-) strand; PAM type: YTN; PAM sequence: CTG
ctttaaccgttgttgttatt

SEQ ID NO: 226945 - DNA, 20 bp, Artificial Sequence
  Description of Artificial Sequence: Synthetic oligonucleotide
  Target: ATXN1; (-) strand; PAM type: YTN; PAM sequence: CTG
ctgctttaaccgttgttgtt

SEQ ID NO: 226946 - DNA, 20 bp, Artificial Sequence
  Description of Artificial Sequence: Synthetic oligonucleotide
  Target: ATXN1; (-) strand; PAM type: YTN; PAM sequence: CTC
aacataaaagctgctgcttt

SEQ ID NO: 226947 - DNA, 20 bp, Artificial Sequence
  Description of Artificial Sequence: Synthetic oligonucleotide
  Target: ATXN1; (-) strand; PAM type: YTN; PAM sequence: TTA
gagacactcaacataaaagc

SEQ ID NO: 226948 - DNA, 20 bp, Artificial Sequence
  Description of Artificial Sequence: Synthetic oligonucleotide
  Target: ATXN1; (-) strand; PAM type: YTN; PAM sequence: TTA
aatggtagttagagacactc

SEQ ID NO: 226949 - DNA, 20 bp, Artificial Sequence
  Description of Artificial Sequence: Synthetic oligonucleotide
  Target: ATXN1; (-) strand; PAM type: YTN; PAM sequence: TTT
aaatggtagttagagacact

SEQ ID NO: 226950 - DNA, 20 bp, Artificial Sequence
  Description of Artificial Sequence: Synthetic oligonucleotide
  Target: ATXN1; (-) strand; PAM type: YTN; PAM sequence: TTT
taaatggtagttagagacac

SEQ ID NO: 226951 - DNA, 20 bp, Artificial Sequence
  Description of Artificial Sequence: Synthetic oligonucleotide
  Target: ATXN1; (-) strand; PAM type: YTN; PAM sequence: TTT
ttaaatggtagttagagaca

SEQ ID NO: 226952 - DNA, 20 bp, Artificial Sequence
  Description of Artificial Sequence: Synthetic oligonucleotide
  Target: ATXN1; (-) strand; PAM type: YTN; PAM sequence: TTA
agtttttaaatggtagttag

SEQ ID NO: 226953 - DNA, 20 bp, Artificial Sequence
  Description of Artificial Sequence: Synthetic oligonucleotide
  Target: ATXN1; (-) strand; PAM type: YTN; PAM sequence: TTT
aagtttttaaatggtagtta

SEQ ID NO: 226954 - DNA, 20 bp, Artificial Sequence
  Description of Artificial Sequence: Synthetic oligonucleotide
  Target: ATXN1; (-) strand; PAM type: YTN; PAM sequence: TTA
tacagatttaagtttttaaa

SEQ ID NO: 226955 - DNA, 20 bp, Artificial Sequence
  Description of Artificial Sequence: Synthetic oligonucleotide
  Target: ATXN1; (-) strand; PAM type: YTN; PAM sequence: CTT
atacagatttaagtttttaa

SEQ ID NO: 226956 - DNA, 20 bp, Artificial Sequence
  Description of Artificial Sequence: Synthetic oligonucleotide
  Target: ATXN1; (-) strand; PAM type: YTN; PAM sequence: CTC
ttatacagatttaagttttt

SEQ ID NO: 226957 - DNA, 20 bp, Artificial Sequence
  Description of Artificial Sequence: Synthetic oligonucleotide
  Target: ATXN1; (-) strand; PAM type: YTN; PAM sequence: CTC
tcttatacagatttaagttt

SEQ ID NO: 226958 - DNA, 20 bp, Artificial Sequence
  Description of Artificial Sequence: Synthetic oligonucleotide
  Target: ATXN1; (-) strand; PAM type: YTN; PAM sequence: CTG
ctctcttatacagatttaag

SEQ ID NO: 226959 - DNA, 20 bp, Artificial Sequence
  Description of Artificial Sequence: Synthetic oligonucleotide
  Target: ATXN1; (-) strand; PAM type: YTN; PAM sequence: TTG
cctgctctcttatacagatt

SEQ ID NO: 226960 - DNA, 20 bp, Artificial Sequence
  Description of Artificial Sequence: Synthetic oligonucleotide
  Target: ATXN1; (-) strand; PAM type: YTN; PAM sequence: TTT
gcctgctctcttatacagat

SEQ ID NO: 226961 - DNA, 20 bp, Artificial Sequence
  Description of Artificial Sequence: Synthetic oligonucleotide
  Target: ATXN1; (-) strand; PAM type: YTN; PAM sequence: TTT
tgcctgctctcttatacaga

SEQ ID NO: 226962 - DNA, 20 bp, Artificial Sequence
  Description of Artificial Sequence: Synthetic oligonucleotide
  Target: ATXN1; (-) strand; PAM type: YTN; PAM sequence: CTC
catgacgtgttttgcctgct

SEQ ID NO: 226963 - DNA, 20 bp, Artificial Sequence
  Description of Artificial Sequence: Synthetic oligonucleotide
  Target: ATXN1; (-) strand; PAM type: YTN; PAM sequence: TTC
gtacagtgtgggctccatga

SEQ ID NO: 226964 - DNA, 20 bp, Artificial Sequence
  Description of Artificial Sequence: Synthetic oligonucleotide
  Target: ATXN1; (-) strand; PAM type: YTN; PAM sequence: CTC
caaaacattcgtacagtgtg

SEQ ID NO: 226965 - DNA, 20 bp, Artificial Sequence
  Description of Artificial Sequence: Synthetic oligonucleotide
  Target: ATXN1; (-) strand; PAM type: YTN; PAM sequence: CTC
agtgcgcacctccaaaacat

SEQ ID NO: 226966 - DNA, 20 bp, Artificial Sequence
  Description of Artificial Sequence: Synthetic oligonucleotide
  Target: ATXN1; (-) strand; PAM type: YTN; PAM sequence: TTA
actcagtgcgcacctccaaa

SEQ ID NO: 226967 - DNA, 20 bp, Artificial Sequence
  Description of Artificial Sequence: Synthetic oligonucleotide
  Target: ATXN1; (-) strand; PAM type: YTN; PAM sequence: TTT
aactcagtgcgcacctccaa

SEQ ID NO: 226968 - DNA, 20 bp, Artificial Sequence
  Description of Artificial Sequence: Synthetic oligonucleotide
  Target: ATXN1; (-) strand; PAM type: YTN; PAM sequence: TTT
taactcagtgcgcacctcca

SEQ ID NO: 226969 - DNA, 20 bp, Artificial Sequence
  Description of Artificial Sequence: Synthetic oligonucleotide
  Target: ATXN1; (-) strand; PAM type: YTN; PAM sequence: TTT
ttaactcagtgcgcacctcc

SEQ ID NO: 226970 - DNA, 20 bp, Artificial Sequence
  Description of Artificial Sequence: Synthetic oligonucleotide
  Target: ATXN1; (-) strand; PAM type: YTN; PAM sequence: TTA
tttttaactcagtgcgcacc

SEQ ID NO: 226971 - DNA, 20 bp, Artificial Sequence
  Description of Artificial Sequence: Synthetic oligonucleotide
  Target: ATXN1; (-) strand; PAM type: YTN; PAM sequence: TTT
atttttaactcagtgcgcac

SEQ ID NO: 226972 - DNA, 20 bp, Artificial Sequence
  Description of Artificial Sequence: Synthetic oligonucleotide
  Target: ATXN1; (-) strand; PAM type: YTN; PAM sequence: TTT
tatttttaactcagtgcgca

SEQ ID NO: 226973 - DNA, 20 bp, Artificial Sequence
  Description of Artificial Sequence: Synthetic oligonucleotide
  Target: ATXN1; (-) strand; PAM type: YTN; PAM sequence: TTT
ttatttttaactcagtgcgc

SEQ ID NO: 226974 - DNA, 20 bp, Artificial Sequence
  Description of Artificial Sequence: Synthetic oligonucleotide
  Target: ATXN1; (-) strand; PAM type: YTN; PAM sequence: TTT
tttatttttaactcagtgcg

SEQ ID NO: 226975 - DNA, 20 bp, Artificial Sequence
  Description of Artificial Sequence: Synthetic oligonucleotide
  Target: ATXN1; (-) strand; PAM type: YTN; PAM sequence: TTC
catgttttttatttttaact

SEQ ID NO: 226976 - DNA, 20 bp, Artificial Sequence
  Description of Artificial Sequence: Synthetic oligonucleotide
  Target: ATXN1; (-) strand; PAM type: YTN; PAM sequence: TTA
gataggaaatgaaaataaat

SEQ ID NO: 226977 - DNA, 20 bp, Artificial Sequence
  Description of Artificial Sequence: Synthetic oligonucleotide
  Target: ATXN1; (-) strand; PAM type: YTN; PAM sequence: CTG
gagaccaaattagataggaa

SEQ ID NO: 226978 - DNA, 20 bp, Artificial Sequence
  Description of Artificial Sequence: Synthetic oligonucleotide
  Target: ATXN1; (-) strand; PAM type: YTN; PAM sequence: CTC
tggagaccaaattagatagg

SEQ ID NO: 226979 - DNA, 20 bp, Artificial Sequence
  Description of Artificial Sequence: Synthetic oligonucleotide
  Target: ATXN1; (-) strand; PAM type: YTN; PAM sequence: TTA
gcaggctctggagaccaaat

SEQ ID NO: 226980 - DNA, 20 bp, Artificial Sequence
  Description of Artificial Sequence: Synthetic oligonucleotide
  Target: ATXN1; (-) strand; PAM type: YTN; PAM sequence: CTT
agcaggctctggagaccaaa

SEQ ID NO: 226981 - DNA, 20 bp, Artificial Sequence
  Description of Artificial Sequence: Synthetic oligonucleotide
  Target: ATXN1; (-) strand; PAM type: YTN; PAM sequence: CTG
tacttagcaggctctggaga

SEQ ID NO: 226982 - DNA, 20 bp, Artificial Sequence
  Description of Artificial Sequence: Synthetic oligonucleotide
  Target: ATXN1; (-) strand; PAM type: YTN; PAM sequence: TTG
cacccgagtagaaatggaaa

SEQ ID NO: 226983 - DNA, 20 bp, Artificial Sequence
  Description of Artificial Sequence: Synthetic oligonucleotide
  Target: ATXN1; (-) strand; PAM type: YTN; PAM sequence: CTT
gcacccgagtagaaatggaa

SEQ ID NO: 226984 - DNA, 20 bp, Artificial Sequence
  Description of Artificial Sequence: Synthetic oligonucleotide
  Target: ATXN1; (-) strand; PAM type: YTN; PAM sequence: CTC
ttgcacccgagtagaaatgg

SEQ ID NO: 226985 - DNA, 20 bp, Artificial Sequence
  Description of Artificial Sequence: Synthetic oligonucleotide
  Target: ATXN1; (-) strand; PAM type: YTN; PAM sequence: TTG
ctcttgcacccgagtagaaa

SEQ ID NO: 226986 - DNA, 20 bp, Artificial Sequence
  Description of Artificial Sequence: Synthetic oligonucleotide
  Target: ATXN1; (-) strand; PAM type: YTN; PAM sequence: CTC
cgtaaaacagcaaataagcc

SEQ ID NO: 226987 - DNA, 20 bp, Artificial Sequence
  Description of Artificial Sequence: Synthetic oligonucleotide
  Target: ATXN1; (-) strand; PAM type: YTN; PAM sequence: CTG
ctccgtaaaacagcaaataa

SEQ ID NO: 226988 - DNA, 20 bp, Artificial Sequence
  Description of Artificial Sequence: Synthetic oligonucleotide
  Target: ATXN1; (-) strand; PAM type: YTN; PAM sequence: TTA
aggaactgctccgtaaaaca

SEQ ID NO: 226989 - DNA, 20 bp, Artificial Sequence
  Description of Artificial Sequence: Synthetic oligonucleotide
  Target: ATXN1; (-) strand; PAM type: YTN; PAM sequence: TTC
agaggcaatgatagttaagg

SEQ ID NO: 226990 - DNA, 20 bp, Artificial Sequence
  Description of Artificial Sequence: Synthetic oligonucleotide
  Target: ATXN1; (-) strand; PAM type: YTN; PAM sequence: TTG
gggggaaagggggttcagag

SEQ ID NO: 226991 - DNA, 20 bp, Artificial Sequence
  Description of Artificial Sequence: Synthetic oligonucleotide
  Target: ATXN1; (-) strand; PAM type: YTN; PAM sequence: CTT
ggggggaaagggggttcaga

SEQ ID NO: 226992 - DNA, 20 bp, Artificial Sequence
  Description of Artificial Sequence: Synthetic oligonucleotide
  Target: ATXN1; (-) strand; PAM type: YTN; PAM sequence: CTG
tagaccgacagtcaatcttg

SEQ ID NO: 226993 - DNA, 20 bp, Artificial Sequence
  Description of Artificial Sequence: Synthetic oligonucleotide
  Target: ATXN1; (-) strand; PAM type: YTN; PAM sequence: TTC
tgtagaccgacagtcaatct

SEQ ID NO: 226994 - DNA, 20 bp, Artificial Sequence
  Description of Artificial Sequence: Synthetic oligonucleotide
  Target: ATXN1; (-) strand; PAM type: YTN; PAM sequence: CTG
attctgtagaccgacagtca

SEQ ID NO: 226995 - DNA, 20 bp, Artificial Sequence
  Description of Artificial Sequence: Synthetic oligonucleotide
  Target: ATXN1; (-) strand; PAM type: YTN; PAM sequence: TTA
actgattctgtagaccgaca

SEQ ID NO: 226996 - DNA, 20 bp, Artificial Sequence
  Description of Artificial Sequence: Synthetic oligonucleotide
  Target: ATXN1; (-) strand; PAM type: YTN; PAM sequence: CTT
aactgattctgtagaccgac

SEQ ID NO: 226997 - DNA, 20 bp, Artificial Sequence
  Description of Artificial Sequence: Synthetic oligonucleotide
  Target: ATXN1; (-) strand; PAM type: YTN; PAM sequence: TTG
tagcacttaactgattctgt

SEQ ID NO: 226998 - DNA, 20 bp, Artificial Sequence
  Description of Artificial Sequence: Synthetic oligonucleotide
  Target: ATXN1; (-) strand; PAM type: YTN; PAM sequence: TTT
gtagcacttaactgattctg

SEQ ID NO: 226999 - DNA, 20 bp, Artificial Sequence
  Description of Artificial Sequence: Synthetic oligonucleotide
  Target: ATXN1; (-) strand; PAM type: YTN; PAM sequence: TTA
gtagtgatttgtagcactta

SEQ ID NO: 227000 - DNA, 20 bp, Artificial Sequence
  Description of Artificial Sequence: Synthetic oligonucleotide
  Target: ATXN1; (-) strand; PAM type: YTN; PAM sequence: CTG
ttagtagtgatttgtagcac

SEQ ID NO: 227001 - DNA, 20 bp, Artificial Sequence
  Description of Artificial Sequence: Synthetic oligonucleotide
  Target: ATXN1; (-) strand; PAM type: YTN; PAM sequence: CTC
gcaggagctgttagtagtga

SEQ ID NO: 227002 - DNA, 20 bp, Artificial Sequence
  Description of Artificial Sequence: Synthetic oligonucleotide
  Target: ATXN1; (-) strand; PAM type: YTN; PAM sequence: TTA
gagggagcgcctcgcaggag

SEQ ID NO: 227003 - DNA, 20 bp, Artificial Sequence
  Description of Artificial Sequence: Synthetic oligonucleotide
  Target: ATXN1; (-) strand; PAM type: YTN; PAM sequence: CTT
agagggagcgcctcgcagga

SEQ ID NO: 227004 - DNA, 20 bp, Artificial Sequence
  Description of Artificial Sequence: Synthetic oligonucleotide
  Target: ATXN1; (-) strand; PAM type: YTN; PAM sequence: TTC
ttagagggagcgcctcgcag

SEQ ID NO: 227005 - DNA, 20 bp, Artificial Sequence
  Description of Artificial Sequence: Synthetic oligonucleotide
  Target: ATXN1; (-) strand; PAM type: YTN; PAM sequence: CTG
tacagattcttagagggagc

SEQ ID NO: 227006 - DNA, 20 bp, Artificial Sequence
  Description of Artificial Sequence: Synthetic oligonucleotide
  Target: ATXN1; (-) strand; PAM type: YTN; PAM sequence: TTG
atctgtacagattcttagag

SEQ ID NO: 227007 - DNA, 20 bp, Artificial Sequence
  Description of Artificial Sequence: Synthetic oligonucleotide
  Target: ATXN1; (-) strand; PAM type: YTN; PAM sequence: TTT
gatctgtacagattcttaga

SEQ ID NO: 227008 - DNA, 20 bp, Artificial Sequence
  Description of Artificial Sequence: Synthetic oligonucleotide
  Target: ATXN1; (-) strand; PAM type: YTN; PAM sequence: TTT
tgatctgtacagattcttag

SEQ ID NO: 227009 - DNA, 20 bp, Artificial Sequence
  Description of Artificial Sequence: Synthetic oligonucleotide
  Target: ATXN1; (-) strand; PAM type: YTN; PAM sequence: TTG
agattttgatctgtacagat

SEQ ID NO: 227010 - DNA, 20 bp, Artificial Sequence
  Description of Artificial Sequence: Synthetic oligonucleotide
  Target: ATXN1; (-) strand; PAM type: YTN; PAM sequence: CTT
gagattttgatctgtacaga

SEQ ID NO: 227011 - DNA, 20 bp, Artificial Sequence
  Description of Artificial Sequence: Synthetic oligonucleotide
  Target: ATXN1; (-) strand; PAM type: YTN; PAM sequence: CTG
ggcaagtaagcacttgagat

SEQ ID NO: 227012 - DNA, 20 bp, Artificial Sequence
  Description of Artificial Sequence: Synthetic oligonucleotide
  Target: ATXN1; (-) strand; PAM type: YTN; PAM sequence: TTA
tggcagtccctgggcaagta

SEQ ID NO: 227013 - DNA, 20 bp, Artificial Sequence
  Description of Artificial Sequence: Synthetic oligonucleotide
  Target: ATXN1; (-) strand; PAM type: YTN; PAM sequence: CTC
aaattatggcagtccctggg

SEQ ID NO: 227014 - DNA, 20 bp, Artificial Sequence
  Description of Artificial Sequence: Synthetic oligonucleotide
  Target: ATXN1; (-) strand; PAM type: YTN; PAM sequence: TTA
aaaagaagcaacacctcaaa

SEQ ID NO: 227015 - DNA, 20 bp, Artificial Sequence
  Description of Artificial Sequence: Synthetic oligonucleotide
  Target: ATXN1; (-) strand; PAM type: YTN; PAM sequence: TTT
aaaaagaagcaacacctcaa

SEQ ID NO: 227016 - DNA, 20 bp, Artificial Sequence
  Description of Artificial Sequence: Synthetic oligonucleotide
  Target: ATXN1; (-) strand; PAM type: YTN; PAM sequence: CTT
taaaaagaagcaacacctca

SEQ ID NO: 227017 - DNA, 20 bp, Artificial Sequence
  Description of Artificial Sequence: Synthetic oligonucleotide
  Target: ATXN1; (-) strand; PAM type: YTN; PAM sequence: TTA
tactttaaaaagaagcaaca

SEQ ID NO: 227018 - DNA, 20 bp, Artificial Sequence
  Description of Artificial Sequence: Synthetic oligonucleotide
  Target: ATXN1; (-) strand; PAM type: YTN; PAM sequence: TTT
atactttaaaaagaagcaac

SEQ ID NO: 227019 - DNA, 20 bp, Artificial Sequence
  Description of Artificial Sequence: Synthetic oligonucleotide
  Target: ATXN1; (-) strand; PAM type: YTN; PAM sequence: TTT
tatactttaaaaagaagcaa

SEQ ID NO: 227020 - DNA, 20 bp, Artificial Sequence
  Description of Artificial Sequence: Synthetic oligonucleotide
  Target: ATXN1; (-) strand; PAM type: YTN; PAM sequence: TTT
ttatactttaaaaagaagca

SEQ ID NO: 227021 - DNA, 20 bp, Artificial Sequence
  Description of Artificial Sequence: Synthetic oligonucleotide
  Target: ATXN1; (-) strand; PAM type: YTN; PAM sequence: TTT
tttatactttaaaaagaagc

SEQ ID NO: 227022 - DNA, 20 bp, Artificial Sequence
  Description of Artificial Sequence: Synthetic oligonucleotide
  Target: ATXN1; (-) strand; PAM type: YTN; PAM sequence: CTG
ttttttatactttaaaaaga

SEQ ID NO: 227023 - DNA, 20 bp, Artificial Sequence
  Description of Artificial Sequence: Synthetic oligonucleotide
  Target: ATXN1; (-) strand; PAM type: YTN; PAM sequence: TTA
gagcatctgttttttatact

SEQ ID NO: 227024 - DNA, 20 bp, Artificial Sequence
  Description of Artificial Sequence: Synthetic oligonucleotide
  Target: ATXN1; (-) strand; PAM type: YTN; PAM sequence: CTT
agagcatctgttttttatac

SEQ ID NO: 227025 - DNA, 20 bp, Artificial Sequence
  Description of Artificial Sequence: Synthetic oligonucleotide
  Target: ATXN1; (-) strand; PAM type: YTN; PAM sequence: TTC
atcagcttagagcatctgtt

SEQ ID NO: 227026 - DNA, 20 bp, Artificial Sequence
  Description of Artificial Sequence: Synthetic oligonucleotide
  Target: ATXN1; (-) strand; PAM type: YTN; PAM sequence: TTT
catcagcttagagcatctgt

SEQ ID NO: 227027 - DNA, 20 bp, Artificial Sequence
  Description of Artificial Sequence: Synthetic oligonucleotide
  Target: ATXN1; (-) strand; PAM type: YTN; PAM sequence: CTT
tcatcagcttagagcatctg

SEQ ID NO: 227028 - DNA, 20 bp, Artificial Sequence
  Description of Artificial Sequence: Synthetic oligonucleotide
  Target: ATXN1; (-) strand; PAM type: YTN; PAM sequence: TTA
ctttcatcagcttagagcat

SEQ ID NO: 227029 - DNA, 20 bp, Artificial Sequence
  Description of Artificial Sequence: Synthetic oligonucleotide
  Target: ATXN1; (-) strand; PAM type: YTN; PAM sequence: TTT
actttcatcagcttagagca

SEQ ID NO: 227030 - DNA, 20 bp, Artificial Sequence
  Description of Artificial Sequence: Synthetic oligonucleotide
  Target: ATXN1; (-) strand; PAM type: YTN; PAM sequence: TTG
aaaggacatttactttcatc

SEQ ID NO: 227031 - DNA, 20 bp, Artificial Sequence
  Description of Artificial Sequence: Synthetic oligonucleotide
  Target: ATXN1; (-) strand; PAM type: YTN; PAM sequence: CTG
gggaagagatgtgttgaaag

SEQ ID NO: 227032 - DNA, 20 bp, Artificial Sequence
  Description of Artificial Sequence: Synthetic oligonucleotide
  Target: ATXN1; (-) strand; PAM type: YTN; PAM sequence: TTC
aagtgctggggaagagatgt

SEQ ID NO: 227033 - DNA, 20 bp, Artificial Sequence
  Description of Artificial Sequence: Synthetic oligonucleotide
  Target: ATXN1; (-) strand; PAM type: YTN; PAM sequence: TTT
caagtgctggggaagagatg

SEQ ID NO: 227034 - DNA, 20 bp, Artificial Sequence
  Description of Artificial Sequence: Synthetic oligonucleotide
  Target: ATXN1; (-) strand; PAM type: YTN; PAM sequence: TTT
tcaagtgctggggaagagat

SEQ ID NO: 227035 - DNA, 20 bp, Artificial Sequence
  Description of Artificial Sequence: Synthetic oligonucleotide
  Target: ATXN1; (-) strand; PAM type: YTN; PAM sequence: TTG
gtaagattttcaagtgctgg

SEQ ID NO: 227036 - DNA, 20 bp, Artificial Sequence
  Description of Artificial Sequence: Synthetic oligonucleotide
  Target: ATXN1; (-) strand; PAM type: YTN; PAM sequence: TTG
ttggtaagattttcaagtgc

SEQ ID NO: 227037 - DNA, 20 bp, Artificial Sequence
  Description of Artificial Sequence: Synthetic oligonucleotide
  Target: ATXN1; (-) strand; PAM type: YTN; PAM sequence: CTT
gttggtaagattttcaagtg

SEQ ID NO: 227038 - DNA, 20 bp, Artificial Sequence
  Description of Artificial Sequence: Synthetic oligonucleotide
  Target: ATXN1; (-) strand; PAM type: YTN; PAM sequence: TTC
ttgttggtaagattttcaag

SEQ ID NO: 227039 - DNA, 20 bp, Artificial Sequence
  Description of Artificial Sequence: Synthetic oligonucleotide
  Target: ATXN1; (-) strand; PAM type: YTN; PAM sequence: CTT
cttgttggtaagattttcaa

SEQ ID NO: 227040 - DNA, 20 bp, Artificial Sequence
  Description of Artificial Sequence: Synthetic oligonucleotide
  Target: ATXN1; (-) strand; PAM type: YTN; PAM sequence: TTA
ccgaccggagtgtgggaagt

SEQ ID NO: 227041 - DNA, 20 bp, Artificial Sequence
  Description of Artificial Sequence: Synthetic oligonucleotide
  Target: ATXN1; (-) strand; PAM type: YTN; PAM sequence: TTC
aaaggaaaagtaaaaaagtg

SEQ ID NO: 227042 - DNA, 20 bp, Artificial Sequence
  Description of Artificial Sequence: Synthetic oligonucleotide
  Target: ATXN1; (-) strand; PAM type: YTN; PAM sequence: CTT
caaaggaaaagtaaaaaagt

SEQ ID NO: 227043 - DNA, 20 bp, Artificial Sequence
  Description of Artificial Sequence: Synthetic oligonucleotide
  Target: ATXN1; (-) strand; PAM type: YTN; PAM sequence: CTG
cggcttcaaaggaaaagtaa

SEQ ID NO: 227044 - DNA, 20 bp, Artificial Sequence
  Description of Artificial Sequence: Synthetic oligonucleotide
  Target: ATXN1; (-) strand; PAM type: YTN; PAM sequence: TTG
cactgcggcttcaaaggaaa

SEQ ID NO: 227045 - DNA, 20 bp, Artificial Sequence
  Description of Artificial Sequence: Synthetic oligonucleotide
  Target: ATXN1; (-) strand; PAM type: YTN; PAM sequence: TTC
accccgggtgtagaatcaca

SEQ ID NO: 227046 - DNA, 20 bp, Artificial Sequence
  Description of Artificial Sequence: Synthetic oligonucleotide
  Target: ATXN1; (-) strand; PAM type: YTN; PAM sequence: TTT
caccccgggtgtagaatcac

SEQ ID NO: 227047 - DNA, 20 bp, Artificial Sequence
  Description of Artificial Sequence: Synthetic oligonucleotide
  Target: ATXN1; (-) strand; PAM type: YTN; PAM sequence: TTG
tttcaccccgggtgtagaat

SEQ ID NO: 227048 - DNA, 20 bp, Artificial Sequence
  Description of Artificial Sequence: Synthetic oligonucleotide
  Target: ATXN1; (-) strand; PAM type: YTN; PAM sequence: CTC
cccgtaaggaattgtttcac

SEQ ID NO: 227049 - DNA, 20 bp, Artificial Sequence
  Description of Artificial Sequence: Synthetic oligonucleotide
  Target: ATXN1; (-) strand; PAM type: YTN; PAM sequence: CTC
caaaggctccccgtaaggaa

SEQ ID NO: 227050 - DNA, 20 bp, Artificial Sequence
  Description of Artificial Sequence: Synthetic oligonucleotide
  Target: ATXN1; (-) strand; PAM type: YTN; PAM sequence: CTC
tccaaaggctccccgtaagg

SEQ ID NO: 227051 - DNA, 20 bp, Artificial Sequence
  Description of Artificial Sequence: Synthetic oligonucleotide
  Target: ATXN1; (-) strand; PAM type: YTN; PAM sequence: TTG
gggtgctctccaaaggctcc

SEQ ID NO: 227052 - DNA, 20 bp, Artificial Sequence
  Description of Artificial Sequence: Synthetic oligonucleotide
  Target: ATXN1; (-) strand; PAM type: YTN; PAM sequence: TTT
ggggtgctctccaaaggctc

SEQ ID NO: 227053 - DNA, 20 bp, Artificial Sequence
  Description of Artificial Sequence: Synthetic oligonucleotide
  Target: ATXN1; (-) strand; PAM type: YTN; PAM sequence: TTG
tttggggtgctctccaaagg

SEQ ID NO: 227054 - DNA, 20 bp, Artificial Sequence
  Description of Artificial Sequence: Synthetic oligonucleotide
  Target: ATXN1; (-) strand; PAM type: YTN; PAM sequence: CTT
gtttggggtgctctccaaag

SEQ ID NO: 227055 - DNA, 20 bp, Artificial Sequence
  Description of Artificial Sequence: Synthetic oligonucleotide
  Target: ATXN1; (-) strand; PAM type: YTN; PAM sequence: TTC
cagcagcccccttgtttggg

SEQ ID NO: 227056 - DNA, 20 bp, Artificial Sequence
  Description of Artificial Sequence: Synthetic oligonucleotide
  Target: ATXN1; (-) strand; PAM type: YTN; PAM sequence: TTG
cattccagcagcccccttgt

SEQ ID NO: 227057 - DNA, 20 bp, Artificial Sequence
  Description of Artificial Sequence: Synthetic oligonucleotide
  Target: ATXN1; (-) strand; PAM type: YTN; PAM sequence: CTT
gcattccagcagcccccttg

SEQ ID NO: 227058 - DNA, 20 bp, Artificial Sequence
  Description of Artificial Sequence: Synthetic oligonucleotide
  Target: ATXN1; (-) strand; PAM type: YTN; PAM sequence: TTG
ggcatcacacttgcattcca

SEQ ID NO: 227059 - DNA, 20 bp, Artificial Sequence
  Description of Artificial Sequence: Synthetic oligonucleotide
  Target: ATXN1; (-) strand; PAM type: YTN; PAM sequence: CTT
gggcatcacacttgcattcc

SEQ ID NO: 227060 - DNA, 20 bp, Artificial Sequence
  Description of Artificial Sequence: Synthetic oligonucleotide
  Target: ATXN1; (-) strand; PAM type: YTN; PAM sequence: CTC
cttgggcatcacacttgcat

SEQ ID NO: 227061 - DNA, 20 bp, Artificial Sequence
  Description of Artificial Sequence: Synthetic oligonucleotide
  Target: ATXN1; (-) strand; PAM type: YTN; PAM sequence: CTG
aggtagggagacagtctcct

SEQ ID NO: 227062 - DNA, 20 bp, Artificial Sequence
  Description of Artificial Sequence: Synthetic oligonucleotide
  Target: ATXN1; (-) strand; PAM type: YTN; PAM sequence: CTC
tgaggtagggagacagtctc

SEQ ID NO: 227063 - DNA, 20 bp, Artificial Sequence
  Description of Artificial Sequence: Synthetic oligonucleotide
  Target: ATXN1; (-) strand; PAM type: YTN; PAM sequence: TTC
agctctgaggtagggagaca

SEQ ID NO: 227064 - DNA, 20 bp, Artificial Sequence
  Description of Artificial Sequence: Synthetic oligonucleotide
  Target: ATXN1; (-) strand; PAM type: YTN; PAM sequence: CTT
cagctctgaggtagggagac

SEQ ID NO: 227065 - DNA, 20 bp, Artificial Sequence
  Description of Artificial Sequence: Synthetic oligonucleotide
  Target: ATXN1; (-) strand; PAM type: YTN; PAM sequence: TTG
atcacttcagctctgaggta

SEQ ID NO: 227066 - DNA, 20 bp, Artificial Sequence
  Description of Artificial Sequence: Synthetic oligonucleotide
  Target: ATXN1; (-) strand; PAM type: YTN; PAM sequence: TTT
gatcacttcagctctgaggt

SEQ ID NO: 227067 - DNA, 20 bp, Artificial Sequence
  Description of Artificial Sequence: Synthetic oligonucleotide
  Target: ATXN1; (-) strand; PAM type: YTN; PAM sequence: TTG
tcaagaagcatttgatcact

SEQ ID NO: 227068 - DNA, 20 bp, Artificial Sequence
  Description of Artificial Sequence: Synthetic oligonucleotide
  Target: ATXN1; (-) strand; PAM type: YTN; PAM sequence: CTC
gtgaaggttgtcaagaagca

SEQ ID NO: 227069 - DNA, 20 bp, Artificial Sequence
  Description of Artificial Sequence: Synthetic oligonucleotide
  Target: ATXN1; (-) strand; PAM type: YTN; PAM sequence: TTC
tcgtgaaggttgtcaagaag

SEQ ID NO: 227070 - DNA, 20 bp, Artificial Sequence
  Description of Artificial Sequence: Synthetic oligonucleotide
  Target: ATXN1; (-) strand; PAM type: YTN; PAM sequence: CTT
ctcgtgaaggttgtcaagaa

SEQ ID NO: 227071 - DNA, 20 bp, Artificial Sequence
  Description of Artificial Sequence: Synthetic oligonucleotide
  Target: ATXN1; (-) strand; PAM type: YTN; PAM sequence: TTG
agacttctcgtgaaggttgt

SEQ ID NO: 227072 - DNA, 20 bp, Artificial Sequence
  Description of Artificial Sequence: Synthetic oligonucleotide
  Target: ATXN1; (-) strand; PAM type: YTN; PAM sequence: TTT
gagacttctcgtgaaggttg

SEQ ID NO: 227073 - DNA, 20 bp, Artificial Sequence
  Description of Artificial Sequence: Synthetic oligonucleotide
  Target: ATXN1; (-) strand; PAM type: YTN; PAM sequence: CTT
tgagacttctcgtgaaggtt

SEQ ID NO: 227074 - DNA, 20 bp, Artificial Sequence
  Description of Artificial Sequence: Synthetic oligonucleotide
  Target: ATXN1; (-) strand; PAM type: YTN; PAM sequence: CTG
tgtgtgtaactttgagactt

SEQ ID NO: 227075 - DNA, 20 bp, Artificial Sequence
  Description of Artificial Sequence: Synthetic oligonucleotide
  Target: ATXN1; (-) strand; PAM type: YTN; PAM sequence: CTA
agcctgtgtgtgtaactttg

SEQ ID NO: 227076 - DNA, 20 bp, Artificial Sequence
  Description of Artificial Sequence: Synthetic oligonucleotide
  Target: ATXN1; (-) strand; PAM type: YTN; PAM sequence: TTG
gaaatgactaagcctgtgtg

SEQ ID NO: 227077 - DNA, 20 bp, Artificial Sequence
  Description of Artificial Sequence: Synthetic oligonucleotide
  Target: ATXN1; (-) strand; PAM type: YTN; PAM sequence: TTT
ggaaatgactaagcctgtgt

SEQ ID NO: 227078 - DNA, 20 bp, Artificial Sequence
  Description of Artificial Sequence: Synthetic oligonucleotide
  Target: ATXN1; (-) strand; PAM type: YTN; PAM sequence: TTG
gtgcagacgtttggaaatga

SEQ ID NO: 227079 - DNA, 20 bp, Artificial Sequence
  Description of Artificial Sequence: Synthetic oligonucleotide
  Target: ATXN1; (-) strand; PAM type: YTN; PAM sequence: CTG
cacattggtgcagacgtttg

SEQ ID NO: 227080 - DNA, 20 bp, Artificial Sequence
  Description of Artificial Sequence: Synthetic oligonucleotide
  Target: ATXN1; (-) strand; PAM type: YTN; PAM sequence: TTC
tgcacattggtgcagacgtt

SEQ ID NO: 227081 - DNA, 20 bp, Artificial Sequence
  Description of Artificial Sequence: Synthetic oligonucleotide
  Target: ATXN1; (-) strand; PAM type: YTN; PAM sequence: TTA
gagagcagggcaggaaaagt

SEQ ID NO: 227082 - DNA, 20 bp, Artificial Sequence
  Description of Artificial Sequence: Synthetic oligonucleotide
  Target: ATXN1; (-) strand; PAM type: YTN; PAM sequence: CTT
agagagcagggcaggaaaag

SEQ ID NO: 227083 - DNA, 20 bp, Artificial Sequence
  Description of Artificial Sequence: Synthetic oligonucleotide
  Target: ATXN1; (-) strand; PAM type: YTN; PAM sequence: CTG
agtgcttagagagcagggca

SEQ ID NO: 227084 - DNA, 20 bp, Artificial Sequence
  Description of Artificial Sequence: Synthetic oligonucleotide
  Target: ATXN1; (-) strand; PAM type: YTN; PAM sequence: CTC
gctgagtgcttagagagcag

SEQ ID NO: 227085 - DNA, 20 bp, Artificial Sequence
  Description of Artificial Sequence: Synthetic oligonucleotide
  Target: ATXN1; (-) strand; PAM type: YTN; PAM sequence: CTC
cccctcgctgagtgcttaga

SEQ ID NO: 227086 - DNA, 20 bp, Artificial Sequence
  Description of Artificial Sequence: Synthetic oligonucleotide
  Target: ATXN1; (-) strand; PAM type: YTN; PAM sequence: CTG
tgccccctccccctcgctga

SEQ ID NO: 227087 - DNA, 20 bp, Artificial Sequence
  Description of Artificial Sequence: Synthetic oligonucleotide
  Target: ATXN1; (-) strand; PAM type: YTN; PAM sequence: TTG
cactgtgccccctccccctc

SEQ ID NO: 227088 - DNA, 20 bp, Artificial Sequence
  Description of Artificial Sequence: Synthetic oligonucleotide
  Target: ATXN1; (-) strand; PAM type: YTN; PAM sequence: TTT
gcactgtgccccctccccct

SEQ ID NO: 227089 - DNA, 20 bp, Artificial Sequence
  Description of Artificial Sequence: Synthetic oligonucleotide
  Target: ATXN1; (-) strand; PAM type: YTN; PAM sequence: TTT
tgcactgtgccccctccccc

SEQ ID NO: 227090 - DNA, 20 bp, Artificial Sequence
  Description of Artificial Sequence: Synthetic oligonucleotide
  Target: ATXN1; (-) strand; PAM type: YTN; PAM sequence: CTG
ttttgcactgtgccccctcc

SEQ ID NO: 227091 - DNA, 20 bp, Artificial Sequence
  Description of Artificial Sequence: Synthetic oligonucleotide
  Target: ATXN1; (-) strand; PAM type: YTN; PAM sequence: CTG
gtctgttttgcactgtgccc

SEQ ID NO: 227092 - DNA, 20 bp, Artificial Sequence
  Description of Artificial Sequence: Synthetic oligonucleotide
  Target: ATXN1; (-) strand; PAM type: YTN; PAM sequence: TTC
actggtctgttttgcactgt

SEQ ID NO: 227093 - DNA, 20 bp, Artificial Sequence
  Description of Artificial Sequence: Synthetic oligonucleotide
  Target: ATXN1; (-) strand; PAM type: YTN; PAM sequence: TTG
attcactggtctgttttgca

SEQ ID NO: 227094 - DNA, 20 bp, Artificial Sequence
  Description of Artificial Sequence: Synthetic oligonucleotide
  Target: ATXN1; (-) strand; PAM type: YTN; PAM sequence: CTT
gattcactggtctgttttgc

SEQ ID NO: 227095 - DNA, 20 bp, Artificial Sequence
  Description of Artificial Sequence: Synthetic oligonucleotide
  Target: ATXN1; (-) strand; PAM type: YTN; PAM sequence: CTA
cagtgtggtcgcttgattca

SEQ ID NO: 227096 - DNA, 20 bp, Artificial Sequence
  Description of Artificial Sequence: Synthetic oligonucleotide
  Target: ATXN1; (-) strand; PAM type: YTN; PAM sequence: CTG
gtgtagggctacagtgtggt

SEQ ID NO: 227097 - DNA, 20 bp, Artificial Sequence
  Description of Artificial Sequence: Synthetic oligonucleotide
  Target: ATXN1; (-) strand; PAM type: YTN; PAM sequence: CTG
cagagcactggtgtagggct

SEQ ID NO: 227098 - DNA, 20 bp, Artificial Sequence
  Description of Artificial Sequence: Synthetic oligonucleotide
  Target: ATXN1; (-) strand; PAM type: YTN; PAM sequence: CTG
aggaggcaagggggcctgca

SEQ ID NO: 227099 - DNA, 20 bp, Artificial Sequence
  Description of Artificial Sequence: Synthetic oligonucleotide
  Target: ATXN1; (-) strand; PAM type: YTN; PAM sequence: TTA
cagatgagagaggtgaggcc

SEQ ID NO: 227100 - DNA, 20 bp, Artificial Sequence
  Description of Artificial Sequence: Synthetic oligonucleotide
  Target: ATXN1; (-) strand; PAM type: YTN; PAM sequence: CTG
caattacagatgagagaggt

SEQ ID NO: 227101 - DNA, 20 bp, Artificial Sequence
  Description of Artificial Sequence: Synthetic oligonucleotide
  Target: ATXN1; (-) strand; PAM type: YTN; PAM sequence: CTC
tgcaattacagatgagagag

SEQ ID NO: 227102 - DNA, 20 bp, Artificial Sequence
  Description of Artificial Sequence: Synthetic oligonucleotide
  Target: ATXN1; (-) strand; PAM type: YTN; PAM sequence: CTG
ggtccaatctctgcaattac

SEQ ID NO: 227103 - DNA, 20 bp, Artificial Sequence
  Description of Artificial Sequence: Synthetic oligonucleotide
  Target: ATXN1; (-) strand; PAM type: YTN; PAM sequence: TTA
ggatcactgggtccaatctc

SEQ ID NO: 227104 - DNA, 20 bp, Artificial Sequence
  Description of Artificial Sequence: Synthetic oligonucleotide
  Target: ATXN1; (-) strand; PAM type: YTN; PAM sequence: TTT
aggatcactgggtccaatct

SEQ ID NO: 227105 - DNA, 20 bp, Artificial Sequence
  Description of Artificial Sequence: Synthetic oligonucleotide
  Target: ATXN1; (-) strand; PAM type: YTN; PAM sequence: TTT
taggatcactgggtccaatc

SEQ ID NO: 227106 - DNA, 20 bp, Artificial Sequence
  Description of Artificial Sequence: Synthetic oligonucleotide
  Target: ATXN1; (-) strand; PAM type: YTN; PAM sequence: CTC
cagcgggtagggattttagg

SEQ ID NO: 227107 - DNA, 20 bp, Artificial Sequence
  Description of Artificial Sequence: Synthetic oligonucleotide
  Target: ATXN1; (-) strand; PAM type: YTN; PAM sequence: CTA
ggatgctccagcgggtaggg

SEQ ID NO: 227108 - DNA, 20 bp, Artificial Sequence
  Description of Artificial Sequence: Synthetic oligonucleotide
  Target: ATXN1; (-) strand; PAM type: YTN; PAM sequence: CTC
taggatgctccagcgggtag

SEQ ID NO: 227109 - DNA, 20 bp, Artificial Sequence
  Description of Artificial Sequence: Synthetic oligonucleotide
  Target: ATXN1; (-) strand; PAM type: YTN; PAM sequence: CTG
tcacagagactctaggatgc

SEQ ID NO: 227110 - DNA, 20 bp, Artificial Sequence
  Description of Artificial Sequence: Synthetic oligonucleotide
  Target: ATXN1; (-) strand; PAM type: YTN; PAM sequence: TTC
ctgtcacagagactctagga

SEQ ID NO: 227111 - DNA, 20 bp, Artificial Sequence
  Description of Artificial Sequence: Synthetic oligonucleotide
  Target: ATXN1; (-) strand; PAM type: YTN; PAM sequence: CTG
tgggcaatcgtgtcatattc

SEQ ID NO: 227112 - DNA, 20 bp, Artificial Sequence
  Description of Artificial Sequence: Synthetic oligonucleotide
  Target: ATXN1; (-) strand; PAM type: YTN; PAM sequence: CTG
ctgtgggcaatcgtgtcata

SEQ ID NO: 227113 - DNA, 20 bp, Artificial Sequence
  Description of Artificial Sequence: Synthetic oligonucleotide
  Target: ATXN1; (-) strand; PAM type: YTN; PAM sequence: CTG
tgtgaactgctgtgggcaat

SEQ ID NO: 227114 - DNA, 20 bp, Artificial Sequence
  Description of Artificial Sequence: Synthetic oligonucleotide
  Target: ATXN1; (-) strand; PAM type: YTN; PAM sequence: TTC
tgtgtgaactgctgtgggca

SEQ ID NO: 227115 - DNA, 20 bp, Artificial Sequence
  Description of Artificial Sequence: Synthetic oligonucleotide
  Target: ATXN1; (-) strand; PAM type: YTN; PAM sequence: CTT
ctgtgtgaactgctgtgggc

SEQ ID NO: 227116 - DNA, 20 bp, Artificial Sequence
  Description of Artificial Sequence: Synthetic oligonucleotide
  Target: ATXN1; (-) strand; PAM type: YTN; PAM sequence: TTG
gcttctgtgtgaactgctgt

SEQ ID NO: 227117 - DNA, 20 bp, Artificial Sequence
  Description of Artificial Sequence: Synthetic oligonucleotide
  Target: ATXN1; (-) strand; PAM type: YTN; PAM sequence: TTT
ggcttctgtgtgaactgctg

SEQ ID NO: 227118 - DNA, 20 bp, Artificial Sequence
  Description of Artificial Sequence: Synthetic oligonucleotide
  Target: ATXN1; (-) strand; PAM type: YTN; PAM sequence: TTT
tggcttctgtgtgaactgct

SEQ ID NO: 227119 - DNA, 20 bp, Artificial Sequence
  Description of Artificial Sequence: Synthetic oligonucleotide
  Target: ATXN1; (-) strand; PAM type: YTN; PAM sequence: CTG
gattttggcttctgtgtgaa

SEQ ID NO: 227120 - DNA, 20 bp, Artificial Sequence
  Description of Artificial Sequence: Synthetic oligonucleotide
  Target: ATXN1; (-) strand; PAM type: YTN; PAM sequence: CTA
cctggattttggcttctgtg

SEQ ID NO: 227121 - DNA, 20 bp, Artificial Sequence
  Description of Artificial Sequence: Synthetic oligonucleotide
  Target: ATXN1; (-) strand; PAM type: YTN; PAM sequence: CTC
actacctggattttggcttc

SEQ ID NO: 227122 - DNA, 20 bp, Artificial Sequence
  Description of Artificial Sequence: Synthetic oligonucleotide
  Target: ATXN1; (-) strand; PAM type: YTN; PAM sequence: CTC
ccccaagtcccagcataggc

SEQ ID NO: 227123 - DNA, 20 bp, Artificial Sequence
  Description of Artificial Sequence: Synthetic oligonucleotide
  Target: ATXN1; (-) strand; PAM type: YTN; PAM sequence: TTA
gccctcccccaagtcccagc

SEQ ID NO: 227124 - DNA, 20 bp, Artificial Sequence
  Description of Artificial Sequence: Synthetic oligonucleotide
  Target: ATXN1; (-) strand; PAM type: YTN; PAM sequence: TTT
agccctcccccaagtcccag

SEQ ID NO: 227125 - DNA, 20 bp, Artificial Sequence
  Description of Artificial Sequence: Synthetic oligonucleotide
  Target: ATXN1; (-) strand; PAM type: YTN; PAM sequence: CTT
tagccctcccccaagtccca

SEQ ID NO: 227126 - DNA, 20 bp, Artificial Sequence
  Description of Artificial Sequence: Synthetic oligonucleotide
  Target: ATXN1; (-) strand; PAM type: YTN; PAM sequence: TTC
actttagccctcccccaagt

SEQ ID NO: 227127 - DNA, 20 bp, Artificial Sequence
  Description of Artificial Sequence: Synthetic oligonucleotide
  Target: ATXN1; (-) strand; PAM type: YTN; PAM sequence: CTT
cactttagccctcccccaag

SEQ ID NO: 227128 - DNA, 20 bp, Artificial Sequence
  Description of Artificial Sequence: Synthetic oligonucleotide
  Target: ATXN1; (-) strand; PAM type: YTN; PAM sequence: CTG
ccttcactttagccctcccc

SEQ ID NO: 227129 - DNA, 20 bp, Artificial Sequence
  Description of Artificial Sequence: Synthetic oligonucleotide
  Target: ATXN1; (-) strand; PAM type: YTN; PAM sequence: CTG
atccctgccttcactttagc

SEQ ID NO: 227130 - DNA, 20 bp, Artificial Sequence
  Description of Artificial Sequence: Synthetic oligonucleotide
  Target: ATXN1; (-) strand; PAM type: YTN; PAM sequence: CTC
tgatccctgccttcacttta

SEQ ID NO: 227131 - DNA, 20 bp, Artificial Sequence
  Description of Artificial Sequence: Synthetic oligonucleotide
  Target: ATXN1; (-) strand; PAM type: YTN; PAM sequence: CTC
accctctgatccctgccttc

SEQ ID NO: 227132 - DNA, 20 bp, Artificial Sequence
  Description of Artificial Sequence: Synthetic oligonucleotide
  Target: ATXN1; (-) strand; PAM type: YTN; PAM sequence: TTG
ctcaccctctgatccctgcc

SEQ ID NO: 227133 - DNA, 20 bp, Artificial Sequence
  Description of Artificial Sequence: Synthetic oligonucleotide
  Target: ATXN1; (-) strand; PAM type: YTN; PAM sequence: TTT
gctcaccctctgatccctgc

SEQ ID NO: 227134 - DNA, 20 bp, Artificial Sequence
  Description of Artificial Sequence: Synthetic oligonucleotide
  Target: ATXN1; (-) strand; PAM type: YTN; PAM sequence: CTT
tgctcaccctctgatccctg

SEQ ID NO: 227135 - DNA, 20 bp, Artificial Sequence
  Description of Artificial Sequence: Synthetic oligonucleotide
  Target: ATXN1; (-) strand; PAM type: YTN; PAM sequence: TTC
tttgctcaccctctgatccc

SEQ ID NO: 227136 - DNA, 20 bp, Artificial Sequence
  Description of Artificial Sequence: Synthetic oligonucleotide
  Target: ATXN1; (-) strand; PAM type: YTN; PAM sequence: TTT
ctttgctcaccctctgatcc

SEQ ID NO: 227137 - DNA, 20 bp, Artificial Sequence
  Description of Artificial Sequence: Synthetic oligonucleotide
  Target: ATXN1; (-) strand; PAM type: YTN; PAM sequence: TTA
atttctttgctcaccctctg

SEQ ID NO: 227138 - DNA, 20 bp, Artificial Sequence
  Description of Artificial Sequence: Synthetic oligonucleotide
  Target: ATXN1; (-) strand; PAM type: YTN; PAM sequence: CTG
tatcattaatttctttgctc

SEQ ID NO: 227139 - DNA, 20 bp, Artificial Sequence
  Description of Artificial Sequence: Synthetic oligonucleotide
  Target: ATXN1; (-) strand; PAM type: YTN; PAM sequence: TTC
tgtatcattaatttctttgc

SEQ ID NO: 227140 - DNA, 20 bp, Artificial Sequence
  Description of Artificial Sequence: Synthetic oligonucleotide
  Target: ATXN1; (-) strand; PAM type: YTN; PAM sequence: CTG
gaattctgtatcattaattt

SEQ ID NO: 227141 - DNA, 20 bp, Artificial Sequence
  Description of Artificial Sequence: Synthetic oligonucleotide
  Target: ATXN1; (-) strand; PAM type: YTN; PAM sequence: TTG
aagtaggtctggaattctgt

SEQ ID NO: 227142 - DNA, 20 bp, Artificial Sequence
  Description of Artificial Sequence: Synthetic oligonucleotide
  Target: ATXN1; (-) strand; PAM type: YTN; PAM sequence: TTT
gaagtaggtctggaattctg

SEQ ID NO: 227143 - DNA, 20 bp, Artificial Sequence
  Description of Artificial Sequence: Synthetic oligonucleotide
  Target: ATXN1; (-) strand; PAM type: YTN; PAM sequence: TTG
tttgaagtaggtctggaatt

SEQ ID NO: 227144 - DNA, 20 bp, Artificial Sequence
  Description of Artificial Sequence: Synthetic oligonucleotide
  Target: ATXN1; (-) strand; PAM type: YTN; PAM sequence: CTA
ttgtttgaagtaggtctgga

SEQ ID NO: 227145 - DNA, 20 bp, Artificial Sequence
  Description of Artificial Sequence: Synthetic oligonucleotide
  Target: ATXN1; (-) strand; PAM type: YTN; PAM sequence: CTA
gtgtggggtgagcaaaacag

SEQ ID NO: 227146 - DNA, 20 bp, Artificial Sequence
  Description of Artificial Sequence: Synthetic oligonucleotide
  Target: ATXN1; (-) strand; PAM type: YTN; PAM sequence: CTA
aaacctagtgtggggtgagc

SEQ ID NO: 227147 - DNA, 20 bp, Artificial Sequence
  Description of Artificial Sequence: Synthetic oligonucleotide
  Target: ATXN1; (-) strand; PAM type: YTN; PAM sequence: TTC
cctaaaacctagtgtggggt

SEQ ID NO: 227148 - DNA, 20 bp, Artificial Sequence
  Description of Artificial Sequence: Synthetic oligonucleotide
  Target: ATXN1; (-) strand; PAM type: YTN; PAM sequence: TTT
ccctaaaacctagtgtgggg

SEQ ID NO: 227149 - DNA, 20 bp, Artificial Sequence
  Description of Artificial Sequence: Synthetic oligonucleotide
  Target: ATXN1; (-) strand; PAM type: YTN; PAM sequence: CTT
tccctaaaacctagtgtggg

SEQ ID NO: 227150 - DNA, 20 bp, Artificial Sequence
  Description of Artificial Sequence: Synthetic oligonucleotide
  Target: ATXN1; (-) strand; PAM type: YTN; PAM sequence: CTC
tttccctaaaacctagtgtg

SEQ ID NO: 227151 - DNA, 20 bp, Artificial Sequence
  Description of Artificial Sequence: Synthetic oligonucleotide
  Target: ATXN1; (-) strand; PAM type: YTN; PAM sequence: TTA
tatctctttccctaaaacct

SEQ ID NO: 227152 - DNA, 20 bp, Artificial Sequence
  Description of Artificial Sequence: Synthetic oligonucleotide
  Target: ATXN1; (-) strand; PAM type: YTN; PAM sequence: CTT
atatctctttccctaaaacc

SEQ ID NO: 227153 - DNA, 20 bp, Artificial Sequence
  Description of Artificial Sequence: Synthetic oligonucleotide
  Target: ATXN1; (-) strand; PAM type: YTN; PAM sequence: CTC
acagaggacgaggtatcctt

SEQ ID NO: 227154 - DNA, 20 bp, Artificial Sequence
  Description of Artificial Sequence: Synthetic oligonucleotide
  Target: ATXN1; (-) strand; PAM type: YTN; PAM sequence: TTG
agtcacctcacagaggacga

SEQ ID NO: 227155 - DNA, 20 bp, Artificial Sequence
  Description of Artificial Sequence: Synthetic oligonucleotide
  Target: ATXN1; (-) strand; PAM type: YTN; PAM sequence: CTG
ttgagtcacctcacagagga

SEQ ID NO: 227156 - DNA, 20 bp, Artificial Sequence
  Description of Artificial Sequence: Synthetic oligonucleotide
  Target: ATXN1; (-) strand; PAM type: YTN; PAM sequence: CTG
tgactgttgagtcacctcac

SEQ ID NO: 227157 - DNA, 20 bp, Artificial Sequence
  Description of Artificial Sequence: Synthetic oligonucleotide
  Target: ATXN1; (-) strand; PAM type: YTN; PAM sequence: TTG
ggtctgtgactgttgagtca

SEQ ID NO: 227158 - DNA, 20 bp, Artificial Sequence
  Description of Artificial Sequence: Synthetic oligonucleotide
  Target: ATXN1; (-) strand; PAM type: YTN; PAM sequence: TTT
gggtctgtgactgttgagtc

SEQ ID NO: 227159 - DNA, 20 bp, Artificial Sequence
  Description of Artificial Sequence: Synthetic oligonucleotide
  Target: ATXN1; (-) strand; PAM type: YTN; PAM sequence: TTC
agtttgggtctgtgactgtt

SEQ ID NO: 227160 - DNA, 20 bp, Artificial Sequence
  Description of Artificial Sequence: Synthetic oligonucleotide
  Target: ATXN1; (-) strand; PAM type: YTN; PAM sequence: CTC
catcattcagtttgggtctg

SEQ ID NO: 227161 - DNA, 20 bp, Artificial Sequence
  Description of Artificial Sequence: Synthetic oligonucleotide
  Target: ATXN1; (-) strand; PAM type: YTN; PAM sequence: CTG
ctccatcattcagtttgggt

SEQ ID NO: 227162 - DNA, 20 bp, Artificial Sequence
  Description of Artificial Sequence: Synthetic oligonucleotide
  Target: ATXN1; (-) strand; PAM type: YTN; PAM sequence: TTC
tgctccatcattcagtttgg

SEQ ID NO: 227163 - DNA, 20 bp, Artificial Sequence
  Description of Artificial Sequence: Synthetic oligonucleotide
  Target: ATXN1; (-) strand; PAM type: YTN; PAM sequence: TTA
ttctgctccatcattcagtt

SEQ ID NO: 227164 - DNA, 20 bp, Artificial Sequence
  Description of Artificial Sequence: Synthetic oligonucleotide
  Target: ATXN1; (-) strand; PAM type: YTN; PAM sequence: TTT
attctgctccatcattcagt

SEQ ID NO: 227165 - DNA, 20 bp, Artificial Sequence
  Description of Artificial Sequence: Synthetic oligonucleotide
  Target: ATXN1; (-) strand; PAM type: YTN; PAM sequence: TTT
tattctgctccatcattcag

SEQ ID NO: 227166 - DNA, 20 bp, Artificial Sequence
  Description of Artificial Sequence: Synthetic oligonucleotide
  Target: ATXN1; (-) strand; PAM type: YTN; PAM sequence: TTG
attttattctgctccatcat

SEQ ID NO: 227167 - DNA, 20 bp, Artificial Sequence
  Description of Artificial Sequence: Synthetic oligonucleotide
  Target: ATXN1; (-) strand; PAM type: YTN; PAM sequence: CTT
gattttattctgctccatca

SEQ ID NO: 227168 - DNA, 20 bp, Artificial Sequence
  Description of Artificial Sequence: Synthetic oligonucleotide
  Target: ATXN1; (-) strand; PAM type: YTN; PAM sequence: TTA
cttgattttattctgctcca

SEQ ID NO: 227169 - DNA, 20 bp, Artificial Sequence
  Description of Artificial Sequence: Synthetic oligonucleotide
  Target: ATXN1; (-) strand; PAM type: YTN; PAM sequence: TTA
cgttacttgattttattctg

SEQ ID NO: 227170 - DNA, 20 bp, Artificial Sequence
  Description of Artificial Sequence: Synthetic oligonucleotide
  Target: ATXN1; (-) strand; PAM type: YTN; PAM sequence: TTT
acgttacttgattttattct

SEQ ID NO: 227171 - DNA, 20 bp, Artificial Sequence
  Description of Artificial Sequence: Synthetic oligonucleotide
  Target: ATXN1; (-) strand; PAM type: YTN; PAM sequence: CTA
tgtggatgtttacgttactt

SEQ ID NO: 227172 - DNA, 20 bp, Artificial Sequence
  Description of Artificial Sequence: Synthetic oligonucleotide
  Target: ATXN1; (-) strand; PAM type: YTN; PAM sequence: TTG
gactatgtggatgtttacgt

SEQ ID NO: 227173 - DNA, 20 bp, Artificial Sequence
  Description of Artificial Sequence: Synthetic oligonucleotide
  Target: ATXN1; (-) strand; PAM type: YTN; PAM sequence: CTG
gatcagggaaagaattggac

SEQ ID NO: 227174 - DNA, 20 bp, Artificial Sequence
  Description of Artificial Sequence: Synthetic oligonucleotide
  Target: ATXN1; (-) strand; PAM type: YTN; PAM sequence: TTA
ctggatcagggaaagaattg

SEQ ID NO: 227175 - DNA, 20 bp, Artificial Sequence
  Description of Artificial Sequence: Synthetic oligonucleotide
  Target: ATXN1; (-) strand; PAM type: YTN; PAM sequence: CTT
actggatcagggaaagaatt

SEQ ID NO: 227176 - DNA, 20 bp, Artificial Sequence
  Description of Artificial Sequence: Synthetic oligonucleotide
  Target: ATXN1; (-) strand; PAM type: YTN; PAM sequence: CTC
cgtgacttactggatcaggg

SEQ ID NO: 227177 - DNA, 20 bp, Artificial Sequence
  Description of Artificial Sequence: Synthetic oligonucleotide
  Target: ATXN1; (-) strand; PAM type: YTN; PAM sequence: CTC
aggaacggcctccgtgactt

SEQ ID NO: 227178 - DNA, 20 bp, Artificial Sequence
  Description of Artificial Sequence: Synthetic oligonucleotide
  Target: ATXN1; (-) strand; PAM type: YTN; PAM sequence: CTG
gatctcaggaacggcctccg

SEQ ID NO: 227179 - DNA, 20 bp, Artificial Sequence
  Description of Artificial Sequence: Synthetic oligonucleotide
  Target: ATXN1; (-) strand; PAM type: YTN; PAM sequence: TTG
tataaataggtctggatctc

SEQ ID NO: 227180 - DNA, 20 bp, Artificial Sequence
  Description of Artificial Sequence: Synthetic oligonucleotide
  Target: ATXN1; (-) strand; PAM type: YTN; PAM sequence: CTT
gtataaataggtctggatct

SEQ ID NO: 227181 - DNA, 20 bp, Artificial Sequence
  Description of Artificial Sequence: Synthetic oligonucleotide
  Target: ATXN1; (-) strand; PAM type: YTN; PAM sequence: CTG
cacttgtataaataggtctg

SEQ ID NO: 227182 - DNA, 20 bp, Artificial Sequence
  Description of Artificial Sequence: Synthetic oligonucleotide
  Target: ATXN1; (-) strand; PAM type: YTN; PAM sequence: TTC
agggaaaggtgcccagcctg

SEQ ID NO: 227183 - DNA, 20 bp, Artificial Sequence
  Description of Artificial Sequence: Synthetic oligonucleotide
  Target: ATXN1; (-) strand; PAM type: YTN; PAM sequence: CTT
cagggaaaggtgcccagcct

SEQ ID NO: 227184 - DNA, 20 bp, Artificial Sequence
  Description of Artificial Sequence: Synthetic oligonucleotide
  Target: ATXN1; (-) strand; PAM type: YTN; PAM sequence: CTG
agtgggaccttcagggaaag

SEQ ID NO: 227185 - DNA, 20 bp, Artificial Sequence
  Description of Artificial Sequence: Synthetic oligonucleotide
  Target: ATXN1; (-) strand; PAM type: YTN; PAM sequence: TTG
gggaaccaagagaataactg

SEQ ID NO: 227186 - DNA, 20 bp, Artificial Sequence
  Description of Artificial Sequence: Synthetic oligonucleotide
  Target: ATXN1; (-) strand; PAM type: YTN; PAM sequence: CTG
tgattggggaaccaagagaa

SEQ ID NO: 227187 - DNA, 20 bp, Artificial Sequence
  Description of Artificial Sequence: Synthetic oligonucleotide
  Target: ATXN1; (-) strand; PAM type: YTN; PAM sequence: CTC
actgtgattggggaaccaag

SEQ ID NO: 227188 - DNA, 20 bp, Artificial Sequence
  Description of Artificial Sequence: Synthetic oligonucleotide
  Target: ATXN1; (-) strand; PAM type: YTN; PAM sequence: TTG
aggaagtgaatgggcaaatg

SEQ ID NO: 227189 - DNA, 20 bp, Artificial Sequence
  Description of Artificial Sequence: Synthetic oligonucleotide
  Target: ATXN1; (-) strand; PAM type: YTN; PAM sequence: TTT
gaggaagtgaatgggcaaat

SEQ ID NO: 227190 - DNA, 20 bp, Artificial Sequence
  Description of Artificial Sequence: Synthetic oligonucleotide
  Target: ATXN1; (-) strand; PAM type: YTN; PAM sequence: CTG
gtttgaggaagtgaatgggc

SEQ ID NO: 227191 - DNA, 20 bp, Artificial Sequence
  Description of Artificial Sequence: Synthetic oligonucleotide
  Target: ATXN1; (-) strand; PAM type: YTN; PAM sequence: TTG
gaagtgaatgagaggggggt

SEQ ID NO: 227192 - DNA, 20 bp, Artificial Sequence
  Description of Artificial Sequence: Synthetic oligonucleotide
  Target: ATXN1; (-) strand; PAM type: YTN; PAM sequence: TTA
gatattggaagtgaatgaga

SEQ ID NO: 227193 - DNA, 20 bp, Artificial Sequence
  Description of Artificial Sequence: Synthetic oligonucleotide
  Target: ATXN1; (-) strand; PAM type: YTN; PAM sequence: TTG
atgagcaattagatattgga

SEQ ID NO: 227194 - DNA, 20 bp, Artificial Sequence
  Description of Artificial Sequence: Synthetic oligonucleotide
  Target: ATXN1; (-) strand; PAM type: YTN; PAM sequence: CTT
gatgagcaattagatattgg

SEQ ID NO: 227195 - DNA, 20 bp, Artificial Sequence
  Description of Artificial Sequence: Synthetic oligonucleotide
  Target: ATXN1; (-) strand; PAM type: YTN; PAM sequence: TTA
gaggacttgatgagcaatta

SEQ ID NO: 227196 - DNA, 20 bp, Artificial Sequence
  Description of Artificial Sequence: Synthetic oligonucleotide
  Target: ATXN1; (-) strand; PAM type: YTN; PAM sequence: TTT
agaggacttgatgagcaatt

SEQ ID NO: 227197 - DNA, 20 bp, Artificial Sequence
  Description of Artificial Sequence: Synthetic oligonucleotide
  Target: ATXN1; (-) strand; PAM type: YTN; PAM sequence: TTA
ataagcaaggatttagagga

SEQ ID NO: 227198 - DNA, 20 bp, Artificial Sequence
  Description of Artificial Sequence: Synthetic oligonucleotide
  Target: ATXN1; (-) strand; PAM type: YTN; PAM sequence: TTG
gagagatgttaataagcaag

SEQ ID NO: 227199 - DNA, 20 bp, Artificial Sequence
  Description of Artificial Sequence: Synthetic oligonucleotide
  Target: ATXN1; (-) strand; PAM type: YTN; PAM sequence: TTG
gagtggcaatggaagtgaca

SEQ ID NO: 227200 - DNA, 20 bp, Artificial Sequence
  Description of Artificial Sequence: Synthetic oligonucleotide
  Target: ATXN1; (-) strand; PAM type: YTN; PAM sequence: TTT
ggagtggcaatggaagtgac

SEQ ID NO: 227201 - DNA, 20 bp, Artificial Sequence
  Description of Artificial Sequence: Synthetic oligonucleotide
  Target: ATXN1; (-) strand; PAM type: YTN; PAM sequence: CTC
atggagtttggagtggcaat

SEQ ID NO: 227202 - DNA, 20 bp, Artificial Sequence
  Description of Artificial Sequence: Synthetic oligonucleotide
  Target: ATXN1; (-) strand; PAM type: YTN; PAM sequence: TTC
tcatggagtttggagtggca

SEQ ID NO: 227203 - DNA, 20 bp, Artificial Sequence
  Description of Artificial Sequence: Synthetic oligonucleotide
  Target: ATXN1; (-) strand; PAM type: YTN; PAM sequence: TTG
ttctcatggagtttggagtg

SEQ ID NO: 227204 - DNA, 20 bp, Artificial Sequence
  Description of Artificial Sequence: Synthetic oligonucleotide
  Target: ATXN1; (-) strand; PAM type: YTN; PAM sequence: CTT
gttctcatggagtttggagt

SEQ ID NO: 227205 - DNA, 20 bp, Artificial Sequence
  Description of Artificial Sequence: Synthetic oligonucleotide
  Target: ATXN1; (-) strand; PAM type: YTN; PAM sequence: CTG
cagggaccaggacagacagg

SEQ ID NO: 227206 - DNA, 20 bp, Artificial Sequence
  Description of Artificial Sequence: Synthetic oligonucleotide
  Target: ATXN1; (-) strand; PAM type: YTN; PAM sequence: TTC
tgcagggaccaggacagaca

SEQ ID NO: 227207 - DNA, 20 bp, Artificial Sequence
  Description of Artificial Sequence: Synthetic oligonucleotide
  Target: ATXN1; (-) strand; PAM type: YTN; PAM sequence: CTT
ctgcagggaccaggacagac

SEQ ID NO: 227208 - DNA, 20 bp, Artificial Sequence
  Description of Artificial Sequence: Synthetic oligonucleotide
  Target: ATXN1; (-) strand; PAM type: YTN; PAM sequence: CTG
cggcttctgcagggaccagg

SEQ ID NO: 227209 - DNA, 20 bp, Artificial Sequence
  Description of Artificial Sequence: Synthetic oligonucleotide
  Target: ATXN1; (-) strand; PAM type: YTN; PAM sequence: CTG
tgtgctgcggcttctgcagg

SEQ ID NO: 227210 - DNA, 20 bp, Artificial Sequence
  Description of Artificial Sequence: Synthetic oligonucleotide
  Target: ATXN1; (-) strand; PAM type: YTN; PAM sequence: CTA
atcacaggtctgtgtgctgc

SEQ ID NO: 227211 - DNA, 20 bp, Artificial Sequence
  Description of Artificial Sequence: Synthetic oligonucleotide
  Target: ATXN1; (-) strand; PAM type: YTN; PAM sequence: TTC
atgctaatcacaggtctgtg

SEQ ID NO: 227212 - DNA, 20 bp, Artificial Sequence
  Description of Artificial Sequence: Synthetic oligonucleotide
  Target: ATXN1; (-) strand; PAM type: YTN; PAM sequence: CTT
catgctaatcacaggtctgt

SEQ ID NO: 227213 - DNA, 20 bp, Artificial Sequence
  Description of Artificial Sequence: Synthetic oligonucleotide
  Target: ATXN1; (-) strand; PAM type: YTN; PAM sequence: CTG
cttcatgctaatcacaggtc

SEQ ID NO: 227214 - DNA, 20 bp, Artificial Sequence
  Description of Artificial Sequence: Synthetic oligonucleotide
  Target: ATXN1; (-) strand; PAM type: YTN; PAM sequence: TTC
cagaaccacagagcacctgc

SEQ ID NO: 227215 - DNA, 20 bp, Artificial Sequence
  Description of Artificial Sequence: Synthetic oligonucleotide
  Target: ATXN1; (-) strand; PAM type: YTN; PAM sequence: TTG
aaaattccagaaccacagag

SEQ ID NO: 227216 - DNA, 20 bp, Artificial Sequence
  Description of Artificial Sequence: Synthetic oligonucleotide
  Target: ATXN1; (-) strand; PAM type: YTN; PAM sequence: TTG
tagaaatccaggtgacagag

SEQ ID NO: 227217 - DNA, 20 bp, Artificial Sequence
  Description of Artificial Sequence: Synthetic oligonucleotide
  Target: ATXN1; (-) strand; PAM type: YTN; PAM sequence: TTG
gcatgataagggaccaggtg

SEQ ID NO: 227218 - DNA, 20 bp, Artificial Sequence
  Description of Artificial Sequence: Synthetic oligonucleotide
  Target: ATXN1; (-) strand; PAM type: YTN; PAM sequence: TTT
ggcatgataagggaccaggt

SEQ ID NO: 227219 - DNA, 20 bp, Artificial Sequence
  Description of Artificial Sequence: Synthetic oligonucleotide
  Target: ATXN1; (-) strand; PAM type: YTN; PAM sequence: CTA
tgcatttggcatgataaggg

SEQ ID NO: 227220 - DNA, 20 bp, Artificial Sequence
  Description of Artificial Sequence: Synthetic oligonucleotide
  Target: ATXN1; (-) strand; PAM type: YTN; PAM sequence: TTA
gtgctatgcatttggcatga

SEQ ID NO: 227221 - DNA, 20 bp, Artificial Sequence
  Description of Artificial Sequence: Synthetic oligonucleotide
  Target: ATXN1; (-) strand; PAM type: YTN; PAM sequence: CTG
ttagtgctatgcatttggca

SEQ ID NO: 227222 - DNA, 20 bp, Artificial Sequence
  Description of Artificial Sequence: Synthetic oligonucleotide
  Target: ATXN1; (-) strand; PAM type: YTN; PAM sequence: TTC
tgttagtgctatgcatttgg

SEQ ID NO: 227223 - DNA, 20 bp, Artificial Sequence
  Description of Artificial Sequence: Synthetic oligonucleotide
  Target: ATXN1; (-) strand; PAM type: YTN; PAM sequence: TTC
attctgttagtgctatgcat

SEQ ID NO: 227224 - DNA, 20 bp, Artificial Sequence
  Description of Artificial Sequence: Synthetic oligonucleotide
  Target: ATXN1; (-) strand; PAM type: YTN; PAM sequence: TTT
cattctgttagtgctatgca

SEQ ID NO: 227225 - DNA, 20 bp, Artificial Sequence
  Description of Artificial Sequence: Synthetic oligonucleotide
  Target: ATXN1; (-) strand; PAM type: YTN; PAM sequence: TTC
agtgatttcattctgttagt

SEQ ID NO: 227226 - DNA, 20 bp, Artificial Sequence
  Description of Artificial Sequence: Synthetic oligonucleotide
  Target: ATXN1; (-) strand; PAM type: YTN; PAM sequence: TTT
cagtgatttcattctgttag

SEQ ID NO: 227227 - DNA, 20 bp, Artificial Sequence
  Description of Artificial Sequence: Synthetic oligonucleotide
  Target: ATXN1; (-) strand; PAM type: YTN; PAM sequence: CTG
tagggatgtgaaaagtcagg

SEQ ID NO: 227228 - DNA, 20 bp, Artificial Sequence
  Description of Artificial Sequence: Synthetic oligonucleotide
  Target: ATXN1; (-) strand; PAM type: YTN; PAM sequence: TTC
aaggactgtagggatgtgaa

SEQ ID NO: 227229 - DNA, 20 bp, Artificial Sequence
  Description of Artificial Sequence: Synthetic oligonucleotide
  Target: ATXN1; (-) strand; PAM type: YTN; PAM sequence: TTG
gatgcaatgtagacccattc

SEQ ID NO: 227230 - DNA, 20 bp, Artificial Sequence
  Description of Artificial Sequence: Synthetic oligonucleotide
  Target: ATXN1; (-) strand; PAM type: YTN; PAM sequence: CTT
ggatgcaatgtagacccatt

SEQ ID NO: 227231 - DNA, 20 bp, Artificial Sequence
  Description of Artificial Sequence: Synthetic oligonucleotide
  Target: ATXN1; (-) strand; PAM type: YTN; PAM sequence: TTA
tcttggatgcaatgtagacc

SEQ ID NO: 227232 - DNA, 20 bp, Artificial Sequence
  Description of Artificial Sequence: Synthetic oligonucleotide
  Target: ATXN1; (-) strand; PAM type: YTN; PAM sequence: TTT
atcttggatgcaatgtagac

SEQ ID NO: 227233 - DNA, 20 bp, Artificial Sequence
  Description of Artificial Sequence: Synthetic oligonucleotide
  Target: ATXN1; (-) strand; PAM type: YTN; PAM sequence: TTT
tatcttggatgcaatgtaga

SEQ ID NO: 227234 - DNA, 20 bp, Artificial Sequence
  Description of Artificial Sequence: Synthetic oligonucleotide
  Target: ATXN1; (-) strand; PAM type: YTN; PAM sequence: TTG
gattttatcttggatgcaat

SEQ ID NO: 227235 - DNA, 20 bp, Artificial Sequence
  Description of Artificial Sequence: Synthetic oligonucleotide
  Target: ATXN1; (-) strand; PAM type: YTN; PAM sequence: CTT
ggattttatcttggatgcaa

SEQ ID NO: 227236 - DNA, 20 bp, Artificial Sequence
  Description of Artificial Sequence: Synthetic oligonucleotide
  Target: ATXN1; (-) strand; PAM type: YTN; PAM sequence: TTG
tgagccaagcagagatcttg

SEQ ID NO: 227237 - DNA, 20 bp, Artificial Sequence
  Description of Artificial Sequence: Synthetic oligonucleotide
  Target: ATXN1; (-) strand; PAM type: YTN; PAM sequence: CTT
gtgagccaagcagagatctt

SEQ ID NO: 227238 - DNA, 20 bp, Artificial Sequence
  Description of Artificial Sequence: Synthetic oligonucleotide
  Target: ATXN1; (-) strand; PAM type: YTN; PAM sequence: CTC
gatcaggaagggcccttgtg

SEQ ID NO: 227239 - DNA, 20 bp, Artificial Sequence
  Description of Artificial Sequence: Synthetic oligonucleotide
  Target: ATXN1; (-) strand; PAM type: YTN; PAM sequence: CTC
agggtctcgatcaggaaggg

SEQ ID NO: 227240 - DNA, 20 bp, Artificial Sequence
  Description of Artificial Sequence: Synthetic oligonucleotide
  Target: ATXN1; (-) strand; PAM type: YTN; PAM sequence: CTA
gaggggctcagggtctcgat

SEQ ID NO: 227241 - DNA, 20 bp, Artificial Sequence
  Description of Artificial Sequence: Synthetic oligonucleotide
  Target: ATXN1; (-) strand; PAM type: YTN; PAM sequence: CTG
acaccgctagaggggctcag

SEQ ID NO: 227242 - DNA, 20 bp, Artificial Sequence
  Description of Artificial Sequence: Synthetic oligonucleotide
  Target: ATXN1; (-) strand; PAM type: YTN; PAM sequence: TTG
gtaggtccatagtgaggcag

SEQ ID NO: 227243 - DNA, 20 bp, Artificial Sequence
  Description of Artificial Sequence: Synthetic oligonucleotide
  Target: ATXN1; (-) strand; PAM type: YTN; PAM sequence: TTT
ggtaggtccatagtgaggca

SEQ ID NO: 227244 - DNA, 20 bp, Artificial Sequence
  Description of Artificial Sequence: Synthetic oligonucleotide
  Target: ATXN1; (-) strand; PAM type: YTN; PAM sequence: CTG
aaggagcaataagcagtttg

SEQ ID NO: 227245 - DNA, 20 bp, Artificial Sequence
  Description of Artificial Sequence: Synthetic oligonucleotide
  Target: ATXN1; (-) strand; PAM type: YTN; PAM sequence: TTA
tatggatgggctgaaggagc

SEQ ID NO: 227246 - DNA, 20 bp, Artificial Sequence
  Description of Artificial Sequence: Synthetic oligonucleotide
  Target: ATXN1; (-) strand; PAM type: YTN; PAM sequence: TTG
ggcaaagaaagacaaaagaa

SEQ ID NO: 227247 - DNA, 20 bp, Artificial Sequence
  Description of Artificial Sequence: Synthetic oligonucleotide
  Target: ATXN1; (-) strand; PAM type: YTN; PAM sequence: CTT
gggcaaagaaagacaaaaga

SEQ ID NO: 227248 - DNA, 20 bp, Artificial Sequence
  Description of Artificial Sequence: Synthetic oligonucleotide
  Target: ATXN1; (-) strand; PAM type: YTN; PAM sequence: TTC
agacaagcttgggcaaagaa

SEQ ID NO: 227249 - DNA, 20 bp, Artificial Sequence
  Description of Artificial Sequence: Synthetic oligonucleotide
  Target: ATXN1; (-) strand; PAM type: YTN; PAM sequence: TTG
ttcagacaagcttgggcaaa

SEQ ID NO: 227250 - DNA, 20 bp, Artificial Sequence
  Description of Artificial Sequence: Synthetic oligonucleotide
  Target: ATXN1; (-) strand; PAM type: YTN; PAM sequence: TTC
agaatgaggagttgttcaga

SEQ ID NO: 227251 - DNA, 20 bp, Artificial Sequence
  Description of Artificial Sequence: Synthetic oligonucleotide
  Target: ATXN1; (-) strand; PAM type: YTN; PAM sequence: TTT
cagaatgaggagttgttcag

SEQ ID NO: 227252 - DNA, 20 bp, Artificial Sequence
  Description of Artificial Sequence: Synthetic oligonucleotide
  Target: ATXN1; (-) strand; PAM type: YTN; PAM sequence: TTT
tcagaatgaggagttgttca

SEQ ID NO: 227253 - DNA, 20 bp, Artificial Sequence
  Description of Artificial Sequence: Synthetic oligonucleotide
  Target: ATXN1; (-) strand; PAM type: YTN; PAM sequence: CTT
ttcagaatgaggagttgttc

SEQ ID NO: 227254 - DNA, 20 bp, Artificial Sequence
  Description of Artificial Sequence: Synthetic oligonucleotide
  Target: ATXN1; (-) strand; PAM type: YTN; PAM sequence: TTC
agtccaagcttttcagaatg

SEQ ID NO: 227255 - DNA, 20 bp, Artificial Sequence
  Description of Artificial Sequence: Synthetic oligonucleotide
  Target: ATXN1; (-) strand; PAM type: YTN; PAM sequence: CTT
cagtccaagcttttcagaat

SEQ ID NO: 227256 - DNA, 20 bp, Artificial Sequence
  Description of Artificial Sequence: Synthetic oligonucleotide
  Target: ATXN1; (-) strand; PAM type: YTN; PAM sequence: CTG
cagagcacgtccttcagtcc

SEQ ID NO: 227257 - DNA, 20 bp, Artificial Sequence
  Description of Artificial Sequence: Synthetic oligonucleotide
  Target: ATXN1; (-) strand; PAM type: YTN; PAM sequence: CTG
agaaggcctgcagagcacgt

SEQ ID NO: 227258 - DNA, 20 bp, Artificial Sequence
  Description of Artificial Sequence: Synthetic oligonucleotide
  Target: ATXN1; (-) strand; PAM type: YTN; PAM sequence: CTG
gaggaaagggtgctgagaag

SEQ ID NO: 227259 - DNA, 20 bp, Artificial Sequence
  Description of Artificial Sequence: Synthetic oligonucleotide
  Target: ATXN1; (-) strand; PAM type: YTN; PAM sequence: TTG
actggaggaaagggtgctga

SEQ ID NO: 227260 - DNA, 20 bp, Artificial Sequence
  Description of Artificial Sequence: Synthetic oligonucleotide
  Target: ATXN1; (-) strand; PAM type: YTN; PAM sequence: CTG
agtcaggttgactggaggaa

SEQ ID NO: 227261 - DNA, 20 bp, Artificial Sequence
  Description of Artificial Sequence: Synthetic oligonucleotide
  Target: ATXN1; (-) strand; PAM type: YTN; PAM sequence: TTC
atacctgagtcaggttgact

SEQ ID NO: 227262 - DNA, 20 bp, Artificial Sequence
  Description of Artificial Sequence: Synthetic oligonucleotide
  Target: ATXN1; (-) strand; PAM type: YTN; PAM sequence: TTT
catacctgagtcaggttgac

SEQ ID NO: 227263 - DNA, 20 bp, Artificial Sequence
  Description of Artificial Sequence: Synthetic oligonucleotide
  Target: ATXN1; (-) strand; PAM type: YTN; PAM sequence: TTA
tggtagggtatgtttcatac

SEQ ID NO: 227264 - DNA, 20 bp, Artificial Sequence
  Description of Artificial Sequence: Synthetic oligonucleotide
  Target: ATXN1; (-) strand; PAM type: YTN; PAM sequence: TTA
agcattatggtagggtatgt

SEQ ID NO: 227265 - DNA, 20 bp, Artificial Sequence
  Description of Artificial Sequence: Synthetic oligonucleotide
  Target: ATXN1; (-) strand; PAM type: YTN; PAM sequence: CTG
ttaagcattatggtagggta

SEQ ID NO: 227266 - DNA, 20 bp, Artificial Sequence
  Description of Artificial Sequence: Synthetic oligonucleotide
  Target: ATXN1; (-) strand; PAM type: YTN; PAM sequence: CTC
tgttaagcattatggtaggg

SEQ ID NO: 227267 - DNA, 20 bp, Artificial Sequence
  Description of Artificial Sequence: Synthetic oligonucleotide
  Target: ATXN1; (-) strand; PAM type: YTN; PAM sequence: CTC
tctgttaagcattatggtag

SEQ ID NO: 227268 - DNA, 20 bp, Artificial Sequence
  Description of Artificial Sequence: Synthetic oligonucleotide
  Target: ATXN1; (-) strand; PAM type: YTN; PAM sequence: TTG
ctctctgttaagcattatgg

SEQ ID NO: 227269 - DNA, 20 bp, Artificial Sequence
  Description of Artificial Sequence: Synthetic oligonucleotide
  Target: ATXN1; (-) strand; PAM type: YTN; PAM sequence: TTA
atcattgctctctgttaagc

SEQ ID NO: 227270 - DNA, 20 bp, Artificial Sequence
  Description of Artificial Sequence: Synthetic oligonucleotide
  Target: ATXN1; (-) strand; PAM type: YTN; PAM sequence: CTG
ggagcaggcaacagattaat

SEQ ID NO: 227271 - DNA, 20 bp, Artificial Sequence
  Description of Artificial Sequence: Synthetic oligonucleotide
  Target: ATXN1; (-) strand; PAM type: YTN; PAM sequence: CTA
gtactgggagcaggcaacag

SEQ ID NO: 227272 - DNA, 20 bp, Artificial Sequence
  Description of Artificial Sequence: Synthetic oligonucleotide
  Target: ATXN1; (-) strand; PAM type: YTN; PAM sequence: CTC
tagtactgggagcaggcaac

SEQ ID NO: 227273 - DNA, 20 bp, Artificial Sequence
  Description of Artificial Sequence: Synthetic oligonucleotide
  Target: ATXN1; (-) strand; PAM type: YTN; PAM sequence: TTG
acctctagtactgggagcag

SEQ ID NO: 227274 - DNA, 20 bp, Artificial Sequence
  Description of Artificial Sequence: Synthetic oligonucleotide
  Target: ATXN1; (-) strand; PAM type: YTN; PAM sequence: TTT
gacctctagtactgggagca

SEQ ID NO: 227275 - DNA, 20 bp, Artificial Sequence
  Description of Artificial Sequence: Synthetic oligonucleotide
  Target: ATXN1; (-) strand; PAM type: YTN; PAM sequence: CTT
tgacctctagtactgggagc

SEQ ID NO: 227276 - DNA, 20 bp, Artificial Sequence
  Description of Artificial Sequence: Synthetic oligonucleotide
  Target: ATXN1; (-) strand; PAM type: YTN; PAM sequence: CTA
aagcataagataggatgtgg

SEQ ID NO: 227277 - DNA, 20 bp, Artificial Sequence
  Description of Artificial Sequence: Synthetic oligonucleotide
  Target: ATXN1; (-) strand; PAM type: YTN; PAM sequence: TTG
aggctaaagcataagatagg

SEQ ID NO: 227278 - DNA, 20 bp, Artificial Sequence
  Description of Artificial Sequence: Synthetic oligonucleotide
  Target: ATXN1; (-) strand; PAM type: YTN; PAM sequence: CTA
ggtattgaggctaaagcata

SEQ ID NO: 227279 - DNA, 20 bp, Artificial Sequence
  Description of Artificial Sequence: Synthetic oligonucleotide
  Target: ATXN1; (-) strand; PAM type: YTN; PAM sequence: CTC
taggtattgaggctaaagca

SEQ ID NO: 227280 - DNA, 20 bp, Artificial Sequence
  Description of Artificial Sequence: Synthetic oligonucleotide
  Target: ATXN1; (-) strand; PAM type: YTN; PAM sequence: CTG
ctctaggtattgaggctaaa

SEQ ID NO: 227281 - DNA, 20 bp, Artificial Sequence
  Description of Artificial Sequence: Synthetic oligonucleotide
  Target: ATXN1; (-) strand; PAM type: YTN; PAM sequence: TTC
tgctctaggtattgaggcta

SEQ ID NO: 227282 - DNA, 20 bp, Artificial Sequence
  Description of Artificial Sequence: Synthetic oligonucleotide
  Target: ATXN1; (-) strand; PAM type: YTN; PAM sequence: TTG
ggcgccaaattctgctctag

SEQ ID NO: 227283 - DNA, 20 bp, Artificial Sequence
  Description of Artificial Sequence: Synthetic oligonucleotide
  Target: ATXN1; (-) strand; PAM type: YTN; PAM sequence: TTG
catacgtattgggcgccaaa

SEQ ID NO: 227284 - DNA, 20 bp, Artificial Sequence
  Description of Artificial Sequence: Synthetic oligonucleotide
  Target: ATXN1; (-) strand; PAM type: YTN; PAM sequence: CTT
gcatacgtattgggcgccaa

SEQ ID NO: 227285 - DNA, 20 bp, Artificial Sequence
  Description of Artificial Sequence: Synthetic oligonucleotide
  Target: ATXN1; (-) strand; PAM type: YTN; PAM sequence: TTC
ttgcatacgtattgggcgcc

SEQ ID NO: 227286 - DNA, 20 bp, Artificial Sequence
  Description of Artificial Sequence: Synthetic oligonucleotide
  Target: ATXN1; (-) strand; PAM type: YTN; PAM sequence: TTT
cttgcatacgtattgggcgc

SEQ ID NO: 227287 - DNA, 20 bp, Artificial Sequence
  Description of Artificial Sequence: Synthetic oligonucleotide
  Target: ATXN1; (-) strand; PAM type: YTN; PAM sequence: TTC
aacaaagatttcttgcatac

SEQ ID NO: 227288 - DNA, 20 bp, Artificial Sequence
  Description of Artificial Sequence: Synthetic oligonucleotide
  Target: ATXN1; (-) strand; PAM type: YTN; PAM sequence: TTA
attcaacaaagatttcttgc

SEQ ID NO: 227289 - DNA, 20 bp, Artificial Sequence
  Description of Artificial Sequence: Synthetic oligonucleotide
  Target: ATXN1; (-) strand; PAM type: YTN; PAM sequence: TTC
attaattcaacaaagatttc

SEQ ID NO: 227290 - DNA, 20 bp, Artificial Sequence
  Description of Artificial Sequence: Synthetic oligonucleotide
  Target: ATXN1; (-) strand; PAM type: YTN; PAM sequence: CTT
cattaattcaacaaagattt

SEQ ID NO: 227291 - DNA, 20 bp, Artificial Sequence
  Description of Artificial Sequence: Synthetic oligonucleotide
  Target: ATXN1; (-) strand; PAM type: YTN; PAM sequence: TTC
ttcattaattcaacaaagat

SEQ ID NO: 227292 - DNA, 20 bp, Artificial Sequence
  Description of Artificial Sequence: Synthetic oligonucleotide
  Target: ATXN1; (-) strand; PAM type: YTN; PAM sequence: CTC
cattcttcattaattcaaca

SEQ ID NO: 227293 - DNA, 20 bp, Artificial Sequence
  Description of Artificial Sequence: Synthetic oligonucleotide
  Target: ATXN1; (-) strand; PAM type: YTN; PAM sequence: TTC
tccattcttcattaattcaa

SEQ ID NO: 227294 - DNA, 20 bp, Artificial Sequence
  Description of Artificial Sequence: Synthetic oligonucleotide
  Target: ATXN1; (-) strand; PAM type: YTN; PAM sequence: TTT
ctccattcttcattaattca

SEQ ID NO: 227295 - DNA, 20 bp, Artificial Sequence
  Description of Artificial Sequence: Synthetic oligonucleotide
  Target: ATXN1; (-) strand; PAM type: YTN; PAM sequence: CTT
tctccattcttcattaattc

SEQ ID NO: 227296 - DNA, 20 bp, Artificial Sequence
  Description of Artificial Sequence: Synthetic oligonucleotide
  Target: ATXN1; (-) strand; PAM type: YTN; PAM sequence: CTC
tttctccattcttcattaat

SEQ ID NO: 227297 - DNA, 20 bp, Artificial Sequence
  Description of Artificial Sequence: Synthetic oligonucleotide
  Target: ATXN1; (-) strand; PAM type: YTN; PAM sequence: TTC
tctttctccattcttcatta

SEQ ID NO: 227298 - DNA, 20 bp, Artificial Sequence
  Description of Artificial Sequence: Synthetic oligonucleotide
  Target: ATXN1; (-) strand; PAM type: YTN; PAM sequence: CTC
gttctctttctccattcttc

SEQ ID NO: 227299 - DNA, 20 bp, Artificial Sequence
  Description of Artificial Sequence: Synthetic oligonucleotide
  Target: ATXN1; (-) strand; PAM type: YTN; PAM sequence: CTC
tcgttctctttctccattct

SEQ ID NO: 227300 - DNA, 20 bp, Artificial Sequence
  Description of Artificial Sequence: Synthetic oligonucleotide
  Target: ATXN1; (-) strand; PAM type: YTN; PAM sequence: CTG
cctctcgttctctttctcca

SEQ ID NO: 227301 - DNA, 20 bp, Artificial Sequence
  Description of Artificial Sequence: Synthetic oligonucleotide
  Target: ATXN1; (-) strand; PAM type: YTN; PAM sequence: CTC
tgcctctcgttctctttctc

SEQ ID NO: 227302 - DNA, 20 bp, Artificial Sequence
  Description of Artificial Sequence: Synthetic oligonucleotide
  Target: ATXN1; (-) strand; PAM type: YTN; PAM sequence: CTC
tctgcctctcgttctctttc

SEQ ID NO: 227303 - DNA, 20 bp, Artificial Sequence
  Description of Artificial Sequence: Synthetic oligonucleotide
  Target: ATXN1; (-) strand; PAM type: YTN; PAM sequence: TTC
tctctgcctctcgttctctt

SEQ ID NO: 227304 - DNA, 20 bp, Artificial Sequence
  Description of Artificial Sequence: Synthetic oligonucleotide
  Target: ATXN1; (-) strand; PAM type: YTN; PAM sequence: TTT
ctctctgcctctcgttctct

SEQ ID NO: 227305 - DNA, 20 bp, Artificial Sequence
  Description of Artificial Sequence: Synthetic oligonucleotide
  Target: ATXN1; (-) strand; PAM type: YTN; PAM sequence: CTT
tctctctgcctctcgttctc

SEQ ID NO: 227306 - DNA, 20 bp, Artificial Sequence
  Description of Artificial Sequence: Synthetic oligonucleotide
  Target: ATXN1; (-) strand; PAM type: YTN; PAM sequence: TTC
tttctctctgcctctcgttc

SEQ ID NO: 227307 - DNA, 20 bp, Artificial Sequence
  Description of Artificial Sequence: Synthetic oligonucleotide
  Target: ATXN1; (-) strand; PAM type: YTN; PAM sequence: TTT
ctttctctctgcctctcgtt

SEQ ID NO: 227308 - DNA, 20 bp, Artificial Sequence
  Description of Artificial Sequence: Synthetic oligonucleotide
  Target: ATXN1; (-) strand; PAM type: YTN; PAM sequence: CTT
tctttctctctgcctctcgt

SEQ ID NO: 227309 - DNA, 20 bp, Artificial Sequence
  Description of Artificial Sequence: Synthetic oligonucleotide
  Target: ATXN1; (-) strand; PAM type: YTN; PAM sequence: CTC
tttctttctctctgcctctc

SEQ ID NO: 227310 - DNA, 20 bp, Artificial Sequence
  Description of Artificial Sequence: Synthetic oligonucleotide
  Target: ATXN1; (-) strand; PAM type: YTN; PAM sequence: TTA
agatctctttctttctctct

SEQ ID NO: 227311 - DNA, 20 bp, Artificial Sequence
  Description of Artificial Sequence: Synthetic oligonucleotide
  Target: ATXN1; (-) strand; PAM type: YTN; PAM sequence: TTT
aagatctctttctttctctc

SEQ ID NO: 227312 - DNA, 20 bp, Artificial Sequence
  Description of Artificial Sequence: Synthetic oligonucleotide
  Target: ATXN1; (-) strand; PAM type: YTN; PAM sequence: CTT
taagatctctttctttctct

SEQ ID NO: 227313 - DNA, 20 bp, Artificial Sequence
  Description of Artificial Sequence: Synthetic oligonucleotide
  Target: ATXN1; (-) strand; PAM type: YTN; PAM sequence: TTC
ctttaagatctctttctttc

SEQ ID NO: 227314 - DNA, 20 bp, Artificial Sequence
  Description of Artificial Sequence: Synthetic oligonucleotide
  Target: ATXN1; (-) strand; PAM type: YTN; PAM sequence: CTT
cctttaagatctctttcttt

SEQ ID NO: 227315 - DNA, 20 bp, Artificial Sequence
  Description of Artificial Sequence: Synthetic oligonucleotide
  Target: ATXN1; (-) strand; PAM type: YTN; PAM sequence: CTC
ttcctttaagatctctttct

SEQ ID NO: 227316 - DNA, 20 bp, Artificial Sequence
  Description of Artificial Sequence: Synthetic oligonucleotide
  Target: ATXN1; (-) strand; PAM type: YTN; PAM sequence: CTC
tcttcctttaagatctcttt

SEQ ID NO: 227317 - DNA, 20 bp, Artificial Sequence
  Description of Artificial Sequence: Synthetic oligonucleotide
  Target: ATXN1; (-) strand; PAM type: YTN; PAM sequence: CTG
tgcccggccctctcttcctt

SEQ ID NO: 227318 - DNA, 20 bp, Artificial Sequence
  Description of Artificial Sequence: Synthetic oligonucleotide
  Target: ATXN1; (-) strand; PAM type: YTN; PAM sequence: TTA
caggcataagccactgtgcc

SEQ ID NO: 227319 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcataagccac

SEQ ID NO: 227320 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 227321 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 227322 - DNA, 20 bp, Artificial Sequence
  Description of Artificial Sequence: Synthetic oligonucleotide
  Target: ATXN1; (-) strand; PAM type: YTN; PAM sequence: TTG
cctcggcctcccaaagtgct

SEQ ID NO: 227323 - DNA, 20 bp, Artificial Sequence
  Description of Artificial Sequence: Synthetic oligonucleotide
  Target: ATXN1; (-) strand; PAM type: YTN; PAM sequence: CTT
gcctcggcctcccaaagtgc

SEQ ID NO: 227324 - DNA, 20 bp, Artificial Sequence
  Description of Artificial Sequence: Synthetic oligonucleotide
  Target: ATXN1; (-) strand; PAM type: YTN; PAM sequence: CTC
gtgatccacttgcctcggcc

SEQ ID NO: 227325 - DNA, 20 bp, Artificial Sequence
  Description of Artificial Sequence: Synthetic oligonucleotide
  Target: ATXN1; (-) strand; PAM type: YTN; PAM sequence: CTG
acctcgtgatccacttgcct

SEQ ID NO: 227326 - DNA, 20 bp, Artificial Sequence
  Description of Artificial Sequence: Synthetic oligonucleotide
  Target: ATXN1; (-) strand; PAM type: YTN; PAM sequence: CTC
ctgacctcgtgatccacttg

SEQ ID NO: 227327 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcgtgatcc

SEQ ID NO: 227328 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcgtgatc

SEQ ID NO: 227329 - DNA, 20 bp, Artificial Sequence
  Description of Artificial Sequence: Synthetic oligonucleotide
  Target: ATXN1; (-) strand; PAM type: YTN; PAM sequence: TTG
gtcaggatggtcttgaactc

SEQ ID NO: 227330 - DNA, 20 bp, Artificial Sequence
  Description of Artificial Sequence: Synthetic oligonucleotide
  Target: ATXN1; (-) strand; PAM type: YTN; PAM sequence: TTG
ttggtcaggatggtcttgaa

SEQ ID NO: 227331 - DNA, 20 bp, Artificial Sequence
  Description of Artificial Sequence: Synthetic oligonucleotide
  Target: ATXN1; (-) strand; PAM type: YTN; PAM sequence: CTT
gttggtcaggatggtcttga

SEQ ID NO: 227332 - DNA, 20 bp, Artificial Sequence
  Description of Artificial Sequence: Synthetic oligonucleotide
  Target: ATXN1; (-) strand; PAM type: YTN; PAM sequence: TTC
accttgttggtcaggatggt

SEQ ID NO: 227333 - DNA, 20 bp, Artificial Sequence
  Description of Artificial Sequence: Synthetic oligonucleotide
  Target: ATXN1; (-) strand; PAM type: YTN; PAM sequence: TTT
caccttgttggtcaggatgg

SEQ ID NO: 227334 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcacct

SEQ ID NO: 227335 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcacc

SEQ ID NO: 227336 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcac

SEQ ID NO: 227337 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 227338 - DNA, 20 bp, Artificial Sequence
  Description of Artificial Sequence: Synthetic oligonucleotide
  Target: ATXN1; (-) strand; PAM type: YTN; PAM sequence: TTG
tgtttttagtagagacaggg

SEQ ID NO: 227339 - DNA, 20 bp, Artificial Sequence
  Description of Artificial Sequence: Synthetic oligonucleotide
  Target: ATXN1; (-) strand; PAM type: YTN; PAM sequence: TTT
gtgtttttagtagagacagg

SEQ ID NO: 227340 - DNA, 20 bp, Artificial Sequence
  Description of Artificial Sequence: Synthetic oligonucleotide
  Target: ATXN1; (-) strand; PAM type: YTN; PAM sequence: TTT
tgtgtttttagtagagacag

SEQ ID NO: 227341 - DNA, 20 bp, Artificial Sequence
  Description of Artificial Sequence: Synthetic oligonucleotide
  Target: ATXN1; (-) strand; PAM type: YTN; PAM sequence: TTT
ttgtgtttttagtagagaca

SEQ ID NO: 227342 - DNA, 20 bp, Artificial Sequence
  Description of Artificial Sequence: Synthetic oligonucleotide
  Target: ATXN1; (-) strand; PAM type: YTN; PAM sequence: TTT
tttgtgtttttagtagagac

SEQ ID NO: 227343 - DNA, 20 bp, Artificial Sequence
  Description of Artificial Sequence: Synthetic oligonucleotide
  Target: ATXN1; (-) strand; PAM type: YTN; PAM sequence: TTT
ttttgtgtttttagtagaga

SEQ ID NO: 227344 - DNA, 20 bp, Artificial Sequence
  Description of Artificial Sequence: Synthetic oligonucleotide
  Target: ATXN1; (-) strand; PAM type: YTN; PAM sequence: CTA
ccacgcacggaccatttttt

SEQ ID NO: 227345 - DNA, 20 bp, Artificial Sequence
  Description of Artificial Sequence: Synthetic oligonucleotide
  Target: ATXN1; (-) strand; PAM type: YTN; PAM sequence: TTA
caagtgtgcactaccacgca

SEQ ID NO: 227346 - DNA, 20 bp, Artificial Sequence
  Description of Artificial Sequence: Synthetic oligonucleotide
  Target: ATXN1; (-) strand; PAM type: YTN; PAM sequence: CTA
ggattacaagtgtgcactac

SEQ ID NO: 227347 - DNA, 20 bp, Artificial Sequence
  Description of Artificial Sequence: Synthetic oligonucleotide
  Target: ATXN1; (-) strand; PAM type: YTN; PAM sequence: CTG
agtagctaggattacaagtg

SEQ ID NO: 227348 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctaggattacaa

SEQ ID NO: 227349 - DNA, 20 bp, Artificial Sequence
  Description of Artificial Sequence: Synthetic oligonucleotide
  Target: ATXN1; (-) strand; PAM type: YTN; PAM sequence: CTC
agtctcctgagtagctagga

SEQ ID NO: 227350 - DNA, 20 bp, Artificial Sequence
  Description of Artificial Sequence: Synthetic oligonucleotide
  Target: ATXN1; (-) strand; PAM type: YTN; PAM sequence: CTG
cctcagtctcctgagtagct

SEQ ID NO: 227351 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagtctcctgagta

SEQ ID NO: 227352 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagtctcctgag

SEQ ID NO: 227353 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcctgcctcag

SEQ ID NO: 227354 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcaattctcctgc

SEQ ID NO: 227355 - DNA, 20 bp, Artificial Sequence
  Description of Artificial Sequence: Synthetic oligonucleotide
  Target: ATXN1; (-) strand; PAM type: YTN; PAM sequence: CTC
tgggttcaagcaattctcct

SEQ ID NO: 227356 - DNA, 20 bp, Artificial Sequence
  Description of Artificial Sequence: Synthetic oligonucleotide
  Target: ATXN1; (-) strand; PAM type: YTN; PAM sequence: TTC
cgcctctgggttcaagcaat

SEQ ID NO: 227357 - DNA, 20 bp, Artificial Sequence
  Description of Artificial Sequence: Synthetic oligonucleotide
  Target: ATXN1; (-) strand; PAM type: YTN; PAM sequence: CTT
ccgcctctgggttcaagcaa

SEQ ID NO: 227358 - DNA, 20 bp, Artificial Sequence
  Description of Artificial Sequence: Synthetic oligonucleotide
  Target: ATXN1; (-) strand; PAM type: YTN; PAM sequence: CTG
caacttccgcctctgggttc

SEQ ID NO: 227359 - DNA, 20 bp, Artificial Sequence
  Description of Artificial Sequence: Synthetic oligonucleotide
  Target: ATXN1; (-) strand; PAM type: YTN; PAM sequence: CTC
cctgcaacttccgcctctgg

SEQ ID NO: 227360 - DNA, 20 bp, Artificial Sequence
  Description of Artificial Sequence: Synthetic oligonucleotide
  Target: ATXN1; (-) strand; PAM type: YTN; PAM sequence: CTC
ggctccctgcaacttccgcc

SEQ ID NO: 227361 - DNA, 20 bp, Artificial Sequence
  Description of Artificial Sequence: Synthetic oligonucleotide
  Target: ATXN1; (-) strand; PAM type: YTN; PAM sequence: CTG
gagcgcaatggtgcaatctc

SEQ ID NO: 227362 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctggagcgcaa

SEQ ID NO: 227363 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggctggagcgc

SEQ ID NO: 227364 - DNA, 20 bp, Artificial Sequence
  Description of Artificial Sequence: Synthetic oligonucleotide
  Target: ATXN1; (-) strand; PAM type: YTN; PAM sequence: TTG
ctctgtcgcccaggctggag

SEQ ID NO: 227365 - DNA, 20 bp, Artificial Sequence
  Description of Artificial Sequence: Synthetic oligonucleotide
  Target: ATXN1; (-) strand; PAM type: YTN; PAM sequence: CTT
gctctgtcgcccaggctgga

SEQ ID NO: 227366 - DNA, 20 bp, Artificial Sequence
  Description of Artificial Sequence: Synthetic oligonucleotide
  Target: ATXN1; (-) strand; PAM type: YTN; PAM sequence: TTG
agatggagtcttgctctgtc

SEQ ID NO: 227367 - DNA, 20 bp, Artificial Sequence
  Description of Artificial Sequence: Synthetic oligonucleotide
  Target: ATXN1; (-) strand; PAM type: YTN; PAM sequence: TTT
gagatggagtcttgctctgt

SEQ ID NO: 227368 - DNA, 20 bp, Artificial Sequence
  Description of Artificial Sequence: Synthetic oligonucleotide
  Target: ATXN1; (-) strand; PAM type: YTN; PAM sequence: TTT
tgagatggagtcttgctctg

SEQ ID NO: 227369 - DNA, 20 bp, Artificial Sequence
  Description of Artificial Sequence: Synthetic oligonucleotide
  Target: ATXN1; (-) strand; PAM type: YTN; PAM sequence: TTT
ttgagatggagtcttgctct

SEQ ID NO: 227370 - DNA, 20 bp, Artificial Sequence
  Description of Artificial Sequence: Synthetic oligonucleotide
  Target: ATXN1; (-) strand; PAM type: YTN; PAM sequence: TTT
tttgagatggagtcttgctc

SEQ ID NO: 227371 - DNA, 20 bp, Artificial Sequence
  Description of Artificial Sequence: Synthetic oligonucleotide
  Target: ATXN1; (-) strand; PAM type: YTN; PAM sequence: TTT
ttttgagatggagtcttgct

SEQ ID NO: 227372 - DNA, 20 bp, Artificial Sequence
  Description of Artificial Sequence: Synthetic oligonucleotide
  Target: ATXN1; (-) strand; PAM type: YTN; PAM sequence: TTT
tttttgagatggagtcttgc

SEQ ID NO: 227373 - DNA, 20 bp, Artificial Sequence
  Description of Artificial Sequence: Synthetic oligonucleotide
  Target: ATXN1; (-) strand; PAM type: YTN; PAM sequence: TTT
ttttttgagatggagtcttg

SEQ ID NO: 227374 - DNA, 20 bp, Artificial Sequence
  Description of Artificial Sequence: Synthetic oligonucleotide
  Target: ATXN1; (-) strand; PAM type: YTN; PAM sequence: TTT
tttttttgagatggagtctt

SEQ ID NO: 227375 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagatggagtct

SEQ ID NO: 227376 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagatggagtc

SEQ ID NO: 227377 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagatggagt

SEQ ID NO: 227378 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagatggag

SEQ ID NO: 227379 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagatgga

SEQ ID NO: 227380 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagatgg

SEQ ID NO: 227381 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagatg

SEQ ID NO: 227382 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttgagat

SEQ ID NO: 227383 - DNA, 20 bp, Artificial Sequence
  Description of Artificial Sequence: Synthetic oligonucleotide
  Target: ATXN1; (-) strand; PAM type: YTN; PAM sequence: TTC
ctttttttttttttttttga

SEQ ID NO: 227384 - DNA, 20 bp, Artificial Sequence
  Description of Artificial Sequence: Synthetic oligonucleotide
  Target: ATXN1; (-) strand; PAM type: YTN; PAM sequence: CTT
cctttttttttttttttttg

SEQ ID NO: 227385 - DNA, 20 bp, Artificial Sequence
  Description of Artificial Sequence: Synthetic oligonucleotide
  Target: ATXN1; (-) strand; PAM type: YTN; PAM sequence: TTC
ttcctttttttttttttttt

SEQ ID NO: 227386 - DNA, 20 bp, Artificial Sequence
  Description of Artificial Sequence: Synthetic oligonucleotide
  Target: ATXN1; (-) strand; PAM type: YTN; PAM sequence: TTT
cttccttttttttttttttt

SEQ ID NO: 227387 - DNA, 20 bp, Artificial Sequence
  Description of Artificial Sequence: Synthetic oligonucleotide
  Target: ATXN1; (-) strand; PAM type: YTN; PAM sequence: CTT
tcttcctttttttttttttt

SEQ ID NO: 227388 - DNA, 20 bp, Artificial Sequence
  Description of Artificial Sequence: Synthetic oligonucleotide
  Target: ATXN1; (-) strand; PAM type: YTN; PAM sequence: TTC
tttcttcctttttttttttt

SEQ ID NO: 227389 - DNA, 20 bp, Artificial Sequence
  Description of Artificial Sequence: Synthetic oligonucleotide
  Target: ATXN1; (-) strand; PAM type: YTN; PAM sequence: TTT
ctttcttccttttttttttt

SEQ ID NO: 227390 - DNA, 20 bp, Artificial Sequence
  Description of Artificial Sequence: Synthetic oligonucleotide
  Target: ATXN1; (-) strand; PAM type: YTN; PAM sequence: CTT
tctttcttcctttttttttt

SEQ ID NO: 227391 - DNA, 20 bp, Artificial Sequence
  Description of Artificial Sequence: Synthetic oligonucleotide
  Target: ATXN1; (-) strand; PAM type: YTN; PAM sequence: CTC
tttctttcttcctttttttt

SEQ ID NO: 227392 - DNA, 20 bp, Artificial Sequence
  Description of Artificial Sequence: Synthetic oligonucleotide
  Target: ATXN1; (-) strand; PAM type: YTN; PAM sequence: CTC
agggtcctctttctttcttc

SEQ ID NO: 227393 - DNA, 20 bp, Artificial Sequence
  Description of Artificial Sequence: Synthetic oligonucleotide
  Target: ATXN1; (-) strand; PAM type: YTN; PAM sequence: CTC
tcagggtcctctttctttct

SEQ ID NO: 227394 - DNA, 20 bp, Artificial Sequence
  Description of Artificial Sequence: Synthetic oligonucleotide
  Target: ATXN1; (-) strand; PAM type: YTN; PAM sequence: TTA
accctctcagggtcctcttt

SEQ ID NO: 227395 - DNA, 20 bp, Artificial Sequence
  Description of Artificial Sequence: Synthetic oligonucleotide
  Target: ATXN1; (-) strand; PAM type: YTN; PAM sequence: CTT
aaccctctcagggtcctctt

SEQ ID NO: 227396 - DNA, 20 bp, Artificial Sequence
  Description of Artificial Sequence: Synthetic oligonucleotide
  Target: ATXN1; (-) strand; PAM type: YTN; PAM sequence: CTG
aataaagcacttaaccctct

SEQ ID NO: 227397 - DNA, 20 bp, Artificial Sequence
  Description of Artificial Sequence: Synthetic oligonucleotide
  Target: ATXN1; (-) strand; PAM type: YTN; PAM sequence: TTA
gccctgaataaagcacttaa

SEQ ID NO: 227398 - DNA, 20 bp, Artificial Sequence
  Description of Artificial Sequence: Synthetic oligonucleotide
  Target: ATXN1; (-) strand; PAM type: YTN; PAM sequence: TTT
agccctgaataaagcactta

SEQ ID NO: 227399 - DNA, 20 bp, Artificial Sequence
  Description of Artificial Sequence: Synthetic oligonucleotide
  Target: ATXN1; (-) strand; PAM type: YTN; PAM sequence: TTA
tttagccctgaataaagcac

SEQ ID NO: 227400 - DNA, 20 bp, Artificial Sequence
  Description of Artificial Sequence: Synthetic oligonucleotide
  Target: ATXN1; (-) strand; PAM type: YTN; PAM sequence: TTT
atttagccctgaataaagca

SEQ ID NO: 227401 - DNA, 20 bp, Artificial Sequence
  Description of Artificial Sequence: Synthetic oligonucleotide
  Target: ATXN1; (-) strand; PAM type: YTN; PAM sequence: CTG
gtttatttagccctgaataa

SEQ ID NO: 227402 - DNA, 20 bp, Artificial Sequence
  Description of Artificial Sequence: Synthetic oligonucleotide
  Target: ATXN1; (-) strand; PAM type: YTN; PAM sequence: TTG
tcccagtctggtttatttag

SEQ ID NO: 227403 - DNA, 20 bp, Artificial Sequence
  Description of Artificial Sequence: Synthetic oligonucleotide
  Target: ATXN1; (-) strand; PAM type: YTN; PAM sequence: CTT
gtcccagtctggtttattta

SEQ ID NO: 227404 - DNA, 20 bp, Artificial Sequence
  Description of Artificial Sequence: Synthetic oligonucleotide
  Target: ATXN1; (-) strand; PAM type: YTN; PAM sequence: TTC
ttgtcccagtctggtttatt

SEQ ID NO: 227405 - DNA, 20 bp, Artificial Sequence
  Description of Artificial Sequence: Synthetic oligonucleotide
  Target: ATXN1; (-) strand; PAM type: YTN; PAM sequence: CTG
aattcttgtcccagtctggt

SEQ ID NO: 227406 - DNA, 20 bp, Artificial Sequence
  Description of Artificial Sequence: Synthetic oligonucleotide
  Target: ATXN1; (-) strand; PAM type: YTN; PAM sequence: TTA
ggaggcctgaattcttgtcc

SEQ ID NO: 227407 - DNA, 20 bp, Artificial Sequence
  Description of Artificial Sequence: Synthetic oligonucleotide
  Target: ATXN1; (-) strand; PAM type: YTN; PAM sequence: TTG
gaagaaggaggatccatcag

SEQ ID NO: 227408 - DNA, 20 bp, Artificial Sequence
  Description of Artificial Sequence: Synthetic oligonucleotide
  Target: ATXN1; (-) strand; PAM type: YTN; PAM sequence: TTA
tgggatggattggaagaagg

SEQ ID NO: 227409 - DNA, 20 bp, Artificial Sequence
  Description of Artificial Sequence: Synthetic oligonucleotide
  Target: ATXN1; (-) strand; PAM type: YTN; PAM sequence: TTT
atgggatggattggaagaag

SEQ ID NO: 227410 - DNA, 20 bp, Artificial Sequence
  Description of Artificial Sequence: Synthetic oligonucleotide
  Target: ATXN1; (-) strand; PAM type: YTN; PAM sequence: TTG
aaaagcatttatgggatgga

SEQ ID NO: 227411 - DNA, 20 bp, Artificial Sequence
  Description of Artificial Sequence: Synthetic oligonucleotide
  Target: ATXN1; (-) strand; PAM type: YTN; PAM sequence: TTT
gaaaagcatttatgggatgg

SEQ ID NO: 227412 - DNA, 20 bp, Artificial Sequence
  Description of Artificial Sequence: Synthetic oligonucleotide
  Target: ATXN1; (-) strand; PAM type: YTN; PAM sequence: CTA
gcgggaggtgataaagtgaa

SEQ ID NO: 227413 - DNA, 20 bp, Artificial Sequence
  Description of Artificial Sequence: Synthetic oligonucleotide
  Target: ATXN1; (-) strand; PAM type: YTN; PAM sequence: CTC
gtctagcgggaggtgataaa

SEQ ID NO: 227414 - DNA, 20 bp, Artificial Sequence
  Description of Artificial Sequence: Synthetic oligonucleotide
  Target: ATXN1; (-) strand; PAM type: YTN; PAM sequence: CTG
tagaagctcgtctagcggga

SEQ ID NO: 227415 - DNA, 20 bp, Artificial Sequence
  Description of Artificial Sequence: Synthetic oligonucleotide
  Target: ATXN1; (-) strand; PAM type: YTN; PAM sequence: TTA
ggaaaactgtagaagctcgt

SEQ ID NO: 227416 - DNA, 20 bp, Artificial Sequence
  Description of Artificial Sequence: Synthetic oligonucleotide
  Target: ATXN1; (-) strand; PAM type: YTN; PAM sequence: CTG
ttaggaaaactgtagaagct

SEQ ID NO: 227417 - DNA, 20 bp, Artificial Sequence
  Description of Artificial Sequence: Synthetic oligonucleotide
  Target: ATXN1; (-) strand; PAM type: YTN; PAM sequence: TTC
aatagctgttaggaaaactg

SEQ ID NO: 227418 - DNA, 20 bp, Artificial Sequence
  Description of Artificial Sequence: Synthetic oligonucleotide
  Target: ATXN1; (-) strand; PAM type: YTN; PAM sequence: TTG
aaaagagatgatagagattc

SEQ ID NO: 227419 - DNA, 20 bp, Artificial Sequence
  Description of Artificial Sequence: Synthetic oligonucleotide
  Target: ATXN1; (-) strand; PAM type: YTN; PAM sequence: CTA
ggattgaaaagagatgatag

SEQ ID NO: 227420 - DNA, 20 bp, Artificial Sequence
  Description of Artificial Sequence: Synthetic oligonucleotide
  Target: ATXN1; (-) strand; PAM type: YTN; PAM sequence: CTA
agtctaggattgaaaagaga

SEQ ID NO: 227421 - DNA, 20 bp, Artificial Sequence
  Description of Artificial Sequence: Synthetic oligonucleotide
  Target: ATXN1; (-) strand; PAM type: YTN; PAM sequence: TTG
tatatctaagtctaggattg

SEQ ID NO: 227422 - DNA, 20 bp, Artificial Sequence
  Description of Artificial Sequence: Synthetic oligonucleotide
  Target: ATXN1; (-) strand; PAM type: YTN; PAM sequence: TTA
ggtgacagaaaattgtatat

SEQ ID NO: 227423 - DNA, 20 bp, Artificial Sequence
  Description of Artificial Sequence: Synthetic oligonucleotide
  Target: ATXN1; (-) strand; PAM type: YTN; PAM sequence: TTT
aggtgacagaaaattgtata

SEQ ID NO: 227424 - DNA, 20 bp, Artificial Sequence
  Description of Artificial Sequence: Synthetic oligonucleotide
  Target: ATXN1; (-) strand; PAM type: YTN; PAM sequence: CTG
ccaatgagacatttaggtga

SEQ ID NO: 227425 - DNA, 20 bp, Artificial Sequence
  Description of Artificial Sequence: Synthetic oligonucleotide
  Target: ATXN1; (-) strand; PAM type: YTN; PAM sequence: TTG
agctgccaatgagacattta

SEQ ID NO: 227426 - DNA, 20 bp, Artificial Sequence
  Description of Artificial Sequence: Synthetic oligonucleotide
  Target: ATXN1; (-) strand; PAM type: YTN; PAM sequence: TTT
gagctgccaatgagacattt

SEQ ID NO: 227427 - DNA, 20 bp, Artificial Sequence
  Description of Artificial Sequence: Synthetic oligonucleotide
  Target: ATXN1; (-) strand; PAM type: YTN; PAM sequence: TTG
aatttgagctgccaatgaga

SEQ ID NO: 227428 - DNA, 20 bp, Artificial Sequence
  Description of Artificial Sequence: Synthetic oligonucleotide
  Target: ATXN1; (-) strand; PAM type: YTN; PAM sequence: TTT
gaatttgagctgccaatgag

SEQ ID NO: 227429 - DNA, 20 bp, Artificial Sequence
  Description of Artificial Sequence: Synthetic oligonucleotide
  Target: ATXN1; (-) strand; PAM type: YTN; PAM sequence: TTT
tgaatttgagctgccaatga

SEQ ID NO: 227430 - DNA, 20 bp, Artificial Sequence
  Description of Artificial Sequence: Synthetic oligonucleotide
  Target: ATXN1; (-) strand; PAM type: YTN; PAM sequence: CTT
ttgaatttgagctgccaatg

SEQ ID NO: 227431 - DNA, 20 bp, Artificial Sequence
  Description of Artificial Sequence: Synthetic oligonucleotide
  Target: ATXN1; (-) strand; PAM type: YTN; PAM sequence: TTC
atcttttgaatttgagctgc

SEQ ID NO: 227432 - DNA, 20 bp, Artificial Sequence
  Description of Artificial Sequence: Synthetic oligonucleotide
  Target: ATXN1; (-) strand; PAM type: YTN; PAM sequence: CTT
catcttttgaatttgagctg

SEQ ID NO: 227433 - DNA, 20 bp, Artificial Sequence
  Description of Artificial Sequence: Synthetic oligonucleotide
  Target: ATXN1; (-) strand; PAM type: YTN; PAM sequence: TTC
ttcatcttttgaatttgagc

SEQ ID NO: 227434 - DNA, 20 bp, Artificial Sequence
  Description of Artificial Sequence: Synthetic oligonucleotide
  Target: ATXN1; (-) strand; PAM type: YTN; PAM sequence: TTT
cttcatcttttgaatttgag

SEQ ID NO: 227435 - DNA, 20 bp, Artificial Sequence
  Description of Artificial Sequence: Synthetic oligonucleotide
  Target: ATXN1; (-) strand; PAM type: YTN; PAM sequence: TTC
atttcttcatcttttgaatt

SEQ ID NO: 227436 - DNA, 20 bp, Artificial Sequence
  Description of Artificial Sequence: Synthetic oligonucleotide
  Target: ATXN1; (-) strand; PAM type: YTN; PAM sequence: TTT
catttcttcatcttttgaat

SEQ ID NO: 227437 - DNA, 20 bp, Artificial Sequence
  Description of Artificial Sequence: Synthetic oligonucleotide
  Target: ATXN1; (-) strand; PAM type: YTN; PAM sequence: TTA
tttcatttcttcatcttttg

SEQ ID NO: 227438 - DNA, 20 bp, Artificial Sequence
  Description of Artificial Sequence: Synthetic oligonucleotide
  Target: ATXN1; (-) strand; PAM type: YTN; PAM sequence: TTA
gaaatgtaattatttcattt

SEQ ID NO: 227439 - DNA, 20 bp, Artificial Sequence
  Description of Artificial Sequence: Synthetic oligonucleotide
  Target: ATXN1; (-) strand; PAM type: YTN; PAM sequence: TTG
gtggcagggtggttagaaat

SEQ ID NO: 227440 - DNA, 20 bp, Artificial Sequence
  Description of Artificial Sequence: Synthetic oligonucleotide
  Target: ATXN1; (-) strand; PAM type: YTN; PAM sequence: CTT
ggtggcagggtggttagaaa

SEQ ID NO: 227441 - DNA, 20 bp, Artificial Sequence
  Description of Artificial Sequence: Synthetic oligonucleotide
  Target: ATXN1; (-) strand; PAM type: YTN; PAM sequence: TTC
ttggtggcagggtggttaga

SEQ ID NO: 227442 - DNA, 20 bp, Artificial Sequence
  Description of Artificial Sequence: Synthetic oligonucleotide
  Target: ATXN1; (-) strand; PAM type: YTN; PAM sequence: TTT
cttggtggcagggtggttag

SEQ ID NO: 227443 - DNA, 20 bp, Artificial Sequence
  Description of Artificial Sequence: Synthetic oligonucleotide
  Target: ATXN1; (-) strand; PAM type: YTN; PAM sequence: TTT
tcttggtggcagggtggtta

SEQ ID NO: 227444 - DNA, 20 bp, Artificial Sequence
  Description of Artificial Sequence: Synthetic oligonucleotide
  Target: ATXN1; (-) strand; PAM type: YTN; PAM sequence: TTT
ttcttggtggcagggtggtt

SEQ ID NO: 227445 - DNA, 20 bp, Artificial Sequence
  Description of Artificial Sequence: Synthetic oligonucleotide
  Target: ATXN1; (-) strand; PAM type: YTN; PAM sequence: CTT
tttcttggtggcagggtggt

SEQ ID NO: 227446 - DNA, 20 bp, Artificial Sequence
  Description of Artificial Sequence: Synthetic oligonucleotide
  Target: ATXN1; (-) strand; PAM type: YTN; PAM sequence: TTC
tttttcttggtggcagggtg

SEQ ID NO: 227447 - DNA, 20 bp, Artificial Sequence
  Description of Artificial Sequence: Synthetic oligonucleotide
  Target: ATXN1; (-) strand; PAM type: YTN; PAM sequence: CTT
ctttttcttggtggcagggt

SEQ ID NO: 227448 - DNA, 20 bp, Artificial Sequence
  Description of Artificial Sequence: Synthetic oligonucleotide
  Target: ATXN1; (-) strand; PAM type: YTN; PAM sequence: CTG
aggaggaacaacttcttttt

SEQ ID NO: 227449 - DNA, 20 bp, Artificial Sequence
  Description of Artificial Sequence: Synthetic oligonucleotide
  Target: ATXN1; (-) strand; PAM type: YTN; PAM sequence: TTC
ctgaggaggaacaacttctt

SEQ ID NO: 227450 - DNA, 20 bp, Artificial Sequence
  Description of Artificial Sequence: Synthetic oligonucleotide
  Target: ATXN1; (-) strand; PAM type: YTN; PAM sequence: CTA
cagattcctgaggaggaaca

SEQ ID NO: 227451 - DNA, 20 bp, Artificial Sequence
  Description of Artificial Sequence: Synthetic oligonucleotide
  Target: ATXN1; (-) strand; PAM type: YTN; PAM sequence: CTG
tatgaatggggaggaggagc

SEQ ID NO: 227452 - DNA, 20 bp, Artificial Sequence
  Description of Artificial Sequence: Synthetic oligonucleotide
  Target: ATXN1; (-) strand; PAM type: YTN; PAM sequence: CTG
actgtatgaatggggaggag

SEQ ID NO: 227453 - DNA, 20 bp, Artificial Sequence
  Description of Artificial Sequence: Synthetic oligonucleotide
  Target: ATXN1; (-) strand; PAM type: YTN; PAM sequence: CTC
aagtgctgactgtatgaatg

SEQ ID NO: 227454 - DNA, 20 bp, Artificial Sequence
  Description of Artificial Sequence: Synthetic oligonucleotide
  Target: ATXN1; (-) strand; PAM type: YTN; PAM sequence: CTG
tctcaagtgctgactgtatg

SEQ ID NO: 227455 - DNA, 20 bp, Artificial Sequence
  Description of Artificial Sequence: Synthetic oligonucleotide
  Target: ATXN1; (-) strand; PAM type: YTN; PAM sequence: TTC
tgtctcaagtgctgactgta

SEQ ID NO: 227456 - DNA, 20 bp, Artificial Sequence
  Description of Artificial Sequence: Synthetic oligonucleotide
  Target: ATXN1; (-) strand; PAM type: YTN; PAM sequence: TTT
ctgtctcaagtgctgactgt

SEQ ID NO: 227457 - DNA, 20 bp, Artificial Sequence
  Description of Artificial Sequence: Synthetic oligonucleotide
  Target: ATXN1; (-) strand; PAM type: YTN; PAM sequence: TTC
cacatttctgtctcaagtgc

SEQ ID NO: 227458 - DNA, 20 bp, Artificial Sequence
  Description of Artificial Sequence: Synthetic oligonucleotide
  Target: ATXN1; (-) strand; PAM type: YTN; PAM sequence: CTT
ccacatttctgtctcaagtg

SEQ ID NO: 227459 - DNA, 20 bp, Artificial Sequence
  Description of Artificial Sequence: Synthetic oligonucleotide
  Target: ATXN1; (-) strand; PAM type: YTN; PAM sequence: CTA
gcttccacatttctgtctca

SEQ ID NO: 227460 - DNA, 20 bp, Artificial Sequence
  Description of Artificial Sequence: Synthetic oligonucleotide
  Target: ATXN1; (-) strand; PAM type: YTN; PAM sequence: TTA
aaaaaaatagatgctagctt

SEQ ID NO: 227461 - DNA, 20 bp, Artificial Sequence
  Description of Artificial Sequence: Synthetic oligonucleotide
  Target: ATXN1; (-) strand; PAM type: YTN; PAM sequence: CTA
gtatagaaatagtaattaaa

SEQ ID NO: 227462 - DNA, 20 bp, Artificial Sequence
  Description of Artificial Sequence: Synthetic oligonucleotide
  Target: ATXN1; (-) strand; PAM type: YTN; PAM sequence: TTA
aatgaaataagacatgtaaa

SEQ ID NO: 227463 - DNA, 20 bp, Artificial Sequence
  Description of Artificial Sequence: Synthetic oligonucleotide
  Target: ATXN1; (-) strand; PAM type: YTN; PAM sequence: TTT
aaatgaaataagacatgtaa

SEQ ID NO: 227464 - DNA, 20 bp, Artificial Sequence
  Description of Artificial Sequence: Synthetic oligonucleotide
  Target: ATXN1; (-) strand; PAM type: YTN; PAM sequence: TTT
taaatgaaataagacatgta

SEQ ID NO: 227465 - DNA, 20 bp, Artificial Sequence
  Description of Artificial Sequence: Synthetic oligonucleotide
  Target: ATXN1; (-) strand; PAM type: YTN; PAM sequence: CTG
ccattttaaatgaaataaga

SEQ ID NO: 227466 - DNA, 20 bp, Artificial Sequence
  Description of Artificial Sequence: Synthetic oligonucleotide
  Target: ATXN1; (-) strand; PAM type: YTN; PAM sequence: TTC
tgccattttaaatgaaataa

SEQ ID NO: 227467 - DNA, 20 bp, Artificial Sequence
  Description of Artificial Sequence: Synthetic oligonucleotide
  Target: ATXN1; (-) strand; PAM type: YTN; PAM sequence: TTG
gttctgccattttaaatgaa

SEQ ID NO: 227468 - DNA, 20 bp, Artificial Sequence
  Description of Artificial Sequence: Synthetic oligonucleotide
  Target: ATXN1; (-) strand; PAM type: YTN; PAM sequence: TTT
ggttctgccattttaaatga

SEQ ID NO: 227469 - DNA, 20 bp, Artificial Sequence
  Description of Artificial Sequence: Synthetic oligonucleotide
  Target: ATXN1; (-) strand; PAM type: YTN; PAM sequence: TTA
ccaaggtttggttctgccat

SEQ ID NO: 227470 - DNA, 20 bp, Artificial Sequence
  Description of Artificial Sequence: Synthetic oligonucleotide
  Target: ATXN1; (-) strand; PAM type: YTN; PAM sequence: CTT
accaaggtttggttctgcca

SEQ ID NO: 227471 - DNA, 20 bp, Artificial Sequence
  Description of Artificial Sequence: Synthetic oligonucleotide
  Target: ATXN1; (-) strand; PAM type: YTN; PAM sequence: TTC
ttaccaaggtttggttctgc

SEQ ID NO: 227472 - DNA, 20 bp, Artificial Sequence
  Description of Artificial Sequence: Synthetic oligonucleotide
  Target: ATXN1; (-) strand; PAM type: YTN; PAM sequence: CTT
cttaccaaggtttggttctg

SEQ ID NO: 227473 - DNA, 20 bp, Artificial Sequence
  Description of Artificial Sequence: Synthetic oligonucleotide
  Target: ATXN1; (-) strand; PAM type: YTN; PAM sequence: TTG
catgacttcttaccaaggtt

SEQ ID NO: 227474 - DNA, 20 bp, Artificial Sequence
  Description of Artificial Sequence: Synthetic oligonucleotide
  Target: ATXN1; (-) strand; PAM type: YTN; PAM sequence: TTT
gcatgacttcttaccaaggt

SEQ ID NO: 227475 - DNA, 20 bp, Artificial Sequence
  Description of Artificial Sequence: Synthetic oligonucleotide
  Target: ATXN1; (-) strand; PAM type: YTN; PAM sequence: TTC
catttgcatgacttcttacc

SEQ ID NO: 227476 - DNA, 20 bp, Artificial Sequence
  Description of Artificial Sequence: Synthetic oligonucleotide
  Target: ATXN1; (-) strand; PAM type: YTN; PAM sequence: CTC
ccaaattccatttgcatgac

SEQ ID NO: 227477 - DNA, 20 bp, Artificial Sequence
  Description of Artificial Sequence: Synthetic oligonucleotide
  Target: ATXN1; (-) strand; PAM type: YTN; PAM sequence: TTC
cctcccaaattccatttgca

SEQ ID NO: 227478 - DNA, 20 bp, Artificial Sequence
  Description of Artificial Sequence: Synthetic oligonucleotide
  Target: ATXN1; (-) strand; PAM type: YTN; PAM sequence: CTT
ccctcccaaattccatttgc

SEQ ID NO: 227479 - DNA, 20 bp, Artificial Sequence
  Description of Artificial Sequence: Synthetic oligonucleotide
  Target: ATXN1; (-) strand; PAM type: YTN; PAM sequence: CTC
ttccctcccaaattccattt

SEQ ID NO: 227480 - DNA, 20 bp, Artificial Sequence
  Description of Artificial Sequence: Synthetic oligonucleotide
  Target: ATXN1; (-) strand; PAM type: YTN; PAM sequence: TTC
tcttccctcccaaattccat

SEQ ID NO: 227481 - DNA, 20 bp, Artificial Sequence
  Description of Artificial Sequence: Synthetic oligonucleotide
  Target: ATXN1; (-) strand; PAM type: YTN; PAM sequence: CTA
ttctcttccctcccaaattc

SEQ ID NO: 227482 - DNA, 20 bp, Artificial Sequence
  Description of Artificial Sequence: Synthetic oligonucleotide
  Target: ATXN1; (-) strand; PAM type: YTN; PAM sequence: CTA
ccctattctcttccctccca

SEQ ID NO: 227483 - DNA, 20 bp, Artificial Sequence
  Description of Artificial Sequence: Synthetic oligonucleotide
  Target: ATXN1; (-) strand; PAM type: YTN; PAM sequence: TTC
ctaccctattctcttccctc

SEQ ID NO: 227484 - DNA, 20 bp, Artificial Sequence
  Description of Artificial Sequence: Synthetic oligonucleotide
  Target: ATXN1; (-) strand; PAM type: YTN; PAM sequence: TTT
cctaccctattctcttccct

SEQ ID NO: 227485 - DNA, 20 bp, Artificial Sequence
  Description of Artificial Sequence: Synthetic oligonucleotide
  Target: ATXN1; (-) strand; PAM type: YTN; PAM sequence: TTT
tcctaccctattctcttccc

SEQ ID NO: 227486 - DNA, 20 bp, Artificial Sequence
  Description of Artificial Sequence: Synthetic oligonucleotide
  Target: ATXN1; (-) strand; PAM type: YTN; PAM sequence: TTT
ttcctaccctattctcttcc

SEQ ID NO: 227487 - DNA, 20 bp, Artificial Sequence
  Description of Artificial Sequence: Synthetic oligonucleotide
  Target: ATXN1; (-) strand; PAM type: YTN; PAM sequence: TTT
tttcctaccctattctcttc

SEQ ID NO: 227488 - DNA, 20 bp, Artificial Sequence
  Description of Artificial Sequence: Synthetic oligonucleotide
  Target: ATXN1; (-) strand; PAM type: YTN; PAM sequence: TTA
ttttttcctaccctattctc

SEQ ID NO: 227489 - DNA, 20 bp, Artificial Sequence
  Description of Artificial Sequence: Synthetic oligonucleotide
  Target: ATXN1; (-) strand; PAM type: YTN; PAM sequence: TTT
attttttcctaccctattct

SEQ ID NO: 227490 - DNA, 20 bp, Artificial Sequence
  Description of Artificial Sequence: Synthetic oligonucleotide
  Target: ATXN1; (-) strand; PAM type: YTN; PAM sequence: TTT
tattttttcctaccctattc

SEQ ID NO: 227491 - DNA, 20 bp, Artificial Sequence
  Description of Artificial Sequence: Synthetic oligonucleotide
  Target: ATXN1; (-) strand; PAM type: YTN; PAM sequence: CTT
ttattttttcctaccctatt

SEQ ID NO: 227492 - DNA, 20 bp, Artificial Sequence
  Description of Artificial Sequence: Synthetic oligonucleotide
  Target: ATXN1; (-) strand; PAM type: YTN; PAM sequence: TTC
ttttattttttcctacccta

SEQ ID NO: 227493 - DNA, 20 bp, Artificial Sequence
  Description of Artificial Sequence: Synthetic oligonucleotide
  Target: ATXN1; (-) strand; PAM type: YTN; PAM sequence: TTT
cttttattttttcctaccct

SEQ ID NO: 227494 - DNA, 20 bp, Artificial Sequence
  Description of Artificial Sequence: Synthetic oligonucleotide
  Target: ATXN1; (-) strand; PAM type: YTN; PAM sequence: TTG
atggtgccaagtatgagtgg

SEQ ID NO: 227495 - DNA, 20 bp, Artificial Sequence
  Description of Artificial Sequence: Synthetic oligonucleotide
  Target: ATXN1; (-) strand; PAM type: YTN; PAM sequence: TTG
agaaaaagagaagttgatgg

SEQ ID NO: 227496 - DNA, 20 bp, Artificial Sequence
  Description of Artificial Sequence: Synthetic oligonucleotide
  Target: ATXN1; (-) strand; PAM type: YTN; PAM sequence: TTT
gagaaaaagagaagttgatg

SEQ ID NO: 227497 - DNA, 20 bp, Artificial Sequence
  Description of Artificial Sequence: Synthetic oligonucleotide
  Target: ATXN1; (-) strand; PAM type: YTN; PAM sequence: TTG
aggagtttgagaaaaagaga

SEQ ID NO: 227498 - DNA, 20 bp, Artificial Sequence
  Description of Artificial Sequence: Synthetic oligonucleotide
  Target: ATXN1; (-) strand; PAM type: YTN; PAM sequence: TTT
gaggagtttgagaaaaagag

SEQ ID NO: 227499 - DNA, 20 bp, Artificial Sequence
  Description of Artificial Sequence: Synthetic oligonucleotide
  Target: ATXN1; (-) strand; PAM type: YTN; PAM sequence: TTG
tatttgaggagtttgagaaa

SEQ ID NO: 227500 - DNA, 20 bp, Artificial Sequence
  Description of Artificial Sequence: Synthetic oligonucleotide
  Target: ATXN1; (-) strand; PAM type: YTN; PAM sequence: TTG
gtgttgtatttgaggagttt

SEQ ID NO: 227501 - DNA, 20 bp, Artificial Sequence
  Description of Artificial Sequence: Synthetic oligonucleotide
  Target: ATXN1; (-) strand; PAM type: YTN; PAM sequence: TTT
ggtgttgtatttgaggagtt

SEQ ID NO: 227502 - DNA, 20 bp, Artificial Sequence
  Description of Artificial Sequence: Synthetic oligonucleotide
  Target: ATXN1; (-) strand; PAM type: YTN; PAM sequence: CTG
gtggaacaaccgggaggatt

SEQ ID NO: 227503 - DNA, 20 bp, Artificial Sequence
  Description of Artificial Sequence: Synthetic oligonucleotide
  Target: ATXN1; (-) strand; PAM type: YTN; PAM sequence: TTA
gagtagtggcagtagagtgg

SEQ ID NO: 227504 - DNA, 20 bp, Artificial Sequence
  Description of Artificial Sequence: Synthetic oligonucleotide
  Target: ATXN1; (-) strand; PAM type: YTN; PAM sequence: TTA
ggagggtccaggttagagta

SEQ ID NO: 227505 - DNA, 20 bp, Artificial Sequence
  Description of Artificial Sequence: Synthetic oligonucleotide
  Target: ATXN1; (-) strand; PAM type: YTN; PAM sequence: TTT
aggagggtccaggttagagt

SEQ ID NO: 227506 - DNA, 20 bp, Artificial Sequence
  Description of Artificial Sequence: Synthetic oligonucleotide
  Target: ATXN1; (-) strand; PAM type: YTN; PAM sequence: CTT
taggagggtccaggttagag

SEQ ID NO: 227507 - DNA, 20 bp, Artificial Sequence
  Description of Artificial Sequence: Synthetic oligonucleotide
  Target: ATXN1; (-) strand; PAM type: YTN; PAM sequence: TTG
aagaagtccaggagacttta

SEQ ID NO: 227508 - DNA, 20 bp, Artificial Sequence
  Description of Artificial Sequence: Synthetic oligonucleotide
  Target: ATXN1; (-) strand; PAM type: YTN; PAM sequence: CTT
gaagaagtccaggagacttt

SEQ ID NO: 227509 - DNA, 20 bp, Artificial Sequence
  Description of Artificial Sequence: Synthetic oligonucleotide
  Target: ATXN1; (-) strand; PAM type: YTN; PAM sequence: CTC
ttgaagaagtccaggagact

SEQ ID NO: 227510 - DNA, 20 bp, Artificial Sequence
  Description of Artificial Sequence: Synthetic oligonucleotide
  Target: ATXN1; (-) strand; PAM type: YTN; PAM sequence: CTA
ggtactcttgaagaagtcca

SEQ ID NO: 227511 - DNA, 20 bp, Artificial Sequence
  Description of Artificial Sequence: Synthetic oligonucleotide
  Target: ATXN1; (-) strand; PAM type: YTN; PAM sequence: TTG
agacagagagaccatctagg

SEQ ID NO: 227512 - DNA, 20 bp, Artificial Sequence
  Description of Artificial Sequence: Synthetic oligonucleotide
  Target: ATXN1; (-) strand; PAM type: YTN; PAM sequence: TTA
ttgagacagagagaccatct

SEQ ID NO: 227513 - DNA, 20 bp, Artificial Sequence
  Description of Artificial Sequence: Synthetic oligonucleotide
  Target: ATXN1; (-) strand; PAM type: YTN; PAM sequence: TTG
gggtgttattgagacagaga

SEQ ID NO: 227514 - DNA, 20 bp, Artificial Sequence
  Description of Artificial Sequence: Synthetic oligonucleotide
  Target: ATXN1; (-) strand; PAM type: YTN; PAM sequence: TTC
attggggtgttattgagaca

SEQ ID NO: 227515 - DNA, 20 bp, Artificial Sequence
  Description of Artificial Sequence: Synthetic oligonucleotide
  Target: ATXN1; (-) strand; PAM type: YTN; PAM sequence: CTG
ggcagagtagaagatagaat

SEQ ID NO: 227516 - DNA, 20 bp, Artificial Sequence
  Description of Artificial Sequence: Synthetic oligonucleotide
  Target: ATXN1; (-) strand; PAM type: YTN; PAM sequence: CTC
tgggcagagtagaagataga

SEQ ID NO: 227517 - DNA, 20 bp, Artificial Sequence
  Description of Artificial Sequence: Synthetic oligonucleotide
  Target: ATXN1; (-) strand; PAM type: YTN; PAM sequence: TTC
tctgggcagagtagaagata

SEQ ID NO: 227518 - DNA, 20 bp, Artificial Sequence
  Description of Artificial Sequence: Synthetic oligonucleotide
  Target: ATXN1; (-) strand; PAM type: YTN; PAM sequence: TTC
attctctgggcagagtagaa

SEQ ID NO: 227519 - DNA, 20 bp, Artificial Sequence
  Description of Artificial Sequence: Synthetic oligonucleotide
  Target: ATXN1; (-) strand; PAM type: YTN; PAM sequence: TTA
gaaagttcattctctgggca

SEQ ID NO: 227520 - DNA, 20 bp, Artificial Sequence
  Description of Artificial Sequence: Synthetic oligonucleotide
  Target: ATXN1; (-) strand; PAM type: YTN; PAM sequence: TTT
agaaagttcattctctgggc

SEQ ID NO: 227521 - DNA, 20 bp, Artificial Sequence
  Description of Artificial Sequence: Synthetic oligonucleotide
  Target: ATXN1; (-) strand; PAM type: YTN; PAM sequence: TTT
tagaaagttcattctctggg

SEQ ID NO: 227522 - DNA, 20 bp, Artificial Sequence
  Description of Artificial Sequence: Synthetic oligonucleotide
  Target: ATXN1; (-) strand; PAM type: YTN; PAM sequence: CTT
ttagaaagttcattctctgg

SEQ ID NO: 227523 - DNA, 20 bp, Artificial Sequence
  Description of Artificial Sequence: Synthetic oligonucleotide
  Target: ATXN1; (-) strand; PAM type: YTN; PAM sequence: CTA
cttttagaaagttcattctc

SEQ ID NO: 227524 - DNA, 20 bp, Artificial Sequence
  Description of Artificial Sequence: Synthetic oligonucleotide
  Target: ATXN1; (-) strand; PAM type: YTN; PAM sequence: TTC
tacttttagaaagttcattc

SEQ ID NO: 227525 - DNA, 20 bp, Artificial Sequence
  Description of Artificial Sequence: Synthetic oligonucleotide
  Target: ATXN1; (-) strand; PAM type: YTN; PAM sequence: CTT
ctacttttagaaagttcatt

SEQ ID NO: 227526 - DNA, 20 bp, Artificial Sequence
  Description of Artificial Sequence: Synthetic oligonucleotide
  Target: ATXN1; (-) strand; PAM type: YTN; PAM sequence: TTG
gaaccggaaatgacttctac

SEQ ID NO: 227527 - DNA, 20 bp, Artificial Sequence
  Description of Artificial Sequence: Synthetic oligonucleotide
  Target: ATXN1; (-) strand; PAM type: YTN; PAM sequence: CTT
ggaaccggaaatgacttcta

SEQ ID NO: 227528 - DNA, 20 bp, Artificial Sequence
  Description of Artificial Sequence: Synthetic oligonucleotide
  Target: ATXN1; (-) strand; PAM type: YTN; PAM sequence: TTG
cttggaaccggaaatgactt

SEQ ID NO: 227529 - DNA, 20 bp, Artificial Sequence
  Description of Artificial Sequence: Synthetic oligonucleotide
  Target: ATXN1; (-) strand; PAM type: YTN; PAM sequence: CTT
gcttggaaccggaaatgact

SEQ ID NO: 227530 - DNA, 20 bp, Artificial Sequence
  Description of Artificial Sequence: Synthetic oligonucleotide
  Target: ATXN1; (-) strand; PAM type: YTN; PAM sequence: TTC
cccaccttgcttggaaccgg

SEQ ID NO: 227531 - DNA, 20 bp, Artificial Sequence
  Description of Artificial Sequence: Synthetic oligonucleotide
  Target: ATXN1; (-) strand; PAM type: YTN; PAM sequence: CTT
ccccaccttgcttggaaccg

SEQ ID NO: 227532 - DNA, 20 bp, Artificial Sequence
  Description of Artificial Sequence: Synthetic oligonucleotide
  Target: ATXN1; (-) strand; PAM type: YTN; PAM sequence: CTG
tgcaacttccccaccttgct

SEQ ID NO: 227533 - DNA, 20 bp, Artificial Sequence
  Description of Artificial Sequence: Synthetic oligonucleotide
  Target: ATXN1; (-) strand; PAM type: YTN; PAM sequence: CTA
gcctgtgcaacttccccacc

SEQ ID NO: 227534 - DNA, 20 bp, Artificial Sequence
  Description of Artificial Sequence: Synthetic oligonucleotide
  Target: ATXN1; (-) strand; PAM type: YTN; PAM sequence: CTC
tagcctgtgcaacttcccca

SEQ ID NO: 227535 - DNA, 20 bp, Artificial Sequence
  Description of Artificial Sequence: Synthetic oligonucleotide
  Target: ATXN1; (-) strand; PAM type: YTN; PAM sequence: CTG
catcaacctctagcctgtgc

SEQ ID NO: 227536 - DNA, 20 bp, Artificial Sequence
  Description of Artificial Sequence: Synthetic oligonucleotide
  Target: ATXN1; (-) strand; PAM type: YTN; PAM sequence: CTC
agctgcatcaacctctagcc

SEQ ID NO: 227537 - DNA, 20 bp, Artificial Sequence
  Description of Artificial Sequence: Synthetic oligonucleotide
  Target: ATXN1; (-) strand; PAM type: YTN; PAM sequence: CTC
tcagctgcatcaacctctag

SEQ ID NO: 227538 - DNA, 20 bp, Artificial Sequence
  Description of Artificial Sequence: Synthetic oligonucleotide
  Target: ATXN1; (-) strand; PAM type: YTN; PAM sequence: TTC
cccatcacatggaaaataac

SEQ ID NO: 227539 - DNA, 20 bp, Artificial Sequence
  Description of Artificial Sequence: Synthetic oligonucleotide
  Target: ATXN1; (-) strand; PAM type: YTN; PAM sequence: CTG
caagaattccccatcacatg

SEQ ID NO: 227540 - DNA, 20 bp, Artificial Sequence
  Description of Artificial Sequence: Synthetic oligonucleotide
  Target: ATXN1; (-) strand; PAM type: YTN; PAM sequence: TTC
ctgcaagaattccccatcac

SEQ ID NO: 227541 - DNA, 20 bp, Artificial Sequence
  Description of Artificial Sequence: Synthetic oligonucleotide
  Target: ATXN1; (-) strand; PAM type: YTN; PAM sequence: TTT
cctgcaagaattccccatca

SEQ ID NO: 227542 - DNA, 20 bp, Artificial Sequence
  Description of Artificial Sequence: Synthetic oligonucleotide
  Target: ATXN1; (-) strand; PAM type: YTN; PAM sequence: CTT
tcctgcaagaattccccatc

SEQ ID NO: 227543 - DNA, 20 bp, Artificial Sequence
  Description of Artificial Sequence: Synthetic oligonucleotide
  Target: ATXN1; (-) strand; PAM type: YTN; PAM sequence: TTC
tttcctgcaagaattcccca

SEQ ID NO: 227544 - DNA, 20 bp, Artificial Sequence
  Description of Artificial Sequence: Synthetic oligonucleotide
  Target: ATXN1; (-) strand; PAM type: YTN; PAM sequence: CTT
ctttcctgcaagaattcccc

SEQ ID NO: 227545 - DNA, 20 bp, Artificial Sequence
  Description of Artificial Sequence: Synthetic oligonucleotide
  Target: ATXN1; (-) strand; PAM type: YTN; PAM sequence: TTA
accaccttctttcctgcaag

SEQ ID NO: 227546 - DNA, 20 bp, Artificial Sequence
  Description of Artificial Sequence: Synthetic oligonucleotide
  Target: ATXN1; (-) strand; PAM type: YTN; PAM sequence: CTT
aaccaccttctttcctgcaa

SEQ ID NO: 227547 - DNA, 20 bp, Artificial Sequence
  Description of Artificial Sequence: Synthetic oligonucleotide
  Target: ATXN1; (-) strand; PAM type: YTN; PAM sequence: CTG
agacttaaccaccttctttc

SEQ ID NO: 227548 - DNA, 20 bp, Artificial Sequence
  Description of Artificial Sequence: Synthetic oligonucleotide
  Target: ATXN1; (-) strand; PAM type: YTN; PAM sequence: CTA
ctgagacttaaccaccttct

SEQ ID NO: 227549 - DNA, 20 bp, Artificial Sequence
  Description of Artificial Sequence: Synthetic oligonucleotide
  Target: ATXN1; (-) strand; PAM type: YTN; PAM sequence: CTC
tactgagacttaaccacctt

SEQ ID NO: 227550 - DNA, 20 bp, Artificial Sequence
  Description of Artificial Sequence: Synthetic oligonucleotide
  Target: ATXN1; (-) strand; PAM type: YTN; PAM sequence: TTC
cctctactgagacttaacca

SEQ ID NO: 227551 - DNA, 20 bp, Artificial Sequence
  Description of Artificial Sequence: Synthetic oligonucleotide
  Target: ATXN1; (-) strand; PAM type: YTN; PAM sequence: TTC
cccagtgttccctctactga

SEQ ID NO: 227552 - DNA, 20 bp, Artificial Sequence
  Description of Artificial Sequence: Synthetic oligonucleotide
  Target: ATXN1; (-) strand; PAM type: YTN; PAM sequence: TTT
ccccagtgttccctctactg

SEQ ID NO: 227553 - DNA, 20 bp, Artificial Sequence
  Description of Artificial Sequence: Synthetic oligonucleotide
  Target: ATXN1; (-) strand; PAM type: YTN; PAM sequence: TTT
tccccagtgttccctctact

SEQ ID NO: 227554 - DNA, 20 bp, Artificial Sequence
  Description of Artificial Sequence: Synthetic oligonucleotide
  Target: ATXN1; (-) strand; PAM type: YTN; PAM sequence: CTA
ttttccccagtgttccctct

SEQ ID NO: 227555 - DNA, 20 bp, Artificial Sequence
  Description of Artificial Sequence: Synthetic oligonucleotide
  Target: ATXN1; (-) strand; PAM type: YTN; PAM sequence: CTG
ctattttccccagtgttccc

SEQ ID NO: 227556 - DNA, 20 bp, Artificial Sequence
  Description of Artificial Sequence: Synthetic oligonucleotide
  Target: ATXN1; (-) strand; PAM type: YTN; PAM sequence: CTC
agtctgctattttccccagt

SEQ ID NO: 227557 - DNA, 20 bp, Artificial Sequence
  Description of Artificial Sequence: Synthetic oligonucleotide
  Target: ATXN1; (-) strand; PAM type: YTN; PAM sequence: CTC
tcagtctgctattttcccca

SEQ ID NO: 227558 - DNA, 20 bp, Artificial Sequence
  Description of Artificial Sequence: Synthetic oligonucleotide
  Target: ATXN1; (-) strand; PAM type: YTN; PAM sequence: CTC
tctcagtctgctattttccc

SEQ ID NO: 227559 - DNA, 20 bp, Artificial Sequence
  Description of Artificial Sequence: Synthetic oligonucleotide
  Target: ATXN1; (-) strand; PAM type: YTN; PAM sequence: TTC
tctctcagtctgctattttc

SEQ ID NO: 227560 - DNA, 20 bp, Artificial Sequence
  Description of Artificial Sequence: Synthetic oligonucleotide
  Target: ATXN1; (-) strand; PAM type: YTN; PAM sequence: CTT
ctctctcagtctgctatttt

SEQ ID NO: 227561 - DNA, 20 bp, Artificial Sequence
  Description of Artificial Sequence: Synthetic oligonucleotide
  Target: ATXN1; (-) strand; PAM type: YTN; PAM sequence: CTC
ttctctctcagtctgctatt

SEQ ID NO: 227562 - DNA, 20 bp, Artificial Sequence
  Description of Artificial Sequence: Synthetic oligonucleotide
  Target: ATXN1; (-) strand; PAM type: YTN; PAM sequence: TTG
gacctcttctctctcagtct

SEQ ID NO: 227563 - DNA, 20 bp, Artificial Sequence
  Description of Artificial Sequence: Synthetic oligonucleotide
  Target: ATXN1; (-) strand; PAM type: YTN; PAM sequence: CTC
ataaccattggacctcttct

SEQ ID NO: 227564 - DNA, 20 bp, Artificial Sequence
  Description of Artificial Sequence: Synthetic oligonucleotide
  Target: ATXN1; (-) strand; PAM type: YTN; PAM sequence: CTC
ccccactcataaccattgga

SEQ ID NO: 227565 - DNA, 20 bp, Artificial Sequence
  Description of Artificial Sequence: Synthetic oligonucleotide
  Target: ATXN1; (-) strand; PAM type: YTN; PAM sequence: TTC
cccaaatgactcccccactc

SEQ ID NO: 227566 - DNA, 20 bp, Artificial Sequence
  Description of Artificial Sequence: Synthetic oligonucleotide
  Target: ATXN1; (-) strand; PAM type: YTN; PAM sequence: TTA
agttccccaaatgactcccc

SEQ ID NO: 227567 - DNA, 20 bp, Artificial Sequence
  Description of Artificial Sequence: Synthetic oligonucleotide
  Target: ATXN1; (-) strand; PAM type: YTN; PAM sequence: TTT
aagttccccaaatgactccc

SEQ ID NO: 227568 - DNA, 20 bp, Artificial Sequence
  Description of Artificial Sequence: Synthetic oligonucleotide
  Target: ATXN1; (-) strand; PAM type: YTN; PAM sequence: TTT
taagttccccaaatgactcc

SEQ ID NO: 227569 - DNA, 20 bp, Artificial Sequence
  Description of Artificial Sequence: Synthetic oligonucleotide
  Target: ATXN1; (-) strand; PAM type: YTN; PAM sequence: TTT
ttaagttccccaaatgactc

SEQ ID NO: 227570 - DNA, 20 bp, Artificial Sequence
  Description of Artificial Sequence: Synthetic oligonucleotide
  Target: ATXN1; (-) strand; PAM type: YTN; PAM sequence: TTA
tcagtaatttttaagttccc

SEQ ID NO: 227571 - DNA, 20 bp, Artificial Sequence
  Description of Artificial Sequence: Synthetic oligonucleotide
  Target: ATXN1; (-) strand; PAM type: YTN; PAM sequence: CTA
aaaattatcagtaattttta

SEQ ID NO: 227572 - DNA, 20 bp, Artificial Sequence
  Description of Artificial Sequence: Synthetic oligonucleotide
  Target: ATXN1; (-) strand; PAM type: YTN; PAM sequence: TTA
tgtctaaaaattatcagtaa

SEQ ID NO: 227573 - DNA, 20 bp, Artificial Sequence
  Description of Artificial Sequence: Synthetic oligonucleotide
  Target: ATXN1; (-) strand; PAM type: YTN; PAM sequence: TTT
atgtctaaaaattatcagta

SEQ ID NO: 227574 - DNA, 20 bp, Artificial Sequence
  Description of Artificial Sequence: Synthetic oligonucleotide
  Target: ATXN1; (-) strand; PAM type: YTN; PAM sequence: CTT
tatgtctaaaaattatcagt

SEQ ID NO: 227575 - DNA, 20 bp, Artificial Sequence
  Description of Artificial Sequence: Synthetic oligonucleotide
  Target: ATXN1; (-) strand; PAM type: YTN; PAM sequence: TTC
ctttatgtctaaaaattatc

SEQ ID NO: 227576 - DNA, 20 bp, Artificial Sequence
  Description of Artificial Sequence: Synthetic oligonucleotide
  Target: ATXN1; (-) strand; PAM type: YTN; PAM sequence: TTT
cctttatgtctaaaaattat

SEQ ID NO: 227577 - DNA, 20 bp, Artificial Sequence
  Description of Artificial Sequence: Synthetic oligonucleotide
  Target: ATXN1; (-) strand; PAM type: YTN; PAM sequence: TTA
ggtataaacatagtttcctt

SEQ ID NO: 227578 - DNA, 20 bp, Artificial Sequence
  Description of Artificial Sequence: Synthetic oligonucleotide
  Target: ATXN1; (-) strand; PAM type: YTN; PAM sequence: CTT
aggtataaacatagtttcct

SEQ ID NO: 227579 - DNA, 20 bp, Artificial Sequence
  Description of Artificial Sequence: Synthetic oligonucleotide
  Target: ATXN1; (-) strand; PAM type: YTN; PAM sequence: TTA
aacataaacttaggtataaa

SEQ ID NO: 227580 - DNA, 20 bp, Artificial Sequence
  Description of Artificial Sequence: Synthetic oligonucleotide
  Target: ATXN1; (-) strand; PAM type: YTN; PAM sequence: TTT
aaacataaacttaggtataa

SEQ ID NO: 227581 - DNA, 20 bp, Artificial Sequence
  Description of Artificial Sequence: Synthetic oligonucleotide
  Target: ATXN1; (-) strand; PAM type: YTN; PAM sequence: TTA
tttaaacataaacttaggta

SEQ ID NO: 227582 - DNA, 20 bp, Artificial Sequence
  Description of Artificial Sequence: Synthetic oligonucleotide
  Target: ATXN1; (-) strand; PAM type: YTN; PAM sequence: TTT
atttaaacataaacttaggt

SEQ ID NO: 227583 - DNA, 20 bp, Artificial Sequence
  Description of Artificial Sequence: Synthetic oligonucleotide
  Target: ATXN1; (-) strand; PAM type: YTN; PAM sequence: CTT
tatttaaacataaacttagg

SEQ ID NO: 227584 - DNA, 20 bp, Artificial Sequence
  Description of Artificial Sequence: Synthetic oligonucleotide
  Target: ATXN1; (-) strand; PAM type: YTN; PAM sequence: TTA
tacctttatttaaacataaa

SEQ ID NO: 227585 - DNA, 20 bp, Artificial Sequence
  Description of Artificial Sequence: Synthetic oligonucleotide
  Target: ATXN1; (-) strand; PAM type: YTN; PAM sequence: TTT
atacctttatttaaacataa

SEQ ID NO: 227586 - DNA, 20 bp, Artificial Sequence
  Description of Artificial Sequence: Synthetic oligonucleotide
  Target: ATXN1; (-) strand; PAM type: YTN; PAM sequence: TTG
tagcatttatacctttattt

SEQ ID NO: 227587 - DNA, 20 bp, Artificial Sequence
  Description of Artificial Sequence: Synthetic oligonucleotide
  Target: ATXN1; (-) strand; PAM type: YTN; PAM sequence: CTT
gtagcatttatacctttatt

SEQ ID NO: 227588 - DNA, 20 bp, Artificial Sequence
  Description of Artificial Sequence: Synthetic oligonucleotide
  Target: ATXN1; (-) strand; PAM type: YTN; PAM sequence: TTC
ttgtagcatttataccttta

SEQ ID NO: 227589 - DNA, 20 bp, Artificial Sequence
  Description of Artificial Sequence: Synthetic oligonucleotide
  Target: ATXN1; (-) strand; PAM type: YTN; PAM sequence: TTA
ttcttgtagcatttatacct

SEQ ID NO: 227590 - DNA, 20 bp, Artificial Sequence
  Description of Artificial Sequence: Synthetic oligonucleotide
  Target: ATXN1; (-) strand; PAM type: YTN; PAM sequence: TTT
attcttgtagcatttatacc

SEQ ID NO: 227591 - DNA, 20 bp, Artificial Sequence
  Description of Artificial Sequence: Synthetic oligonucleotide
  Target: ATXN1; (-) strand; PAM type: YTN; PAM sequence: TTT
tattcttgtagcatttatac

SEQ ID NO: 227592 - DNA, 20 bp, Artificial Sequence
  Description of Artificial Sequence: Synthetic oligonucleotide
  Target: ATXN1; (-) strand; PAM type: YTN; PAM sequence: TTA
ttttattcttgtagcattta

SEQ ID NO: 227593 - DNA, 20 bp, Artificial Sequence
  Description of Artificial Sequence: Synthetic oligonucleotide
  Target: ATXN1; (-) strand; PAM type: YTN; PAM sequence: TTT
attttattcttgtagcattt

SEQ ID NO: 227594 - DNA, 20 bp, Artificial Sequence
  Description of Artificial Sequence: Synthetic oligonucleotide
  Target: ATXN1; (-) strand; PAM type: YTN; PAM sequence: TTT
tattttattcttgtagcatt

SEQ ID NO: 227595 - DNA, 20 bp, Artificial Sequence
  Description of Artificial Sequence: Synthetic oligonucleotide
  Target: ATXN1; (-) strand; PAM type: YTN; PAM sequence: TTC
ccgaacacattttattttat

SEQ ID NO: 227596 - DNA, 20 bp, Artificial Sequence
  Description of Artificial Sequence: Synthetic oligonucleotide
  Target: ATXN1; (-) strand; PAM type: YTN; PAM sequence: TTT
cccgaacacattttatttta

SEQ ID NO: 227597 - DNA, 20 bp, Artificial Sequence
  Description of Artificial Sequence: Synthetic oligonucleotide
  Target: ATXN1; (-) strand; PAM type: YTN; PAM sequence: TTT
tcccgaacacattttatttt

SEQ ID NO: 227598 - DNA, 20 bp, Artificial Sequence
  Description of Artificial Sequence: Synthetic oligonucleotide
  Target: ATXN1; (-) strand; PAM type: YTN; PAM sequence: TTT
ttcccgaacacattttattt

SEQ ID NO: 227599 - DNA, 20 bp, Artificial Sequence
  Description of Artificial Sequence: Synthetic oligonucleotide
  Target: ATXN1; (-) strand; PAM type: YTN; PAM sequence: TTT
tttcccgaacacattttatt

SEQ ID NO: 227600 - DNA, 20 bp, Artificial Sequence
  Description of Artificial Sequence: Synthetic oligonucleotide
  Target: ATXN1; (-) strand; PAM type: YTN; PAM sequence: TTT
ttttcccgaacacattttat

SEQ ID NO: 227601 - DNA, 20 bp, Artificial Sequence
  Description of Artificial Sequence: Synthetic oligonucleotide
  Target: ATXN1; (-) strand; PAM type: YTN; PAM sequence: TTT
tttttcccgaacacatttta

SEQ ID NO: 227602 - DNA, 20 bp, Artificial Sequence
  Description of Artificial Sequence: Synthetic oligonucleotide
  Target: ATXN1; (-) strand; PAM type: YTN; PAM sequence: TTG
gatagatcggattttttttc

SEQ ID NO: 227603 - DNA, 20 bp, Artificial Sequence
  Description of Artificial Sequence: Synthetic oligonucleotide
  Target: ATXN1; (-) strand; PAM type: YTN; PAM sequence: TTT
ggatagatcggatttttttt

SEQ ID NO: 227604 - DNA, 20 bp, Artificial Sequence
  Description of Artificial Sequence: Synthetic oligonucleotide
  Target: ATXN1; (-) strand; PAM type: YTN; PAM sequence: CTT
tggatagatcggattttttt

SEQ ID NO: 227605 - DNA, 20 bp, Artificial Sequence
  Description of Artificial Sequence: Synthetic oligonucleotide
  Target: ATXN1; (-) strand; PAM type: YTN; PAM sequence: TTC
ctttggatagatcggatttt

SEQ ID NO: 227606 - DNA, 20 bp, Artificial Sequence
  Description of Artificial Sequence: Synthetic oligonucleotide
  Target: ATXN1; (-) strand; PAM type: YTN; PAM sequence: CTT
cctttggatagatcggattt

SEQ ID NO: 227607 - DNA, 20 bp, Artificial Sequence
  Description of Artificial Sequence: Synthetic oligonucleotide
  Target: ATXN1; (-) strand; PAM type: YTN; PAM sequence: TTC
ttcctttggatagatcggat

SEQ ID NO: 227608 - DNA, 20 bp, Artificial Sequence
  Description of Artificial Sequence: Synthetic oligonucleotide
  Target: ATXN1; (-) strand; PAM type: YTN; PAM sequence: TTT
cttcctttggatagatcgga

SEQ ID NO: 227609 - DNA, 20 bp, Artificial Sequence
  Description of Artificial Sequence: Synthetic oligonucleotide
  Target: ATXN1; (-) strand; PAM type: YTN; PAM sequence: CTT
tcttcctttggatagatcgg

SEQ ID NO: 227610 - DNA, 20 bp, Artificial Sequence
  Description of Artificial Sequence: Synthetic oligonucleotide
  Target: ATXN1; (-) strand; PAM type: YTN; PAM sequence: TTG
ctttcttcctttggatagat

SEQ ID NO: 227611 - DNA, 20 bp, Artificial Sequence
  Description of Artificial Sequence: Synthetic oligonucleotide
  Target: ATXN1; (-) strand; PAM type: YTN; PAM sequence: TTT
gctttcttcctttggataga

SEQ ID NO: 227612 - DNA, 20 bp, Artificial Sequence
  Description of Artificial Sequence: Synthetic oligonucleotide
  Target: ATXN1; (-) strand; PAM type: YTN; PAM sequence: TTT
tgctttcttcctttggatag

SEQ ID NO: 227613 - DNA, 20 bp, Artificial Sequence
  Description of Artificial Sequence: Synthetic oligonucleotide
  Target: ATXN1; (-) strand; PAM type: YTN; PAM sequence: TTG
ttttgctttcttcctttgga

SEQ ID NO: 227614 - DNA, 20 bp, Artificial Sequence
  Description of Artificial Sequence: Synthetic oligonucleotide
  Target: ATXN1; (-) strand; PAM type: YTN; PAM sequence: TTT
gttttgctttcttcctttgg

SEQ ID NO: 227615 - DNA, 20 bp, Artificial Sequence
  Description of Artificial Sequence: Synthetic oligonucleotide
  Target: ATXN1; (-) strand; PAM type: YTN; PAM sequence: TTT
tgttttgctttcttcctttg

SEQ ID NO: 227616 - DNA, 20 bp, Artificial Sequence
  Description of Artificial Sequence: Synthetic oligonucleotide
  Target: ATXN1; (-) strand; PAM type: YTN; PAM sequence: TTG
ttttgttttgctttcttcct

SEQ ID NO: 227617 - DNA, 20 bp, Artificial Sequence
  Description of Artificial Sequence: Synthetic oligonucleotide
  Target: ATXN1; (-) strand; PAM type: YTN; PAM sequence: TTT
gttttgttttgctttcttcc

SEQ ID NO: 227618 - DNA, 20 bp, Artificial Sequence
  Description of Artificial Sequence: Synthetic oligonucleotide
  Target: ATXN1; (-) strand; PAM type: YTN; PAM sequence: TTT
tgttttgttttgctttcttc

SEQ ID NO: 227619 - DNA, 20 bp, Artificial Sequence
  Description of Artificial Sequence: Synthetic oligonucleotide
  Target: ATXN1; (-) strand; PAM type: YTN; PAM sequence: TTG
ttttgttttgttttgctttc

SEQ ID NO: 227620 - DNA, 20 bp, Artificial Sequence
  Description of Artificial Sequence: Synthetic oligonucleotide
  Target: ATXN1; (-) strand; PAM type: YTN; PAM sequence: TTT
gttttgttttgttttgcttt

SEQ ID NO: 227621 - DNA, 20 bp, Artificial Sequence
  Description of Artificial Sequence: Synthetic oligonucleotide
  Target: ATXN1; (-) strand; PAM type: YTN; PAM sequence: TTT
tgttttgttttgttttgctt

SEQ ID NO: 227622 - DNA, 20 bp, Artificial Sequence
  Description of Artificial Sequence: Synthetic oligonucleotide
  Target: ATXN1; (-) strand; PAM type: YTN; PAM sequence: TTT
ttgttttgttttgttttgct

SEQ ID NO: 227623 - DNA, 20 bp, Artificial Sequence
  Description of Artificial Sequence: Synthetic oligonucleotide
  Target: ATXN1; (-) strand; PAM type: YTN; PAM sequence: CTT
tttgttttgttttgttttgc

SEQ ID NO: 227624 - DNA, 20 bp, Artificial Sequence
  Description of Artificial Sequence: Synthetic oligonucleotide
  Target: ATXN1; (-) strand; PAM type: YTN; PAM sequence: TTA
ctttttgttttgttttgttt

SEQ ID NO: 227625 - DNA, 20 bp, Artificial Sequence
  Description of Artificial Sequence: Synthetic oligonucleotide
  Target: ATXN1; (-) strand; PAM type: YTN; PAM sequence: TTT
actttttgttttgttttgtt

SEQ ID NO: 227626 - DNA, 20 bp, Artificial Sequence
  Description of Artificial Sequence: Synthetic oligonucleotide
  Target: ATXN1; (-) strand; PAM type: YTN; PAM sequence: CTT
tactttttgttttgttttgt

SEQ ID NO: 227627 - DNA, 20 bp, Artificial Sequence
  Description of Artificial Sequence: Synthetic oligonucleotide
  Target: ATXN1; (-) strand; PAM type: YTN; PAM sequence: TTG
gctttactttttgttttgtt

SEQ ID NO: 227628 - DNA, 20 bp, Artificial Sequence
  Description of Artificial Sequence: Synthetic oligonucleotide
  Target: ATXN1; (-) strand; PAM type: YTN; PAM sequence: CTT
ggctttactttttgttttgt

SEQ ID NO: 227629 - DNA, 20 bp, Artificial Sequence
  Description of Artificial Sequence: Synthetic oligonucleotide
  Target: ATXN1; (-) strand; PAM type: YTN; PAM sequence: CTA
cttggctttactttttgttt

SEQ ID NO: 227630 - DNA, 20 bp, Artificial Sequence
  Description of Artificial Sequence: Synthetic oligonucleotide
  Target: ATXN1; (-) strand; PAM type: YTN; PAM sequence: TTC
tacttggctttactttttgt

SEQ ID NO: 227631 - DNA, 20 bp, Artificial Sequence
  Description of Artificial Sequence: Synthetic oligonucleotide
  Target: ATXN1; (-) strand; PAM type: YTN; PAM sequence: TTT
ctacttggctttactttttg

SEQ ID NO: 227632 - DNA, 20 bp, Artificial Sequence
  Description of Artificial Sequence: Synthetic oligonucleotide
  Target: ATXN1; (-) strand; PAM type: YTN; PAM sequence: TTT
tctacttggctttacttttt

SEQ ID NO: 227633 - DNA, 20 bp, Artificial Sequence
  Description of Artificial Sequence: Synthetic oligonucleotide
  Target: ATXN1; (-) strand; PAM type: YTN; PAM sequence: TTA
atgttttctacttggcttta

SEQ ID NO: 227634 - DNA, 20 bp, Artificial Sequence
  Description of Artificial Sequence: Synthetic oligonucleotide
  Target: ATXN1; (-) strand; PAM type: YTN; PAM sequence: TTT
aatgttttctacttggcttt

SEQ ID NO: 227635 - DNA, 20 bp, Artificial Sequence
  Description of Artificial Sequence: Synthetic oligonucleotide
  Target: ATXN1; (-) strand; PAM type: YTN; PAM sequence: TTC
atttaatgttttctacttgg

SEQ ID NO: 227636 - DNA, 20 bp, Artificial Sequence
  Description of Artificial Sequence: Synthetic oligonucleotide
  Target: ATXN1; (-) strand; PAM type: YTN; PAM sequence: CTT
catttaatgttttctacttg

SEQ ID NO: 227637 - DNA, 20 bp, Artificial Sequence
  Description of Artificial Sequence: Synthetic oligonucleotide
  Target: ATXN1; (-) strand; PAM type: YTN; PAM sequence: TTA
gcttcatttaatgttttcta

SEQ ID NO: 227638 - DNA, 20 bp, Artificial Sequence
  Description of Artificial Sequence: Synthetic oligonucleotide
  Target: ATXN1; (-) strand; PAM type: YTN; PAM sequence: TTT
agcttcatttaatgttttct

SEQ ID NO: 227639 - DNA, 20 bp, Artificial Sequence
  Description of Artificial Sequence: Synthetic oligonucleotide
  Target: ATXN1; (-) strand; PAM type: YTN; PAM sequence: TTT
tagcttcatttaatgttttc

SEQ ID NO: 227640 - DNA, 20 bp, Artificial Sequence
  Description of Artificial Sequence: Synthetic oligonucleotide
  Target: ATXN1; (-) strand; PAM type: YTN; PAM sequence: TTT
ttagcttcatttaatgtttt

SEQ ID NO: 227641 - DNA, 20 bp, Artificial Sequence
  Description of Artificial Sequence: Synthetic oligonucleotide
  Target: ATXN1; (-) strand; PAM type: YTN; PAM sequence: TTA
agatttttagcttcatttaa

SEQ ID NO: 227642 - DNA, 20 bp, Artificial Sequence
  Description of Artificial Sequence: Synthetic oligonucleotide
  Target: ATXN1; (-) strand; PAM type: YTN; PAM sequence: TTA
ttaagatttttagcttcatt

SEQ ID NO: 227643 - DNA, 20 bp, Artificial Sequence
  Description of Artificial Sequence: Synthetic oligonucleotide
  Target: ATXN1; (-) strand; PAM type: YTN; PAM sequence: TTT
attaagatttttagcttcat

SEQ ID NO: 227644 - DNA, 20 bp, Artificial Sequence
  Description of Artificial Sequence: Synthetic oligonucleotide
  Target: ATXN1; (-) strand; PAM type: YTN; PAM sequence: TTT
tattaagatttttagcttca

SEQ ID NO: 227645 - DNA, 20 bp, Artificial Sequence
  Description of Artificial Sequence: Synthetic oligonucleotide
  Target: ATXN1; (-) strand; PAM type: YTN; PAM sequence: TTT
ttattaagatttttagcttc

SEQ ID NO: 227646 - DNA, 20 bp, Artificial Sequence
  Description of Artificial Sequence: Synthetic oligonucleotide
  Target: ATXN1; (-) strand; PAM type: YTN; PAM sequence: CTG
taatcatttttattaagatt

SEQ ID NO: 227647 - DNA, 20 bp, Artificial Sequence
  Description of Artificial Sequence: Synthetic oligonucleotide
  Target: ATXN1; (-) strand; PAM type: YTN; PAM sequence: TTA
ctgtaatcatttttattaag

SEQ ID NO: 227648 - DNA, 20 bp, Artificial Sequence
  Description of Artificial Sequence: Synthetic oligonucleotide
  Target: ATXN1; (-) strand; PAM type: YTN; PAM sequence: CTT
actgtaatcatttttattaa

SEQ ID NO: 227649 - DNA, 20 bp, Artificial Sequence
  Description of Artificial Sequence: Synthetic oligonucleotide
  Target: ATXN1; (-) strand; PAM type: YTN; PAM sequence: TTA
tccttactgtaatcattttt

SEQ ID NO: 227650 - DNA, 20 bp, Artificial Sequence
  Description of Artificial Sequence: Synthetic oligonucleotide
  Target: ATXN1; (-) strand; PAM type: YTN; PAM sequence: TTA
tacccagttatccttactgt

SEQ ID NO: 227651 - DNA, 20 bp, Artificial Sequence
  Description of Artificial Sequence: Synthetic oligonucleotide
  Target: ATXN1; (-) strand; PAM type: YTN; PAM sequence: TTT
atacccagttatccttactg

SEQ ID NO: 227652 - DNA, 20 bp, Artificial Sequence
  Description of Artificial Sequence: Synthetic oligonucleotide
  Target: ATXN1; (-) strand; PAM type: YTN; PAM sequence: CTT
tatacccagttatccttact

SEQ ID NO: 227653 - DNA, 20 bp, Artificial Sequence
  Description of Artificial Sequence: Synthetic oligonucleotide
  Target: ATXN1; (-) strand; PAM type: YTN; PAM sequence: TTA
gtgactttatacccagttat

SEQ ID NO: 227654 - DNA, 20 bp, Artificial Sequence
  Description of Artificial Sequence: Synthetic oligonucleotide
  Target: ATXN1; (-) strand; PAM type: YTN; PAM sequence: TTG
attagtgactttatacccag

SEQ ID NO: 227655 - DNA, 20 bp, Artificial Sequence
  Description of Artificial Sequence: Synthetic oligonucleotide
  Target: ATXN1; (-) strand; PAM type: YTN; PAM sequence: TTT
gattagtgactttataccca

SEQ ID NO: 227656 - DNA, 20 bp, Artificial Sequence
  Description of Artificial Sequence: Synthetic oligonucleotide
  Target: ATXN1; (-) strand; PAM type: YTN; PAM sequence: TTA
tttgattagtgactttatac

SEQ ID NO: 227657 - DNA, 20 bp, Artificial Sequence
  Description of Artificial Sequence: Synthetic oligonucleotide
  Target: ATXN1; (-) strand; PAM type: YTN; PAM sequence: CTG
ttatttgattagtgacttta

SEQ ID NO: 227658 - DNA, 20 bp, Artificial Sequence
  Description of Artificial Sequence: Synthetic oligonucleotide
  Target: ATXN1; (-) strand; PAM type: YTN; PAM sequence: CTC
tgttatttgattagtgactt

SEQ ID NO: 227659 - DNA, 20 bp, Artificial Sequence
  Description of Artificial Sequence: Synthetic oligonucleotide
  Target: ATXN1; (-) strand; PAM type: YTN; PAM sequence: TTG
tctctgttatttgattagtg

SEQ ID NO: 227660 - DNA, 20 bp, Artificial Sequence
  Description of Artificial Sequence: Synthetic oligonucleotide
  Target: ATXN1; (-) strand; PAM type: YTN; PAM sequence: CTT
gtctctgttatttgattagt

SEQ ID NO: 227661 - DNA, 20 bp, Artificial Sequence
  Description of Artificial Sequence: Synthetic oligonucleotide
  Target: ATXN1; (-) strand; PAM type: YTN; PAM sequence: CTG
tacttgtctctgttatttga

SEQ ID NO: 227662 - DNA, 20 bp, Artificial Sequence
  Description of Artificial Sequence: Synthetic oligonucleotide
  Target: ATXN1; (-) strand; PAM type: YTN; PAM sequence: CTC
tgtacttgtctctgttattt

SEQ ID NO: 227663 - DNA, 20 bp, Artificial Sequence
  Description of Artificial Sequence: Synthetic oligonucleotide
  Target: ATXN1; (-) strand; PAM type: YTN; PAM sequence: TTG
tgcatagctctgtacttgtc

SEQ ID NO: 227664 - DNA, 20 bp, Artificial Sequence
  Description of Artificial Sequence: Synthetic oligonucleotide
  Target: ATXN1; (-) strand; PAM type: YTN; PAM sequence: TTC
ccccccaccacatattgtgc

SEQ ID NO: 227665 - DNA, 20 bp, Artificial Sequence
  Description of Artificial Sequence: Synthetic oligonucleotide
  Target: ATXN1; (-) strand; PAM type: YTN; PAM sequence: CTT
cccccccaccacatattgtg

SEQ ID NO: 227666 - DNA, 20 bp, Artificial Sequence
  Description of Artificial Sequence: Synthetic oligonucleotide
  Target: ATXN1; (-) strand; PAM type: YTN; PAM sequence: TTC
ttcccccccaccacatattg

SEQ ID NO: 227667 - DNA, 20 bp, Artificial Sequence
  Description of Artificial Sequence: Synthetic oligonucleotide
  Target: ATXN1; (-) strand; PAM type: YTN; PAM sequence: TTA
cacgcatcattcttcccccc

SEQ ID NO: 227668 - DNA, 20 bp, Artificial Sequence
  Description of Artificial Sequence: Synthetic oligonucleotide
  Target: ATXN1; (-) strand; PAM type: YTN; PAM sequence: TTT
acacgcatcattcttccccc

SEQ ID NO: 227669 - DNA, 20 bp, Artificial Sequence
  Description of Artificial Sequence: Synthetic oligonucleotide
  Target: ATXN1; (-) strand; PAM type: YTN; PAM sequence: TTT
tacacgcatcattcttcccc

SEQ ID NO: 227670 - DNA, 20 bp, Artificial Sequence
  Description of Artificial Sequence: Synthetic oligonucleotide
  Target: ATXN1; (-) strand; PAM type: YTN; PAM sequence: TTC
attttacacgcatcattctt

SEQ ID NO: 227671 - DNA, 20 bp, Artificial Sequence
  Description of Artificial Sequence: Synthetic oligonucleotide
  Target: ATXN1; (-) strand; PAM type: YTN; PAM sequence: TTG
tatatgttcattttacacgc

SEQ ID NO: 227672 - DNA, 20 bp, Artificial Sequence
  Description of Artificial Sequence: Synthetic oligonucleotide
  Target: ATXN1; (-) strand; PAM type: YTN; PAM sequence: TTA
atgtcattgtatatgttcat

SEQ ID NO: 227673 - DNA, 20 bp, Artificial Sequence
  Description of Artificial Sequence: Synthetic oligonucleotide
  Target: ATXN1; (-) strand; PAM type: YTN; PAM sequence: TTT
aatgtcattgtatatgttca

SEQ ID NO: 227674 - DNA, 20 bp, Artificial Sequence
  Description of Artificial Sequence: Synthetic oligonucleotide
  Target: ATXN1; (-) strand; PAM type: YTN; PAM sequence: TTT
taatgtcattgtatatgttc

SEQ ID NO: 227675 - DNA, 20 bp, Artificial Sequence
  Description of Artificial Sequence: Synthetic oligonucleotide
  Target: ATXN1; (-) strand; PAM type: YTN; PAM sequence: TTA
gttttaatgtcattgtatat

SEQ ID NO: 227676 - DNA, 20 bp, Artificial Sequence
  Description of Artificial Sequence: Synthetic oligonucleotide
  Target: ATXN1; (-) strand; PAM type: YTN; PAM sequence: TTT
agttttaatgtcattgtata

SEQ ID NO: 227677 - DNA, 20 bp, Artificial Sequence
  Description of Artificial Sequence: Synthetic oligonucleotide
  Target: ATXN1; (-) strand; PAM type: YTN; PAM sequence: TTT
tagttttaatgtcattgtat

SEQ ID NO: 227678 - DNA, 20 bp, Artificial Sequence
  Description of Artificial Sequence: Synthetic oligonucleotide
  Target: ATXN1; (-) strand; PAM type: YTN; PAM sequence: CTT
ttagttttaatgtcattgta

SEQ ID NO: 227679 - DNA, 20 bp, Artificial Sequence
  Description of Artificial Sequence: Synthetic oligonucleotide
  Target: ATXN1; (-) strand; PAM type: YTN; PAM sequence: TTA
aaaatcttttagttttaatg

SEQ ID NO: 227680 - DNA, 20 bp, Artificial Sequence
  Description of Artificial Sequence: Synthetic oligonucleotide
  Target: ATXN1; (-) strand; PAM type: YTN; PAM sequence: TTT
aaaaatcttttagttttaat

SEQ ID NO: 227681 - DNA, 20 bp, Artificial Sequence
  Description of Artificial Sequence: Synthetic oligonucleotide
  Target: ATXN1; (-) strand; PAM type: YTN; PAM sequence: TTT
taaaaatcttttagttttaa

SEQ ID NO: 227682 - DNA, 20 bp, Artificial Sequence
  Description of Artificial Sequence: Synthetic oligonucleotide
  Target: ATXN1; (-) strand; PAM type: YTN; PAM sequence: TTT
ttaaaaatcttttagtttta

SEQ ID NO: 227683 - DNA, 20 bp, Artificial Sequence
  Description of Artificial Sequence: Synthetic oligonucleotide
  Target: ATXN1; (-) strand; PAM type: YTN; PAM sequence: TTT
tttaaaaatcttttagtttt

SEQ ID NO: 227684 - DNA, 20 bp, Artificial Sequence
  Description of Artificial Sequence: Synthetic oligonucleotide
  Target: ATXN1; (-) strand; PAM type: YTN; PAM sequence: CTT
ttttaaaaatcttttagttt

SEQ ID NO: 227685 - DNA, 20 bp, Artificial Sequence
  Description of Artificial Sequence: Synthetic oligonucleotide
  Target: ATXN1; (-) strand; PAM type: YTN; PAM sequence: TTC
ttttttaaaaatcttttagt

SEQ ID NO: 227686 - DNA, 20 bp, Artificial Sequence
  Description of Artificial Sequence: Synthetic oligonucleotide
  Target: ATXN1; (-) strand; PAM type: YTN; PAM sequence: TTT
cttttttaaaaatcttttag

SEQ ID NO: 227687 - DNA, 20 bp, Artificial Sequence
  Description of Artificial Sequence: Synthetic oligonucleotide
  Target: ATXN1; (-) strand; PAM type: YTN; PAM sequence: TTT
tcttttttaaaaatctttta

SEQ ID NO: 227688 - DNA, 20 bp, Artificial Sequence
  Description of Artificial Sequence: Synthetic oligonucleotide
  Target: ATXN1; (-) strand; PAM type: YTN; PAM sequence: TTA
tattttcttttttaaaaatc

SEQ ID NO: 227689 - DNA, 20 bp, Artificial Sequence
  Description of Artificial Sequence: Synthetic oligonucleotide
  Target: ATXN1; (-) strand; PAM type: YTN; PAM sequence: CTT
atattttcttttttaaaaat

SEQ ID NO: 227690 - DNA, 20 bp, Artificial Sequence
  Description of Artificial Sequence: Synthetic oligonucleotide
  Target: ATXN1; (-) strand; PAM type: YTN; PAM sequence: TTG
cttatattttcttttttaaa

SEQ ID NO: 227691 - DNA, 20 bp, Artificial Sequence
  Description of Artificial Sequence: Synthetic oligonucleotide
  Target: ATXN1; (-) strand; PAM type: YTN; PAM sequence: TTT
gcttatattttcttttttaa

SEQ ID NO: 227692 - DNA, 20 bp, Artificial Sequence
  Description of Artificial Sequence: Synthetic oligonucleotide
  Target: ATXN1; (-) strand; PAM type: YTN; PAM sequence: TTT
tgcttatattttctttttta

SEQ ID NO: 227693 - DNA, 20 bp, Artificial Sequence
  Description of Artificial Sequence: Synthetic oligonucleotide
  Target: ATXN1; (-) strand; PAM type: YTN; PAM sequence: TTA
gttttgcttatattttcttt

SEQ ID NO: 227694 - DNA, 20 bp, Artificial Sequence
  Description of Artificial Sequence: Synthetic oligonucleotide
  Target: ATXN1; (-) strand; PAM type: YTN; PAM sequence: TTT
agttttgcttatattttctt

SEQ ID NO: 227695 - DNA, 20 bp, Artificial Sequence
  Description of Artificial Sequence: Synthetic oligonucleotide
  Target: ATXN1; (-) strand; PAM type: YTN; PAM sequence: TTT
tagttttgcttatattttct

SEQ ID NO: 227696 - DNA, 20 bp, Artificial Sequence
  Description of Artificial Sequence: Synthetic oligonucleotide
  Target: ATXN1; (-) strand; PAM type: YTN; PAM sequence: TTT
ttagttttgcttatattttc

SEQ ID NO: 227697 - DNA, 20 bp, Artificial Sequence
  Description of Artificial Sequence: Synthetic oligonucleotide
  Target: ATXN1; (-) strand; PAM type: YTN; PAM sequence: TTG
tttttagttttgcttatatt

SEQ ID NO: 227698 - DNA, 20 bp, Artificial Sequence
  Description of Artificial Sequence: Synthetic oligonucleotide
  Target: ATXN1; (-) strand; PAM type: YTN; PAM sequence: TTT
gtttttagttttgcttatat

SEQ ID NO: 227699 - DNA, 20 bp, Artificial Sequence
  Description of Artificial Sequence: Synthetic oligonucleotide
  Target: ATXN1; (-) strand; PAM type: YTN; PAM sequence: TTT
tgtttttagttttgcttata

SEQ ID NO: 227700 - DNA, 20 bp, Artificial Sequence
  Description of Artificial Sequence: Synthetic oligonucleotide
  Target: ATXN1; (-) strand; PAM type: YTN; PAM sequence: TTT
ttgtttttagttttgcttat

SEQ ID NO: 227701 - DNA, 20 bp, Artificial Sequence
  Description of Artificial Sequence: Synthetic oligonucleotide
  Target: ATXN1; (-) strand; PAM type: YTN; PAM sequence: CTG
gtttttgtttttagttttgc

SEQ ID NO: 227702 - DNA, 20 bp, Artificial Sequence
  Description of Artificial Sequence: Synthetic oligonucleotide
  Target: ATXN1; (-) strand; PAM type: YTN; PAM sequence: CTA
tcctggtttttgtttttagt

SEQ ID NO: 227703 - DNA, 20 bp, Artificial Sequence
  Description of Artificial Sequence: Synthetic oligonucleotide
  Target: ATXN1; (-) strand; PAM type: YTN; PAM sequence: TTC
agagtgctatcctggttttt

SEQ ID NO: 227704 - DNA, 20 bp, Artificial Sequence
  Description of Artificial Sequence: Synthetic oligonucleotide
  Target: ATXN1; (-) strand; PAM type: YTN; PAM sequence: CTG
atattcagagtgctatcctg

SEQ ID NO: 227705 - DNA, 20 bp, Artificial Sequence
  Description of Artificial Sequence: Synthetic oligonucleotide
  Target: ATXN1; (-) strand; PAM type: YTN; PAM sequence: TTG
tctgatattcagagtgctat

SEQ ID NO: 227706 - DNA, 20 bp, Artificial Sequence
  Description of Artificial Sequence: Synthetic oligonucleotide
  Target: ATXN1; (-) strand; PAM type: YTN; PAM sequence: TTT
gtctgatattcagagtgcta

SEQ ID NO: 227707 - DNA, 20 bp, Artificial Sequence
  Description of Artificial Sequence: Synthetic oligonucleotide
  Target: ATXN1; (-) strand; PAM type: YTN; PAM sequence: TTT
tgtctgatattcagagtgct

SEQ ID NO: 227708 - DNA, 20 bp, Artificial Sequence
  Description of Artificial Sequence: Synthetic oligonucleotide
  Target: ATXN1; (-) strand; PAM type: YTN; PAM sequence: TTC
cattttgtctgatattcaga

SEQ ID NO: 227709 - DNA, 20 bp, Artificial Sequence
  Description of Artificial Sequence: Synthetic oligonucleotide
  Target: ATXN1; (-) strand; PAM type: YTN; PAM sequence: TTA
cattccattttgtctgatat

SEQ ID NO: 227710 - DNA, 20 bp, Artificial Sequence
  Description of Artificial Sequence: Synthetic oligonucleotide
  Target: ATXN1; (-) strand; PAM type: YTN; PAM sequence: CTT
acattccattttgtctgata

SEQ ID NO: 227711 - DNA, 20 bp, Artificial Sequence
  Description of Artificial Sequence: Synthetic oligonucleotide
  Target: ATXN1; (-) strand; PAM type: YTN; PAM sequence: TTA
accttacattccattttgtc

SEQ ID NO: 227712 - DNA, 20 bp, Artificial Sequence
  Description of Artificial Sequence: Synthetic oligonucleotide
  Target: ATXN1; (-) strand; PAM type: YTN; PAM sequence: TTT
aaccttacattccattttgt

SEQ ID NO: 227713 - DNA, 20 bp, Artificial Sequence
  Description of Artificial Sequence: Synthetic oligonucleotide
  Target: ATXN1; (-) strand; PAM type: YTN; PAM sequence: TTT
taaccttacattccattttg

SEQ ID NO: 227714 - DNA, 20 bp, Artificial Sequence
  Description of Artificial Sequence: Synthetic oligonucleotide
  Target: ATXN1; (-) strand; PAM type: YTN; PAM sequence: CTT
ttaaccttacattccatttt

SEQ ID NO: 227715 - DNA, 20 bp, Artificial Sequence
  Description of Artificial Sequence: Synthetic oligonucleotide
  Target: ATXN1; (-) strand; PAM type: YTN; PAM sequence: TTA
taatgcttttaaccttacat

SEQ ID NO: 227716 - DNA, 20 bp, Artificial Sequence
  Description of Artificial Sequence: Synthetic oligonucleotide
  Target: ATXN1; (-) strand; PAM type: YTN; PAM sequence: TTT
ataatgcttttaaccttaca

SEQ ID NO: 227717 - DNA, 20 bp, Artificial Sequence
  Description of Artificial Sequence: Synthetic oligonucleotide
  Target: ATXN1; (-) strand; PAM type: YTN; PAM sequence: CTC
accatcatttataatgcttt

SEQ ID NO: 227718 - DNA, 20 bp, Artificial Sequence
  Description of Artificial Sequence: Synthetic oligonucleotide
  Target: ATXN1; (-) strand; PAM type: YTN; PAM sequence: CTA
ggatgtccctcaccatcatt

SEQ ID NO: 227719 - DNA, 20 bp, Artificial Sequence
  Description of Artificial Sequence: Synthetic oligonucleotide
  Target: ATXN1; (-) strand; PAM type: YTN; PAM sequence: TTG
ccagcctaggatgtccctca

SEQ ID NO: 227720 - DNA, 20 bp, Artificial Sequence
  Description of Artificial Sequence: Synthetic oligonucleotide
  Target: ATXN1; (-) strand; PAM type: YTN; PAM sequence: TTT
gccagcctaggatgtccctc

SEQ ID NO: 227721 - DNA, 20 bp, Artificial Sequence
  Description of Artificial Sequence: Synthetic oligonucleotide
  Target: ATXN1; (-) strand; PAM type: YTN; PAM sequence: TTT
tgccagcctaggatgtccct

SEQ ID NO: 227722 - DNA, 20 bp, Artificial Sequence
  Description of Artificial Sequence: Synthetic oligonucleotide
  Target: ATXN1; (-) strand; PAM type: YTN; PAM sequence: CTT
ttgccagcctaggatgtccc

SEQ ID NO: 227723 - DNA, 20 bp, Artificial Sequence
  Description of Artificial Sequence: Synthetic oligonucleotide
  Target: ATXN1; (-) strand; PAM type: YTN; PAM sequence: TTC
cttttgccagcctaggatgt

SEQ ID NO: 227724 - DNA, 20 bp, Artificial Sequence
  Description of Artificial Sequence: Synthetic oligonucleotide
  Target: ATXN1; (-) strand; PAM type: YTN; PAM sequence: TTG
ttccttttgccagcctagga

SEQ ID NO: 227725 - DNA, 20 bp, Artificial Sequence
  Description of Artificial Sequence: Synthetic oligonucleotide
  Target: ATXN1; (-) strand; PAM type: YTN; PAM sequence: TTG
gttgttccttttgccagcct

SEQ ID NO: 227726 - DNA, 20 bp, Artificial Sequence
  Description of Artificial Sequence: Synthetic oligonucleotide
  Target: ATXN1; (-) strand; PAM type: YTN; PAM sequence: TTA
ttggttgttccttttgccag

SEQ ID NO: 227727 - DNA, 20 bp, Artificial Sequence
  Description of Artificial Sequence: Synthetic oligonucleotide
  Target: ATXN1; (-) strand; PAM type: YTN; PAM sequence: TTT
attggttgttccttttgcca

SEQ ID NO: 227728 - DNA, 20 bp, Artificial Sequence
  Description of Artificial Sequence: Synthetic oligonucleotide
  Target: ATXN1; (-) strand; PAM type: YTN; PAM sequence: CTT
tattggttgttccttttgcc

SEQ ID NO: 227729 - DNA, 20 bp, Artificial Sequence
  Description of Artificial Sequence: Synthetic oligonucleotide
  Target: ATXN1; (-) strand; PAM type: YTN; PAM sequence: TTA
taaaatcatctttattggtt

SEQ ID NO: 227730 - DNA, 20 bp, Artificial Sequence
  Description of Artificial Sequence: Synthetic oligonucleotide
  Target: ATXN1; (-) strand; PAM type: YTN; PAM sequence: TTG
acgattataaaatcatcttt

SEQ ID NO: 227731 - DNA, 20 bp, Artificial Sequence
  Description of Artificial Sequence: Synthetic oligonucleotide
  Target: ATXN1; (-) strand; PAM type: YTN; PAM sequence: TTA
gatgcatgtatgttgacgat

SEQ ID NO: 227732 - DNA, 20 bp, Artificial Sequence
  Description of Artificial Sequence: Synthetic oligonucleotide
  Target: ATXN1; (-) strand; PAM type: YTN; PAM sequence: TTG
ttagatgcatgtatgttgac

SEQ ID NO: 227733 - DNA, 20 bp, Artificial Sequence
  Description of Artificial Sequence: Synthetic oligonucleotide
  Target: ATXN1; (-) strand; PAM type: YTN; PAM sequence: TTT
gttagatgcatgtatgttga

SEQ ID NO: 227734 - DNA, 20 bp, Artificial Sequence
  Description of Artificial Sequence: Synthetic oligonucleotide
  Target: ATXN1; (-) strand; PAM type: YTN; PAM sequence: TTT
tgttagatgcatgtatgttg

SEQ ID NO: 227735 - DNA, 20 bp, Artificial Sequence
  Description of Artificial Sequence: Synthetic oligonucleotide
  Target: ATXN1; (-) strand; PAM type: YTN; PAM sequence: CTG
tgccattttgttagatgcat

SEQ ID NO: 227736 - DNA, 20 bp, Artificial Sequence
  Description of Artificial Sequence: Synthetic oligonucleotide
  Target: ATXN1; (-) strand; PAM type: YTN; PAM sequence: CTC
tgtgccattttgttagatgc

SEQ ID NO: 227737 - DNA, 20 bp, Artificial Sequence
  Description of Artificial Sequence: Synthetic oligonucleotide
  Target: ATXN1; (-) strand; PAM type: YTN; PAM sequence: TTA
aatatctctgtgccattttg

SEQ ID NO: 227738 - DNA, 20 bp, Artificial Sequence
  Description of Artificial Sequence: Synthetic oligonucleotide
  Target: ATXN1; (-) strand; PAM type: YTN; PAM sequence: TTT
aaatatctctgtgccatttt

SEQ ID NO: 227739 - DNA, 20 bp, Artificial Sequence
  Description of Artificial Sequence: Synthetic oligonucleotide
  Target: ATXN1; (-) strand; PAM type: YTN; PAM sequence: CTT
taaatatctctgtgccattt

SEQ ID NO: 227740 - DNA, 20 bp, Artificial Sequence
  Description of Artificial Sequence: Synthetic oligonucleotide
  Target: ATXN1; (-) strand; PAM type: YTN; PAM sequence: TTG
ctttaaatatctctgtgcca

SEQ ID NO: 227741 - DNA, 20 bp, Artificial Sequence
  Description of Artificial Sequence: Synthetic oligonucleotide
  Target: ATXN1; (-) strand; PAM type: YTN; PAM sequence: TTG
ttgctttaaatatctctgtg

SEQ ID NO: 227742 - DNA, 20 bp, Artificial Sequence
  Description of Artificial Sequence: Synthetic oligonucleotide
  Target: ATXN1; (-) strand; PAM type: YTN; PAM sequence: TTC
atagttgttgctttaaatat

SEQ ID NO: 227743 - DNA, 20 bp, Artificial Sequence
  Description of Artificial Sequence: Synthetic oligonucleotide
  Target: ATXN1; (-) strand; PAM type: YTN; PAM sequence: CTT
catagttgttgctttaaata

SEQ ID NO: 227744 - DNA, 20 bp, Artificial Sequence
  Description of Artificial Sequence: Synthetic oligonucleotide
  Target: ATXN1; (-) strand; PAM type: YTN; PAM sequence: CTC
ttcatagttgttgctttaaa

SEQ ID NO: 227745 - DNA, 20 bp, Artificial Sequence
  Description of Artificial Sequence: Synthetic oligonucleotide
  Target: ATXN1; (-) strand; PAM type: YTN; PAM sequence: TTC
tcttcatagttgttgcttta

SEQ ID NO: 227746 - DNA, 20 bp, Artificial Sequence
  Description of Artificial Sequence: Synthetic oligonucleotide
  Target: ATXN1; (-) strand; PAM type: YTN; PAM sequence: TTT
ctcttcatagttgttgcttt

SEQ ID NO: 227747 - DNA, 20 bp, Artificial Sequence
  Description of Artificial Sequence: Synthetic oligonucleotide
  Target: ATXN1; (-) strand; PAM type: YTN; PAM sequence: TTA
tttctcttcatagttgttgc

SEQ ID NO: 227748 - DNA, 20 bp, Artificial Sequence
  Description of Artificial Sequence: Synthetic oligonucleotide
  Target: ATXN1; (-) strand; PAM type: YTN; PAM sequence: TTT
atttctcttcatagttgttg

SEQ ID NO: 227749 - DNA, 20 bp, Artificial Sequence
  Description of Artificial Sequence: Synthetic oligonucleotide
  Target: ATXN1; (-) strand; PAM type: YTN; PAM sequence: TTA
tttatttctcttcatagttg

SEQ ID NO: 227750 - DNA, 20 bp, Artificial Sequence
  Description of Artificial Sequence: Synthetic oligonucleotide
  Target: ATXN1; (-) strand; PAM type: YTN; PAM sequence: TTT
atttatttctcttcatagtt

SEQ ID NO: 227751 - DNA, 20 bp, Artificial Sequence
  Description of Artificial Sequence: Synthetic oligonucleotide
  Target: ATXN1; (-) strand; PAM type: YTN; PAM sequence: TTA
tttatttatttctcttcata

SEQ ID NO: 227752 - DNA, 20 bp, Artificial Sequence
  Description of Artificial Sequence: Synthetic oligonucleotide
  Target: ATXN1; (-) strand; PAM type: YTN; PAM sequence: TTT
atttatttatttctcttcat

SEQ ID NO: 227753 - DNA, 20 bp, Artificial Sequence
  Description of Artificial Sequence: Synthetic oligonucleotide
  Target: ATXN1; (-) strand; PAM type: YTN; PAM sequence: TTT
tatttatttatttctcttca

SEQ ID NO: 227754 - DNA, 20 bp, Artificial Sequence
  Description of Artificial Sequence: Synthetic oligonucleotide
  Target: ATXN1; (-) strand; PAM type: YTN; PAM sequence: TTT
ttatttatttatttctcttc

SEQ ID NO: 227755 - DNA, 20 bp, Artificial Sequence
  Description of Artificial Sequence: Synthetic oligonucleotide
  Target: ATXN1; (-) strand; PAM type: YTN; PAM sequence: TTA
catttttatttatttatttc

SEQ ID NO: 227756 - DNA, 20 bp, Artificial Sequence
  Description of Artificial Sequence: Synthetic oligonucleotide
  Target: ATXN1; (-) strand; PAM type: YTN; PAM sequence: CTA
attacatttttatttattta

SEQ ID NO: 227757 - DNA, 20 bp, Artificial Sequence
  Description of Artificial Sequence: Synthetic oligonucleotide
  Target: ATXN1; (-) strand; PAM type: YTN; PAM sequence: TTG
ctaattacatttttatttat

SEQ ID NO: 227758 - DNA, 20 bp, Artificial Sequence
  Description of Artificial Sequence: Synthetic oligonucleotide
  Target: ATXN1; (-) strand; PAM type: YTN; PAM sequence: TTA
attgctaattacatttttat

SEQ ID NO: 227759 - DNA, 20 bp, Artificial Sequence
  Description of Artificial Sequence: Synthetic oligonucleotide
  Target: ATXN1; (-) strand; PAM type: YTN; PAM sequence: CTT
aattgctaattacattttta

SEQ ID NO: 227760 - DNA, 20 bp, Artificial Sequence
  Description of Artificial Sequence: Synthetic oligonucleotide
  Target: ATXN1; (-) strand; PAM type: YTN; PAM sequence: TTC
cttaattgctaattacattt

SEQ ID NO: 227761 - DNA, 20 bp, Artificial Sequence
  Description of Artificial Sequence: Synthetic oligonucleotide
  Target: ATXN1; (-) strand; PAM type: YTN; PAM sequence: TTT
ccttaattgctaattacatt

SEQ ID NO: 227762 - DNA, 20 bp, Artificial Sequence
  Description of Artificial Sequence: Synthetic oligonucleotide
  Target: ATXN1; (-) strand; PAM type: YTN; PAM sequence: TTT
tccttaattgctaattacat

SEQ ID NO: 227763 - DNA, 20 bp, Artificial Sequence
  Description of Artificial Sequence: Synthetic oligonucleotide
  Target: ATXN1; (-) strand; PAM type: YTN; PAM sequence: TTT
ttccttaattgctaattaca

SEQ ID NO: 227764 - DNA, 20 bp, Artificial Sequence
  Description of Artificial Sequence: Synthetic oligonucleotide
  Target: ATXN1; (-) strand; PAM type: YTN; PAM sequence: TTT
tttccttaattgctaattac

SEQ ID NO: 227765 - DNA, 20 bp, Artificial Sequence
  Description of Artificial Sequence: Synthetic oligonucleotide
  Target: ATXN1; (-) strand; PAM type: YTN; PAM sequence: CTT
ttttccttaattgctaatta

SEQ ID NO: 227766 - DNA, 20 bp, Artificial Sequence
  Description of Artificial Sequence: Synthetic oligonucleotide
  Target: ATXN1; (-) strand; PAM type: YTN; PAM sequence: TTC
ccttttttccttaattgcta

SEQ ID NO: 227767 - DNA, 20 bp, Artificial Sequence
  Description of Artificial Sequence: Synthetic oligonucleotide
  Target: ATXN1; (-) strand; PAM type: YTN; PAM sequence: CTT
cccttttttccttaattgct

SEQ ID NO: 227768 - DNA, 20 bp, Artificial Sequence
  Description of Artificial Sequence: Synthetic oligonucleotide
  Target: ATXN1; (-) strand; PAM type: YTN; PAM sequence: TTA
agcttcccttttttccttaa

SEQ ID NO: 227769 - DNA, 20 bp, Artificial Sequence
  Description of Artificial Sequence: Synthetic oligonucleotide
  Target: ATXN1; (-) strand; PAM type: YTN; PAM sequence: TTT
aagcttcccttttttcctta

SEQ ID NO: 227770 - DNA, 20 bp, Artificial Sequence
  Description of Artificial Sequence: Synthetic oligonucleotide
  Target: ATXN1; (-) strand; PAM type: YTN; PAM sequence: TTT
taagcttcccttttttcctt

SEQ ID NO: 227771 - DNA, 20 bp, Artificial Sequence
  Description of Artificial Sequence: Synthetic oligonucleotide
  Target: ATXN1; (-) strand; PAM type: YTN; PAM sequence: TTT
ttaagcttcccttttttcct

SEQ ID NO: 227772 - DNA, 20 bp, Artificial Sequence
  Description of Artificial Sequence: Synthetic oligonucleotide
  Target: ATXN1; (-) strand; PAM type: YTN; PAM sequence: TTC
acagacgtggggaattttta

SEQ ID NO: 227773 - DNA, 20 bp, Artificial Sequence
  Description of Artificial Sequence: Synthetic oligonucleotide
  Target: ATXN1; (-) strand; PAM type: YTN; PAM sequence: TTA
attcacagacgtggggaatt

SEQ ID NO: 227774 - DNA, 20 bp, Artificial Sequence
  Description of Artificial Sequence: Synthetic oligonucleotide
  Target: ATXN1; (-) strand; PAM type: YTN; PAM sequence: TTT
aattcacagacgtggggaat

SEQ ID NO: 227775 - DNA, 20 bp, Artificial Sequence
  Description of Artificial Sequence: Synthetic oligonucleotide
  Target: ATXN1; (-) strand; PAM type: YTN; PAM sequence: TTT
taattcacagacgtggggaa

SEQ ID NO: 227776 - DNA, 20 bp, Artificial Sequence
  Description of Artificial Sequence: Synthetic oligonucleotide
  Target: ATXN1; (-) strand; PAM type: YTN; PAM sequence: CTA
gtagtaaacattttaattca

SEQ ID NO: 227777 - DNA, 20 bp, Artificial Sequence
  Description of Artificial Sequence: Synthetic oligonucleotide
  Target: ATXN1; (-) strand; PAM type: YTN; PAM sequence: TTG
tctagtagtaaacattttaa

SEQ ID NO: 227778 - DNA, 20 bp, Artificial Sequence
  Description of Artificial Sequence: Synthetic oligonucleotide
  Target: ATXN1; (-) strand; PAM type: YTN; PAM sequence: CTG
ggaattgtctagtagtaaac

SEQ ID NO: 227779 - DNA, 20 bp, Artificial Sequence
  Description of Artificial Sequence: Synthetic oligonucleotide
  Target: ATXN1; (-) strand; PAM type: YTN; PAM sequence: CTC
tgggaattgtctagtagtaa

SEQ ID NO: 227780 - DNA, 20 bp, Artificial Sequence
  Description of Artificial Sequence: Synthetic oligonucleotide
  Target: ATXN1; (-) strand; PAM type: YTN; PAM sequence: TTC
ctctgggaattgtctagtag

SEQ ID NO: 227781 - DNA, 20 bp, Artificial Sequence
  Description of Artificial Sequence: Synthetic oligonucleotide
  Target: ATXN1; (-) strand; PAM type: YTN; PAM sequence: TTT
cctctgggaattgtctagta

SEQ ID NO: 227782 - DNA, 20 bp, Artificial Sequence
  Description of Artificial Sequence: Synthetic oligonucleotide
  Target: ATXN1; (-) strand; PAM type: YTN; PAM sequence: TTA
tttcctctgggaattgtcta

SEQ ID NO: 227783 - DNA, 20 bp, Artificial Sequence
  Description of Artificial Sequence: Synthetic oligonucleotide
  Target: ATXN1; (-) strand; PAM type: YTN; PAM sequence: TTT
atttcctctgggaattgtct

SEQ ID NO: 227784 - DNA, 20 bp, Artificial Sequence
  Description of Artificial Sequence: Synthetic oligonucleotide
  Target: ATXN1; (-) strand; PAM type: YTN; PAM sequence: TTT
tatttcctctgggaattgtc

SEQ ID NO: 227785 - DNA, 20 bp, Artificial Sequence
  Description of Artificial Sequence: Synthetic oligonucleotide
  Target: ATXN1; (-) strand; PAM type: YTN; PAM sequence: TTC
cattttatttcctctgggaa

SEQ ID NO: 227786 - DNA, 20 bp, Artificial Sequence
  Description of Artificial Sequence: Synthetic oligonucleotide
  Target: ATXN1; (-) strand; PAM type: YTN; PAM sequence: TTT
ccattttatttcctctggga

SEQ ID NO: 227787 - DNA, 20 bp, Artificial Sequence
  Description of Artificial Sequence: Synthetic oligonucleotide
  Target: ATXN1; (-) strand; PAM type: YTN; PAM sequence: TTG
tatttccattttatttcctc

SEQ ID NO: 227788 - DNA, 20 bp, Artificial Sequence
  Description of Artificial Sequence: Synthetic oligonucleotide
  Target: ATXN1; (-) strand; PAM type: YTN; PAM sequence: TTT
gtatttccattttatttcct

SEQ ID NO: 227789 - DNA, 20 bp, Artificial Sequence
  Description of Artificial Sequence: Synthetic oligonucleotide
  Target: ATXN1; (-) strand; PAM type: YTN; PAM sequence: TTT
tgtatttccattttatttcc

SEQ ID NO: 227790 - DNA, 20 bp, Artificial Sequence
  Description of Artificial Sequence: Synthetic oligonucleotide
  Target: ATXN1; (-) strand; PAM type: YTN; PAM sequence: CTC
agtattttgtatttccattt

SEQ ID NO: 227791 - DNA, 20 bp, Artificial Sequence
  Description of Artificial Sequence: Synthetic oligonucleotide
  Target: ATXN1; (-) strand; PAM type: YTN; PAM sequence: TTA
actcagtattttgtatttcc

SEQ ID NO: 227792 - DNA, 20 bp, Artificial Sequence
  Description of Artificial Sequence: Synthetic oligonucleotide
  Target: ATXN1; (-) strand; PAM type: YTN; PAM sequence: CTT
aactcagtattttgtatttc

SEQ ID NO: 227793 - DNA, 20 bp, Artificial Sequence
  Description of Artificial Sequence: Synthetic oligonucleotide
  Target: ATXN1; (-) strand; PAM type: YTN; PAM sequence: TTG
tcacttaactcagtattttg

SEQ ID NO: 227794 - DNA, 20 bp, Artificial Sequence
  Description of Artificial Sequence: Synthetic oligonucleotide
  Target: ATXN1; (-) strand; PAM type: YTN; PAM sequence: TTA
ttgtcacttaactcagtatt

SEQ ID NO: 227795 - DNA, 20 bp, Artificial Sequence
  Description of Artificial Sequence: Synthetic oligonucleotide
  Target: ATXN1; (-) strand; PAM type: YTN; PAM sequence: TTT
attgtcacttaactcagtat

SEQ ID NO: 227796 - DNA, 20 bp, Artificial Sequence
  Description of Artificial Sequence: Synthetic oligonucleotide
  Target: ATXN1; (-) strand; PAM type: YTN; PAM sequence: TTT
tattgtcacttaactcagta

SEQ ID NO: 227797 - DNA, 20 bp, Artificial Sequence
  Description of Artificial Sequence: Synthetic oligonucleotide
  Target: ATXN1; (-) strand; PAM type: YTN; PAM sequence: CTT
ttattgtcacttaactcagt

SEQ ID NO: 227798 - DNA, 20 bp, Artificial Sequence
  Description of Artificial Sequence: Synthetic oligonucleotide
  Target: ATXN1; (-) strand; PAM type: YTN; PAM sequence: TTG
atatatacttttattgtcac

SEQ ID NO: 227799 - DNA, 20 bp, Artificial Sequence
  Description of Artificial Sequence: Synthetic oligonucleotide
  Target: ATXN1; (-) strand; PAM type: YTN; PAM sequence: TTT
gatatatacttttattgtca

SEQ ID NO: 227800 - DNA, 20 bp, Artificial Sequence
  Description of Artificial Sequence: Synthetic oligonucleotide
  Target: ATXN1; (-) strand; PAM type: YTN; PAM sequence: TTT
tgatatatacttttattgtc

SEQ ID NO: 227801 - DNA, 20 bp, Artificial Sequence
  Description of Artificial Sequence: Synthetic oligonucleotide
  Target: ATXN1; (-) strand; PAM type: YTN; PAM sequence: TTG
tacaaattttgatatatact

SEQ ID NO: 227802 - DNA, 20 bp, Artificial Sequence
  Description of Artificial Sequence: Synthetic oligonucleotide
  Target: ATXN1; (-) strand; PAM type: YTN; PAM sequence: TTG
cattgtacaaattttgatat

SEQ ID NO: 227803 - DNA, 20 bp, Artificial Sequence
  Description of Artificial Sequence: Synthetic oligonucleotide
  Target: ATXN1; (-) strand; PAM type: YTN; PAM sequence: TTA
attgcattgtacaaattttg

SEQ ID NO: 227804 - DNA, 20 bp, Artificial Sequence
  Description of Artificial Sequence: Synthetic oligonucleotide
  Target: ATXN1; (-) strand; PAM type: YTN; PAM sequence: TTT
aattgcattgtacaaatttt

SEQ ID NO: 227805 - DNA, 20 bp, Artificial Sequence
  Description of Artificial Sequence: Synthetic oligonucleotide
  Target: ATXN1; (-) strand; PAM type: YTN; PAM sequence: TTT
taattgcattgtacaaattt

SEQ ID NO: 227806 - DNA, 20 bp, Artificial Sequence
  Description of Artificial Sequence: Synthetic oligonucleotide
  Target: ATXN1; (-) strand; PAM type: YTN; PAM sequence: TTA
tgttttaattgcattgtaca

SEQ ID NO: 227807 - DNA, 20 bp, Artificial Sequence
  Description of Artificial Sequence: Synthetic oligonucleotide
  Target: ATXN1; (-) strand; PAM type: YTN; PAM sequence: CTT
atgttttaattgcattgtac

SEQ ID NO: 227808 - DNA, 20 bp, Artificial Sequence
  Description of Artificial Sequence: Synthetic oligonucleotide
  Target: ATXN1; (-) strand; PAM type: YTN; PAM sequence: TTG
caatgagcccttatgtttta

SEQ ID NO: 227809 - DNA, 20 bp, Artificial Sequence
  Description of Artificial Sequence: Synthetic oligonucleotide
  Target: ATXN1; (-) strand; PAM type: YTN; PAM sequence: CTT
gcaatgagcccttatgtttt

SEQ ID NO: 227810 - DNA, 20 bp, Artificial Sequence
  Description of Artificial Sequence: Synthetic oligonucleotide
  Target: ATXN1; (-) strand; PAM type: YTN; PAM sequence: TTC
agccgaggtcttgcaatgag

SEQ ID NO: 227811 - DNA, 20 bp, Artificial Sequence
  Description of Artificial Sequence: Synthetic oligonucleotide
  Target: ATXN1; (-) strand; PAM type: YTN; PAM sequence: CTT
cagccgaggtcttgcaatga

SEQ ID NO: 227812 - DNA, 20 bp, Artificial Sequence
  Description of Artificial Sequence: Synthetic oligonucleotide
  Target: ATXN1; (-) strand; PAM type: YTN; PAM sequence: TTC
agacttcagccgaggtcttg

SEQ ID NO: 227813 - DNA, 20 bp, Artificial Sequence
  Description of Artificial Sequence: Synthetic oligonucleotide
  Target: ATXN1; (-) strand; PAM type: YTN; PAM sequence: CTG
ttcagacttcagccgaggtc

SEQ ID NO: 227814 - DNA, 20 bp, Artificial Sequence
  Description of Artificial Sequence: Synthetic oligonucleotide
  Target: ATXN1; (-) strand; PAM type: YTN; PAM sequence: CTG
caggctgttcagacttcagc

SEQ ID NO: 227815 - DNA, 20 bp, Artificial Sequence
  Description of Artificial Sequence: Synthetic oligonucleotide
  Target: ATXN1; (-) strand; PAM type: YTN; PAM sequence: CTA
caagagctgcaggctgttca

SEQ ID NO: 227816 - DNA, 20 bp, Artificial Sequence
  Description of Artificial Sequence: Synthetic oligonucleotide
  Target: ATXN1; (-) strand; PAM type: YTN; PAM sequence: CTG
aatatggctacaagagctgc

SEQ ID NO: 227817 - DNA, 20 bp, Artificial Sequence
  Description of Artificial Sequence: Synthetic oligonucleotide
  Target: ATXN1; (-) strand; PAM type: YTN; PAM sequence: CTG
atctgaatatggctacaaga

SEQ ID NO: 227818 - DNA, 20 bp, Artificial Sequence
  Description of Artificial Sequence: Synthetic oligonucleotide
  Target: ATXN1; (-) strand; PAM type: YTN; PAM sequence: CTA
ctgatctgaatatggctaca

SEQ ID NO: 227819 - DNA, 20 bp, Artificial Sequence
  Description of Artificial Sequence: Synthetic oligonucleotide
  Target: ATXN1; (-) strand; PAM type: YTN; PAM sequence: CTA
gaaatctactgatctgaata

SEQ ID NO: 227820 - DNA, 20 bp, Artificial Sequence
  Description of Artificial Sequence: Synthetic oligonucleotide
  Target: ATXN1; (-) strand; PAM type: YTN; PAM sequence: TTG
tctagaaatctactgatctg

SEQ ID NO: 227821 - DNA, 20 bp, Artificial Sequence
  Description of Artificial Sequence: Synthetic oligonucleotide
  Target: ATXN1; (-) strand; PAM type: YTN; PAM sequence: CTT
gtctagaaatctactgatct

SEQ ID NO: 227822 - DNA, 20 bp, Artificial Sequence
  Description of Artificial Sequence: Synthetic oligonucleotide
  Target: ATXN1; (-) strand; PAM type: YTN; PAM sequence: CTC
cttgtctagaaatctactga

SEQ ID NO: 227823 - DNA, 20 bp, Artificial Sequence
  Description of Artificial Sequence: Synthetic oligonucleotide
  Target: ATXN1; (-) strand; PAM type: YTN; PAM sequence: TTC
tccttgtctagaaatctact

SEQ ID NO: 227824 - DNA, 20 bp, Artificial Sequence
  Description of Artificial Sequence: Synthetic oligonucleotide
  Target: ATXN1; (-) strand; PAM type: YTN; PAM sequence: CTG
gcaattctccttgtctagaa

SEQ ID NO: 227825 - DNA, 20 bp, Artificial Sequence
  Description of Artificial Sequence: Synthetic oligonucleotide
  Target: ATXN1; (-) strand; PAM type: YTN; PAM sequence: CTC
tggcaattctccttgtctag

SEQ ID NO: 227826 - DNA, 20 bp, Artificial Sequence
  Description of Artificial Sequence: Synthetic oligonucleotide
  Target: ATXN1; (-) strand; PAM type: YTN; PAM sequence: TTA
actctggcaattctccttgt

SEQ ID NO: 227827 - DNA, 20 bp, Artificial Sequence
  Description of Artificial Sequence: Synthetic oligonucleotide
  Target: ATXN1; (-) strand; PAM type: YTN; PAM sequence: TTT
aactctggcaattctccttg

SEQ ID NO: 227828 - DNA, 20 bp, Artificial Sequence
  Description of Artificial Sequence: Synthetic oligonucleotide
  Target: ATXN1; (-) strand; PAM type: YTN; PAM sequence: CTT
taactctggcaattctcctt

SEQ ID NO: 227829 - DNA, 20 bp, Artificial Sequence
  Description of Artificial Sequence: Synthetic oligonucleotide
  Target: ATXN1; (-) strand; PAM type: YTN; PAM sequence: TTA
tgaaatgaccctttaactct

SEQ ID NO: 227830 - DNA, 20 bp, Artificial Sequence
  Description of Artificial Sequence: Synthetic oligonucleotide
  Target: ATXN1; (-) strand; PAM type: YTN; PAM sequence: TTA
ttatgaaatgaccctttaac

SEQ ID NO: 227831 - DNA, 20 bp, Artificial Sequence
  Description of Artificial Sequence: Synthetic oligonucleotide
  Target: ATXN1; (-) strand; PAM type: YTN; PAM sequence: TTA
attattatgaaatgaccctt

SEQ ID NO: 227832 - DNA, 20 bp, Artificial Sequence
  Description of Artificial Sequence: Synthetic oligonucleotide
  Target: ATXN1; (-) strand; PAM type: YTN; PAM sequence: TTT
aattattatgaaatgaccct

SEQ ID NO: 227833 - DNA, 20 bp, Artificial Sequence
  Description of Artificial Sequence: Synthetic oligonucleotide
  Target: ATXN1; (-) strand; PAM type: YTN; PAM sequence: CTT
taattattatgaaatgaccc

SEQ ID NO: 227834 - DNA, 20 bp, Artificial Sequence
  Description of Artificial Sequence: Synthetic oligonucleotide
  Target: ATXN1; (-) strand; PAM type: YTN; PAM sequence: CTA
ataagtacaccctttaatta

SEQ ID NO: 227835 - DNA, 20 bp, Artificial Sequence
  Description of Artificial Sequence: Synthetic oligonucleotide
  Target: ATXN1; (-) strand; PAM type: YTN; PAM sequence: TTC
ctaataagtacaccctttaa

SEQ ID NO: 227836 - DNA, 20 bp, Artificial Sequence
  Description of Artificial Sequence: Synthetic oligonucleotide
  Target: ATXN1; (-) strand; PAM type: YTN; PAM sequence: CTT
cctaataagtacacccttta

SEQ ID NO: 227837 - DNA, 20 bp, Artificial Sequence
  Description of Artificial Sequence: Synthetic oligonucleotide
  Target: ATXN1; (-) strand; PAM type: YTN; PAM sequence: TTG
atgtatcttcctaataagta

SEQ ID NO: 227838 - DNA, 20 bp, Artificial Sequence
  Description of Artificial Sequence: Synthetic oligonucleotide
  Target: ATXN1; (-) strand; PAM type: YTN; PAM sequence: TTA
agattgatgtatcttcctaa

SEQ ID NO: 227839 - DNA, 20 bp, Artificial Sequence
  Description of Artificial Sequence: Synthetic oligonucleotide
  Target: ATXN1; (-) strand; PAM type: YTN; PAM sequence: TTT
aagattgatgtatcttccta

SEQ ID NO: 227840 - DNA, 20 bp, Artificial Sequence
  Description of Artificial Sequence: Synthetic oligonucleotide
  Target: ATXN1; (-) strand; PAM type: YTN; PAM sequence: TTT
taagattgatgtatcttcct

SEQ ID NO: 227841 - DNA, 20 bp, Artificial Sequence
  Description of Artificial Sequence: Synthetic oligonucleotide
  Target: ATXN1; (-) strand; PAM type: YTN; PAM sequence: CTT
ttaagattgatgtatcttcc

SEQ ID NO: 227842 - DNA, 20 bp, Artificial Sequence
  Description of Artificial Sequence: Synthetic oligonucleotide
  Target: ATXN1; (-) strand; PAM type: YTN; PAM sequence: CTA
ggtacacacacttttaagat

SEQ ID NO: 227843 - DNA, 20 bp, Artificial Sequence
  Description of Artificial Sequence: Synthetic oligonucleotide
  Target: ATXN1; (-) strand; PAM type: YTN; PAM sequence: TTC
ctaggtacacacacttttaa

SEQ ID NO: 227844 - DNA, 20 bp, Artificial Sequence
  Description of Artificial Sequence: Synthetic oligonucleotide
  Target: ATXN1; (-) strand; PAM type: YTN; PAM sequence: CTG
ttcctaggtacacacacttt

SEQ ID NO: 227845 - DNA, 20 bp, Artificial Sequence
  Description of Artificial Sequence: Synthetic oligonucleotide
  Target: ATXN1; (-) strand; PAM type: YTN; PAM sequence: TTC
tgttcctaggtacacacact

SEQ ID NO: 227846 - DNA, 20 bp, Artificial Sequence
  Description of Artificial Sequence: Synthetic oligonucleotide
  Target: ATXN1; (-) strand; PAM type: YTN; PAM sequence: TTT
ctgttcctaggtacacacac

SEQ ID NO: 227847 - DNA, 20 bp, Artificial Sequence
  Description of Artificial Sequence: Synthetic oligonucleotide
  Target: ATXN1; (-) strand; PAM type: YTN; PAM sequence: TTT
tctgttcctaggtacacaca

SEQ ID NO: 227848 - DNA, 20 bp, Artificial Sequence
  Description of Artificial Sequence: Synthetic oligonucleotide
  Target: ATXN1; (-) strand; PAM type: YTN; PAM sequence: TTT
ttctgttcctaggtacacac

SEQ ID NO: 227849 - DNA, 20 bp, Artificial Sequence
  Description of Artificial Sequence: Synthetic oligonucleotide
  Target: ATXN1; (-) strand; PAM type: YTN; PAM sequence: TTT
tttctgttcctaggtacaca

SEQ ID NO: 227850 - DNA, 20 bp, Artificial Sequence
  Description of Artificial Sequence: Synthetic oligonucleotide
  Target: ATXN1; (-) strand; PAM type: YTN; PAM sequence: TTT
ttttctgttcctaggtacac

SEQ ID NO: 227851 - DNA, 20 bp, Artificial Sequence
  Description of Artificial Sequence: Synthetic oligonucleotide
  Target: ATXN1; (-) strand; PAM type: YTN; PAM sequence: TTT
tttttctgttcctaggtaca

SEQ ID NO: 227852 - DNA, 20 bp, Artificial Sequence
  Description of Artificial Sequence: Synthetic oligonucleotide
  Target: ATXN1; (-) strand; PAM type: YTN; PAM sequence: TTT
ttttttctgttcctaggtac

SEQ ID NO: 227853 - DNA, 20 bp, Artificial Sequence
  Description of Artificial Sequence: Synthetic oligonucleotide
  Target: ATXN1; (-) strand; PAM type: YTN; PAM sequence: CTT
tttttttctgttcctaggta

SEQ ID NO: 227854 - DNA, 20 bp, Artificial Sequence
  Description of Artificial Sequence: Synthetic oligonucleotide
  Target: ATXN1; (-) strand; PAM type: YTN; PAM sequence: TTC
tttttttttctgttcctagg

SEQ ID NO: 227855 - DNA, 20 bp, Artificial Sequence
  Description of Artificial Sequence: Synthetic oligonucleotide
  Target: ATXN1; (-) strand; PAM type: YTN; PAM sequence: CTT
ctttttttttctgttcctag

SEQ ID NO: 227856 - DNA, 20 bp, Artificial Sequence
  Description of Artificial Sequence: Synthetic oligonucleotide
  Target: ATXN1; (-) strand; PAM type: YTN; PAM sequence: TTG
aacgtcttctttttttttct

SEQ ID NO: 227857 - DNA, 20 bp, Artificial Sequence
  Description of Artificial Sequence: Synthetic oligonucleotide
  Target: ATXN1; (-) strand; PAM type: YTN; PAM sequence: TTT
gaacgtcttctttttttttc

SEQ ID NO: 227858 - DNA, 20 bp, Artificial Sequence
  Description of Artificial Sequence: Synthetic oligonucleotide
  Target: ATXN1; (-) strand; PAM type: YTN; PAM sequence: CTG
atttgaacgtcttctttttt

SEQ ID NO: 227859 - DNA, 20 bp, Artificial Sequence
  Description of Artificial Sequence: Synthetic oligonucleotide
  Target: ATXN1; (-) strand; PAM type: YTN; PAM sequence: CTA
tatcactgatttgaacgtct

SEQ ID NO: 227860 - DNA, 20 bp, Artificial Sequence
  Description of Artificial Sequence: Synthetic oligonucleotide
  Target: ATXN1; (-) strand; PAM type: YTN; PAM sequence: CTC
tatatcactgatttgaacgt

SEQ ID NO: 227861 - DNA, 20 bp, Artificial Sequence
  Description of Artificial Sequence: Synthetic oligonucleotide
  Target: ATXN1; (-) strand; PAM type: YTN; PAM sequence: TTC
tctatatcactgatttgaac

SEQ ID NO: 227862 - DNA, 20 bp, Artificial Sequence
  Description of Artificial Sequence: Synthetic oligonucleotide
  Target: ATXN1; (-) strand; PAM type: YTN; PAM sequence: TTT
ctctatatcactgatttgaa

SEQ ID NO: 227863 - DNA, 20 bp, Artificial Sequence
  Description of Artificial Sequence: Synthetic oligonucleotide
  Target: ATXN1; (-) strand; PAM type: YTN; PAM sequence: CTT
tctctatatcactgatttga

SEQ ID NO: 227864 - DNA, 20 bp, Artificial Sequence
  Description of Artificial Sequence: Synthetic oligonucleotide
  Target: ATXN1; (-) strand; PAM type: YTN; PAM sequence: TTC
ctttctctatatcactgatt

SEQ ID NO: 227865 - DNA, 20 bp, Artificial Sequence
  Description of Artificial Sequence: Synthetic oligonucleotide
  Target: ATXN1; (-) strand; PAM type: YTN; PAM sequence: TTT
cctttctctatatcactgat

SEQ ID NO: 227866 - DNA, 20 bp, Artificial Sequence
  Description of Artificial Sequence: Synthetic oligonucleotide
  Target: ATXN1; (-) strand; PAM type: YTN; PAM sequence: CTT
tcctttctctatatcactga

SEQ ID NO: 227867 - DNA, 20 bp, Artificial Sequence
  Description of Artificial Sequence: Synthetic oligonucleotide
  Target: ATXN1; (-) strand; PAM type: YTN; PAM sequence: TTG
ctttcctttctctatatcac

SEQ ID NO: 227868 - DNA, 20 bp, Artificial Sequence
  Description of Artificial Sequence: Synthetic oligonucleotide
  Target: ATXN1; (-) strand; PAM type: YTN; PAM sequence: CTT
gctttcctttctctatatca

SEQ ID NO: 227869 - DNA, 20 bp, Artificial Sequence
  Description of Artificial Sequence: Synthetic oligonucleotide
  Target: ATXN1; (-) strand; PAM type: YTN; PAM sequence: CTG
gcttgctttcctttctctat

SEQ ID NO: 227870 - DNA, 20 bp, Artificial Sequence
  Description of Artificial Sequence: Synthetic oligonucleotide
  Target: ATXN1; (-) strand; PAM type: YTN; PAM sequence: TTA
taggcatgagacaccgtgcc

SEQ ID NO: 227871 - DNA, 20 bp, Artificial Sequence
  Description of Artificial Sequence: Synthetic oligonucleotide
  Target: ATXN1; (-) strand; PAM type: YTN; PAM sequence: CTA
ggattataggcatgagacac

SEQ ID NO: 227872 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctaggattatag

SEQ ID NO: 227873 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctaggat

SEQ ID NO: 227874 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctagga

SEQ ID NO: 227875 - DNA, 20 bp, Artificial Sequence
  Description of Artificial Sequence: Synthetic oligonucleotide
  Target: ATXN1; (-) strand; PAM type: YTN; PAM sequence: CTG
ccttggcctcccaaagtgct

SEQ ID NO: 227876 - DNA, 20 bp, Artificial Sequence
  Description of Artificial Sequence: Synthetic oligonucleotide
  Target: ATXN1; (-) strand; PAM type: YTN; PAM sequence: TTC
cacctgccttggcctcccaa

SEQ ID NO: 227877 - DNA, 20 bp, Artificial Sequence
  Description of Artificial Sequence: Synthetic oligonucleotide
  Target: ATXN1; (-) strand; PAM type: YTN; PAM sequence: CTC
aggtgttccacctgccttgg

SEQ ID NO: 227878 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgttccacctgc

SEQ ID NO: 227879 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgttccacc

SEQ ID NO: 227880 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcaggtgtt

SEQ ID NO: 227881 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcaggtgt

SEQ ID NO: 227882 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgacctca

SEQ ID NO: 227883 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtcttgaactc

SEQ ID NO: 227884 - DNA, 20 bp, Artificial Sequence
  Description of Artificial Sequence: Synthetic oligonucleotide
  Target: ATXN1; (-) strand; PAM type: YTN; PAM sequence: TTC
gccacgttggccaggctggt

SEQ ID NO: 227885 - DNA, 20 bp, Artificial Sequence
  Description of Artificial Sequence: Synthetic oligonucleotide
  Target: ATXN1; (-) strand; PAM type: YTN; PAM sequence: TTT
cgccacgttggccaggctgg

SEQ ID NO: 227886 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcgcca

SEQ ID NO: 227887 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcgcc

SEQ ID NO: 227888 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcgc

SEQ ID NO: 227889 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttcg

SEQ ID NO: 227890 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacaggg

SEQ ID NO: 227891 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagg

SEQ ID NO: 227892 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 227893 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 227894 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 227895 - DNA, 20 bp, Artificial Sequence
  Description of Artificial Sequence: Synthetic oligonucleotide
  Target: ATXN1; (-) strand; PAM type: YTN; PAM sequence: TTA
caggcatgcaccaccgtgcc

SEQ ID NO: 227896 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgcaccac

SEQ ID NO: 227897 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 227898 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 227899 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 227900 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccaagta

SEQ ID NO: 227901 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccaag

SEQ ID NO: 227902 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcctgcctcag

SEQ ID NO: 227903 - DNA, 20 bp, Artificial Sequence
  Description of Artificial Sequence: Synthetic oligonucleotide
  Target: ATXN1; (-) strand; PAM type: YTN; PAM sequence: CTG
ggttcaagtgattctcctgc

SEQ ID NO: 227904 - DNA, 20 bp, Artificial Sequence
  Description of Artificial Sequence: Synthetic oligonucleotide
  Target: ATXN1; (-) strand; PAM type: YTN; PAM sequence: TTC
cctgggttcaagtgattctc

SEQ ID NO: 227905 - DNA, 20 bp, Artificial Sequence
  Description of Artificial Sequence: Synthetic oligonucleotide
  Target: ATXN1; (-) strand; PAM type: YTN; PAM sequence: CTG
ttccctgggttcaagtgatt

SEQ ID NO: 227906 - DNA, 20 bp, Artificial Sequence
  Description of Artificial Sequence: Synthetic oligonucleotide
  Target: ATXN1; (-) strand; PAM type: YTN; PAM sequence: CTC
tgttccctgggttcaagtga

SEQ ID NO: 227907 - DNA, 20 bp, Artificial Sequence
  Description of Artificial Sequence: Synthetic oligonucleotide
  Target: ATXN1; (-) strand; PAM type: YTN; PAM sequence: CTG
caaactctgttccctgggtt

SEQ ID NO: 227908 - DNA, 20 bp, Artificial Sequence
  Description of Artificial Sequence: Synthetic oligonucleotide
  Target: ATXN1; (-) strand; PAM type: YTN; PAM sequence: CTC
actgcaaactctgttccctg

SEQ ID NO: 227909 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaaactctgttc

SEQ ID NO: 227910 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaaactctgtt

SEQ ID NO: 227911 - DNA, 20 bp, Artificial Sequence
  Description of Artificial Sequence: Synthetic oligonucleotide
  Target: ATXN1; (-) strand; PAM type: YTN; PAM sequence: TTC
agtggcacaatcttggctca

SEQ ID NO: 227912 - DNA, 20 bp, Artificial Sequence
  Description of Artificial Sequence: Synthetic oligonucleotide
  Target: ATXN1; (-) strand; PAM type: YTN; PAM sequence: CTG
gagttcagtggcacaatctt

SEQ ID NO: 227913 - DNA, 20 bp, Artificial Sequence
  Description of Artificial Sequence: Synthetic oligonucleotide
  Target: ATXN1; (-) strand; PAM type: YTN; PAM sequence: TTC
acccaggctggagttcagtg

SEQ ID NO: 227914 - DNA, 20 bp, Artificial Sequence
  Description of Artificial Sequence: Synthetic oligonucleotide
  Target: ATXN1; (-) strand; PAM type: YTN; PAM sequence: TTT
cacccaggctggagttcagt

SEQ ID NO: 227915 - DNA, 20 bp, Artificial Sequence
  Description of Artificial Sequence: Synthetic oligonucleotide
  Target: ATXN1; (-) strand; PAM type: YTN; PAM sequence: CTT
tcacccaggctggagttcag

SEQ ID NO: 227916 - DNA, 20 bp, Artificial Sequence
  Description of Artificial Sequence: Synthetic oligonucleotide
  Target: ATXN1; (-) strand; PAM type: YTN; PAM sequence: CTC
tttcacccaggctggagttc

SEQ ID NO: 227917 - DNA, 20 bp, Artificial Sequence
  Description of Artificial Sequence: Synthetic oligonucleotide
  Target: ATXN1; (-) strand; PAM type: YTN; PAM sequence: TTC
gctctttcacccaggctgga

SEQ ID NO: 227918 - DNA, 20 bp, Artificial Sequence
  Description of Artificial Sequence: Synthetic oligonucleotide
  Target: ATXN1; (-) strand; PAM type: YTN; PAM sequence: TTT
cgctctttcacccaggctgg

SEQ ID NO: 227919 - DNA, 20 bp, Artificial Sequence
  Description of Artificial Sequence: Synthetic oligonucleotide
  Target: ATXN1; (-) strand; PAM type: YTN; PAM sequence: TTG
agacagagtttcgctctttc

SEQ ID NO: 227920 - DNA, 20 bp, Artificial Sequence
  Description of Artificial Sequence: Synthetic oligonucleotide
  Target: ATXN1; (-) strand; PAM type: YTN; PAM sequence: TTT
gagacagagtttcgctcttt

SEQ ID NO: 227921 - DNA, 20 bp, Artificial Sequence
  Description of Artificial Sequence: Synthetic oligonucleotide
  Target: ATXN1; (-) strand; PAM type: YTN; PAM sequence: TTT
tgagacagagtttcgctctt

SEQ ID NO: 227922 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagtttcgctct

SEQ ID NO: 227923 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagtttcgctc

SEQ ID NO: 227924 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagtttcgct

SEQ ID NO: 227925 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagtttcgc

SEQ ID NO: 227926 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagagtttcg

SEQ ID NO: 227927 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagagtttc

SEQ ID NO: 227928 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagagttt

SEQ ID NO: 227929 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacagagtt

SEQ ID NO: 227930 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacagagt

SEQ ID NO: 227931 - DNA, 20 bp, Artificial Sequence
  Description of Artificial Sequence: Synthetic oligonucleotide
  Target: ATXN1; (-) strand; PAM type: YTN; PAM sequence: CTT
tttttttttttgagacagag

SEQ ID NO: 227932 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttgagacag

SEQ ID NO: 227933 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttttgagaca

SEQ ID NO: 227934 - DNA, 20 bp, Artificial Sequence
  Description of Artificial Sequence: Synthetic oligonucleotide
  Target: ATXN1; (-) strand; PAM type: YTN; PAM sequence: TTT
tctttttttttttttgagac

SEQ ID NO: 227935 - DNA, 20 bp, Artificial Sequence
  Description of Artificial Sequence: Synthetic oligonucleotide
  Target: ATXN1; (-) strand; PAM type: YTN; PAM sequence: CTT
ttctttttttttttttgaga

SEQ ID NO: 227936 - DNA, 20 bp, Artificial Sequence
  Description of Artificial Sequence: Synthetic oligonucleotide
  Target: ATXN1; (-) strand; PAM type: YTN; PAM sequence: TTC
ttttctttttttttttttga

SEQ ID NO: 227937 - DNA, 20 bp, Artificial Sequence
  Description of Artificial Sequence: Synthetic oligonucleotide
  Target: ATXN1; (-) strand; PAM type: YTN; PAM sequence: TTT
cttttctttttttttttttg

SEQ ID NO: 227938 - DNA, 20 bp, Artificial Sequence
  Description of Artificial Sequence: Synthetic oligonucleotide
  Target: ATXN1; (-) strand; PAM type: YTN; PAM sequence: TTT
tcttttcttttttttttttt

SEQ ID NO: 227939 - DNA, 20 bp, Artificial Sequence
  Description of Artificial Sequence: Synthetic oligonucleotide
  Target: ATXN1; (-) strand; PAM type: YTN; PAM sequence: CTT
ttcttttctttttttttttt

SEQ ID NO: 227940 - DNA, 20 bp, Artificial Sequence
  Description of Artificial Sequence: Synthetic oligonucleotide
  Target: ATXN1; (-) strand; PAM type: YTN; PAM sequence: TTC
ttttcttttctttttttttt

SEQ ID NO: 227941 - DNA, 20 bp, Artificial Sequence
  Description of Artificial Sequence: Synthetic oligonucleotide
  Target: ATXN1; (-) strand; PAM type: YTN; PAM sequence: TTT
cttttcttttcttttttttt

SEQ ID NO: 227942 - DNA, 20 bp, Artificial Sequence
  Description of Artificial Sequence: Synthetic oligonucleotide
  Target: ATXN1; (-) strand; PAM type: YTN; PAM sequence: TTT
tcttttcttttctttttttt

SEQ ID NO: 227943 - DNA, 20 bp, Artificial Sequence
  Description of Artificial Sequence: Synthetic oligonucleotide
  Target: ATXN1; (-) strand; PAM type: YTN; PAM sequence: TTT
ttcttttcttttcttttttt

SEQ ID NO: 227944 - DNA, 20 bp, Artificial Sequence
  Description of Artificial Sequence: Synthetic oligonucleotide
  Target: ATXN1; (-) strand; PAM type: YTN; PAM sequence: CTT
tttcttttcttttctttttt
